(12) United States Patent
Rechavi et al.

(10) Patent No.: US 11,260,081 B2
(45) Date of Patent: Mar. 1, 2022

(54) ENGINEERED PARASITES FOR DELIVERING PROTEIN TO THE CENTRAL NERVOUS SYSTEM (CNS)

(71) Applicants: Ramot at Tel-Aviv University Ltd., Tel-Aviv (IL); The University Court of the University of Glasgow, Glasgow (GB)

(72) Inventors: Oded Rechavi, Tel-Aviv (IL); Shahar Bracha, Tel-Aviv (IL); Lilach Sheiner, Glasgow (GB)

(73) Assignees: Ramot at Tel-Aviv University Ltd., Tel-Aviv (IL); The University Court of the University of Glasgow, Glasgow (GB)

( * ) Notice: Subject to any disclaimer, the term of this patent is extended or adjusted under 35 U.S.C. 154(b) by 426 days.

(21) Appl. No.: 16/313,060

(22) PCT Filed: Jun. 29, 2017

(86) PCT No.: PCT/IL2017/050731
§ 371 (c)(1),
(2) Date: Dec. 24, 2018

(87) PCT Pub. No.: WO2018/002938
PCT Pub. Date: Jan. 4, 2018

(65) Prior Publication Data
US 2020/0121731 A1    Apr. 23, 2020

Related U.S. Application Data

(60) Provisional application No. 62/355,898, filed on Jun. 29, 2016.

(51) Int. Cl.
*A01N 63/00* (2020.01)
*A61K 35/68* (2006.01)
*C07K 14/45* (2006.01)
*C12N 9/00* (2006.01)
*C12N 15/65* (2006.01)
*C12N 15/79* (2006.01)

(52) U.S. Cl.
CPC .............. *A61K 35/68* (2013.01); *C07K 14/45* (2013.01); *C12N 9/93* (2013.01); *C12N 15/65* (2013.01); *C12N 15/79* (2013.01); *C07K 2319/10* (2013.01); *C12Y 603/05005* (2013.01)

(58) Field of Classification Search
CPC .................................................. A61K 35/68
See application file for complete search history.

(56) References Cited

U.S. PATENT DOCUMENTS

| 5,693,325 A | * | 12/1997 | Kahn | ................... | C07K 14/005 424/188.1 |
| 8,293,224 B2 | | 10/2012 | Bzik et al. | | |
| 8,673,289 B2 | | 3/2014 | Bzik et al. | | |
| 2012/0045477 A1 | | 2/2012 | Bzik et al. | | |

FOREIGN PATENT DOCUMENTS

| WO | WO 2016/046321 | 3/2016 |
| WO | WO 2018/002938 | 1/2018 |

OTHER PUBLICATIONS

Notice of Reason(s) for Rejection dated Jul. 20, 2021 From the Japan Patent Office Re. Application No. 2018-568203 and Its Translation Into English. (14 Pages).
Sommerville et al. "Biochemical and Immunological Characterization of Toxoplasma Gondii Macrophage Miigration Inhibitory Factor", Journal of Biological Chemistry, 288(18):12733-12741, May 2013.
Wang et al. "Research Advances in Microneme Protein 3 of Toxoplasma Gondii", Parasites & Vectors, 8(Art.384):1-12, Jul. 22, 2015.
International Preliminary Report on Patentability dated Jan. 10, 2019 From the International Bureau of WIPO Re. Application No. PCT/IL2017/050731. (10 Pages).
International Search Report and the Written Opinion dated Aug. 22, 2017 From the International Searching Authority Re. Application No. PCT/IL2017/050731. (15 Pages).
Boothroyd et al. "Kiss and Spit: The Dual Roles of Toxoplasma Rhoptries", Nature Reviews Microbiology, 6(1): 79-88, Published Online Dec. 3, 2007.
Carruthers et al. "Effects of Toxoplasma Gondii Infection on the Brain", Schizophrenia Bulletin, 33(3): 745-751, Advance Access Publication Feb. 23, 2007.
Dlugonska "Toxoplasma Rhoptries: Unique Secretory Organelles and Source of Promising Vaccine Proteins for Immunoprevention of Toxoplasmosis", Journal of Biomedicine and Biotechnology, 12008(Art. ID 632424): 1-7, Jul. 22, 2008.
Feustel et al. "Toxoplasma Gondii and the Blood-Brain Barrier", Virulence, 3(2): 182-192, Mar. 1, 2012.
Kim et al. "Toxoplasma Gondii: The Model Apicomplexan", International Journal of Parasitology, 34(3): 423-432, Mar. 9, 2004. Chaps.11, 15.
Koshy et al. "Toxoplasma Secreting Cre Recombinase for Analysis of Host-Parasite Interactions", Nature Methods, 7(4): 307-309, Apr. 2010. Electronic Version, p. 2. 2nd & 3rd Para. Fig.1a.

(Continued)

*Primary Examiner* — Albert M Navarro
*Assistant Examiner* — Mark Navarro

(57) ABSTRACT

Provided are nucleic acid constructs, Toxoplasma comprising same, pharmaceutical compositions comprising same and methods using same for delivering a protein-of-interest to a tissue-of-interest of a subject, such as the CNS and further treating a pathology which is treatable by administration of a therapeutic polypeptide in a central nervous system of the subject.

18 Claims, 16 Drawing Sheets
(13 of 16 Drawing Sheet(s) Filed in Color)
Specification includes a Sequence Listing.

(56) References Cited

OTHER PUBLICATIONS

Sibley "Invasion and Intracellular Survival by Protozoan Parasites", Immunological Reviews, 240(1): 72-91, Mar. 2011. Electronic Version, p. 3, 2nd Para, p. 9, 2nd Para, Ref.112.
Stanislaus et al. "Genetically Engineered Self-Destruction: An Alternative to Herbicides for Cover Crop Systems", Weed Science, 50(6): 794-801, Nov.-Dec. 2002. Abstract, p. 795, Left col. Last Para—Right col. First Para, p. 797, Right col. 2nd Para, Figs.1. 2.
Van Diggelen "Laboratory Protocol for Enzyme Analysis for Krabbe Disease: Galactocerebrodiase: HMU-BetaGal". Protocol KRB, Moscerdam Substrates, p. 1-3. Dec. 2009.
Supplementary Partial European Search Report and the European Provisional Opinion dated Dec. 17, 2019 From the European Patent Office Re. Application No. 17819507.9. (13 Pages).
Bracha et al. "Engineering Brain Parasites for Intracellular Delivery of Therapeutic Proteins", BioRxiv, XP055649990, 481192-1-481192-45, Jan. 2018.
Gissot et al. "Epigenomic Modifications Predict Active Promoters and Gene Structure in Toxoplasma Gondii", PLoS One Pathogens, XP055650151, 396): e77-0709-e77-0719, Published Online Jun. 8, 2007.
Zou et al. "Evaluation of Toxoplasma Gondii as A Live Vaccine Vector in Susceptible and Resistant Hosts", Parasites & Vectors, XP021109662, 4(1): 168-1-168-10, Aug. 28, 2011.
Supplementary European Search Report and the European Search Opinion dated Mar. 23, 2020 From the European Patent Office Re. Application No. 17819507.9. (12 Pages).

\* cited by examiner

GRA16 5'UTR | GRA16 | HA | Therapeutic Polypeptide | GRA2 3'UTR

GRA16-fusion T. gondii expression vector
10,261 bp

Fig. 3

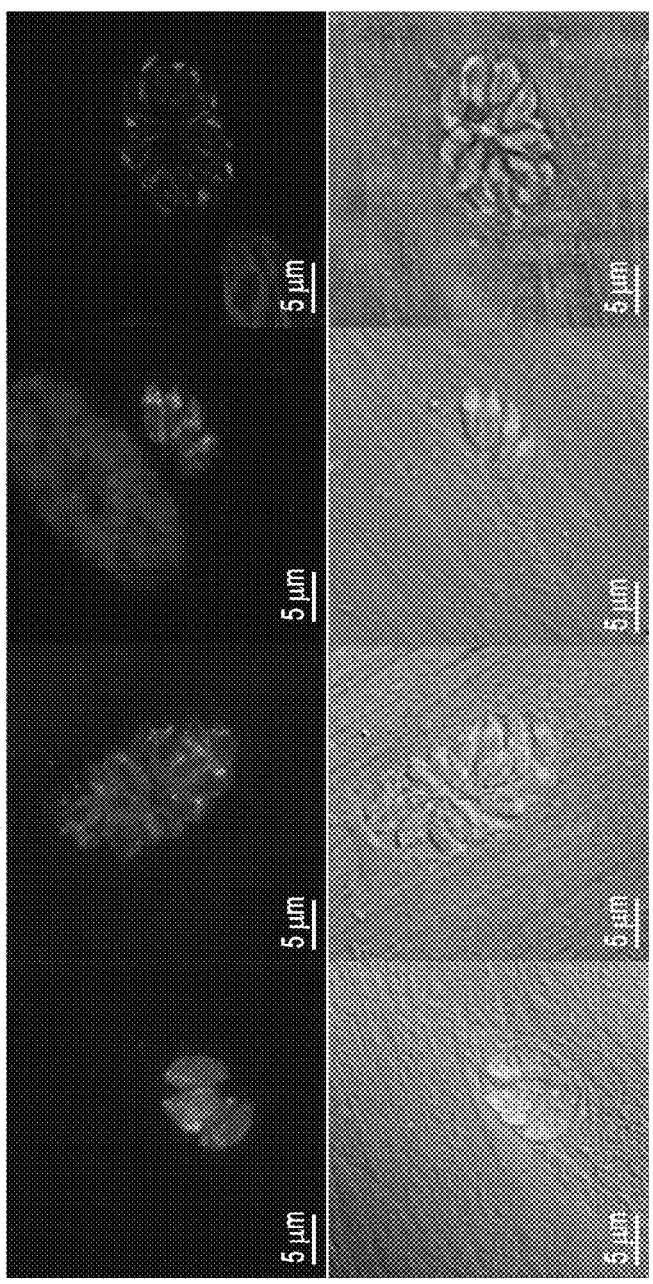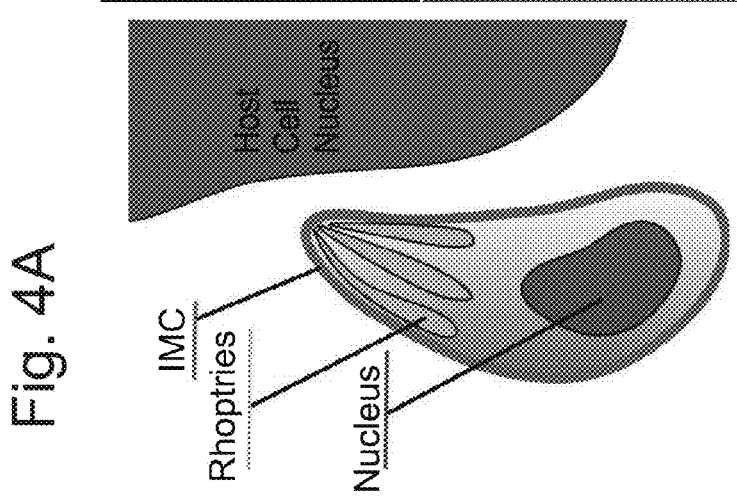

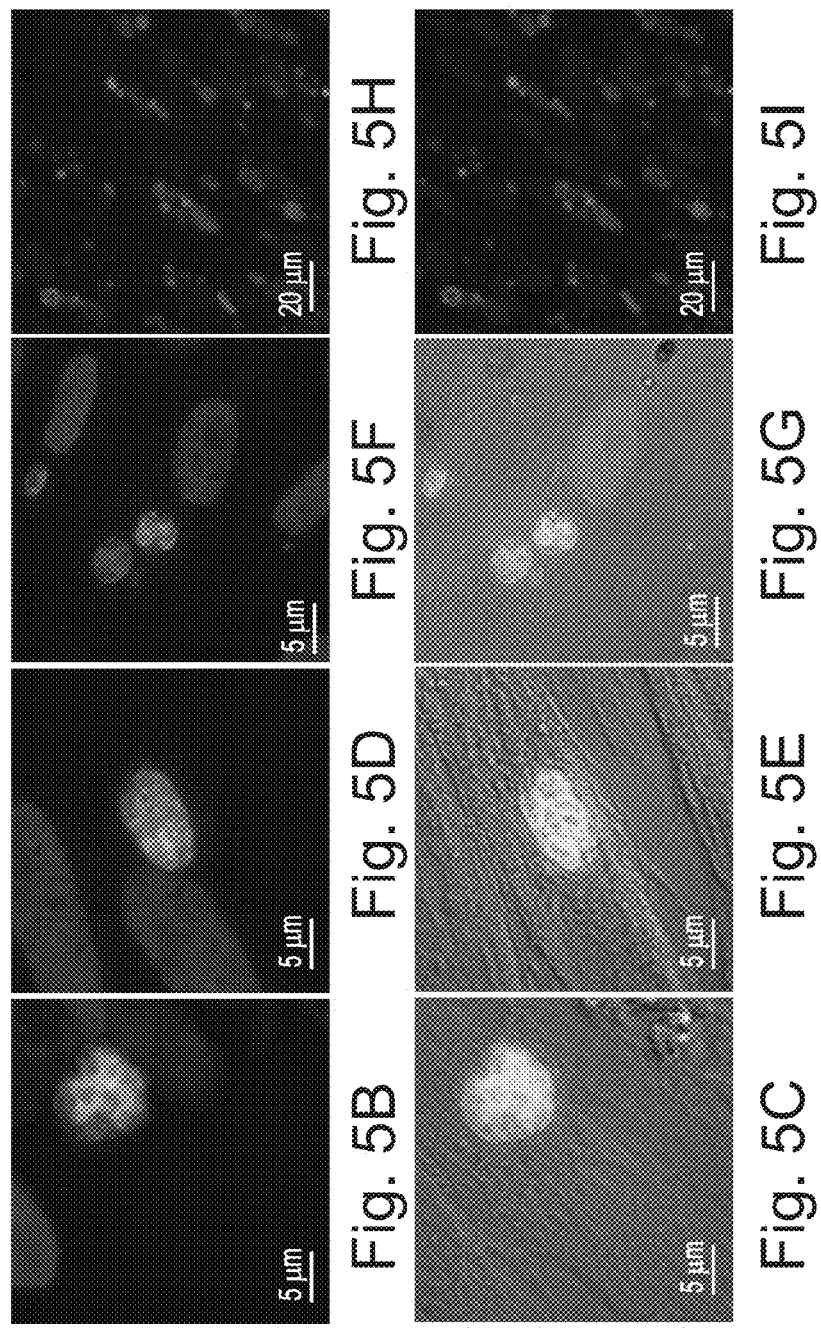

Toxofilin 5'UTR | Toxofilin | HA | Therapeutic Polypeptide | GRA2 3'UTR

Toxofilin fusion protein vector
8126 bp

HXGPRT
DHFR
mCherry

Fig. 7

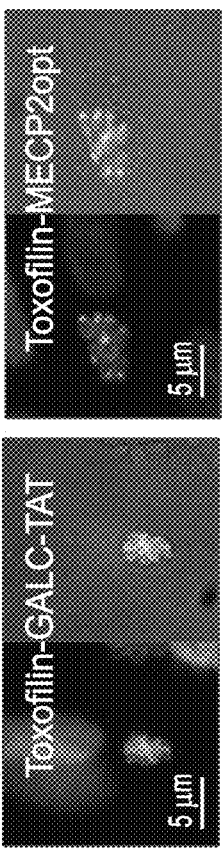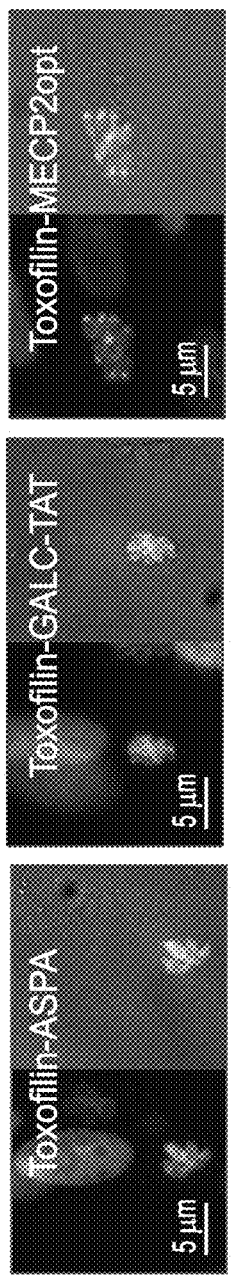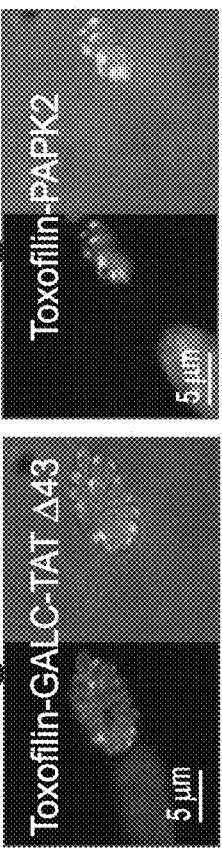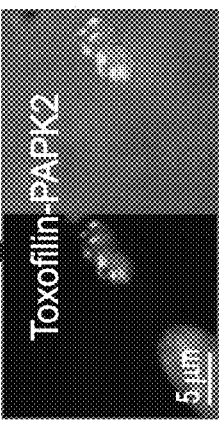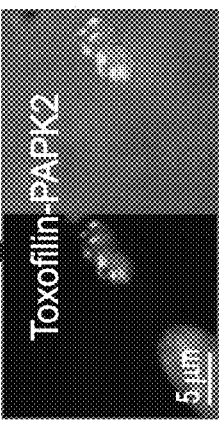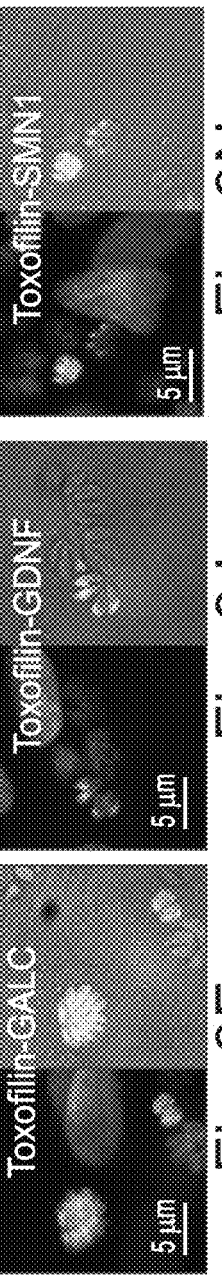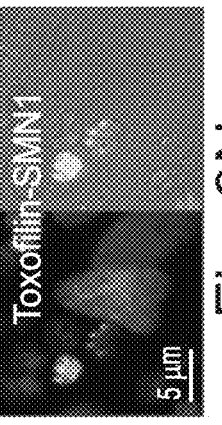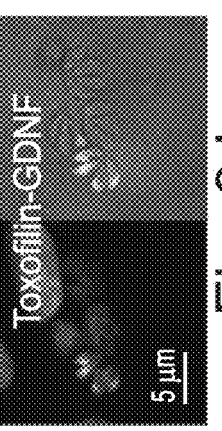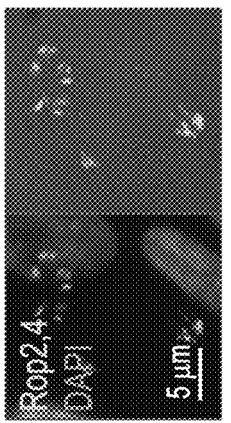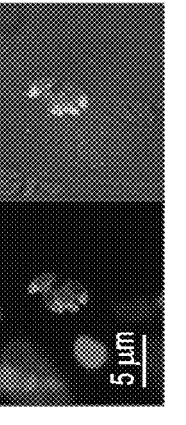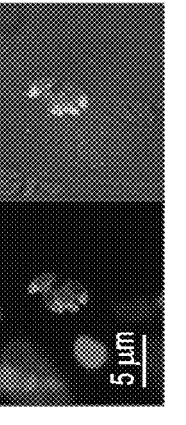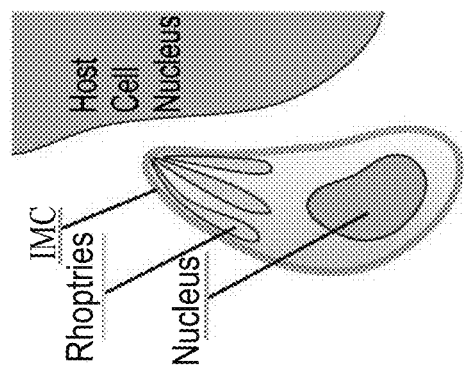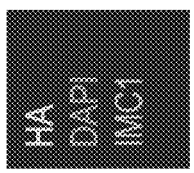

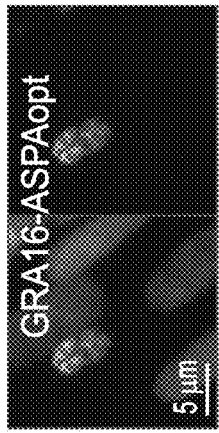
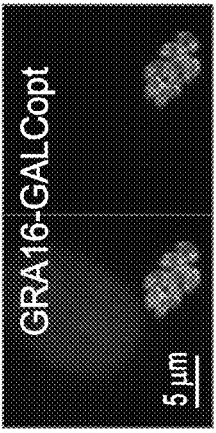
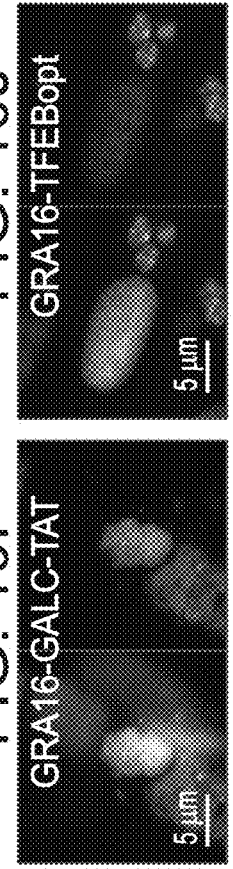
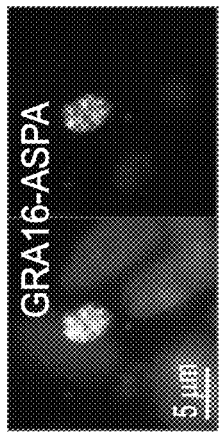
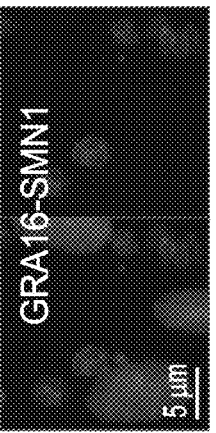
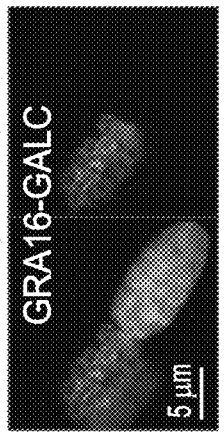
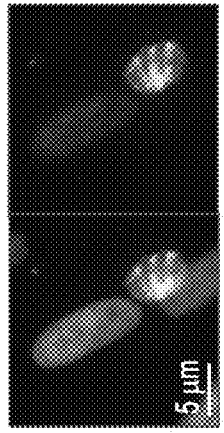
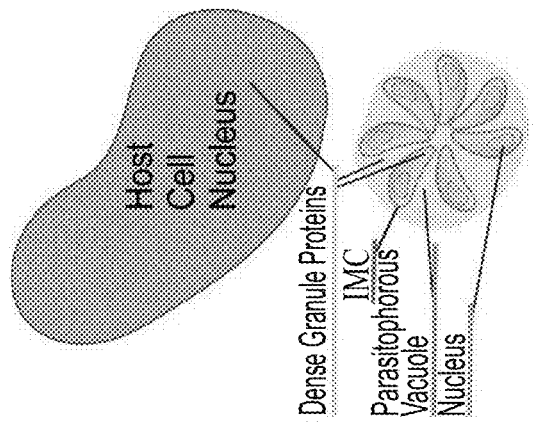

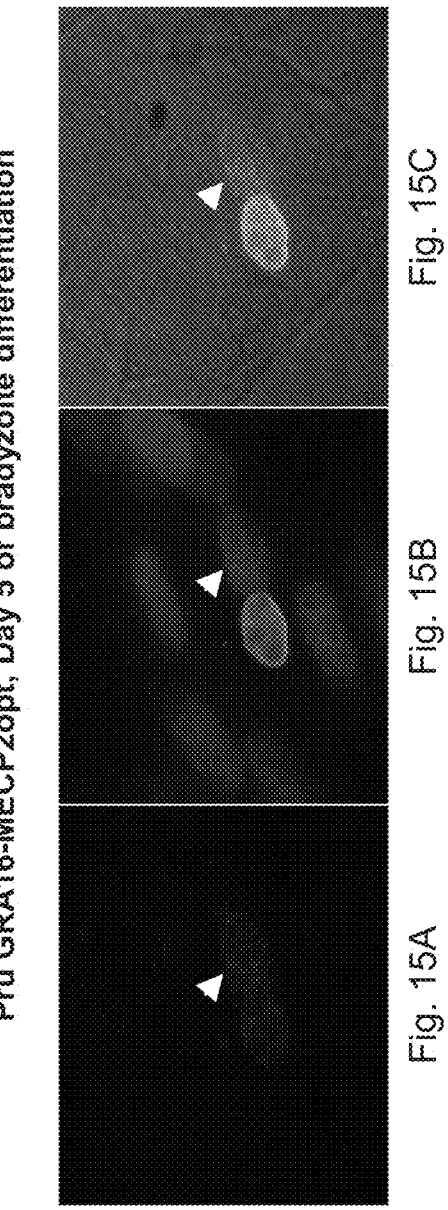

ENGINEERED PARASITES FOR DELIVERING PROTEIN TO THE CENTRAL NERVOUS SYSTEM (CNS)

RELATED APPLICATIONS

This application is a National Phase of PCT Patent Application No. PCT/IL2017/050731 having International filing date of Jun. 29, 2017, which claims the benefit of priority under 35 USC § 119(e) of U.S. Provisional Patent Application No. 62/355,898 filed on Jun. 29, 2016. The contents of the above applications are all incorporated by reference as if fully set forth herein in their entirety.

SEQUENCE LISTING STATEMENT

The ASCII file, entitled 74636SequenceListing.txt, created on Dec. 24, 2018, comprising 17,070,469 bytes, submitted concurrently with the filing of this application is incorporated herein by reference. The sequence listing submitted herewith is identical to the sequence listing forming part of the international application.

FIELD AND BACKGROUND OF THE INVENTION

The present invention, in some embodiments thereof, relates to a nucleic acid construct for the secretion of a pharmaceutical polypeptide fused to a *Toxoplasma gondii* secreted polypeptide, and Toxoplasma comprising same, and, more particularly, but not exclusively, to a pharmaceutical compositions and methods of using same for treating a subject.

The lack of robust methods for the delivery of protein therapeutics is to a great degree the current bottleneck in their translation into clinical treatment. Proteins often serve a highly specific and complex set of functions that cannot be mimicked by simple chemical compounds (Nat Rev Drug Discov. 2008; 7(1):21-39. Protein therapeutics: a summary and pharmacological classification. Leader B, Baca Q J, and Golan D E); however, owing to their macromolecular nature, the delivery of therapeutic protein to target sites in the body is extremely challenging. Low functional stability and rapid loss of activity following administration or during storage, along with low permeability through biological barriers, limit the delivery of active proteins. The ongoing development of chemical modifications, conjugates and carrier systems aided the delivery of some therapeutic proteins, but these are mostly still limited to targets within the "accessible target space"—in the vascular compartment or on the surface of cells (Mitragotri 2014, Nat. Rev. Drug. Discov. 13(9):655-72). Efficient delivery is particularly challenging in the field of neurological diseases due to the blood-brain barrier (BBB), which tightly regulates the transport of molecules to the brain, while further complexity is added when the target is intracellular.

In order to deliver supplementary proteins to cells within the CNS, it is necessary to develop mechanisms that penetrate the BBB and may target specific cells within the CNS.

Currently, the major approaches for treating conditions caused by a deficiency of a specific protein are gene therapy, stem cell therapy and enzyme replacement therapy.

Gene therapy is the insertion of a functional copy of a gene that encodes a therapeutic protein (Cox, D. B. T., et al., 2015) which aims to increase the expression of a functional copy of the protein. While gene therapy provides the correct sequence of the gene, it does not address loss of protein function that is caused by or accompanied by defects in translational mechanisms or post-translational modifications. In addition, it can bear the risk of cancer development due to insertional mutagenesis (Persons, D. A. & Baum, C. 2011), mobilization, germline transmission, immunogenicity and limited transgene capacity (Schambach, A., et al., 2013; Al-Dosari et al., 2009). To target the CNS, gene therapy is most commonly mediated by the use of viral vectors, including those derived from herpes simplex virus type 1 (HSV-1), adenovirus, AAV, lentiviruses such as HIV-1, feline immunodeficiency virus or equine infectious anemia virus, and more recently SV40-AAV and lentivirus which are currently the most common of those. While some viral vectors are safer than the others, they do not address protein processing defects, and clinical efficiency remains limited.

Stem cell therapy relies on the protein synthesis mechanisms of implanted cells which can supplement the defective endogenous synthesis of the protein. Despite numerous efforts to implement this approach clinically, the efficiency of such treatments is reduced by rejection of implanted cells, and the low cost-efficiency of using patient-specific stem cells. In addition, the risks involved in stem cell treatments include complications associated with immunosuppression required to reduce rejection of grafted cells, and the development of cancer (Dimmeler, S., et al., 2014).

Protein- or Enzyme replacement therapy (ERT), in which the supplementary protein is synthesized externally and then delivered into the CNS, must overcome the impermeability of the BBB, and develop precise targeting in order to be clinically relevant. One such approach to protein delivery is injection directly into the brain or into adjacent organs from which the protein may diffuse at a low efficiency. Thus, in addition to the risk of such approaches, the ability to target specific regions within the CNS with the necessary amount is limited. Another problem of such approaches is the requirement of repeated dosing, which is often clinically impractical (Abbott, N.J. 2013).

ERT can be combined with an increase in BBB permeability to allow the therapeutic protein to diffuse into the CNS with greater efficiency (Malhotra, M. & Prakash, S. 2011). This is achieved through the shrinking of the cells that compose the BBB, or manipulation of the transport mechanisms through the BBB. However, this approach is not efficient due to opsonization, and bears the risk of unwanted substances diffusing into the CNS along with the supplemented protein of interest (Bradbury, M. W. B. 2012).

An alternative approach is the attachment of the therapeutic protein to elements that enter the CNS to utilize their inherent ability to cross the BBB. Agents that may mediate trafficking across the BBB include fusion proteins, dendrimers, solid lipid nanoparticles, liposomes and nanoparticles (Solaro, R., 2010). However, these approaches require further development and have not reached clinical trials.

*Toxoplasma gondii* is a single-cell intracellular protozoan parasite of the phylum apicomplexa. Its primary hosts are felines, and only in them it can go through the sexual stages of its life cycle. However, as secondary hosts it can infect many warm-blooded organisms, including humans. In humans as in rodents, after the host contracts the parasite (typically after ingestion of infectious tissue cysts or oocysts), the parasite differentiates into the fast-replicating tachyzoite stage. *Toxoplasma gondii* tachyzoites invade nucleated host cells by active penetration and establish a vacuole within which they replicate by endodyogeny. The tachyzoites travel through the intestinal epithelium, and by both "hitch-hiking" on immune cells and by mobilizing itself autonomously, they reach distal tissues, breach the blood brain barrier and spread in the brain [Harker 2015, Parasite Immunol. 37(3):141-9]. Thus, the tachyzoites enter the circulation and disseminate to secondary tissues. Replication is critical for dissemination and for reaching distal tissues during the acute stage of infection. Once inside the unique environment of the brain, *T. gondii* penetrates cells in the brain (primarily neurons, but also glial cells in lower proportions) and following immune pressure, it differentiates to the latent bradyzoite stage, and resides in cytoplasmic intercellular cysts. This characterizes a chronic infection (Cabral et al. 2016, PLoS Pathog. 12(2):e1005447). Tissue cysts harbouring bradyzoites persist for the lifetime of the host, while multiplying very slowly and having a quiescent metabolic program (Parasite Immunol. 2015, 37(3):141-9. "*Toxoplasma gondii* dissemination: a parasite's journey through the infected host").

Although *T. gondii* infects an estimated one third of the world population, infection remains asymptomatic in healthy humans (Montoya, J. G. & Liesenfeld, O. 2004) and is primarily a risk only for individuals with irregularly compromised immune systems. Most importantly, during infection *T. gondii* secretes proteins into the host's cells, both during cell invasion and while intracellular. *T. gondii* has three types of electrodense secretory organelles: micronemes, rhoptries, and dense granules. Host cell invasion is mediated by the sequential secretion of the contents of all three organelles, which are exocytosed from the apical region when the parasite invades the host cell and when it resides inside it (Dlugonska, H. 2008). Micronemes are involved in the attachment and penetration of *T. gondii*, while rhoptries are required for creating a transient structure, moving junction and then the establishment of the PV. Rhoptry proteins are secreted upon initial contact with the host in a process termed "kiss and spit" (Boothroyd, J. C. et al., 2008). Dense granules secrete proteins throughout most of the parasite stages. The secretion process coincides with the formation of intravacuolar network and continues during the intracellular residence of *T. gondii* (Dlugonska, H. 2008; Carruthers, V. B. & Sibley, L. D. 1997).

Additional background art includes Koshy, A. A. et al. 2010; U.S. Pat. No. 8,673,289; US20120045477 A1; Lodoen M. B., et al. 2010. Cellular Microbiology, 12: 55-66.

SUMMARY OF THE INVENTION

According to an aspect of some embodiments of the present invention there is provided a nucleic acid construct comprising a heterologous polynucleotide comprising a first nucleic acid sequence encoding a Toxoplasma secreted protein in frame fused upstream to a second nucleic acid sequence encoding a pharmaceutical polypeptide, wherein the heterologous polynucleotide is operably linked to a promoter for directing transcription of the heterologous polynucleotide in a Toxoplasma, wherein the promoter is selected from the group consisting of: a constitutive promoter, an inducible promoter, a latent period-specific promoter, and a Toxoplasma endogenous promoter with the proviso that the promoter is not a Toxofilin promoter.

According to an aspect of some embodiments of the present invention there is provided a nucleic acid construct system comprising at least two nucleic acid constructs, wherein a first nucleic acid construct of the at least two nucleic acid constructs is the nucleic acid construct of some embodiments of the invention, and a second nucleic construct of the at least two nucleic acid constructs comprises a polynucleotide encoding a selectable marker.

According to an aspect of some embodiments of the present invention there is provided a Toxoplasma transformed with the nucleic acid construct of some embodiments of the invention or with the nucleic acid construct system of some embodiments of the invention.

According to an aspect of some embodiments of the present invention there is provided a pharmaceutical composition comprising the Toxoplasma of some embodiments of the invention, and a pharmaceutically acceptable carrier.

According to an aspect of some embodiments of the present invention there is provided a method of administering a protein-of-interest into a central nervous system of a subject, the method comprising: administering to the subject the Toxoplasma of some embodiments of the invention or the pharmaceutical composition of some embodiments of the invention, thereby administering the protein-of-interest to the central nervous system of the subject.

According to an aspect of some embodiments of the present invention there is provided a method of treating a subject in need thereof, comprising administering to the subject the Toxoplasma of some embodiments of the invention or the pharmaceutical composition of some embodiments of the invention, wherein the subject is diagnosed with a pathology treatable by administration of the pharmaceutical polypeptide in a central nervous system of the subject, thereby treating the subject in need thereof.

According to an aspect of some embodiments of the present invention there is provided a method of treating a subject in need thereof, comprising administering to the subject a Toxoplasma comprising a nucleic acid construct which comprises a heterologous polynucleotide comprising a first nucleic acid sequence encoding a Toxoplasma secreted protein in frame fused upstream to a second nucleic acid sequence encoding a pharmaceutical polypeptide, wherein the heterologous polynucleotide is operably linked to a promoter for directing transcription of the heterologous polynucleotide in a Toxoplasma, wherein the subject is diagnosed with a pathology treatable by administration of the pharmaceutical polypeptide in a central nervous system of the subject, thereby treating the subject in need thereof.

According to some embodiments of the invention, the promoter is selected from the group consisting of: a constitutive promoter, an inducible promoter, a latent period-specific promoter, and a Toxoplasma endogenous promoter with the proviso that the promoter is not a Toxofilin promoter.

According to some embodiments of the invention, the endogenous promoter is not of a rhoptry protein.

According to some embodiments of the invention, the Toxoplasma being not attenuated.

According to some embodiments of the invention, the Toxoplasma secreted protein is secreted from a rhoptry of the Toxoplasma.

According to some embodiments of the invention, the Toxoplasma secreted protein which is secreted from the rhoptry comprises Toxofilin and/or ROP1.

According to some embodiments of the invention, the Toxoplasma secreted protein which is secreted from the rhoptry comprises the amino acid sequence selected from the group consisting of SEQ ID NOs:344-465.

According to some embodiments of the invention, the Toxoplasma secreted protein is a non-rhoptry protein.

According to some embodiments of the invention, the Toxoplasma secreted protein is selected from the group consisting of a microneme protein and a dense granule protein.

According to some embodiments of the invention, the Toxoplasma secreted protein is secreted from a dense granule of the Toxoplasma.

According to some embodiments of the invention, the Toxoplasma secreted protein which is secreted from the dense granule comprises a GRA16, and/or GRA24.

According to some embodiments of the invention, the Toxoplasma secreted protein is secreted from a microneme of the Toxoplasma.

According to some embodiments of the invention, the protein secreted from the microneme comprises the amino acid sequence selected from the group consisting of SEQ ID NOs:280-322.

According to some embodiments of the invention, the protein secreted from the dense granule comprises the amino acid sequence selected from the group consisting of SEQ ID NOs:234-279.

According to some embodiments of the invention, the Toxoplasma secreted protein comprises *Toxoplasma gondii* macrophage migration inhibitory factor (TgMIF).

According to some embodiments of the invention, the heterologous polynucleotide further comprises a Toxoplasma untranslated region (UTR) nucleic acid sequence upstream and/or downstream of the Toxoplasma secreted protein open reading frame.

According to some embodiments of the invention, the Toxoplasma 5'-untranslated region (5'-UTR) is placed upstream of the Toxoplasma secreted protein open reading frame.

According to some embodiments of the invention, the Toxoplasma 3'-untranslated region (3'-UTR) is placed downstream of the Toxoplasma secreted protein open reading frame.

According to some embodiments of the invention, the Toxoplasma 3' untranslated region (3'-UTR) nucleic acid sequence is the GRA2 3'-UTR, GRA16 3'-UTR, GRA24 3'-UTR, SAG1 3'-UTR, or the DHFR 3'-UTR.

According to some embodiments of the invention, the Toxoplasma 5' untranslated region (5'-UTR) nucleic acid sequence is the GRA2 5'-UTR, GRA16 5'-UTR, GRA24 5'-UTR, SAG1 5'-UTR, or the DHFR 5'-UTR.

According to some embodiments of the invention, the Toxoplasma endogenous promoter is the GRA2 promoter, GRA16 promoter, GRA24 promoter, SAG1 promoter, or the DHFR promoter.

According to some embodiments of the invention, the Toxoplasma untranslated region (UTR) nucleic acid sequence is the Toxofilin 3'-UTR.

According to some embodiments of the invention, the nucleic acid construct further comprises a third nucleic acid sequence encoding an inducible self-destruction element.

According to some embodiments of the invention, the third nucleic acid sequence encoding the inducible self-destruction element is comprised in the same nucleic acid construct which comprises the heterologous polynucleotide comprising the first nucleic acid sequence encoding the Toxoplasma secreted protein in frame fused upstream to the second nucleic acid sequence encoding the pharmaceutical polypeptide.

According to some embodiments of the invention, the third nucleic acid sequence encoding the inducible self-destruction element is comprised in a separate nucleic acid construct with respect to the nucleic acid construct which comprises the heterologous polynucleotide comprising the first nucleic acid sequence encoding the Toxoplasma secreted protein in frame fused upstream to the second nucleic acid sequence encoding the pharmaceutical polypeptide.

According to some embodiments of the invention, the nucleic acid construct does not comprise a Cre-recombinase coding sequence.

According to some embodiments of the invention, the nucleic acid construct does not comprise a beta (β)-lactamase (BLA) coding sequence.

According to some embodiments of the invention, the nucleic acid construct is suitable for integration into a genome of Toxoplasma.

According to some embodiments of the invention, the inducible self-destruction element is active in response to a drug.

According to some embodiments of the invention, the drug comprises an antibiotic.

According to some embodiments of the invention, the nucleic acid construct further comprises at least one in frame cleavage site which allows detachment of the pharmaceutical polypeptide from the Toxoplasma secreted protein.

According to some embodiments of the invention, the Toxoplasma is devoid of elements which facilitate propagation of the Toxoplasma in a host cell.

According to some embodiments of the invention, the Toxoplasma is devoid of virulence genes which are not necessary for delivery of the protein-of-interest into a CNS of a subject.

According to some embodiments of the invention, the heterologous polynucleotide further comprises a nucleic acid sequence encoding a selectable marker.

According to some embodiments of the invention, the selectable marker comprises chloramphenicol acetyltransferase (CAT), DHFR-TS, BLE, HXGPRT, UPRT, TK, CD, a fluorescent protein (such as GFP, YFP, RFP, mCherry or other) or an epitope tag (such as HA, Myc, Ty-1, FLAG or other).

According to some embodiments of the invention, the pharmaceutical composition is for treating a subject diagnosed with a pathology characterized by a deficient endogenous protein in a central nervous system of a subject.

According to some embodiments of the invention, the pharmaceutical composition is for treating a subject diagnosed with a pathology which is treatable by administration of the pharmaceutical polypeptide in a central nervous system of a subject.

According to some embodiments of the invention, the pharmaceutical composition further comprises an immunosuppression agent.

According to some embodiments of the invention, the method further comprises administering to the subject an immunosuppression drug prior to administration of the Toxoplasma and/or subsequent to administration of the Toxoplasma and/or concomitantly with administration of the Toxoplasma to the subject.

According to some embodiments of the invention, the method further comprises administering to the subject an immunosuppression drug prior to administration of the Toxoplasma to the subject.

According to some embodiments of the invention, the method further comprises administering to the subject an immunosuppression drug subsequent to administration of the Toxoplasma to the subject.

According to some embodiments of the invention, the method further comprises administering to the subject an immunosuppression drug concomitantly with administration of the Toxoplasma to the subject.

According to some embodiments of the invention, the pharmaceutical polypeptide comprises a wild type amino acid sequence corresponding to the endogenous protein capable of treating the pathology.

According to some embodiments of the invention, the pharmaceutical polypeptide comprises an antibody capable of treating the pathology.

According to some embodiments of the invention, the pharmaceutical polypeptide comprises an antigen capable of treating the pathology.

According to some embodiments of the invention, the pharmaceutical polypeptide comprises a toxin capable of treating the pathology.

According to some embodiments of the invention, the pharmaceutical polypeptide comprises an enzyme, a structural polypeptide, a motility polypeptide, a regulatory polypeptide, a storage polypeptide, a signaling/ligand polypeptide, a receptor polypeptide, a sensory polypeptide, an antibody, a protein channel and/or a transport polypeptide.

According to some embodiments of the invention, administering is performed by peripheral administration.

According to some embodiments of the invention, the peripheral administration comprises intravenous administration.

According to some embodiments of the invention, the peripheral administration comprises oral administration.

According to some embodiments of the invention, administering is performed by direct administration to the central nervous system.

According to some embodiments of the invention, the deficient endogenous protein comprises a deletion, insertion, and/or substitution of at least one amino acid of the endogenous protein as compared to a wild type amino acid sequence of the endogenous protein.

According to some embodiments of the invention, the deficient endogenous protein comprises a reduced level of the endogenous protein as compared to a level of the endogenous protein in a healthy subject devoid of the pathology.

According to some embodiments of the invention, the deficient endogenous protein is absence of the endogenous protein in the subject diagnosed with the pathology.

According to some embodiments of the invention, the pharmaceutical polypeptide is Galactocerebrosidase (GALC).

According to some embodiments of the invention, the pharmaceutical polypeptide is Galactocerebrosidase (GALC) isoform 1, isoform 2, isoform 3, isoform 4 or isoform 5.

According to some embodiments of the invention, the pharmaceutical polypeptide is Methyl-CpG Binding Protein 2 (MECP2) isoform 1 or MECP2 isoform 2.

According to some embodiments of the invention, the pharmaceutical polypeptide is Glial Cell Derived Neurotrophic Factor (GDNF).

According to some embodiments of the invention, the pharmaceutical polypeptide is Glial Cell Derived Neurotrophic Factor (GDNF) isoform 1, isoform 2, isoform 3, isoform 4 or isoform 5.

According to some embodiments of the invention, the pharmaceutical polypeptide is Aspartoacylase (ASPA).

According to some embodiments of the invention, the pharmaceutical polypeptide is Survival Motor Neuron Protein (SMN1).

According to some embodiments of the invention, the pharmaceutical polypeptide is Survival Motor Neuron Protein isoform SMN, isoform SMN-delta5, isoform SMN-delta7, or isoform SMN-delta57.

According to some embodiments of the invention, the pharmaceutical polypeptide is Parkin (PARK2).

According to some embodiments of the invention, the pharmaceutical polypeptide is Parkin (PARK2) isoform 1, isoform 2, isoform 3, isoform 4, isoform 5, isoform 6, isoform 7, or isoform 8.

According to some embodiments of the invention, the pharmaceutical polypeptide is Transcription Factor E B (TFEB).

According to some embodiments of the invention, the pharmaceutical polypeptide is Transcription Factor E B (TFEB) isoform 1 or isoform 2.

According to some embodiments of the invention, the pharmaceutical polypeptide is a TALEN (TALE nuclease).

According to some embodiments of the invention, the pharmaceutical polypeptide is a TALE TF (TALE transcription factor).

According to some embodiments of the invention, the subject is diagnosed with Krabbe disease.

According to some embodiments of the invention, the subject is diagnosed with Rett syndrome.

According to some embodiments of the invention, the subject is diagnosed with Canavan disease.

According to some embodiments of the invention, the subject is diagnosed with Spinal Muscular Atrophy.

According to some embodiments of the invention, the subject is diagnosed with Parkinson's disease.

According to some embodiments of the invention, the subject is diagnosed with hypoxic/ischemic or neuroinflammatory CNS disorder.

According to some embodiments of the invention, the subject is diagnosed with Alzheimer's disease.

According to some embodiments of the invention, the subject is diagnosed with Amyotrophic Lateral Sclerosis.

According to some embodiments of the invention, the subject is diagnosed with Huntington's disease.

According to some embodiments of the invention, the subject is diagnosed with a lysosomal storage disease.

According to some embodiments of the invention, the subject is diagnosed with MECP2-duplication syndrome.

According to some embodiments of the invention, the method further comprising administering to the subject a drug capable of inducing the self-destruction element.

According to some embodiments of the invention, the method further comprising administering to the subject a molecule necessary for sustaining the Toxoplasma inside the host cell and/or body.

According to some embodiments of the invention, the molecule necessary for sustaining the Toxoplasma is an antibiotic.

According to some embodiments of the invention, the molecule necessary for sustaining the Toxoplasma is a small-molecule.

According to some embodiments of the invention, the molecule necessary for sustaining the Toxoplasma is a metabolite.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1:
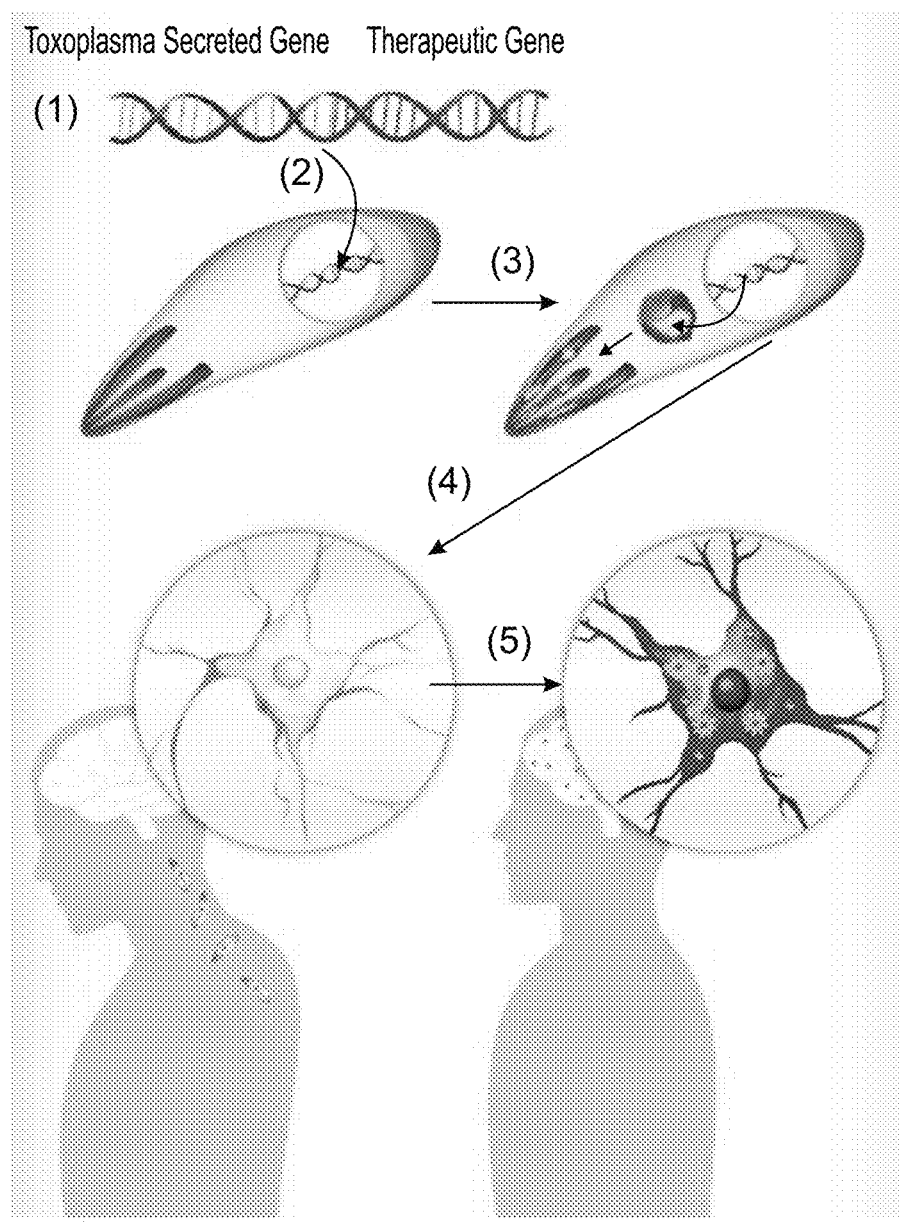

FIG. 1 is a schematic representation of the clinical concept of some embodiments of the invention. (1) The pharmaceutical polypeptide coding sequence of choice is fused to a Toxoplasma gondii secretable polypeptide coding sequence; (2) The nucleic acid construct is introduced into the Toxoplasma; (3) The fusion protein is expressed inside the parasite and localizes to the parasite's secretory organelle (here shown as an example, the rhoptries); (4) The parasite enters the CNS of the subject and reaches the site of pathology; (5) The protein is secreted into the subject's cells and rescues the pathological phenotype.

Figure 2:
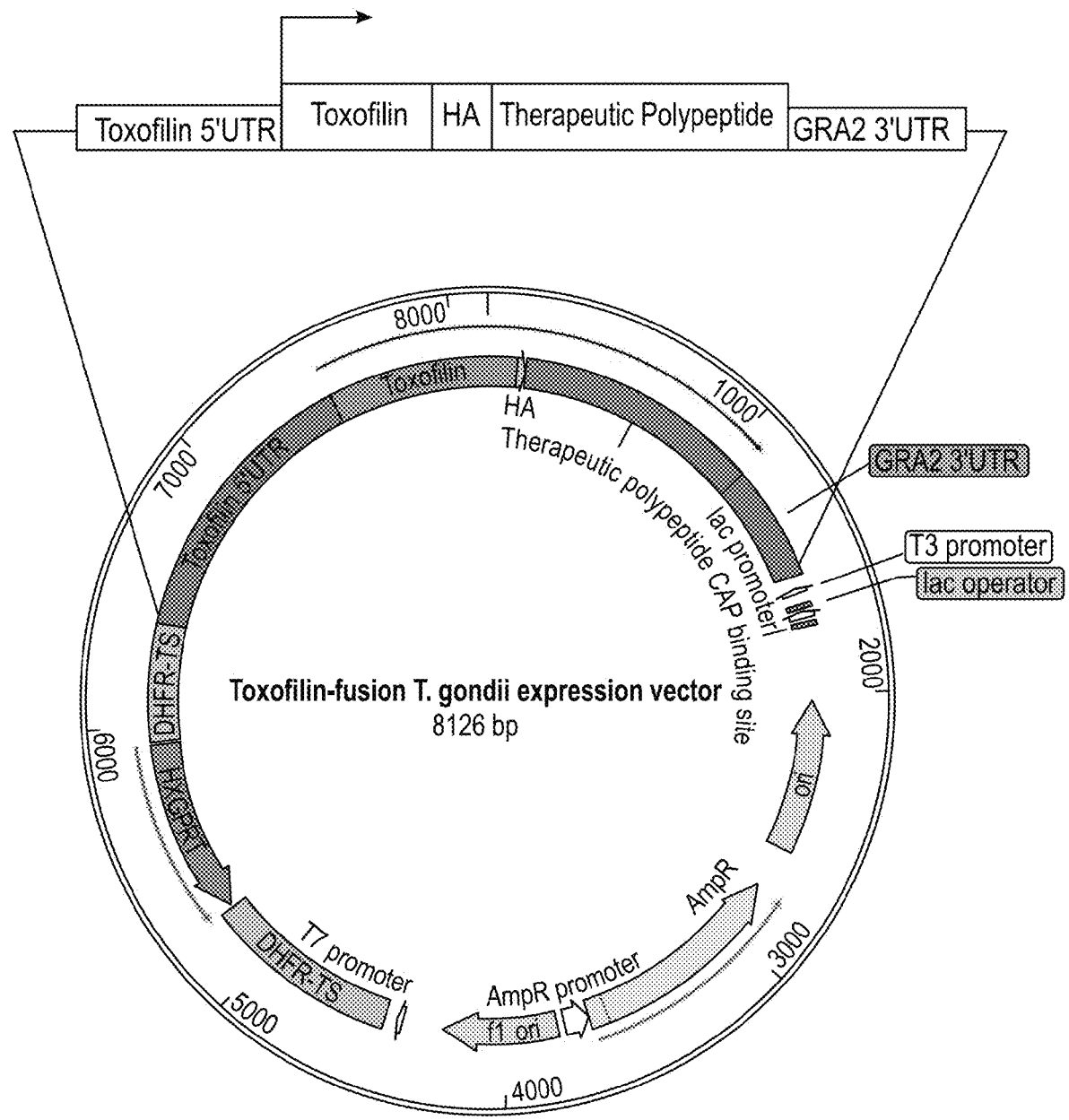

FIG. 2 depicts a schematic map of the construct used for the generation of therapeutic transgenic T. gondii lines based on the pGRA backbone. The nucleic acid construct comprises an open reading frame (ORF) consisting of a fusion of a therapeutic polypeptide coding sequence in frame with the T. gondii Toxofilin coding sequence and an "HA" tag. Upstream of the ORF is the endogenous 5' UTR (untranslated region) of the Toxofilin gene (Toxofilin 5'-UTR which acts as a promoter), and downstream of the ORF is the 3' UTR of the abundant dense granule protein GRA2 (GRA2 3'-UTR). The construct also contains a selectable marker cassette consisting of the HXGPRT gene, nested between the endogenous 5' UTR and the 3' UTR of DHFR-TS. Also included in the construct is a bacterial expression cassette including selectable antibiotic resistance.

FIG. 3 depicts a schematic map of the construct used for the generation of therapeutic transgenic T. gondii lines based on the pGRA backbone. The nucleic acid construct comprises an ORF consisting of a fusion of a therapeutic polypeptide coding sequence in frame with the T. gondii GRA16 coding sequence and an HA tag. Upstream of the ORF is the endogenous 5' UTR of the GRA16 gene (GRA16 5'-UTR which acts as a promoter), and downstream of the ORF is the 3' UTR of the abundant dense granule protein GRA2 (GRA2 3'-UTR). The construct also contains a selectable marker cassette consisted of the HXGPRT gene, nested between the endogenous 5'-UTR and the 3'-UTR of DHFR-TS. Also included in the construct is a bacterial expression cassette including selectable antibiotic resistance.

FIGS. 4A-I depict novel parasite strains within mammalian cells (HFF), wherein the parasite strains expressing the Toxofilin-fused therapeutic proteins Aspartoacylase (ASPA), Survival motor neuron protein (SMN1), Methyl-CpG Binding Protein 2 (MECP2) and Galactocerebrosidase-TAT 443 (also referred to as "mutated GALC-TAT" in the GENERAL MATERIALS AND EXPERIMENTAL METHODS section), presenting specific localization to the parasites' secretory rhoptry organelles. FIG. 4A—Schematic structure of an intracellular T. gondii, highlighting the rhoptries. Red: inner membrane complex (IMC), Blue: DNA (host cell nucleus and T. gondii nucleus), Green: rhoptry proteins; FIGS. 4B-I—Fluorescence microscopy analysis of parasites grown on HFF cells, expressing endogenously HA-tagged Toxofilin-ASPA (FIGS. 4B and 4C), HA-tagged Toxofilin-SMN1 (FIGS. 4D and 4E), HA-tagged Toxofilin-MECP2 (FIGS. 4F and 4G) and HA-tagged Toxofilin-GALC-TAT mutated (FIGS. 4H and 4I) using anti-HA antibody (green in all panels), co-stained with the inner membrane complex IMC1 using anti-IMC1 antibody (red) and DAPI (blue), or shown on top of a polarized light image of the cells (grayscale). Parasites are shown in a mixed population, whereas only parasites showing green staining express the transgenic proteins. Scale bar=5 μM in all of the images shown in FIGS. 4B-I.

FIGS. 5A-I depict novel parasite strains within mammalian cells (HFF), wherein the parasite strains expressing the GRA16-fused therapeutic proteins Aspartoacylase (ASPA), Survival motor neuron protein (SMN1) and Methyl-CpG Binding Protein 2 (MECP2), presenting specific localization to the parasitophorous vacuole (PV) space, as well as to the host cell nucleus. FIG. 5A—Schematic representation of intracellular T. gondii parasites in a parasitophorous vacuole inside a host cell (fibroblast), highlighting the distribution of secreted dense granule effector proteins. Red: inner membrane complex (IMC), blue: DNA (host cell nucleus and T. gondii nuclei), yellow: dense granule secreted effector proteins, orange: parasitophorous vacuole. FIGS. 5B-I—Fluorescence microscopy analysis of parasites grown on HFF cells, expressing endogenously HA-tagged GRA16-ASPA (FIGS. 5B and 5C), HA-tagged GRA16-SMN1 (FIGS. 5D and 5E) and HA-tagged GRA16-MECP2 (FIGS. 5B-G in 100× magnification and FIGS. 5H-I in 40× magnification) using anti-HA antibody (green in all panels), co-stained with the inner membrane complex IMC1 using anti-IMC1 antibody (red) and DAPI (blue), or shown on top of a polarized light image of the cells. Parasites are shown in a mixed population, whereas only parasites showing green staining express the transgenic proteins. Scale bar=5 μM (for FIGS. 5B-G). Scale bar=20 μM (for FIGS. 5H-I).

Figure 6A:
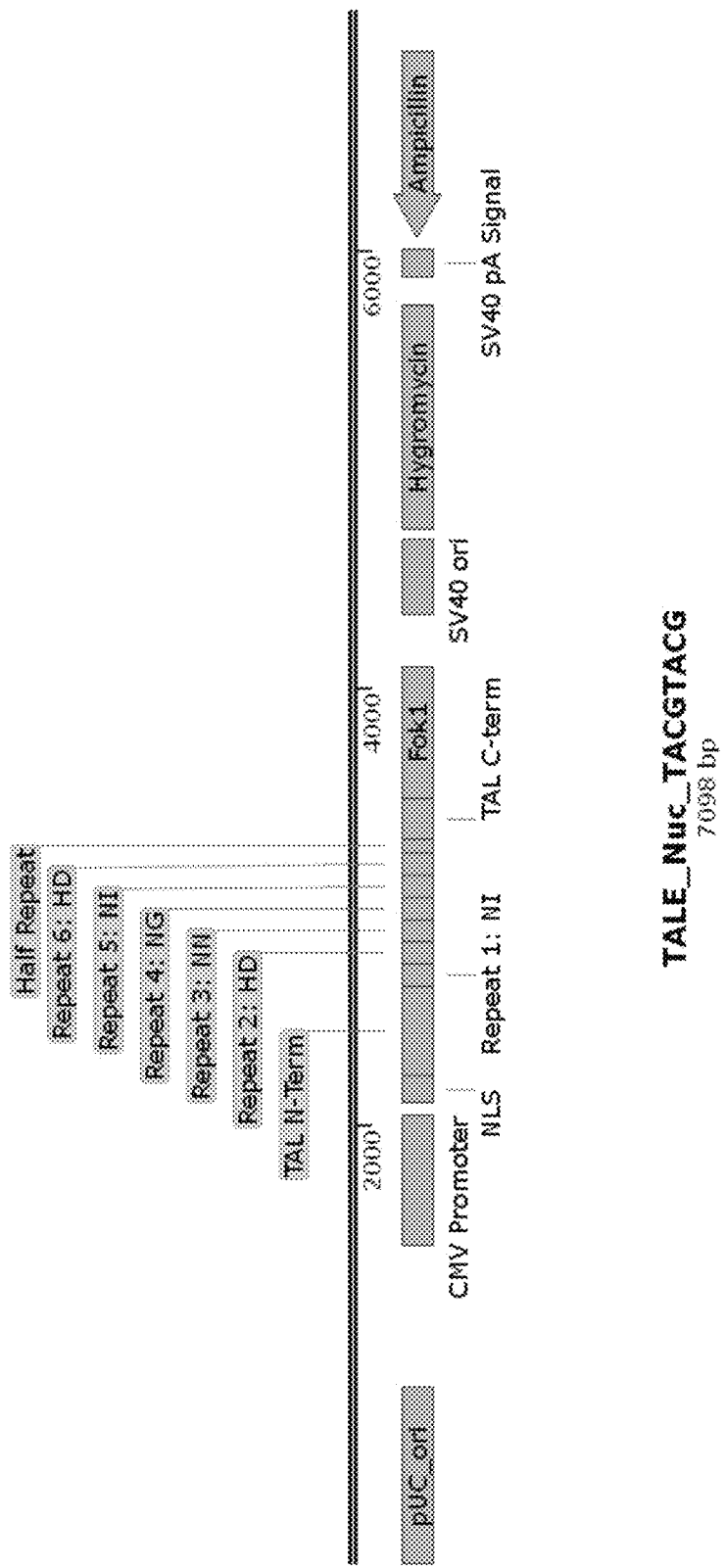
Figure 6B:
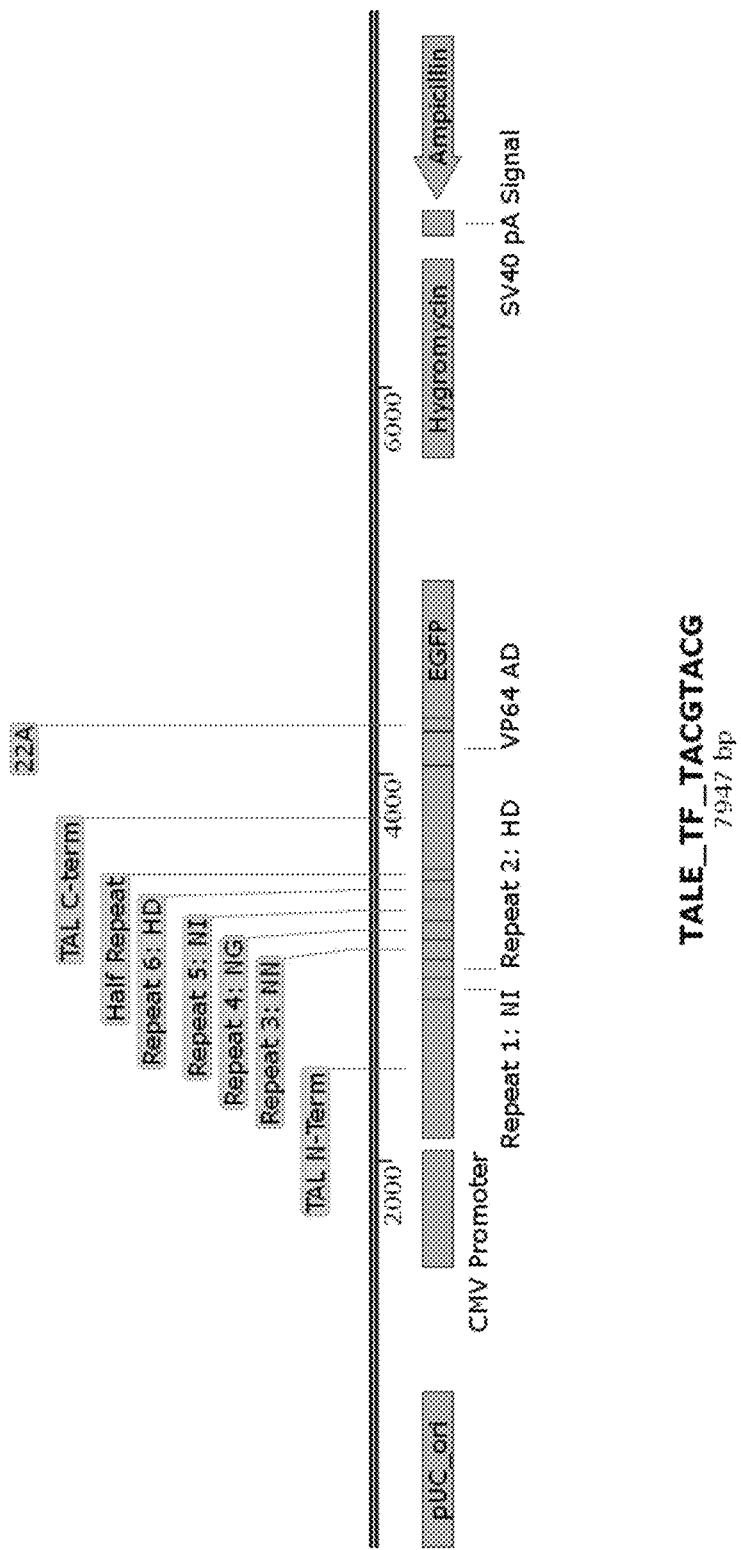

FIGS. 6A-B are schematic illustrations of a TALE Nuclease (FIG. 6A) and TALE transcription factor (FIG. 6B) which are designed, as example, to the "TACGTACG" (SEQ ID NO: 4505) target sequence. The TALE repeats are presented according to the order of the nucleotides in the target sequence. It is noted that because of the nature of TALEs, the first nucleotide always has to be T (so it is integrated in the TAL N-Terminus and is not annotated), and the last nucleotide (in this case G) is represented in a half-monomer (so it is annotated as "Half repeat"). In order to be expressed and secreted by the Toxoplasma of some embodiments of the invention, the open reading frame (ORF) of these constructs is inserted to the nucleic acid construct of some embodiments of the invention. For the TALE_Nuc (TALE nuclease) the ORF is from the NLS until after the FokI (e.g., nucleotides 2113-4104 of the polynucleotide set forth by SEQ ID NO: 4506). For the TALE-TF (TALE Transcription Factor) the ORF is from the TALE N terminus (N-term) after the EGFP (e.g., nucleotides 2120-5005 of the polynucleotide set forth by SEQ ID NO: 4507). "TALE-TF"=TALE transcription factor; "TALEN"=TALE nuclease. "NI", "NG", "NN" and "HD"=monomers as described in Example 5 hereinbelow.

FIG. 7 depicts a schematic map of the constructs used for the generation of the therapeutic transgenic *T. gondii* lines. The nucleic acid construct comprises an open reading frame (ORF) consisting of a fusion of a therapeutic polypeptide coding sequence in frame with the *T. gondii* Toxofilin coding sequence and an "HA" tag. Upstream of the ORF is the endogenous 5' UTR (untranslated region) of the Toxofilin gene (the "Toxofilin 5'-UTR"), and downstream of the ORF is the 3' UTR of the abundant dense granule protein GRA2 ("GRA2 3'-UTR"). The construct also contains a selectable marker cassette consisting of the HXGPRT gene, DHFR-TS gene or mCherry gene, nested between the endogenous 5' UTR and the 3' UTR of DHFR-TS. Also included in the construct is a bacterial expression cassette including selectable antibiotic resistance, used for molecular cloning.

Figure 8:
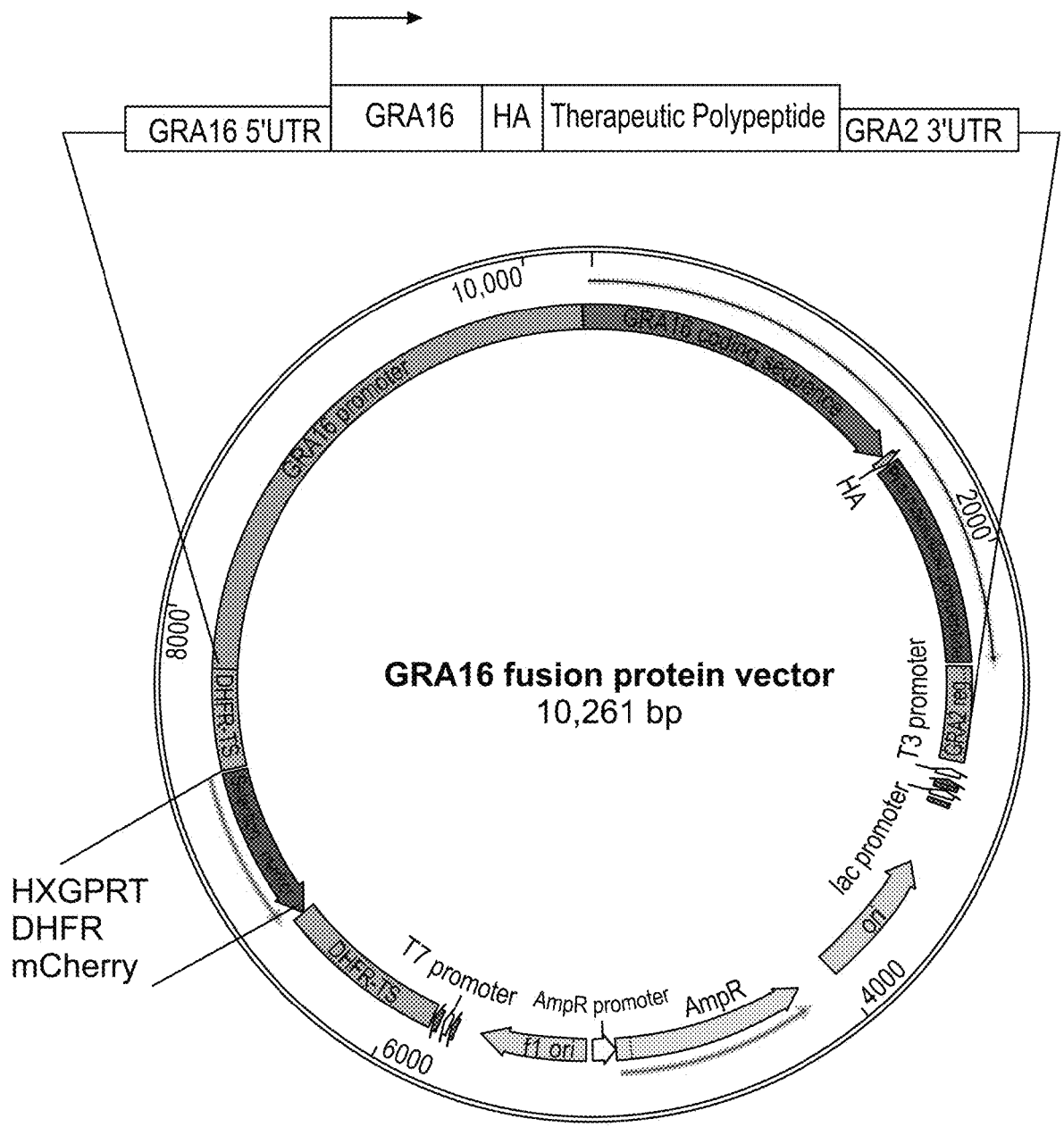

FIG. 8 depicts a schematic map of the construct used for the generation of the therapeutic transgenic *T. gondii* lines. The nucleic acid construct comprises an ORF consisting of a fusion of a therapeutic polypeptide coding sequence in frame with the *T. gondii* GRA16 coding sequence and an HA tag. Upstream of the ORF is the endogenous 5' UTR of the GRA16 gene (the "GRA16 5'-UTR"), and downstream of the ORF is the 3' UTR of the abundant dense granule protein GRA2 ("GRA2 3'-UTR"). The construct also contains a selectable marker cassette consisted of the HXGPRT gene, DHFR-TS gene or mCherry gene, nested between the endogenous 5' UTR and the 3' UTR of DHFR-TS. Also included in the construct is a bacterial expression cassette including selectable antibiotic resistance, used for molecular cloning.

FIGS. 9A-N depict images of transgenic parasites within mammalian cells (HFF), wherein the parasite strains expressing 12 novel Toxofilin-fused therapeutic proteins. FIG. 9A—Schematic structure of an intracellular *T. gondii*, highlighting the rhoptries. Magenta: inner membrane complex (IMC), cyan: DNA (host cell nucleus and *T. gondii* nucleus), yellow: rhoptry proteins; FIG. 9B—Representative fluorescence microscopy image of *T. gondii* grown in HFF cells, immunostained for the rhoptry marker ROP2/4 (yellow). Left: co-stained with DAPI (cyan), right: overlaid on a polarized-light image (grayscale). FIGS. 9C-N—images of transgenic parasites expressing the HA-tagged Toxofilin-fused therapeutic proteins: FIG. 9C—Aspartoacylase (ASPA), FIG. 9D—Aspartoacylase codon-optimized (ASPAopt), FIG. 9E—Galactocerebrosidase (GALC), FIG. 9F—Galactocerebrosidase codon-optimized (GALCopt), FIG. 9G—Galactocerebrosidase-TAT (GALC-TAT), FIG. 9H—Galactocerebrosidase-TAT 443 (GALC-TAT 443—also referred to as "mutated GALC-TAT" in the GENERAL MATERIALS AND EXPERIMENTAL METHODS section), FIG. 9I—Glial Cell Derived Neurotrophic Factor (GDNF), FIG. 9J—Methyl-CpG Binding Protein 2 (MECP2), FIG. 9K—Methyl-CpG Binding Protein 2 codon-optimized (MECP2opt), FIG. 9L—Parkin (PARK2), FIG. 9M—Survival motor neuron protein (SMN1) and FIG. 9N—Transcription Factor EB codon-optimized (TFEBopt). Example images of the parasites expressing Toxofilin-ASPAopt, Toxofilin-GALC-TAT 443, Toxofilin-GDNF, Toxofilin-MeCP2opt, Toxofilin-PARK2, Toxofilin-SMN1 and Toxofilin-TFEB show localization to the parasites' secretory rhoptry organelles. Toxofilin fusion protein are immunostained using anti-HA antibody (yellow). Left: co-stained with DAPI (cyan) and the parasite marker anti-IMC-1 (magenta), right: overlaid on a polarized-light image (grayscale). Parasites are shown in a mixed population, whereas only parasites showing yellow staining express the transgenic proteins. Scale bars=5 µM.

FIGS. 10A-J depict images of transgenic parasites within mammalian cells (HFF), wherein the parasite strains expressing 8 novel GRA16-fused therapeutic proteins. FIG. 10A—Schematic representation of intracellular *T. gondii* parasites in a parasitophorous vacuole inside a host cell, highlighting the distribution of secreted dense granule effector proteins. Magenta: inner membrane complex (IMC), cyan: DNA (host cell nucleus and *T. gondii* nuclei), yellow: dense granule secreted effector proteins, orange: parasitophorous vacuole; FIG. 10B—Representative fluorescence microscopy image of *T. gondii* grown in HFF cells, expressing an HA-tagged GRA16 protein and immunostained with anti-HA (yellow). Left: co-stained with DAPI (cyan), right: overlaid on a polarized-light image (grayscale). FIGS. 10C-J—Example images of transgenic parasites expressing the HA-tagged GRA16-fused therapeutic proteins: FIG. 10C—Aspartoacylase (ASPA), FIG. 10D—Survival motor neuron protein (SMN1), FIG. 10E—Galactocerebrosidase (GALC), FIG. 10F—Galactocerebrosidase-TAT (GALC-TAT), FIG. 10G—Aspartoacylase codon-optimized (ASPAopt). FIG. 10H—Galactocerebrosidase codon-optimized (GALCopt), FIG. 10I—Methyl-CpG Binding Protein 2 codon-optimized (MECP2opt) and FIG. 10J—Transcription Factor EB codon-optimized (TFEBopt). GRA16-ASPA, GRA16-SMN1, GRA16-ASPAopt, GRA16-MECP2opt and GRA16-TFEBopt show localization to the parasitophorous vacuole. GRA16-MECP2opt and GRA16-TFEBopt show also localization to the host cell nucleus. GRA16 fusion protein are immunostained using anti-HA antibody (yellow). Left: co-stained with DAPI (cyan) and the parasite marker anti-IMC-1 (magenta), right: overlaid on a polarized-light image (grayscale). Parasites are shown in a mixed population, whereas only parasites showing yellow staining express the transgenic proteins. Scale bars=5 µM.

Figure 11A:
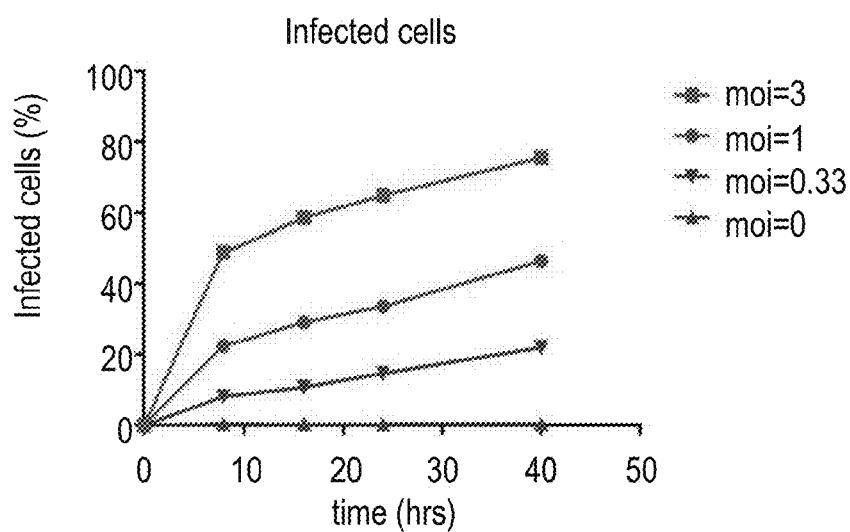
Figure 11B:
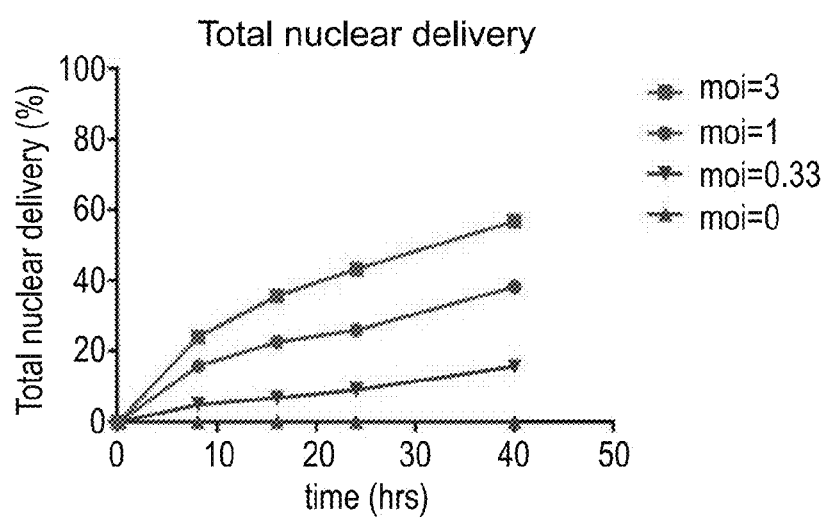
Figure 11C:
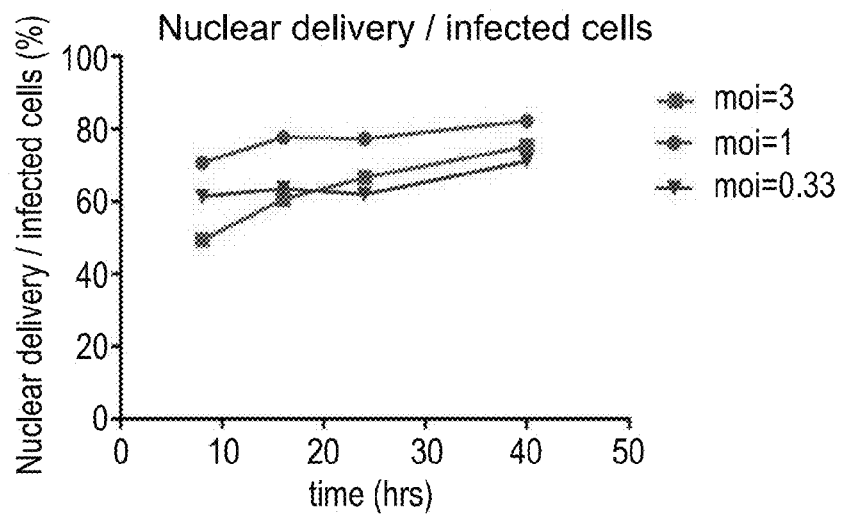

FIGS. 11A-C—Dynamics of protein delivery to the nuclei of HFF cells by tachyzoites of the strains RH GRA16-HAstop, GRA16-MECP2opt and GRA16-TFEBopt, over time and multiplicity of infection (MOI). Infected cells and nuclei delivery were counted by automated image analysis using GE IN Cell Investigator software (GE healthcare, Chicago, Ill., USA). Graphs represent aggregated results from the 3 strains together.

Figures 12A, 12B, 12C:
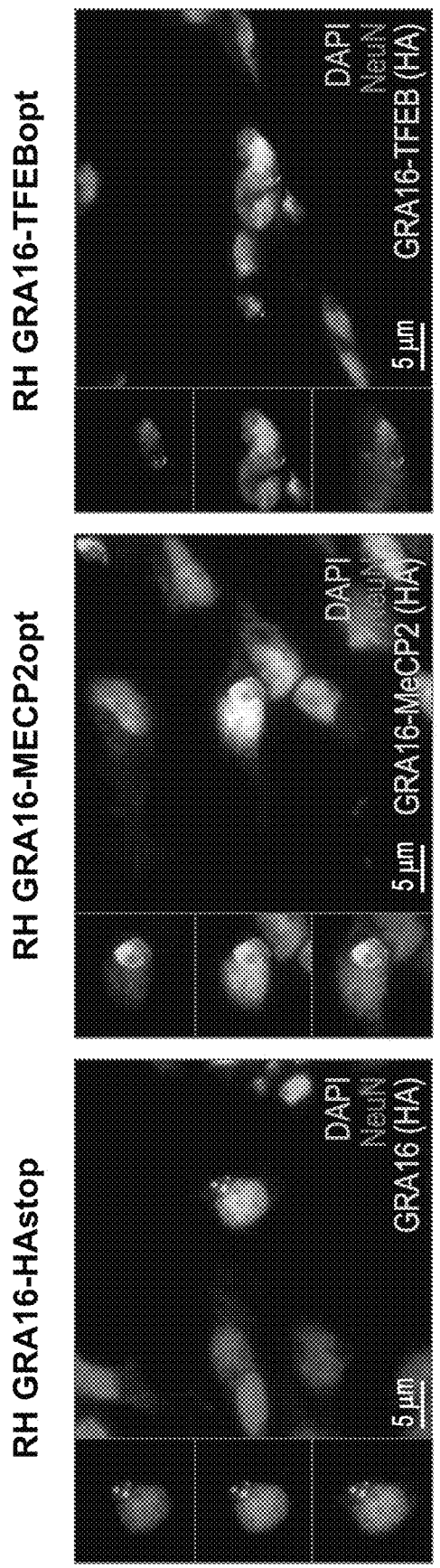

FIGS. 12A-C—Representative images of in vitro-differentiated LUHMES human neuronal cells 16-22 hours after infection with tachyzoites of the *T. gondii* strains RH GRA16-HAstop (FIG. 12A), GRA16-MECP2opt (FIG. 12B) and GRA16-TFEBopt (FIG. 12C). GRA16 fusion protein are immunostained using an anti-HA antibody (yellow) and co-stained with DAPI (cyan) and the marker for mature neurons anti-NeuN (magenta). Insets on the left of each figure show the infected cells visualized with anti-HA only (top, yellow), anti-HA and DAPI (middle, yellow and cyan) and anti-HA and NeuN (bottom, yellow and magenta). All strains show clear secretion and targeting of the fusion proteins to the nuclei of the human neurons.

Figure 13A:
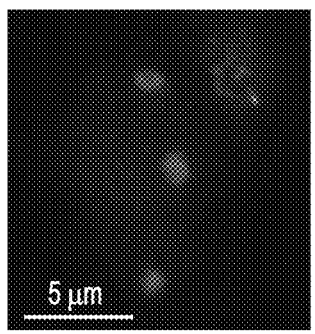
Figure 13B:
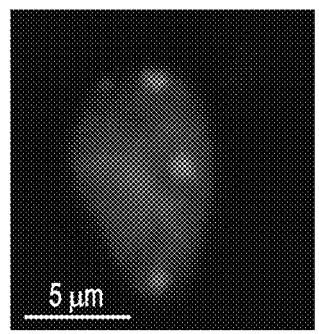
Figure 13C:
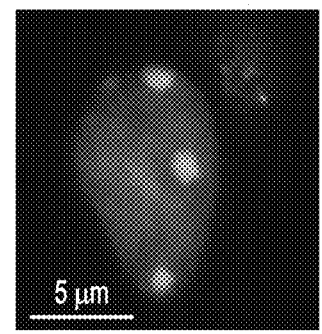
Figure 13D:
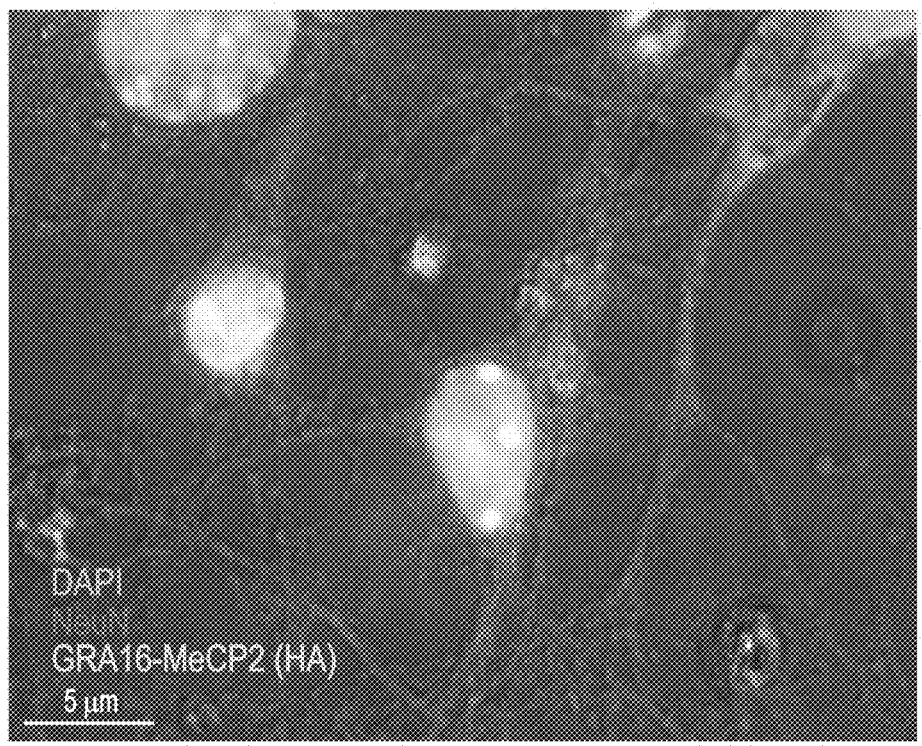

FIGS. 13A-D—Representative images of immunohistochemically stained neuron-enriched primary cultures from the cortices and hippocampi of P1 mice pups, 12 hours after infection with tachyzoites of the transgenic line RH GRA16-MECP2opt. The GRA16-MeCP2 fusion protein is immunostained using an anti-HA antibody (yellow). FIG. 13A—GRA16-MeCP2 alone (yellow). FIG. 13B—DAPI alone (cyan). FIG. 13C—merge of GRA16-MeCP2 and DAPI staining. FIG. 13D—merge of GRA16-MeCP2 (yellow), DAPI (cyan) and NeuN (magenta) overlaid on a polarized-light image (grayscale). The delivered GRA16-MeCP2opt demonstrates a characteristic pattern of co-localization with areas of condensed, heterochromatic DNA in the nuclei of the neuron, suggesting effective binding of the delivered MeCP2 to heterochromatin.

Figure 14:
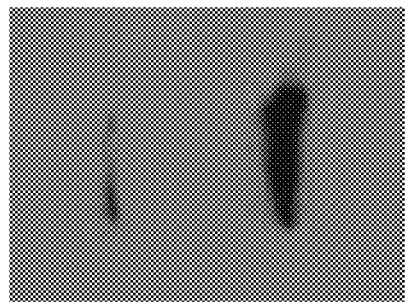

FIG. 14 is a Western blot of nuclear extracts of R306C MeCP2-mutant human LUHMES neurons infected with an MOI=1 of the RH GRA16-MECP2opt transgenic *T. gondii* strain, immunoprecipitated and blotted with a MeCP2-specific antibody. The blot shows two bands corresponding to the endogenous mutated MeCP2 and the *T. gondii*-delivered MeCP2. The *T. gondii*-delivered MeCP2 has higher molecular weight due to the fusion to GRA16.

FIGS. 15A-C show example images of in vitro differentiated bradyzoites of the transgenic *T. gondii* strain Pru GRA16-MECP2opt in HFF cells. The GRA16-MeCP2 fusion protein is immunostained using an anti-HA antibody (red). FIG. 15A—GRA16-MeCP2 alone. FIG. 15B—co-stained with the bradyzoite cyst-wall marker *Dolichos Biflorus* Agglutinin (DBA) (green) and DAPI (blue) showing in green the parasite cyst and blue the nuclei of the host fibroblast cells (HFF) with the HA-stained (red) GRA16-MeCP2 fusion protein within the nucleus of the host fibroblast cell containing the cyst. FIG. 15C—co-stained with DBA and overlaid on a polarized-light image (grayscale). The presented cyst shows continuous expression of GRA16-MeCP2, secretion and targeting of the fusion protein to the nucleus of the host cell at the bradyzoites stage. White arrowheads point on the nucleus of the cell containing the bradyzoite cyst, which contains the delivered protein GRA16-MeCP2.

DESCRIPTION OF SPECIFIC EMBODIMENTS OF THE INVENTION

The present invention, in some embodiments thereof, relates to a nucleic acid construct for secretion of Toxoplasma secreted protein fused to a pharmaceutical polypeptide, and Toxoplasma comprising same, and, more particularly, but not exclusively, to a pharmaceutical compositions and methods of using same for treating a subject.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have uncovered that Toxoplasma parasites transformed with genetic constructs encoding for a heterologous polypeptide synthesize and deliver the heterologous polypeptide to mammalian cells (FIGS. 4B-I, 5B-I, 9B-N, 10B-J, 11A-C, 12A-C, 13A-D, 14 and 15A-C and the Examples section which follows). Inside the mammalian cells, the heterologous polypeptide shuttles to its region of activity in the cell where it is able to augment cellular processes related to the known functions of the endogenous pharmaceutical protein. For example, the present inventors generated Type I and Type II Toxoplasma strains which express and deliver the mammalian proteins MeCP2 and TFEB into mice and human cells, translationally fused to the Toxoplasma secreted protein GRA16, and secreting the fused therapeutic protein into the desired cellular localization (nuclei) within mammalian cells treated ex-vivo with the Toxoplasma (FIGS. 13A-D), thus proving the feasibility of the constructs, Toxoplasma and methods for specific delivery of therapeutic polypeptides into a subject and treating the subject.

According to an aspect to some embodiments of the invention, there is provided a nucleic acid construct comprising a heterologous polynucleotide comprising a first nucleic acid sequence encoding a Toxoplasma secreted protein in frame fused upstream to a second nucleic acid sequence encoding a pharmaceutical polypeptide, wherein the heterologous polynucleotide is operably linked to a promoter for directing transcription of the heterologous polynucleotide in a Toxoplasma, wherein the promoter is selected from the group consisting of: a constitutive promoter, an inducible promoter, a latent period-specific promoter, and a Toxoplasma endogenous promoter with the proviso that the promoter is not a Toxofilin promoter.

According to some embodiments of the invention, the nucleic acid construct is suitable for expression in a Toxoplasma.

According to some embodiments of the invention, the nucleic acid construct does not comprise a Cre-recombinase coding sequence.

According to some embodiments of the invention, the nucleic acid construct does not comprise a beta (β)-lactamase (BLA) coding sequence.

According to some embodiments of the invention, the nucleic acid construct is suitable for integration into a genome of Toxoplasma.

According to some embodiments of the invention, the Toxoplasma is devoid of elements which facilitate propagation of the Toxoplasma in a host cell (e.g., elements important for evading the immune system of the host, elements essential for the production or utilization of certain metabolites, elements important for counteracting certain toxins or antibiotics), yet including an endogenous functional CPSII.

According to some embodiments of the invention, the Toxoplasma is devoid of virulence genes which are not necessary for delivery of the protein-of-interest into a CNS of a subject.

The nucleic acid construct includes a promoter sequence for directing transcription of the polynucleotide sequence in the Toxoplasma cell in a constitutive, transient, regulated or inducible manner.

As mentioned, the heterologous polynucleotide is operably linked to a promoter for directing transcription of the heterologous polynucleotide in a Toxoplasma.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls the timing and the intensity of expression of the gene, e.g., at which stage or condition in the lifetime of a parasite and/or of a host cell the gene is expressed.

According to some embodiments of the invention, the promoter is heterologous to the Toxoplasma used for expression of the nucleic acid construct.

According to some embodiments of the invention, the promoter is a constitutive promoter.

According to some embodiments of the invention, the promoter is an inducible promoter.

According to some embodiments of the invention, the promoter is a latent period-specific promoter.

According to some embodiments of the invention, the promoter is a Toxoplasma endogenous promoter with the proviso that the promoter is not a Toxofilin promoter.

According to some embodiments of the invention the promoter is not a Toxofillin endogenous promoter. It is noted that the predicted promoter of Toxofillin (predicted promoter of gene ID=TGME49_214080; SEQ ID NO:3689) contains the Toxofilin promoter used in some of the experiments of the Examples section (SEQ ID NO: 4482) and additional nucleotides upstream.

According to some embodiments the promoter does not comprise the nucleic acid sequence set forth by SEQ ID NO: 3689 and/or SEQ ID NO: 4482.

According to some embodiments of the invention, the endogenous promoter is not of a rhoptry protein.

According to some embodiments of the invention, the Toxoplasma endogenous promoter is the GRA2 promoter, GRA16 promoter, GRA24 promoter, SAG1 promoter, or the DHFR promoter.

According to some embodiments of the invention, the Toxoplasma endogenous promoter is the GRA2 promoter.

According to some embodiments of the invention, the Toxoplasma endogenous promoter is the GRA16 promoter.

According to some embodiments of the invention, the Toxoplasma endogenous promoter is the GRA24 promoter.

According to some embodiments of the invention, the Toxoplasma endogenous promoter is the SAG1 promoter.

According to some embodiments of the invention, the Toxoplasma endogenous promoter is the DHFR promoter.

Table 1 herein below lists suitable endogenous promoters which can be cloned into the nucleic acid construct of some embodiments of the invention in order to drive expression of the heterologous polynucleotide in the Toxoplasma.

TABLE 1

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 6018714 | 6021975 | − | ID = TGME49_278580; length = 3261 | 467 |
| TGME49_chrXI | 4645816 | 4647664 | + | ID = TGME49_315320; length = 1848 | 468 |
| TGME49_chrXI | 5975725 | 5979863 | − | ID = TGME49_216670; length = 4138 | 469 |
| TGME49_chrIa | 602877 | 607895 | + | ID = TGME49_293850; length = 5018 | 470 |
| TGME49_chrVIIa | 1551626 | 1554994 | + | ID = TGME49_205190; length = 3368 | 471 |
| TGME49_chrVIIb | 561320 | 563366 | + | ID = TGME49_263420; length = 2046 | 472 |
| TGME49_chrXII | 2795162 | 2799102 | + | ID = TGME49_246485; length = 3940 | 473 |
| TGME49_chrIb | 904562 | 908487 | + | ID = TGME49_208850; length = 3925 | 474 |
| TGME49_chrVIII | 4449329 | 4451277 | − | ID = TGME49_271610; length = 1948 | 475 |
| TGME49_chrVIII | 3044788 | 3047633 | + | ID = TGME49_274060; length = 2845 | 476 |
| TGME49_chrVIIb | 3612195 | 3614194 | + | ID = TGME49_258060; length = 1999 | 477 |
| TGME49_chrXII | 6549613 | 6551657 | + | ID = TGME49_277730; length = 2044 | 478 |
| TGME49_chrVIII | 197364 | 199295 | − | ID = TGME49_229350; length = 1931 | 479 |
| TGME49_chrXI | 5143319 | 5145850 | + | ID = TGME49_316130; length = 2531 | 480 |
| TGME49_chrVIIa | 2471302 | 2472989 | + | ID = TGME49_203490; length = 1687 | 481 |
| TGME49_chrV | 1117761 | 1121481 | + | ID = TGME49_213530; length = 3720 | 482 |
| TGME49_chrXII | 5640983 | 5642416 | − | ID = TGME49_251880; length = 1433 | 483 |
| TGME49_chrIb | 1120926 | 1123894 | + | ID = TGME49_209210; length = 2968 | 484 |
| TGME49_chrVIII | 4996018 | 4997934 | − | ID = TGME49_270790; length = 1916 | 485 |
| TGME49_chrVIII | 4266477 | 4270885 | − | ID = TGME49_271960; length = 4408 | 486 |
| TGME49_chrX | 7250986 | 7254222 | + | ID = TGME49_275430; length = 3236 | 487 |
| TGME49_chrVIIb | 3933132 | 3934570 | + | ID = TGME49_257640; length = 1438 | 488 |
| TGME49_chrIb | 1207044 | 1211342 | − | ID = TGME49_209410; length = 4298 | 489 |
| TGME49_chrVIIb | 3849337 | 3853482 | + | ID = TGME49_257750; length = 4145 | 490 |
| TGME49_chrVIII | 706425 | 708192 | + | ID = TGME49_230230; length = 1767 | 491 |
| TGME49_chrII | 2108697 | 2112820 | + | ID = TGME49_297920; length = 4123 | 492 |
| TGME49_chrIX | 3678105 | 3679325 | − | ID = TGME49_290270; length = 1220 | 493 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrV | 2469549 | 2471470 | − | ID = TGME49_285272; length = 1921 | 494 |
| TGME49_chrVIIb | 2197522 | 2200500 | + | ID = TGME49_260500; length = 2978 | 495 |
| TGME49_chrXII | 4500766 | 4502482 | − | ID = TGME49_249370; length = 1716 | 496 |
| TGME49_chrVIIa | 2313521 | 2315991 | − | ID = TGME49_203705; length = 2470 | 497 |
| TGME49_chrVIIb | 4993618 | 4998625 | + | ID = TGME49_255215; length = 5007 | 498 |
| TGME49_chrII | 2100257 | 2103772 | + | ID = TGME49_297900; length = 3515 | 499 |
| TGME49_chrVIIa | 2799113 | 2803405 | − | ID = TGME49_203135; length = 4292 | 500 |
| TGME49_chrIX | 1389644 | 1391469 | − | ID = TGME49_265990; length = 1825 | 501 |
| TGME49_chrIX | 5182974 | 5185461 | − | ID = TGME49_305030; length = 2487 | 502 |
| TGME49_chrVIII | 50367 | 52586 | − | ID = TGME49_229140; length = 2219 | 503 |
| TGME49_chrX | 3072006 | 3074113 | − | ID = TGME49_224350; length = 2107 | 504 |
| TGME49_chrXII | 3203140 | 3205868 | − | ID = TGME49_247260; length = 2728 | 505 |
| TGME49_chrVI | 1316502 | 1318224 | + | ID = TGME49_240550; length = 1722 | 506 |
| TGME49_chrVIIb | 4903838 | 4908769 | + | ID = TGME49_255310; length = 4931 | 507 |
| TGME49_chrVIIa | 689060 | 693095 | + | ID = TGME49_304760; length = 4035 | 508 |
| TGME49_chrVIII | 1508960 | 1513678 | − | ID = TGME49_231625; length = 4718 | 509 |
| TGME49_chrXII | 1903216 | 1907934 | + | ID = TGME49_217555; length = 4718 | 510 |
| TGME49_chrXI | 6096576 | 6098700 | − | ID = TGME49_216530; length = 2124 | 511 |
| TGME49_chrXII | 4300753 | 4303035 | − | ID = TGME49_249010; length = 2282 | 512 |
| TGME49_chrVIII | 5298854 | 5300947 | + | ID = TGME49_270270; length = 2093 | 513 |
| TGME49_chrVIII | 2184023 | 2186702 | + | ID = TGME49_232600; length = 2679 | 514 |
| TGME49_chrIV | 1432984 | 1435042 | − | ID = TGME49_318300; length = 2058 | 515 |
| TGME49_chrIX | 5708243 | 5710982 | + | ID = TGME49_305990; length = 2739 | 516 |
| TGME49_chrX | 2689262 | 2692060 | + | ID = TGME49_224910; length = 2798 | 517 |
| TGME49_chrIX | 871380 | 874729 | − | ID = TGME49_266960; length = 3349 | 518 |
| TGME49_chrIX | 1580498 | 1583961 | + | ID = TGME49_265390; length = 3463 | 519 |
| TGME49_chrVI | 1107433 | 1112442 | + | ID = TGME49_240250; length = 5009 | 520 |
| TGME49_chrXI | 4618602 | 4621016 | − | ID = TGME49_315270; length = 2414 | 521 |
| TGME49_chrIX | 1238941 | 1239596 | − | ID = TGME49_266290; length = 655 | 522 |
| TGME49_chrIb | 65733 | 70002 | − | ID = TGME49_207440; length = 4269 | 523 |
| TGME49_chrVIIa | 1078389 | 1081603 | − | ID = TGME49_206300; length = 3214 | 524 |
| TGME49_chrVIII | 1628848 | 1630628 | + | ID = TGME49_231910; length = 1780 | 525 |
| TGME49_chrIa | 556012 | 557885 | + | ID = TGME49_293780; length = 1873 | 526 |
| TGME49_chrIa | 1286481 | 1288807 | + | ID = TGME49_294960; length = 2326 | 527 |
| TGME49_chrXII | 2098720 | 2101108 | − | ID = TGME49_217760; length = 2388 | 528 |
| TGME49_chrIX | 3356580 | 3358813 | − | ID = TGME49_289620; length = 2233 | 529 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 6432210 | 6433693 | − | ID = TGME49_277920; length = 1483 | 530 |
| TGME49_chrIX | 1440831 | 1443406 | + | ID = TGME49_265810; length = 2575 | 531 |
| TGME49_chrVIIb | 2505068 | 2506652 | − | ID = TGME49_260150; length = 1584 | 532 |
| TGME49_chrVIIa | 2513490 | 2515244 | + | ID = TGME49_203400; length = 1754 | 533 |
| TGME49_chrIX | 4338786 | 4341883 | − | ID = TGME49_291680; length = 3097 | 534 |
| TGME49_chrVIII | 1844203 | 1845704 | + | ID = TGME49_232085; length = 1501 | 535 |
| TGME49_chrXI | 4303293 | 4303677 | + | ID = TGME49_314800; length = 384 | 536 |
| TGME49_chrVIIa | 3949957 | 3952927 | − | ID = TGME49_201240; length = 2970 | 537 |
| TGME49_chrIa | 1061383 | 1062031 | − | ID = TGME49_294680; length = 648 | 538 |
| TGME49_chrXI | 5090593 | 5094613 | + | ID = TGME49_315950; length = 4020 | 539 |
| TGME49_chrVIIa | 2441166 | 2446197 | − | ID = TGME49_203540; length = 5031 | 540 |
| TGME49_chrIX | 5012648 | 5015438 | − | ID = TGME49_307605; length = 2790 | 541 |
| TGME49_chrVIIb | 3906304 | 3910432 | − | ID = TGME49_257690; length = 4128 | 542 |
| TGME49_chrXII | 3652730 | 3655440 | − | ID = TGME49_247980; length = 2710 | 543 |
| TGME49_chrVIII | 6732568 | 6737516 | + | ID = TGME49_267990; length = 4948 | 544 |
| TGME49_chrIX | 362887 | 364364 | − | ID = TGME49_267790; length = 1477 | 545 |
| TGME49_chrV | 2197440 | 2202168 | + | ID = TGME49_285810; length = 4728 | 546 |
| TGME49_chrX | 7360015 | 7363002 | − | ID = TGME49_207050; length = 2987 | 547 |
| TGME49_chrIb | 1073856 | 1076422 | + | ID = TGME49_209150; length = 2566 | 548 |
| TGME49_chrVIIb | 2747094 | 2748845 | + | ID = TGME49_259630; length = 1751 | 549 |
| TGME49_chrb | 4351 | 6355 | − | ID = TGME49_207350; length = 2004 | 550 |
| TGME49_chrX | 2899092 | 2901603 | + | ID = TGME49_224660; length = 2511 | 551 |
| TGME49_chrX | 697594 | 700161 | + | ID = TGME49_227970; length = 2567 | 552 |
| TGME49_chrXI | 2069622 | 2070833 | − | ID = TGME49_311430; length = 1211 | 553 |
| TGME49_chrVIII | 2975808 | 2977909 | + | ID = TGME49_274150; length = 2101 | 554 |
| TGME49_chrVIIb | 1633764 | 1635885 | + | ID = TGME49_261600; length = 2121 | 555 |
| TGME49_chrIX | 4778923 | 4783666 | − | ID = TGME49_210450; length = 4743 | 556 |
| TGME49_chrXII | 170916 | 172799 | − | ID = TGME49_300180; length = 1883 | 557 |
| TGME49_chrVI | 903242 | 908079 | − | ID = TGME49_239760; length = 4837 | 558 |
| TGME49_chrXII | 5256913 | 5260639 | + | ID = TGME49_250840; length = 3726 | 559 |
| TGME49_chrX | 2609467 | 2612329 | + | ID = TGME49_224980; length = 2862 | 560 |
| TGME49_chrX | 5806295 | 5808296 | + | ID = TGME49_237250; length = 2001 | 561 |
| TGME49_chrVI | 548569 | 552854 | − | ID = TGME49_239320; length = 4285 | 562 |
| TGME49_chrVIIb | 1456014 | 1458169 | + | ID = TGME49_261960; length = 2155 | 563 |
| TGME49_chrXII | 838987 | 840604 | + | ID = TGME49_219590; length = 1617 | 564 |
| TGME49_chrIX | 600361 | 602779 | − | ID = TGME49_267530; length = 2418 | 565 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrV | 3072356 | 3074734 | + | ID = TGME49_283550; length = 2378 | 566 |
| TGME49_chrIV | 1653702 | 1657375 | + | ID = TGME49_211630; length = 3673 | 567 |
| TGME49_chrXI | 6343575 | 6348246 | + | ID = TGME49_216190; length = 4671 | 568 |
| TGME49_chrXII | 3835647 | 3837281 | − | ID = TGME49_248400; length = 1634 | 569 |
| TGME49_chrVI | 613254 | 616583 | + | ID = TGME49_239400; length = 3329 | 570 |
| TGME49_chrX | 2864192 | 2865912 | − | ID = TGME49_224710; length = 1720 | 571 |
| TGME49_chrII | 404894 | 406860 | − | ID = TGME49_221500; length = 1966 | 572 |
| TGME49_chrVIII | 6364079 | 6366025 | + | ID = TGME49_268685; length = 1946 | 573 |
| TGME49_chrIX | 3413082 | 3417820 | − | ID = TGME49_289730; length = 4738 | 574 |
| TGME49_chrIX | 4411548 | 4413465 | + | ID = TGME49_291940; length = 1917 | 575 |
| TGME49_chrX | 7395157 | 7398234 | − | ID = TGME49_207100; length = 3077 | 576 |
| TGME49_chrIX | 4245187 | 4246860 | + | ID = TGME49_291330; length = 1673 | 577 |
| TGME49_chrV | 1422070 | 1425388 | + | ID = TGME49_213910; length = 3318 | 578 |
| TGME49_chrIX | 3766794 | 3768071 | − | ID = TGME49_290605; length = 1277 | 579 |
| TGME49_chrX | 4283352 | 4285324 | − | ID = TGME49_234280; length = 1972 | 580 |
| TGME49_chrX | 6956462 | 6958294 | − | ID = TGME49_215430; length = 1832 | 581 |
| TGME49_chrV | 186946 | 188803 | + | ID = TGME49_220175; length = 1857 | 582 |
| TGME49_chrXII | 2719770 | 2724408 | − | ID = TGME49_246182; length = 4638 | 583 |
| TGME49_chrX | 7273127 | 7275437 | − | ID = TGME49_275440; length = 2310 | 584 |
| TGME49_chrVIII | 2250133 | 2251577 | + | ID = TGME49_232760; length = 1444 | 585 |
| TGME49_chrIX | 2113235 | 2114688 | − | ID = TGME49_264680; length = 1453 | 586 |
| TGME49_chrIb | 1503624 | 1507993 | + | ID = TGME49_209880; length = 4369 | 587 |
| TGME49_chrVIIa | 1653920 | 1656907 | − | ID = TGME49_205050; length = 2987 | 588 |
| TGME49_chrVIII | 1614122 | 1617638 | − | ID = TGME49_231880; length = 3516 | 589 |
| TGME49_chrVIII | 6823035 | 6824629 | + | ID = TGME49_200360; length = 1594 | 590 |
| TGME49_chrIV | 392225 | 396143 | + | ID = TGME49_320290; length = 3918 | 591 |
| TGME49_chrXI | 1725051 | 1727020 | − | ID = TGME49_311010; length = 1969 | 592 |
| TGME49_chrIX | 1570813 | 1573290 | + | ID = TGME49_265410; length = 2477 | 593 |
| TGME49_chrIV | 258575 | 263510 | + | ID = TGME49_320550; length = 4935 | 594 |
| TGME49_chrVIIb | 3432626 | 3435118 | + | ID = TGME49_258410; length = 2492 | 595 |
| TGME49_chrX | 4433471 | 4435962 | − | ID = TGME49_234510; length = 2491 | 596 |
| TGME49_chrXI | 4695687 | 4699361 | − | ID = TGME49_315410; length = 3674 | 597 |
| TGME49_chrX | 1944153 | 1947194 | + | ID = TGME49_225905; length = 3041 | 598 |
| TGME49_chrVIIb | 2072870 | 2074965 | − | ID = TGME49_260670; length = 2095 | 599 |
| TGME49_chrXII | 2651958 | 2655687 | + | ID = TGME49_246090; length = 3729 | 600 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 1225490 | 1226911 | + | ID = TGME49_205662; length = 1421 | 601 |
| TGME49_chrVIIa | 524618 | 528076 | + | ID = TGME49_304500; length = 3458 | 602 |
| TGME49_chrVIII | 2901671 | 2903828 | − | ID = TGME49_233925; length = 2157 | 603 |
| TGME49_chrVIII | 4715373 | 4717272 | + | ID = TGME49_271100; length = 1899 | 604 |
| TGME49_chrXI | 4750836 | 4752746 | − | ID = TGME49_315480; length = 1910 | 605 |
| TGME49_chrX | 3428954 | 3431481 | − | ID = TGME49_223960; length = 2527 | 606 |
| TGME49_chrIX | 1195352 | 1197540 | − | ID = TGME49_266368; length = 2188 | 607 |
| TGME49_chrII | 1798742 | 1800245 | + | ID = TGME49_297465; length = 1503 | 608 |
| TGME49_chrIX | 6077602 | 6080932 | − | ID = TGME49_306430; length = 3330 | 609 |
| TGME49_chrVIIa | 740498 | 744501 | + | ID = TGME49_206660; length = 4003 | 610 |
| TGME49_chrX | 3135671 | 3138592 | − | ID = TGME49_224280; length = 2921 | 611 |
| TGME49_chrVIIb | 3553741 | 3554846 | − | ID = TGME49_258140; length = 1105 | 612 |
| TGME49_chrIX | 5352748 | 5353735 | − | ID = TGME49_305315; length = 987 | 613 |
| TGME49_chrVIII | 4698087 | 4702028 | − | ID = TGME49_271115; length = 3941 | 614 |
| TGME49_chrIX | 793986 | 798309 | + | ID = TGME49_267060; length = 4323 | 615 |
| TGME49_chrVIIb | 3202590 | 3203934 | + | ID = TGME49_258760; length = 1344 | 616 |
| TGME49_chrX | 379796 | 381741 | + | ID = TGME49_228350; length = 1945 | 617 |
| TGME49_chrX | 4639580 | 4641831 | + | ID = TGME49_235150; length = 2251 | 618 |
| TGME49_chrIX | 3458713 | 3461263 | + | ID = TGME49_289800; length = 2550 | 619 |
| TGME49_chrVIIa | 2500255 | 2501767 | − | ID = TGME49_203450; length = 1512 | 620 |
| TGME49_chrXII | 4692112 | 4694534 | + | ID = TGME49_249620; length = 2422 | 621 |
| TGME49_chrVIII | 4351126 | 4354140 | − | ID = TGME49_271810; length = 3014 | 622 |
| TGME49_chrVIIa | 1305173 | 1307774 | − | ID = TGME49_205570; length = 2601 | 623 |
| TGME49_chrXI | 5710062 | 5711311 | + | ID = TGME49_217040; length = 1249 | 624 |
| TGME49_chrIa | 876889 | 879930 | − | ID = TGME49_294390; length = 3041 | 625 |
| TGME49_chrVIIa | 3975182 | 3977201 | + | ID = TGME49_201200; length = 2019 | 626 |
| TGME49_chrVIIb | 2870084 | 2871524 | − | ID = TGME49_259220; length = 1440 | 627 |
| TGME49_chrVI | 1084348 | 1088618 | + | ID = TGME49_240230; length = 4270 | 628 |
| TGME49_chrVIIb | 3385721 | 3387496 | + | ID = TGME49_258490; length = 1775 | 629 |
| TGME49_chrVIIb | 528457 | 531919 | + | ID = TGME49_263480; length = 3462 | 630 |
| TGME49_chrII | 757384 | 761699 | + | ID = TGME49_222020; length = 4315 | 631 |
| TGME49_chrVIII | 1358289 | 1362306 | − | ID = TGME49_231350; length = 4017 | 632 |
| TGME49_chrIX | 2802162 | 2802980 | − | ID = TGME49_288900; length = 818 | 633 |
| TGME49_chrX | 2467589 | 2469875 | − | ID = TGME49_225130; length = 2286 | 634 |
| TGME49_chrVIIb | 2251666 | 2252571 | − | ID = TGME49_260460; length = 905 | 635 |
| TGME49_chrVIIa | 2091486 | 2095749 | + | ID = TGME49_203950; length = 4263 | 636 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 6058657 | 6060999 | + | ID = TGME49_306410; length = 2342 | 637 |
| TGME49_chrV | 198241 | 200161 | + | ID = TGME49_220200; length = 1920 | 638 |
| TGME49_chrII | 1356741 | 1359871 | − | ID = TGME49_222980; length = 3130 | 639 |
| TGME49_chrX | 2206505 | 2209526 | + | ID = TGME49_225490; length = 3021 | 640 |
| TGME49_chrXII | 2096828 | 2099495 | + | ID = TGME49_217770; length = 2667 | 641 |
| TGME49_chrVIIa | 2970014 | 2971521 | + | ID = TGME49_202870; length = 1507 | 642 |
| TGME49_chrVIIb | 322918 | 324659 | − | ID = TGME49_263800; length = 1741 | 643 |
| TGME49_chrVIIb | 2953991 | 2955320 | − | ID = TGME49_259140; length = 1329 | 644 |
| TGME49_chrVIIa | 1469449 | 1473570 | + | ID = TGME49_205320; length = 4121 | 645 |
| TGME49_chrXI | 461912 | 464423 | + | ID = TGME49_309060; length = 2511 | 646 |
| TGME49_chrIX | 1224097 | 1225515 | − | ID = TGME49_266320; length = 1418 | 647 |
| TGME49_chrII | 2142037 | 2146242 | + | ID = TGME49_297970; length = 4205 | 648 |
| TGME49_chrVI | 1042594 | 1045138 | − | ID = TGME49_240070; length = 2544 | 649 |
| TGME49_chrV | 1309086 | 1311333 | − | ID = TGME49_213770; length = 2247 | 650 |
| TGME49_chrII | 1023447 | 1025166 | − | ID = TGME49_222305; length = 1719 | 651 |
| TGME49_chrXI | 1500417 | 1504291 | − | ID = TGME49_310640; length = 3874 | 652 |
| TGME49_chrXI | 4378378 | 4379028 | + | ID = TGME49_314890; length = 650 | 653 |
| TGME49_chrX | 738524 | 740600 | + | ID = TGME49_227910; length = 2076 | 654 |
| TGME49_chrIX | 6045512 | 6047246 | + | ID = TGME49_306390; length = 1734 | 655 |
| TGME49_chrX | 1935232 | 1938008 | − | ID = TGME49_225920; length = 2776 | 656 |
| TGME49_chrVI | 1441267 | 1443761 | − | ID = TGME49_240770; length = 2494 | 657 |
| TGME49_chrVIIa | 2001508 | 2005367 | − | ID = TGME49_204090; length = 3859 | 658 |
| TGME49_chrIa | 654666 | 657455 | − | ID = TGME49_294025; length = 2789 | 659 |
| TGME49_chrVIIb | 2174692 | 2176915 | + | ID = TGME49_260530; length = 2223 | 660 |
| TGME49_chrXII | 711702 | 713805 | + | ID = TGME49_219700; length = 2103 | 661 |
| TGME49_chrIa | 1304701 | 1306918 | + | ID = TGME49_295000; length = 2217 | 662 |
| TGME49_chrIX | 568139 | 569234 | + | ID = TGME49_267560; length = 1095 | 663 |
| TGME49_chrVIII | 5397829 | 5399254 | − | ID = TGME49_270110; length = 1425 | 664 |
| TGME49_chrXII | 2844102 | 2846241 | + | ID = TGME49_246550; length = 2139 | 665 |
| TGME49_chrXII | 4934926 | 4937491 | + | ID = TGME49_249900; length = 2565 | 666 |
| TGME49_chrX | 4880053 | 4884161 | + | ID = TGME49_235470; length = 4108 | 667 |
| TGME49_chrXI | 5868595 | 5871618 | − | ID = TGME49_216820; length = 3023 | 668 |
| TGME49_chrXII | 6404251 | 6407186 | − | ID = TGME49_277940; length = 2935 | 669 |
| TGME49_chrIX | 957423 | 959519 | + | ID = TGME49_266800; length = 2096 | 670 |
| TGME49_chrXII | 5774989 | 5777401 | − | ID = TGME49_278900; length = 2412 | 671 |
| TGME49_chrVIII | 3959751 | 3962176 | + | ID = TGME49_272450; length = 2425 | 672 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 3700675 | 3704469 | − | ID = TGME49_273030; length = 3794 | 673 |
| TGME49_chrVIIb | 3532555 | 3534514 | + | ID = TGME49_258170; length = 1959 | 674 |
| TGME49_chrIX | 5338645 | 5340540 | − | ID = TGME49_305290; length = 1895 | 675 |
| TGME49_chrIX | 3807351 | 3810696 | + | ID = TGME49_290645; length = 3345 | 676 |
| TGME49_chrXII | 5625786 | 5628283 | + | ID = TGME49_251855; length = 2497 | 677 |
| TGME49_chrVI | 3004204 | 3006660 | + | ID = TGME49_244070; length = 2456 | 678 |
| TGME49_chrVIIa | 3948602 | 3952191 | + | ID = TGME49_201230; length = 3589 | 679 |
| TGME49_chrVIII | 15020 | 16940 | + | ID = TGME49_229005; length = 1920 | 680 |
| TGME49_chrIa | 429247 | 432726 | − | ID = TGME49_293570; length = 3479 | 681 |
| TGME49_chrII | 1927281 | 1932126 | + | ID = TGME49_297710; length = 4845 | 682 |
| TGME49_chrXI | 2637010 | 2638757 | + | ID = TGME49_312370; length = 1747 | 683 |
| TGME49_chrXII | 3469020 | 3473396 | − | ID = TGME49_247660; length = 4376 | 684 |
| TGME49_chrXI | 4916157 | 4920214 | − | ID = TGME49_315700; length = 4057 | 685 |
| TGME49_chrIb | 629071 | 630918 | + | ID = TGME49_208360; length = 1847 | 686 |
| TGME49_chrXII | 6755827 | 6757330 | + | ID = TGME49_277050; length = 1503 | 687 |
| TGME49_chrVIIb | 4411300 | 4413757 | − | ID = TGME49_256840; length = 2457 | 688 |
| TGME49_chrX | 7049221 | 7051104 | − | ID = TGME49_215610; length = 1883 | 689 |
| TGME49_chrXII | 6528538 | 6533549 | + | ID = TGME49_277760; length = 5011 | 690 |
| TGME49_chrVIIa | 3427921 | 3430094 | + | ID = TGME49_202310; length = 2173 | 691 |
| TGME49_chrX | 6689399 | 6691360 | + | ID = TGME49_215030; length = 1961 | 692 |
| TGME49_chrVI | 2874483 | 2876334 | + | ID = TGME49_243900; length = 1851 | 693 |
| TGME49_chrVIII | 83739 | 85719 | − | ID = TGME49_229180; length = 1980 | 694 |
| TGME49_chrIV | 2119015 | 2122018 | − | ID = TGME49_210715; length = 3003 | 695 |
| TGME49_chrVIIb | 3259075 | 3262189 | + | ID = TGME49_258680; length = 3114 | 696 |
| TGME49_chrV | 125975 | 128008 | + | ID = TGME49_220100; length = 2033 | 697 |
| TGME49_chrVI | 3354392 | 3358777 | − | ID = TGME49_244550; length = 4385 | 698 |
| TGME49_chrV | 1810497 | 1813699 | + | ID = TGME49_286490; length = 3202 | 699 |
| TGME49_chrIb | 1306317 | 1308410 | + | ID = TGME49_209530; length = 2093 | 700 |
| TGME49_chrV | 2062700 | 2065738 | + | ID = TGME49_286000; length = 3038 | 701 |
| TGME49_chrIX | 2762545 | 2764943 | + | ID = TGME49_288840; length = 2398 | 702 |
| TGME49_chrX | 995784 | 1000191 | + | ID = TGME49_227350; length = 4407 | 703 |
| TGME49_chrIb | 1537215 | 1542214 | − | ID = TGME49_209890; length = 4999 | 704 |
| TGME49_chrVI | 2985954 | 2988613 | + | ID = TGME49_244050; length = 2659 | 705 |
| TGME49_chrXI | 5187085 | 5189714 | − | ID = TGME49_316200; length = 2629 | 706 |
| TGME49_chrVIIa | 2561670 | 2565986 | + | ID = TGME49_203340; length = 4316 | 707 |
| TGME49_chrV | 2226315 | 2231159 | + | ID = TGME49_285790; length = 4844 | 708 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 404524 | 405991 | + | ID = TGME49_267725; length = 1467 | 709 |
| TGME49_chrIX | 694704 | 696929 | + | ID = TGME49_267360; length = 2225 | 710 |
| TGME49_chrXII | 3777345 | 3780569 | + | ID = TGME49_248290; length = 3224 | 711 |
| TGME49_chrVIIa | 3092406 | 3094459 | − | ID = TGME49_202720; length = 2053 | 712 |
| TGME49_chrXI | 2455600 | 2459938 | + | ID = TGME49_312150; length = 4338 | 713 |
| TGME49_chrII | 220920 | 223578 | + | ID = TGME49_221295; length = 2658 | 714 |
| TGME49_chrXII | 2084169 | 2087144 | − | ID = TGME49_217730; length = 2975 | 715 |
| TGME49_chrIb | 1007791 | 1010351 | − | ID = TGME49_209045; length = 2560 | 716 |
| TGME49_chrX | 5265702 | 5266555 | − | ID = TGME49_236070; length = 853 | 717 |
| TGME49_chrVIIb | 3457465 | 3460841 | − | ID = TGME49_258360; length = 3376 | 718 |
| TGME49_chrVIII | 2192903 | 2195917 | − | ID = TGME49_232610; length = 3014 | 719 |
| TGME49_chrVIIb | 1109483 | 1111172 | + | ID = TGME49_262640; length = 1689 | 720 |
| TGME49_chrX | 3853657 | 3855793 | − | ID = TGME49_223430; length = 2136 | 721 |
| TGME49_chrXI | 4239198 | 4243862 | + | ID = TGME49_314720; length = 4664 | 722 |
| TGME49_chrVIIb | 2697869 | 2700279 | + | ID = TGME49_259710; length = 2410 | 723 |
| TGME49_chrVIIa | 1471730 | 1473919 | − | ID = TGME49_205330; length = 2189 | 724 |
| TGME49_chrV | 2711878 | 2714132 | − | ID = TGME49_284570; length = 2254 | 725 |
| TGME49_chrVIII | 388717 | 391218 | − | ID = TGME49_229700; length = 2501 | 726 |
| TGME49_chrIX | 1538973 | 1542213 | + | ID = TGME49_265455; length = 3240 | 727 |
| TGME49_chrXI | 763730 | 767625 | − | ID = TGME49_309610; length = 3895 | 728 |
| TGME49_chrXI | 2544365 | 2546425 | + | ID = TGME49_312250; length = 2060 | 729 |
| TGME49_chrVIII | 5643590 | 5647253 | − | ID = TGME49_269730; length = 3663 | 730 |
| TGME49_chrIX | 3584012 | 3585263 | − | ID = TGME49_290005; length = 1251 | 731 |
| TGME49_chrVIIa | 3971108 | 3972217 | − | ID = TGME49_201215; length = 1109 | 732 |
| TGME49_chrIX | 5666852 | 5669401 | − | ID = TGME49_305910; length = 2549 | 733 |
| TGME49_chrVIIa | 1726778 | 1728368 | + | ID = TGME49_204540; length = 1590 | 734 |
| TGME49_chrIX | 5763619 | 5766671 | − | ID = TGME49_306030; length = 3052 | 735 |
| TGME49_chrIX | 5211532 | 5213996 | − | ID = TGME49_305080; length = 2464 | 736 |
| TGME49_chrII | 1002441 | 1005482 | + | ID = TGME49_222270; length = 3041 | 737 |
| TGME49_chrXII | 82314 | 83922 | + | ID = TGME49_300320; length = 1608 | 738 |
| TGME49_chrXI | 4112813 | 4117560 | + | ID = TGME49_314470; length = 4747 | 739 |
| TGME49_chrVIII | 6338649 | 6340670 | − | ID = TGME49_268740; length = 2021 | 740 |
| TGME49_chrIX | 4955341 | 4957346 | − | ID = TGME49_210220; length = 2005 | 741 |
| TGME49_chrX | 1176693 | 1177745 | − | ID = TGME49_226980; length = 1052 | 742 |
| TGME49_chrXII | 1656412 | 1659890 | − | ID = TGME49_218240; length = 3478 | 743 |
| TGME49_chrXII | 6033919 | 6035646 | − | ID = TGME49_278550; length = 1727 | 744 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 2960978 | 2963669 | − | ID = TGME49_202890; length = 2691 | 745 |
| TGME49_chrXII | 6087585 | 6092290 | + | ID = TGME49_278450; length = 4705 | 746 |
| TGME49_chrVIII | 101229 | 104465 | + | ID = TGME49_229230; length = 3236 | 747 |
| TGME49_chrIV | 1027176 | 1029320 | − | ID = TGME49_319330; length = 2144 | 748 |
| TGME49_chrV | 927001 | 929683 | + | ID = TGME49_213325; length = 2682 | 749 |
| TGME49_chrVIIa | 1979278 | 1981377 | − | ID = TGME49_204120; length = 2099 | 750 |
| TGME49_chrVIIa | 2168400 | 2170024 | − | ID = TGME49_203875; length = 1624 | 751 |
| TGME49_chrV | 805784 | 808589 | + | ID = TGME49_213040; length = 2805 | 752 |
| TGME49_chrXI | 3257664 | 3259999 | + | ID = TGME49_313310; length = 2335 | 753 |
| TGME49_chrXI | 4225921 | 4227690 | − | ID = TGME49_314690; length = 1769 | 754 |
| TGME49_chrXI | 2469249 | 2471186 | − | ID = TGME49_312160; length = 1937 | 755 |
| TGME49_chrVIIa | 3069396 | 3071264 | − | ID = TGME49_202740; length = 1868 | 756 |
| TGME49_chrVIIb | 3982505 | 3984582 | − | ID = TGME49_257550; length = 2077 | 757 |
| TGME49_chrVI | 2352405 | 2356464 | − | ID = TGME49_242850; length = 4059 | 758 |
| TGME49_chrVIIa | 1364682 | 1367044 | − | ID = TGME49_205510; length = 2362 | 759 |
| TGME49_chrIX | 3290280 | 3294112 | − | ID = TGME49_289530; length = 3832 | 760 |
| TGME49_chrX | 6509764 | 6512159 | + | ID = TGME49_214820; length = 2395 | 761 |
| TGME49_chrX | 581261 | 582904 | − | ID = TGME49_228110; length = 1643 | 762 |
| TGME49_chrVIIb | 2990065 | 2994627 | + | ID = TGME49_259040; length = 4562 | 763 |
| TGME49_chrXI | 2072060 | 2077000 | + | ID = TGME49_311450; length = 4940 | 764 |
| TGME49_chrVIII | 2876231 | 2878765 | − | ID = TGME49_233880; length = 2534 | 765 |
| TGME49_chrV | 1940852 | 1943237 | + | ID = TGME49_286160; length = 2385 | 766 |
| TGME49_chrIb | 737486 | 739366 | + | ID = TGME49_208510; length = 1880 | 767 |
| TGME49_chrX | 7427442 | 7429460 | + | ID = TGME49_207180; length = 2018 | 768 |
| TGME49_chrXI | 4517672 | 4520283 | + | ID = TGME49_315150; length = 2611 | 769 |
| TGME49_chrVI | 2075613 | 2077679 | − | ID = TGME49_242570; length = 2066 | 770 |
| TGME49_chrXII | 5792779 | 5795081 | − | ID = TGME49_278878; length = 2302 | 771 |
| TGME49_chrXI | 6607068 | 6609847 | + | ID = TGME49_298630; length = 2779 | 772 |
| TGME49_chrII | 1309836 | 1311957 | + | ID = TGME49_222920; length = 2121 | 773 |
| TGME49_chrVI | 3254059 | 3255822 | − | ID = TGME49_244420; length = 1763 | 774 |
| TGME49_chrVI | 1733335 | 1738338 | + | ID = TGME49_241840; length = 5003 | 775 |
| TGME49_chrXII | 51579 | 55519 | + | ID = TGME49_300350; length = 3940 | 776 |
| TGME49_chrIX | 4278507 | 4279338 | − | ID = TGME49_291580; length = 831 | 777 |
| TGME49_chrX | 537261 | 540449 | − | ID = TGME49_228160; length = 3188 | 778 |
| TGME49_chrVIII | 2637897 | 2639548 | + | ID = TGME49_233430; length = 1651 | 779 |
| TGME49_chrX | 6320461 | 6322071 | − | ID = TGME49_214490; length = 1610 | 780 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 1438969 | 1442993 | + | ID = TGME49_205360; length = 4024 | 781 |
| TGME49_chrIX | 423314 | 427457 | + | ID = TGME49_267710; length = 4143 | 782 |
| TGME49_chrXII | 3305338 | 3310175 | − | ID = TGME49_247380; length = 4837 | 783 |
| TGME49_chrV | 1107121 | 1109784 | + | ID = TGME49_213510; length = 2663 | 784 |
| TGME49_chrIX | 3928247 | 3930598 | − | ID = TGME49_290900; length = 2351 | 785 |
| TGME49_chrXII | 1737254 | 1738814 | − | ID = TGME49_218070; length = 1560 | 786 |
| TGME49_chrX | 1297593 | 1300223 | + | ID = TGME49_226840; length = 2630 | 787 |
| TGME49_chrVI | 3298917 | 3303680 | + | ID = TGME49_244480; length = 4763 | 788 |
| TGME49_chrXII | 681432 | 686187 | + | ID = TGME49_219730; length = 4755 | 789 |
| TGME49_chrVIIb | 1154398 | 1159261 | + | ID = TGME49_262564; length = 4863 | 790 |
| TGME49_chrVIIb | 2520918 | 2523507 | + | ID = TGME49_260020; length = 2589 | 791 |
| TGME49_chrVIIa | 4383439 | 4388493 | + | ID = TGME49_282130; length = 5054 | 792 |
| TGME49_chrVIII | 6357878 | 6362199 | − | ID = TGME49_268710; length = 4321 | 793 |
| TGME49_chrV | 3062858 | 3064646 | − | ID = TGME49_283698; length = 1788 | 794 |
| TGME49_chrIb | 185665 | 190405 | + | ID = TGME49_207650; length = 4740 | 795 |
| TGME49_chrXII | 3113953 | 3117617 | − | ID = TGME49_247025; length = 3664 | 796 |
| TGME49_chrIV | 2662136 | 2664273 | + | ID = TGME49_317705; length = 2137 | 797 |
| TGME49_chrXI | 6204102 | 6206390 | − | ID = TGME49_216375; length = 2288 | 798 |
| TGME49_chrVIIa | 1971451 | 1974609 | − | ID = TGME49_204130; length = 3158 | 799 |
| TGME49_chrII | 1378645 | 1380471 | − | ID = TGME49_223030; length = 1826 | 800 |
| TGME49_chrX | 294956 | 296317 | − | ID = TGME49_228480; length = 1361 | 801 |
| TGME49_chrVIIa | 3325912 | 3327698 | − | ID = TGME49_202445; length = 1786 | 802 |
| TGME49_chrVIIa | 530623 | 533507 | + | ID = TGME49_304520; length = 2884 | 803 |
| TGME49_chrV | 1878530 | 1880133 | − | ID = TGME49_286265; length = 1603 | 804 |
| TGME49_chrXI | 5955570 | 5956873 | − | ID = TGME49_216700; length = 1303 | 805 |
| TGME49_chrII | 2094542 | 2097582 | − | ID = TGME49_297880; length = 3040 | 806 |
| TGME49_chrX | 6821949 | 6825368 | + | ID = TGME49_215220; length = 3419 | 807 |
| TGME49_chrVIII | 6586174 | 6591203 | − | ID = TGME49_268280; length = 5029 | 808 |
| TGME49_chrV | 2346870 | 2349052 | + | ID = TGME49_285520; length = 2182 | 809 |
| TGME49_chrVIIa | 3182956 | 3184488 | − | ID = TGME49_202600; length = 1532 | 810 |
| TGME49_chrII | 1959873 | 1961931 | − | ID = TGME49_297730; length = 2058 | 811 |
| TGME49_chrVIII | 2213367 | 2216028 | − | ID = TGME49_232660; length = 2661 | 812 |
| TGME49_chrVIII | 1472593 | 1474572 | + | ID = TGME49_231590; length = 1979 | 813 |
| TGME49_chrVIIb | 407034 | 411993 | + | ID = TGME49_263650; length = 4959 | 814 |
| TGME49_chrXII | 6040410 | 6041868 | + | ID = TGME49_278522; length = 1458 | 815 |
| TGME49_chrVI | 128832 | 133066 | + | ID = TGME49_238210; length = 4234 | 816 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 2351312 | 2353449 | − | ID = TGME49_233020; length = 2137 | 817 |
| TGME49_chrXII | 3675670 | 3678134 | + | ID = TGME49_248130; length = 2464 | 818 |
| TGME49_chrXI | 1751305 | 1754114 | + | ID = TGME49_311060; length = 2809 | 819 |
| TGME49_chrVIII | 3820920 | 3824021 | − | ID = TGME49_272650; length = 3101 | 820 |
| TGME49_chrIX | 3958197 | 3961023 | − | ID = TGME49_290940; length = 2826 | 821 |
| TGME49_chrVIII | 3927306 | 3931495 | + | ID = TGME49_272500; length = 4189 | 822 |
| TGME49_chrVIIb | 4557365 | 4559435 | − | ID = TGME49_256030; length = 2070 | 823 |
| TGME49_chrVIIa | 3276204 | 3279186 | − | ID = TGME49_202500; length = 2982 | 824 |
| TGME49_chrVIII | 6318896 | 6321304 | − | ID = TGME49_268780; length = 2408 | 825 |
| TGME49_chrVIIb | 479812 | 483399 | + | ID = TGME49_263550; length = 3587 | 826 |
| TGME49_chrIX | 4290283 | 4293221 | + | ID = TGME49_291620; length = 2938 | 827 |
| TGME49_chrVI | 28927 | 31927 | + | ID = TGME49_238050; length = 3000 | 828 |
| TGME49_chrIV | 478540 | 480420 | − | ID = TGME49_320140; length = 1880 | 829 |
| TGME49_chrVIIa | 625928 | 629635 | − | ID = TGME49_304690; length = 3707 | 830 |
| TGME49_chrXI | 5485338 | 5489618 | − | ID = TGME49_316670; length = 4280 | 831 |
| TGME49_chrVIIa | 1539841 | 1542075 | + | ID = TGME49_205210; length = 2234 | 832 |
| TGME49_chrXII | 634097 | 638220 | + | ID = TGME49_219800; length = 4123 | 833 |
| TGME49_chrV | 1822851 | 1827597 | − | ID = TGME49_286465; length = 4746 | 834 |
| TGME49_chrVIII | 5573023 | 5577518 | + | ID = TGME49_269850; length = 4495 | 835 |
| TGME49_chrV | 688702 | 691280 | − | ID = TGME49_212880; length = 2578 | 836 |
| TGME49_chrVIIa | 718101 | 722948 | − | ID = TGME49_206700; length = 4847 | 837 |
| TGME49_chrVIIb | 1078623 | 1080134 | + | ID = TGME49_262690; length = 1511 | 838 |
| TGME49_chrVIII | 122484 | 127476 | + | ID = TGME49_229270; length = 4992 | 839 |
| TGME49_chrVIII | 1984455 | 1988743 | + | ID = TGME49_232270; length = 4288 | 840 |
| TGME49_chrIb | 1635560 | 1637014 | + | ID = TGME49_321685; length = 1454 | 841 |
| TGME49_chrXII | 4936100 | 4940316 | − | ID = TGME49_249890; length = 4216 | 842 |
| TGME49_chrXI | 542439 | 545032 | − | ID = TGME49_309185; length = 2593 | 843 |
| TGME49_chrX | 4421909 | 4423573 | + | ID = TGME49_234505; length = 1664 | 844 |
| TGME49_chrXI | 6172181 | 6176170 | − | ID = TGME49_216400; length = 3989 | 845 |
| TGME49_chrX | 2291510 | 2293010 | − | ID = TGME49_225350; length = 1500 | 846 |
| TGME49_chrV | 1749542 | 1751790 | + | ID = TGME49_286630; length = 2248 | 847 |
| TGME49_chrVI | 1319811 | 1322525 | + | ID = TGME49_240570; length = 2714 | 848 |
| TGME49_chrVIIb | 229491 | 232296 | − | ID = TGME49_264030; length = 2805 | 849 |
| TGME49_chrVI | 2310854 | 2312930 | + | ID = TGME49_242810; length = 2076 | 850 |
| TGME49_chrX | 6502678 | 6507667 | − | ID = TGME49_214800; length = 4989 | 851 |
| TGME49_chrXI | 2060339 | 2062705 | − | ID = TGME49_311400; length = 2366 | 852 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 926825 | 929619 | + | ID = TGME49_230650; length = 2794 | 853 |
| TGME49_chrXII | 105272 | 106503 | − | ID = TGME49_300300; length = 1231 | 854 |
| TGME49_chrVIII | 453277 | 455115 | − | ID = TGME49_229800; length = 1838 | 855 |
| TGME49_chrX | 1644562 | 1648123 | + | ID = TGME49_226420; length = 3561 | 856 |
| TGME49_chrII | 1517438 | 1521865 | + | ID = TGME49_297080; length = 4427 | 857 |
| TGME49_chrVIIa | 4046509 | 4047748 | − | ID = TGME49_281360; length = 1239 | 858 |
| TGME49_chrX | 2847812 | 2849682 | − | ID = TGME49_224740; length = 1870 | 859 |
| TGME49_chrIX | 2404001 | 2406112 | + | ID = TGME49_288240; length = 2111 | 860 |
| TGME49_chrII | 2059679 | 2062541 | − | ID = TGME49_297830; length = 2862 | 861 |
| TGME49_chrVI | 1483766 | 1486135 | + | ID = TGME49_240870; length = 2369 | 862 |
| TGME49_chrVIII | 5701192 | 5703410 | − | ID = TGME49_269670; length = 2218 | 863 |
| TGME49_chrV | 3011022 | 3012612 | + | ID = TGME49_283720; length = 1590 | 864 |
| TGME49_chrV | 2873814 | 2875242 | − | ID = TGME49_283900; length = 1428 | 865 |
| TGME49_chrX | 2677638 | 2679002 | − | ID = TGME49_224928; length = 1364 | 866 |
| TGME49_chrVI | 459221 | 463664 | − | ID = TGME49_239090; length = 4443 | 867 |
| TGME49_chrIX | 2481691 | 2483404 | + | ID = TGME49_288380; length = 1713 | 868 |
| TGME49_chrXII | 6336466 | 6338146 | − | ID = TGME49_278050; length = 1680 | 869 |
| TGME49_chrXI | 3461726 | 3464489 | − | ID = TGME49_313530; length = 2763 | 870 |
| TGME49_chrIV | 494931 | 499385 | − | ID = TGME49_320105; length = 4454 | 871 |
| TGME49_chrVIIb | 3216785 | 3221009 | + | ID = TGME49_258730; length = 4224 | 872 |
| TGME49_chrIV | 2387569 | 2389243 | − | ID = TGME49_301330; length = 1674 | 873 |
| TGME49_chrXII | 4581992 | 4584975 | + | ID = TGME49_249510; length = 2983 | 874 |
| TGME49_chrX | 764443 | 766659 | − | ID = TGME49_227870; length = 2216 | 875 |
| TGME49_chrXI | 5272434 | 5274572 | + | ID = TGME49_316400; length = 2138 | 876 |
| TGME49_chrIX | 907526 | 912198 | − | ID = TGME49_266910; length = 4672 | 877 |
| TGME49_chrVIII | 3348738 | 3350248 | − | ID = TGME49_273620; length = 1510 | 878 |
| TGME49_chrXII | 4977966 | 4980165 | − | ID = TGME49_249990; length = 2199 | 879 |
| TGME49_chrV | 2971036 | 2974678 | − | ID = TGME49_283790; length = 3642 | 880 |
| TGME49_chrXII | 6194501 | 6196639 | + | ID = TGME49_278250; length = 2138 | 881 |
| TGME49_chrVIIb | 4886434 | 4890628 | − | ID = TGME49_255350; length = 4194 | 882 |
| TGME49_chrVIIb | 1537462 | 1538674 | − | ID = TGME49_261770; length = 1212 | 883 |
| TGME49_chrIX | 2673441 | 2676363 | − | ID = TGME49_288680; length = 2922 | 884 |
| TGME49_chrX | 3787941 | 3790472 | + | ID = TGME49_223480; length = 2531 | 885 |
| TGME49_chrXII | 3635884 | 3640897 | − | ID = TGME49_247940; length = 5013 | 886 |
| TGME49_chrVI | 3491337 | 3495343 | + | ID = TGME49_244726; length = 4006 | 887 |
| TGME49_chrXII | 3425901 | 3428625 | − | ID = TGME49_247580; length = 2724 | 888 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 1660039 | 1663128 | + | ID = TGME49_261540; length = 3089 | 889 |
| TGME49_chrVI | 110931 | 113077 | − | ID = TGME49_238180; length = 2146 | 890 |
| TGME49_chrXII | 1569011 | 1573385 | − | ID = TGME49_218362; length = 4374 | 891 |
| TGME49_chrVIIb | 3048837 | 3050490 | − | ID = TGME49_258990; length = 1653 | 892 |
| TGME49_chrVIIb | 301194 | 305916 | + | ID = TGME49_263820; length = 4722 | 893 |
| TGME49_chrVIIa | 4386727 | 4390549 | − | ID = TGME49_282120; length = 3822 | 894 |
| TGME49_chrIV | 205415 | 209239 | + | ID = TGME49_320600; length = 3824 | 895 |
| TGME49_chrIX | 281401 | 284597 | − | ID = TGME49_279315; length = 3196 | 896 |
| TGME49_chrVIIb | 4247947 | 4250288 | + | ID = TGME49_257060; length = 2341 | 897 |
| TGME49_chrXI | 4347593 | 4351033 | − | ID = TGME49_314850; length = 3440 | 898 |
| TGME49_chrX | 1671295 | 1673894 | − | ID = TGME49_226385; length = 2599 | 899 |
| TGME49_chrXII | 1898504 | 1900791 | − | ID = TGME49_217540; length = 2287 | 900 |
| TGME49_chrVI | 1623501 | 1626197 | + | ID = TGME49_241130; length = 2696 | 901 |
| TGME49_chrXI | 5083118 | 5085552 | + | ID = TGME49_315940; length = 2434 | 902 |
| TGME49_chrXII | 1108648 | 1110707 | − | ID = TGME49_219150; length = 2059 | 903 |
| TGME49_chrXI | 3691754 | 3696010 | − | ID = TGME49_313780; length = 4256 | 904 |
| TGME49_chrIX | 1201055 | 1203450 | + | ID = TGME49_266360; length = 2395 | 905 |
| TGME49_chrIX | 1628753 | 1630162 | + | ID = TGME49_265290; length = 1409 | 906 |
| TGME49_chrIX | 5802166 | 5805344 | + | ID = TGME49_306080; length = 3178 | 907 |
| TGME49_chrV | 1269324 | 1271922 | − | ID = TGME49_213730; length = 2598 | 908 |
| TGME49_chrVIII | 6544943 | 6546577 | + | ID = TGME49_268320; length = 1634 | 909 |
| TGME49_chrVI | 2565899 | 2570600 | + | ID = TGME49_243350; length = 4701 | 910 |
| TGME49_chrV | 244725 | 247396 | − | ID = TGME49_220250; length = 2671 | 911 |
| TGME49_chrX | 4253581 | 4254822 | − | ID = TGME49_234260; length = 1241 | 912 |
| TGME49_chrXII | 141229 | 143333 | + | ID = TGME49_300230; length = 2104 | 913 |
| TGME49_chrX | 5248755 | 5253245 | + | ID = TGME49_236050; length = 4490 | 914 |
| TGME49_chrII | 1255974 | 1257956 | − | ID = TGME49_222840; length = 1982 | 915 |
| TGME49_chrVIII | 1421265 | 1423169 | − | ID = TGME49_231430; length = 1904 | 916 |
| TGME49_chrVIIa | 789026 | 794038 | − | ID = TGME49_206610; length = 5012 | 917 |
| TGME49_chrVI | 1454696 | 1457473 | + | ID = TGME49_240810; length = 2777 | 918 |
| TGME49_chrX | 4432719 | 4434480 | + | ID = TGME49_234520; length = 1761 | 919 |
| TGME49_chrIa | 999746 | 1003574 | − | ID = TGME49_294610; length = 3828 | 920 |
| TGME49_chrVIIa | 374254 | 376921 | − | ID = TGME49_280480; length = 2667 | 921 |
| TGME49_chrIV | 146510 | 149451 | + | ID = TGME49_320670; length = 2941 | 922 |
| TGME49_chrIX | 2955650 | 2958322 | − | ID = TGME49_289060; length = 2672 | 923 |
| TGME49_chrV | 2283288 | 2285190 | − | ID = TGME49_285700; length = 1902 | 924 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 2619287 | 2621303 | + | ID = TGME49_233390; length = 2016 | 925 |
| TGME49_chrXI | 2246218 | 2248260 | − | ID = TGME49_311740; length = 2042 | 926 |
| TGME49_chrXII | 3304425 | 3309462 | + | ID = TGME49_247390; length = 5037 | 927 |
| TGME49_chrX | 6822559 | 6826683 | − | ID = TGME49_215210; length = 4124 | 928 |
| TGME49_chrXI | 1048590 | 1053342 | + | ID = TGME49_310100; length = 4752 | 929 |
| TGME49_chrX | 1429153 | 1433385 | + | ID = TGME49_226690; length = 4232 | 930 |
| TGME49_chrIX | 2602771 | 2606731 | + | ID = TGME49_288540; length = 3960 | 931 |
| TGME49_chrX | 76000 | 78305 | − | ID = TGME49_200590; length = 2305 | 932 |
| TGME49_chrVI | 3131474 | 3132802 | + | ID = TGME49_244240; length = 1328 | 933 |
| TGME49_chrVI | 2746962 | 2750934 | − | ID = TGME49_243600; length = 3972 | 934 |
| TGME49_chrX | 4869703 | 4872065 | + | ID = TGME49_235440; length = 2362 | 935 |
| TGME49_chrIa | 245706 | 248432 | − | ID = TGME49_293310; length = 2726 | 936 |
| TGME49_chrVI | 18291 | 19862 | − | ID = TGME49_238030; length = 1571 | 937 |
| TGME49_chrIa | 1025883 | 1028407 | + | ID = TGME49_294640; length = 2524 | 938 |
| TGME49_chrXII | 6329045 | 6330752 | − | ID = TGME49_278060; length = 1707 | 939 |
| TGME49_chrXI | 6343575 | 6346044 | + | ID = TGME49_216200; length = 2469 | 940 |
| TGME49_chrX | 5528016 | 5528444 | − | ID = TGME49_236830; length = 428 | 941 |
| TGME49_chrVIIa | 4006122 | 4008450 | + | ID = TGME49_201140; length = 2328 | 942 |
| TGME49_chrXI | 744895 | 746156 | + | ID = TGME49_309590; length = 1261 | 943 |
| TGME49_chrIV | 777767 | 779444 | + | ID = TGME49_319700; length = 1677 | 944 |
| TGME49_chrIa | 1704993 | 1707763 | − | ID = TGME49_295600; length = 2770 | 945 |
| TGME49_chrIV | 251460 | 253297 | − | ID = TGME49_320580; length = 1837 | 946 |
| TGME49_chrVIIb | 4543345 | 4545276 | + | ID = TGME49_256050; length = 1931 | 947 |
| TGME49_chrVI | 2880063 | 2882722 | + | ID = TGME49_243920; length = 2659 | 948 |
| TGME49_chrV | 2297009 | 2301830 | − | ID = TGME49_285670; length = 4821 | 949 |
| TGME49_chrIV | 742966 | 745952 | + | ID = TGME49_319850; length = 2986 | 950 |
| TGME49_chrII | 551419 | 555255 | − | ID = TGME49_221670; length = 3836 | 951 |
| TGME49_chrIX | 903708 | 908281 | + | ID = TGME49_266900; length = 4573 | 952 |
| TGME49_chrXII | 6571890 | 6574505 | + | ID = TGME49_277685; length = 2615 | 953 |
| TGME49_chrIV | 2511002 | 2514234 | + | ID = TGME49_301470; length = 3232 | 954 |
| TGME49_chrX | 2881882 | 2886012 | − | ID = TGME49_224680; length = 4130 | 955 |
| TGME49_chrXII | 1189943 | 1192566 | − | ID = TGME49_218955; length = 2623 | 956 |
| TGME49_chrXI | 1636715 | 1638328 | + | ID = TGME49_310870; length = 1613 | 957 |
| TGME49_chrV | 1740838 | 1743872 | − | ID = TGME49_286650; length = 3034 | 958 |
| TGME49_chrIV | 2038028 | 2039463 | − | ID = TGME49_210815; length = 1435 | 959 |
| TGME49_chrX | 6246170 | 6248972 | + | ID = TGME49_214320; length = 2802 | 960 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 460354 | 462837 | − | ID = TGME49_263590; length = 2483 | 961 |
| TGME49_chrXI | 4239198 | 4241167 | + | ID = TGME49_314715; length = 1969 | 962 |
| TGME49_chrX | 1747886 | 1749867 | − | ID = TGME49_226280; length = 1981 | 963 |
| TGME49_chrVIII | 4872953 | 4877607 | + | ID = TGME49_270920; length = 4654 | 964 |
| TGME49_chrII | 420859 | 424002 | − | ID = TGME49_221530; length = 3143 | 965 |
| TGME49_chrXI | 4902639 | 4904888 | + | ID = TGME49_315690; length = 2249 | 966 |
| TGME49_chrIX | 2404526 | 2406796 | − | ID = TGME49_288230; length = 2270 | 967 |
| TGME49_chrXI | 5009093 | 5010699 | − | ID = TGME49_315810; length = 1606 | 968 |
| TGME49_chrVIII | 6809858 | 6812222 | − | ID = TGME49_200330; length = 2364 | 969 |
| TGME49_chrVI | 1973911 | 1974670 | + | ID = TGME49_242340; length = 759 | 970 |
| TGME49_chrXII | 316928 | 321044 | − | ID = TGME49_299825; length = 4116 | 971 |
| TGME49_chrII | 683949 | 688778 | + | ID = TGME49_221910; length = 4829 | 972 |
| TGME49_chrIb | 607119 | 609291 | − | ID = TGME49_208310; length = 2172 | 973 |
| TGME49_chrXI | 1717490 | 1721072 | + | ID = TGME49_311000; length = 3582 | 974 |
| TGME49_chrXI | 2887262 | 2889295 | − | ID = TGME49_312650; length = 2033 | 975 |
| TGME49_chrVIIa | 332983 | 334493 | + | ID = TGME49_280522; length = 1510 | 976 |
| TGME49_chrX | 1531923 | 1536680 | + | ID = TGME49_226560; length = 4757 | 977 |
| TGME49_chrVIII | 2626057 | 2627682 | + | ID = TGME49_233405; length = 1625 | 978 |
| TGME49_chrVIIb | 1170152 | 1173763 | − | ID = TGME49_262550; length = 3611 | 979 |
| TGME49_chrIV | 1941441 | 1943945 | + | ID = TGME49_211060; length = 2504 | 980 |
| TGME49_chrVIII | 4447522 | 4450597 | + | ID = TGME49_271600; length = 3075 | 981 |
| TGME49_chrVIII | 1965225 | 1967627 | + | ID = TGME49_232240; length = 2402 | 982 |
| TGME49_chrIX | 3596648 | 3598874 | + | ID = TGME49_290040; length = 2226 | 983 |
| TGME49_chrVIIb | 3968336 | 3973027 | − | ID = TGME49_257572; length = 4691 | 984 |
| TGME49_chrV | 187252 | 190551 | − | ID = TGME49_220170; length = 3299 | 985 |
| TGME49_chrVIII | 1274114 | 1276871 | + | ID = TGME49_231160; length = 2757 | 986 |
| TGME49_chrVIIb | 4633239 | 4633990 | − | ID = TGME49_255910; length = 751 | 987 |
| TGME49_chrXII | 6567740 | 6569055 | + | ID = TGME49_277690; length = 1315 | 988 |
| TGME49_chrII | 605002 | 607207 | − | ID = TGME49_221710; length = 2205 | 989 |
| TGME49_chrIb | 1391208 | 1394231 | + | ID = TGME49_209680; length = 3023 | 990 |
| TGME49_chrVI | 468532 | 470265 | + | ID = TGME49_239120; length = 1733 | 991 |
| TGME49_chrX | 2921630 | 2925549 | − | ID = TGME49_224630; length = 3919 | 992 |
| TGME49_chrVI | 2799007 | 2803879 | − | ID = TGME49_243690; length = 4872 | 993 |
| TGME49_chrVI | 2904927 | 2906963 | − | ID = TGME49_243940; length = 2036 | 994 |
| TGME49_chrII | 466401 | 468740 | − | ID = TGME49_221585; length = 2339 | 995 |
| TGME49_chrVIII | 6616283 | 6618113 | − | ID = TGME49_268240; length = 1830 | 996 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 5565970 | 5568898 | − | ID = TGME49_236890; length = 2928 | 997 |
| TGME49_chrXII | 651262 | 652841 | + | ID = TGME49_219770; length = 1579 | 998 |
| TGME49_chrIX | 2432096 | 2434121 | + | ID = TGME49_288280; length = 2025 | 999 |
| TGME49_chrXII | 1636217 | 1640467 | − | ID = TGME49_218270; length = 4250 | 1000 |
| TGME49_chrVIIa | 1872508 | 1874024 | + | ID = TGME49_204330; length = 1516 | 1001 |
| TGME49_chrXII | 3737300 | 3739417 | + | ID = TGME49_248200; length = 2117 | 1002 |
| TGME49_chrXI | 3858510 | 3860201 | + | ID = TGME49_313990; length = 1691 | 1003 |
| TGME49_chrVI | 2535609 | 2537835 | − | ID = TGME49_243302; length = 2226 | 1004 |
| TGME49_chrVIII | 218635 | 220518 | + | ID = TGME49_229380; length = 1883 | 1005 |
| TGME49_chrXII | 5899226 | 5904153 | + | ID = TGME49_278750; length = 4927 | 1006 |
| TGME49_chrVIIb | 791575 | 793258 | − | ID = TGME49_263120; length = 1683 | 1007 |
| TGME49_chrXII | 965702 | 969227 | − | ID = TGME49_219370; length = 3525 | 1008 |
| TGME49_chrVIIb | 2247921 | 2252571 | − | ID = TGME49_260470; length = 4650 | 1009 |
| TGME49_chrII | 925169 | 930001 | − | ID = TGME49_222160; length = 4832 | 1010 |
| TGME49_chrVIII | 4328122 | 4331040 | − | ID = TGME49_271870; length = 2918 | 1011 |
| TGME49_chrVIIb | 4565803 | 4568166 | − | ID = TGME49_256020; length = 2363 | 1012 |
| TGME49_chrIX | 401868 | 404259 | − | ID = TGME49_267730; length = 2391 | 1013 |
| TGME49_chrIV | 883987 | 886188 | + | ID = TGME49_319580; length = 2201 | 1014 |
| TGME49_chrXII | 3271212 | 3273508 | − | ID = TGME49_247330; length = 2296 | 1015 |
| TGME49_chrIV | 1179180 | 1180121 | − | ID = TGME49_318632; length = 941 | 1016 |
| TGME49_chrIX | 5904748 | 5906644 | − | ID = TGME49_306270; length = 1896 | 1017 |
| TGME49_chrVIII | 2882878 | 2885243 | + | ID = TGME49_233905; length = 2365 | 1018 |
| TGME49_chrIb | 319440 | 322320 | + | ID = TGME49_207830; length = 2880 | 1019 |
| TGME49_chrXI | 5276064 | 5279392 | + | ID = TGME49_316410; length = 3328 | 1020 |
| TGME49_chrVIIb | 4327835 | 4329892 | − | ID = TGME49_256965; length = 2057 | 1021 |
| TGME49_chrVIIa | 1383664 | 1387009 | − | ID = TGME49_205480; length = 3345 | 1022 |
| TGME49_chrX | 1183277 | 1184615 | − | ID = TGME49_226970; length = 1338 | 1023 |
| TGME49_chrV | 3011696 | 3013612 | − | ID = TGME49_283730; length = 1916 | 1024 |
| TGME49_chrX | 1531923 | 1533938 | + | ID = TGME49_226565; length = 2015 | 1025 |
| TGME49_chrX | 2248390 | 2249697 | + | ID = TGME49_225420; length = 1307 | 1026 |
| TGME49_chrVIII | 792105 | 796468 | + | ID = TGME49_230450; length = 4363 | 1027 |
| TGME49_chrIX | 3471473 | 3473649 | + | ID = TGME49_289830; length = 2176 | 1028 |
| TGME49_chrXI | 6086232 | 6089255 | − | ID = TGME49_216560; length = 3023 | 1029 |
| TGME49_chrVIII | 5980059 | 5982851 | − | ID = TGME49_269232; length = 2792 | 1030 |
| TGME49_chrVIII | 2023670 | 2028207 | + | ID = TGME49_232350; length = 4537 | 1031 |
| TGME49_chrXII | 3641104 | 3645165 | + | ID = TGME49_247970; length = 4061 | 1032 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 883251 | 885953 | − | ID = TGME49_262990; length = 2702 | 1033 |
| TGME49_chrIV | 2626644 | 2631162 | − | ID = TGME49_237880; length = 4518 | 1034 |
| TGME49_chrIa | 111397 | 113812 | + | ID = TGME49_293060; length = 2415 | 1035 |
| TGME49_chrVI | 428224 | 431908 | − | ID = TGME49_239030; length = 3684 | 1036 |
| TGME49_chrVIII | 2540409 | 2542122 | − | ID = TGME49_233245; length = 1713 | 1037 |
| TGME49_chrXI | 5728987 | 5730625 | + | ID = TGME49_217000; length = 1638 | 1038 |
| TGME49_chrXII | 4394111 | 4398427 | − | ID = TGME49_249240; length = 4316 | 1039 |
| TGME49_chrVIIa | 3976204 | 3977892 | − | ID = TGME49_201210; length = 1688 | 1040 |
| TGME49_chrIa | 135999 | 139033 | − | ID = TGME49_293170; length = 3034 | 1041 |
| TGME49_chrVIIb | 2446322 | 2450162 | − | ID = TGME49_260220; length = 3840 | 1042 |
| TGME49_chrXI | 4005065 | 4007884 | + | ID = TGME49_314330; length = 2819 | 1043 |
| TGME49_chrIV | 1721858 | 1725651 | + | ID = TGME49_211430; length = 3793 | 1044 |
| TGME49_chrVI | 1440256 | 1442654 | + | ID = TGME49_240780; length = 2398 | 1045 |
| TGME49_chrVIIb | 2309437 | 2311494 | + | ID = TGME49_260400; length = 2057 | 1046 |
| TGME49_chrVIII | 1057314 | 1061637 | + | ID = TGME49_230850; length = 4323 | 1047 |
| TGME49_chrVIIb | 3104595 | 3106681 | + | ID = TGME49_258880; length = 2086 | 1048 |
| TGME49_chrIX | 3553898 | 3558050 | + | ID = TGME49_289970; length = 4152 | 1049 |
| TGME49_chrVIIb | 747456 | 750990 | − | ID = TGME49_263180; length = 3534 | 1050 |
| TGME49_chrIb | 508499 | 510809 | + | ID = TGME49_208010; length = 2310 | 1051 |
| TGME49_chrVIII | 3403939 | 3407719 | − | ID = TGME49_273560; length = 3780 | 1052 |
| TGME49_chrVIIb | 2328258 | 2331030 | − | ID = TGME49_260380; length = 2772 | 1053 |
| TGME49_chrIX | 5447569 | 5449517 | + | ID = TGME49_305520; length = 1948 | 1054 |
| TGME49_chrXII | 4540898 | 4544602 | − | ID = TGME49_249440; length = 3704 | 1055 |
| TGME49_chrIX | 1180662 | 1185700 | − | ID = TGME49_266380; length = 5038 | 1056 |
| TGME49_chrII | 741431 | 743464 | − | ID = TGME49_221990; length = 2033 | 1057 |
| TGME49_chrIX | 3302423 | 3304195 | − | ID = TGME49_289550; length = 1772 | 1058 |
| TGME49_chrXII | 5163344 | 5167027 | − | ID = TGME49_250740; length = 3683 | 1059 |
| TGME49_chrIb | 1364877 | 1366149 | − | ID = TGME49_209620; length = 1272 | 1060 |
| TGME49_chrVIIb | 858403 | 860259 | + | ID = TGME49_263020; length = 1856 | 1061 |
| TGME49_chrVI | 2080861 | 2082634 | − | ID = TGME49_242580; length = 1773 | 1062 |
| TGME49_chrXI | 5126509 | 5128203 | + | ID = TGME49_316100; length = 1694 | 1063 |
| TGME49_chrVIIb | 2142072 | 2145018 | + | ID = TGME49_260580; length = 2946 | 1064 |
| TGME49_chrXII | 2685283 | 2687256 | + | ID = TGME49_246150; length = 1973 | 1065 |
| TGME49_chrVI | 110307 | 112590 | + | ID = TGME49_238190; length = 2283 | 1066 |
| TGME49_chrVIII | 2837478 | 2839433 | − | ID = TGME49_233830; length = 1955 | 1067 |
| TGME49_chrX | 867923 | 871948 | + | ID = TGME49_227615; length = 4025 | 1068 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 5071223 | 5073998 | − | ID = TGME49_304880; length = 2775 | 1069 |
| TGME49_chrVIII | 2090890 | 2095794 | − | ID = TGME49_232430; length = 4904 | 1070 |
| TGME49_chrVIIb | 2781631 | 2784134 | − | ID = TGME49_259550; length = 2503 | 1071 |
| TGME49_chrX | 193904 | 195964 | + | ID = TGME49_228690; length = 2060 | 1072 |
| TGME49_chrIa | 1059712 | 1062031 | − | ID = TGME49_294670; length = 2319 | 1073 |
| TGME49_chrVIIa | 3890344 | 3893030 | + | ID = TGME49_201520; length = 2686 | 1074 |
| TGME49_chrIX | 5214676 | 5217074 | + | ID = TGME49_305100; length = 2398 | 1075 |
| TGME49_chrVIIa | 899877 | 902361 | + | ID = TGME49_206520; length = 2484 | 1076 |
| TGME49_chrIX | 3539347 | 3541778 | − | ID = TGME49_289940; length = 2431 | 1077 |
| TGME49_chrVIIb | 4528811 | 4530770 | − | ID = TGME49_256080; length = 1959 | 1078 |
| TGME49_chrVIII | 110877 | 112644 | − | ID = TGME49_229250; length = 1767 | 1079 |
| TGME49_chrXI | 2296765 | 2300817 | + | ID = TGME49_311810; length = 4052 | 1080 |
| TGME49_chrXI | 2742958 | 2745345 | − | ID = TGME49_312500; length = 2387 | 1081 |
| TGME49_chrV | 417057 | 419288 | + | ID = TGME49_220500; length = 2231 | 1082 |
| TGME49_chrVIIb | 2057525 | 2060480 | + | ID = TGME49_260680; length = 2955 | 1083 |
| TGME49_chrIb | 746521 | 750200 | + | ID = TGME49_208530; length = 3679 | 1084 |
| TGME49_chrX | 5474968 | 5478116 | − | ID = TGME49_236650; length = 3148 | 1085 |
| TGME49_chrX | 5074937 | 5076733 | − | ID = TGME49_235710; length = 1796 | 1086 |
| TGME49_chrIb | 1282077 | 1283563 | + | ID = TGME49_209510; length = 1486 | 1087 |
| TGME49_chrIa | 617372 | 619206 | + | ID = TGME49_293870; length = 1834 | 1088 |
| TGME49_chrX | 5248755 | 5250532 | + | ID = TGME49_236040; length = 1777 | 1089 |
| TGME49_chrXII | 5288046 | 5290319 | − | ID = TGME49_250860; length = 2273 | 1090 |
| TGME49_chrIX | 2720225 | 2724939 | + | ID = TGME49_288750; length = 4714 | 1091 |
| TGME49_chrIX | 544999 | 547818 | + | ID = TGME49_267585; length = 2819 | 1092 |
| TGME49_chrVIIa | 1068023 | 1069996 | + | ID = TGME49_206310; length = 1973 | 1093 |
| TGME49_chrVI | 830758 | 833127 | + | ID = TGME49_239690; length = 2369 | 1094 |
| TGME49_chrIX | 2265055 | 2268965 | − | ID = TGME49_287960; length = 3910 | 1095 |
| TGME49_chrXI | 6087183 | 6089255 | − | ID = TGME49_216550; length = 2072 | 1096 |
| TGME49_chrIV | 2578257 | 2581065 | + | ID = TGME49_237840; length = 2808 | 1097 |
| TGME49_chrVIII | 991782 | 995395 | − | ID = TGME49_230705; length = 3613 | 1098 |
| TGME49_chrII | 1884186 | 1886034 | + | ID = TGME49_297643; length = 1848 | 1099 |
| TGME49_chrXI | 2312050 | 2313267 | + | ID = TGME49_311830; length = 1217 | 1100 |
| TGME49_chrII | 1254506 | 1256879 | + | ID = TGME49_222850; length = 2373 | 1101 |
| TGME49_chrII | 766484 | 768700 | + | ID = TGME49_222030; length = 2216 | 1102 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 1961088 | 1961769 | + | ID = TGME49_264850; length = 681 | 1103 |
| TGME49_chrVIII | 5344269 | 5348104 | − | ID = TGME49_270200; length = 3835 | 1104 |
| TGME49_chrVI | 1380775 | 1382606 | − | ID = TGME49_240660; length = 1831 | 1105 |
| TGME49_chrVIIb | 1804716 | 1807943 | + | ID = TGME49_261240; length = 3227 | 1106 |
| TGME49_chrX | 3382286 | 3386675 | + | ID = TGME49_224020; length = 4389 | 1107 |
| TGME49_chrXI | 1908342 | 1912400 | − | ID = TGME49_311240; length = 4058 | 1108 |
| TGME49_chrVIIa | 4438610 | 4442652 | + | ID = TGME49_282200; length = 4042 | 1109 |
| TGME49_chrIX | 5844712 | 5848045 | + | ID = TGME49_306230; length = 3333 | 1110 |
| TGME49_chrXI | 1502815 | 1504291 | − | ID = TGME49_310650; length = 1476 | 1111 |
| TGME49_chrXI | 1970355 | 1973898 | + | ID = TGME49_311320; length = 3543 | 1112 |
| TGME49_chrX | 2305695 | 2308125 | + | ID = TGME49_225330; length = 2430 | 1113 |
| TGME49_chrVIIb | 1736562 | 1738490 | − | ID = TGME49_261460; length = 1928 | 1114 |
| TGME49_chrXI | 2288840 | 2290926 | + | ID = TGME49_311790; length = 2086 | 1115 |
| TGME49_chrX | 5000703 | 5002026 | + | ID = TGME49_235635; length = 1323 | 1116 |
| TGME49_chrXI | 3051809 | 3053089 | + | ID = TGME49_313025; length = 1280 | 1117 |
| TGME49_chrV | 1226819 | 1229241 | − | ID = TGME49_213670; length = 2422 | 1118 |
| TGME49_chrVI | 1846930 | 1848152 | + | ID = TGME49_242040; length = 1222 | 1119 |
| TGME49_chrXI | 5127101 | 5129194 | − | ID = TGME49_316090; length = 2093 | 1120 |
| TGME49_chrVIIa | 489530 | 492510 | + | ID = TGME49_280370; length = 2980 | 1121 |
| TGME49_chrVIII | 2733118 | 2736128 | − | ID = TGME49_233702; length = 3010 | 1122 |
| TGME49_chrXI | 6398771 | 6401970 | − | ID = TGME49_216120; length = 3199 | 1123 |
| TGME49_chrXI | 530082 | 533588 | − | ID = TGME49_309160; length = 3506 | 1124 |
| TGME49_chrVIII | 428448 | 432358 | − | ID = TGME49_229750; length = 3910 | 1125 |
| TGME49_chrII | 2077832 | 2082637 | + | ID = TGME49_297850; length = 4805 | 1126 |
| TGME49_chrIV | 2088470 | 2090595 | − | ID = TGME49_210770; length = 2125 | 1127 |
| TGME49_chrIV | 1112801 | 1114995 | − | ID = TGME49_318742; length = 2194 | 1128 |
| TGME49_chrVIII | 2694512 | 2696420 | + | ID = TGME49_233530; length = 1908 | 1129 |
| TGME49_chrIb | 1392188 | 1394786 | − | ID = TGME49_209650; length = 2598 | 1130 |
| TGME49_chrV | 469162 | 470010 | + | ID = TGME49_220580; length = 848 | 1131 |
| TGME49_chrIX | 2034098 | 2036991 | + | ID = TGME49_264770; length = 2893 | 1132 |
| TGME49_chrVIII | 2855966 | 2857966 | − | ID = TGME49_233850; length = 2000 | 1133 |
| TGME49_chrXI | 1595350 | 1597733 | + | ID = TGME49_310798; length = 2383 | 1134 |
| TGME49_chrIX | 5541500 | 5543417 | + | ID = TGME49_305750; length = 1917 | 1135 |
| TGME49_chrIX | 4142523 | 4144608 | + | ID = TGME49_291130; length = 2085 | 1136 |
| TGME49_chrVIIb | 790933 | 792672 | + | ID = TGME49_263110; length = 1739 | 1137 |
| TGME49_chrVIIa | 2210477 | 2211546 | − | ID = TGME49_203815; length = 1069 | 1138 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 4063764 | 4065564 | + | ID = TGME49_272340; length = 1800 | 1139 |
| TGME49_chrIX | 862193 | 864770 | + | ID = TGME49_266970; length = 2577 | 1140 |
| TGME49_chrX | 6005350 | 6009045 | − | ID = TGME49_237585; length = 3695 | 1141 |
| TGME49_chrIV | 812682 | 816552 | − | ID = TGME49_319650; length = 3870 | 1142 |
| TGME49_chrIV | 1351025 | 1353144 | + | ID = TGME49_318410; length = 2119 | 1143 |
| TGME49_chrVIIb | 628035 | 632181 | + | ID = TGME49_263323; length = 4146 | 1144 |
| TGME49_chrII | 464340 | 467546 | + | ID = TGME49_221590; length = 3206 | 1145 |
| TGME49_chrVIIa | 2353189 | 2355787 | − | ID = TGME49_203682; length = 2598 | 1146 |
| TGME49_chrIa | 1365331 | 1367979 | + | ID = TGME49_295060; length = 2648 | 1147 |
| TGME49_chrXI | 3086379 | 3090390 | + | ID = TGME49_313090; length = 4011 | 1148 |
| TGME49_chrII | 639786 | 644118 | + | ID = TGME49_221870; length = 4332 | 1149 |
| TGME49_chrIV | 1283541 | 1287463 | − | ID = TGME49_318490; length = 3922 | 1150 |
| TGME49_chrX | 2544948 | 2548532 | − | ID = TGME49_225070; length = 3584 | 1151 |
| TGME49_chrVIIb | 541912 | 545460 | − | ID = TGME49_263470; length = 3548 | 1152 |
| TGME49_chrIX | 3591560 | 3593074 | − | ID = TGME49_290020; length = 1514 | 1153 |
| TGME49_chrX | 3928163 | 3932517 | − | ID = TGME49_212310; length = 4354 | 1154 |
| TGME49_chrVIIb | 4701292 | 4702972 | − | ID = TGME49_255720; length = 1680 | 1155 |
| TGME49_chrVIII | 5506593 | 5510411 | + | ID = TGME49_269940; length = 3818 | 1156 |
| TGME49_chrIV | 592700 | 595047 | + | ID = TGME49_320005; length = 2347 | 1157 |
| TGME49_chrVIIb | 4519629 | 4521475 | − | ID = TGME49_256100; length = 1846 | 1158 |
| TGME49_chrIa | 1848533 | 1850781 | − | ID = TGME49_295320; length = 2248 | 1159 |
| TGME49_chrX | 3761112 | 3762929 | − | ID = TGME49_223530; length = 1817 | 1160 |
| TGME49_chrVIII | 3839250 | 3840966 | − | ID = TGME49_272620; length = 1716 | 1161 |
| TGME49_chrX | 5533324 | 5536592 | + | ID = TGME49_236850; length = 3268 | 1162 |
| TGME49_chrX | 5233291 | 5235370 | − | ID = TGME49_235990; length = 2079 | 1163 |
| TGME49_chrIb | 1816564 | 1818369 | + | ID = TGME49_321430; length = 1805 | 1164 |
| TGME49_chrXI | 3327009 | 3329669 | + | ID = TGME49_313380; length = 2660 | 1165 |
| TGME49_chrIX | 3363488 | 3365112 | + | ID = TGME49_289650; length = 1624 | 1166 |
| TGME49_chrV | 287641 | 288269 | − | ID = TGME49_220310; length = 628 | 1167 |
| TGME49_chrII | 2077832 | 2079808 | + | ID = TGME49_297845; length = 1976 | 1168 |
| TGME49_chrVIIb | 3657735 | 3659476 | + | ID = TGME49_258000; length = 1741 | 1169 |
| TGME49_chrIX | 2039013 | 2043206 | + | ID = TGME49_264760; length = 4193 | 1170 |
| TGME49_chrXII | 6988840 | 6990981 | + | ID = TGME49_276810; length = 2141 | 1171 |
| TGME49_chrIX | 3612365 | 3615024 | − | ID = TGME49_290160; length = 2659 | 1172 |
| TGME49_chrIa | 1259545 | 1263126 | − | ID = TGME49_294898; length = 3581 | 1173 |
| TGME49_chrXI | 6165715 | 6166848 | + | ID = TGME49_216415; length = 1133 | 1174 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 3511489 | 3512915 | − | ID = TGME49_289890; length = 1426 | 1175 |
| TGME49_chrIX | 1748283 | 1752414 | + | ID = TGME49_265130; length = 4131 | 1176 |
| TGME49_chrIV | 1015278 | 1019035 | + | ID = TGME49_319340; length = 3757 | 1177 |
| TGME49_chrVI | 905412 | 908079 | − | ID = TGME49_239770; length = 2667 | 1178 |
| TGME49_chrXI | 570018 | 574932 | − | ID = TGME49_309220; length = 4914 | 1179 |
| TGME49_chrVIII | 2228983 | 2231436 | + | ID = TGME49_232690; length = 2453 | 1180 |
| TGME49_chrXI | 3756375 | 3758818 | + | ID = TGME49_313870; length = 2443 | 1181 |
| TGME49_chrXI | 1683330 | 1684845 | − | ID = TGME49_310940; length = 1515 | 1182 |
| TGME49_chrIb | 802516 | 804677 | − | ID = TGME49_208580; length = 2161 | 1183 |
| TGME49_chrV | 3073350 | 3075701 | − | ID = TGME49_283580; length = 2351 | 1184 |
| TGME49_chrIX | 2433199 | 2434876 | − | ID = TGME49_288270; length = 1677 | 1185 |
| TGME49_chrVIII | 5247499 | 5249101 | + | ID = TGME49_270360; length = 1602 | 1186 |
| TGME49_chrIa | 538347 | 541224 | + | ID = TGME49_293740; length = 2877 | 1187 |
| TGME49_chrXI | 1034402 | 1037980 | − | ID = TGME49_310055; length = 3578 | 1188 |
| TGME49_chrVIII | 4273765 | 4277392 | + | ID = TGME49_271930; length = 3627 | 1189 |
| TGME49_chrX | 3942210 | 3943072 | + | ID = TGME49_212280; length = 862 | 1190 |
| TGME49_chrXI | 6427213 | 6429335 | − | ID = TGME49_216060; length = 2122 | 1191 |
| TGME49_chrVIII | 5776984 | 5780816 | − | ID = TGME49_269470; length = 3832 | 1192 |
| TGME49_chrVI | 1334066 | 1335457 | + | ID = TGME49_240600; length = 1391 | 1193 |
| TGME49_chrVIIa | 4234959 | 4237402 | + | ID = TGME49_281640; length = 2443 | 1194 |
| TGME49_chrV | 1240541 | 1242474 | + | ID = TGME49_213700; length = 1933 | 1195 |
| TGME49_chrX | 1079054 | 1081448 | − | ID = TGME49_227140; length = 2394 | 1196 |
| TGME49_chrXII | 2362341 | 2363912 | − | ID = TGME49_245540; length = 1571 | 1197 |
| TGME49_chrVIIb | 4735950 | 4738492 | − | ID = TGME49_255690; length = 2542 | 1198 |
| TGME49_chrVIIb | 215535 | 217628 | − | ID = TGME49_264060; length = 2093 | 1199 |
| TGME49_chrXI | 3767685 | 3770308 | + | ID = TGME49_313880; length = 2623 | 1200 |
| TGME49_chrVIIb | 382525 | 387001 | − | ID = TGME49_263710; length = 4476 | 1201 |
| TGME49_chrVIII | 3764146 | 3769011 | − | ID = TGME49_272730; length = 4865 | 1202 |
| TGME49_chrVIII | 2518242 | 2523170 | + | ID = TGME49_233230; length = 4928 | 1203 |
| TGME49_chrX | 2512981 | 2514745 | + | ID = TGME49_225105; length = 1764 | 1204 |
| TGME49_chrX | 1747337 | 1749496 | + | ID = TGME49_226270; length = 2159 | 1205 |
| TGME49_chrXI | 2556450 | 2561384 | + | ID = TGME49_312280; length = 4934 | 1206 |
| TGME49_chrXI | 1508511 | 1511130 | + | ID = TGME49_310670; length = 2619 | 1207 |
| TGME49_chrX | 1357073 | 1358633 | − | ID = TGME49_226800; length = 1560 | 1208 |
| TGME49_chrXII | 1856018 | 1859951 | − | ID = TGME49_217460; length = 3933 | 1209 |
| TGME49_chrVI | 1032113 | 1035230 | + | ID = TGME49_240060; length = 3117 | 1210 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 4750240 | 4753174 | − | ID = TGME49_255660; length = 2934 | 1211 |
| TGME49_chrIV | 2488322 | 2491013 | + | ID = TGME49_301450; length = 2691 | 1212 |
| TGME49_chrVIIa | 2399437 | 2401178 | + | ID = TGME49_203610; length = 1741 | 1213 |
| TGME49_chrIV | 717427 | 720591 | − | ID = TGME49_319870; length = 3164 | 1214 |
| TGME49_chrIX | 633939 | 636510 | + | ID = TGME49_267450; length = 2571 | 1215 |
| TGME49_chrII | 1064277 | 1067130 | − | ID = TGME49_222350; length = 2853 | 1216 |
| TGME49_chrX | 6587512 | 6589629 | − | ID = TGME49_214910; length = 2117 | 1217 |
| TGME49_chrVIIb | 1100273 | 1103123 | + | ID = TGME49_262650; length = 2850 | 1218 |
| TGME49_chrX | 4019693 | 4021700 | − | ID = TGME49_212150; length = 2007 | 1219 |
| TGME49_chrIV | 910057 | 912578 | + | ID = TGME49_319560; length = 2521 | 1220 |
| TGME49_chrXI | 5954623 | 5956672 | + | ID = TGME49_216680; length = 2049 | 1221 |
| TGME49_chrVIIb | 936733 | 939153 | + | ID = TGME49_262900; length = 2420 | 1222 |
| TGME49_chrIX | 2624481 | 2626169 | + | ID = TGME49_288580; length = 1688 | 1223 |
| TGME49_chrX | 6117985 | 6120211 | + | ID = TGME49_214220; length = 2226 | 1224 |
| TGME49_chrIX | 4670575 | 4671677 | − | ID = TGME49_292310; length = 1102 | 1225 |
| TGME49_chrVIIa | 1586701 | 1588039 | + | ID = TGME49_205140; length = 1338 | 1226 |
| TGME49_chrV | 343813 | 347336 | − | ID = TGME49_220380; length = 3523 | 1227 |
| TGME49_chrVIIa | 2824543 | 2828105 | − | ID = TGME49_203060; length = 3562 | 1228 |
| TGME49_chrVI | 2842072 | 2843767 | − | ID = TGME49_243750; length = 1695 | 1229 |
| TGME49_chrXII | 5901664 | 5905896 | − | ID = TGME49_278757; length = 4232 | 1230 |
| TGME49_chrIX | 864169 | 866128 | − | ID = TGME49_266980; length = 1959 | 1231 |
| TGME49_chrV | 405382 | 408887 | − | ID = TGME49_220470; length = 3505 | 1232 |
| TGME49_chrVIIb | 2512076 | 2514420 | − | ID = TGME49_260140; length = 2344 | 1233 |
| TGME49_chrVI | 2098336 | 2100722 | − | ID = TGME49_242600; length = 2386 | 1234 |
| TGME49_chrX | 1508884 | 1511053 | − | ID = TGME49_226610; length = 2169 | 1235 |
| TGME49_chrVIIa | 2043666 | 2046086 | + | ID = TGME49_204020; length = 2420 | 1236 |
| TGME49_chrVIIb | 1030528 | 1035441 | + | ID = TGME49_262760; length = 4913 | 1237 |
| TGME49_chrIa | 906891 | 908355 | − | ID = TGME49_294420; length = 1464 | 1238 |
| TGME49_chrIX | 3949096 | 3950443 | − | ID = TGME49_290925; length = 1347 | 1239 |
| TGME49_chrV | 2021160 | 2025024 | + | ID = TGME49_286060; length = 3864 | 1240 |
| TGME49_chrXI | 3334286 | 3335654 | − | ID = TGME49_313385; length = 1368 | 1241 |
| TGME49_chrIX | 4592337 | 4595459 | − | ID = TGME49_292170; length = 3122 | 1242 |
| TGME49_chrXII | 883327 | 885042 | − | ID = TGME49_219530; length = 1715 | 1243 |
| TGME49_chrVIIa | 646040 | 650529 | + | ID = TGME49_304720; length = 4489 | 1244 |
| TGME49_chrXII | 2582968 | 2583778 | + | ID = TGME49_245995; length = 810 | 1245 |
| TGME49_chrVIIa | 1492534 | 1497097 | + | ID = TGME49_205280; length = 4563 | 1246 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 6529292 | 6532178 | − | ID = TGME49_268340; length = 2886 | 1247 |
| TGME49_chrX | 1775473 | 1776642 | − | ID = TGME49_226240; length = 1169 | 1248 |
| TGME49_chrX | 3282886 | 3287547 | + | ID = TGME49_224160; length = 4661 | 1249 |
| TGME49_chrXI | 6397920 | 6400037 | + | ID = TGME49_216090; length = 2117 | 1250 |
| TGME49_chrVI | 2706529 | 2711143 | + | ID = TGME49_243545; length = 4614 | 1251 |
| TGME49_chrXI | 416696 | 419057 | − | ID = TGME49_308980; length = 2361 | 1252 |
| TGME49_chrIb | 1342257 | 1346867 | + | ID = TGME49_209580; length = 4610 | 1253 |
| TGME49_chrX | 5509755 | 5511547 | − | ID = TGME49_236790; length = 1792 | 1254 |
| TGME49_chrXI | 463158 | 465197 | − | ID = TGME49_309050; length = 2039 | 1255 |
| TGME49_chrVI | 256977 | 258317 | − | ID = TGME49_238505; length = 1340 | 1256 |
| TGME49_chrX | 6916813 | 6920734 | − | ID = TGME49_215343; length = 3921 | 1257 |
| TGME49_chrXII | 4789347 | 4790800 | + | ID = TGME49_249770; length = 1453 | 1258 |
| TGME49_chrXII | 2221509 | 2225506 | − | ID = TGME49_217910; length = 3997 | 1259 |
| TGME49_chrXII | 635109 | 638817 | − | ID = TGME49_219810; length = 3708 | 1260 |
| TGME49_chrX | 996966 | 1001699 | − | ID = TGME49_227360; length = 4733 | 1261 |
| TGME49_chrXII | 4759357 | 4761502 | − | ID = TGME49_249720; length = 2145 | 1262 |
| TGME49_chrVIII | 880481 | 882435 | − | ID = TGME49_230580; length = 1954 | 1263 |
| TGME49_chrVIIa | 2393820 | 2395507 | − | ID = TGME49_203630; length = 1687 | 1264 |
| TGME49_chrX | 3969673 | 3972540 | − | ID = TGME49_212230; length = 2867 | 1265 |
| TGME49_chrVIIa | 3730718 | 3732764 | + | ID = TGME49_201870; length = 2046 | 1266 |
| TGME49_chrVIII | 1001169 | 1003387 | + | ID = TGME49_230820; length = 2218 | 1267 |
| TGME49_chrIX | 4600674 | 4601980 | − | ID = TGME49_292190; length = 1306 | 1268 |
| TGME49_chrIV | 1318793 | 1321000 | − | ID = TGME49_318460; length = 2207 | 1269 |
| TGME49_chrXII | 5008645 | 5010570 | − | ID = TGME49_250050; length = 1925 | 1270 |
| TGME49_chrVIII | 2821108 | 2824516 | + | ID = TGME49_233820; length = 3408 | 1271 |
| TGME49_chrVIIa | 945242 | 947003 | + | ID = TGME49_206470; length = 1761 | 1272 |
| TGME49_chrVIIa | 618512 | 620275 | − | ID = TGME49_304670; length = 1763 | 1273 |
| TGME49_chrXI | 5431083 | 5433154 | − | ID = TGME49_316610; length = 2071 | 1274 |
| TGME49_chrXI | 3894915 | 3897284 | + | ID = TGME49_314042; length = 2369 | 1275 |
| TGME49_chrVI | 613785 | 617334 | − | ID = TGME49_239885; length = 3549 | 1276 |
| TGME49_chrXII | 6080645 | 6082084 | + | ID = TGME49_278470; length = 1439 | 1277 |
| TGME49_chrXII | 4530057 | 4533822 | − | ID = TGME49_249425; length = 3765 | 1278 |
| TGME49_chrVIIb | 4983552 | 4986683 | − | ID = TGME49_255240; length = 3131 | 1279 |
| TGME49_chrIX | 6162509 | 6166258 | + | ID = TGME49_306540; length = 3749 | 1280 |
| TGME49_chrVIII | 1191790 | 1195369 | − | ID = TGME49_231000; length = 3579 | 1281 |
| TGME49_chrVIIb | 2539671 | 2543923 | − | ID = TGME49_260000; length = 4252 | 1282 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 849810 | 852648 | − | ID = TGME49_263060; length = 2838 | 1283 |
| TGME49_chrVIIb | 648112 | 651155 | − | ID = TGME49_263300; length = 3043 | 1284 |
| TGME49_chrIX | 3384763 | 3389725 | + | ID = TGME49_289710; length = 4962 | 1285 |
| TGME49_chrIV | 1667704 | 1671687 | − | ID = TGME49_211610; length = 3983 | 1286 |
| TGME49_chrVI | 3370670 | 3372867 | − | ID = TGME49_244570; length = 2197 | 1287 |
| TGME49_chrIa | 1384531 | 1387176 | − | ID = TGME49_295070; length = 2645 | 1288 |
| TGME49_chrII | 1380736 | 1382666 | + | ID = TGME49_223045; length = 1930 | 1289 |
| TGME49_chrVIIa | 4051293 | 4053186 | − | ID = TGME49_281370; length = 1893 | 1290 |
| TGME49_chrX | 3955985 | 3958323 | + | ID = TGME49_212250; length = 2338 | 1291 |
| TGME49_chrVI | 320087 | 321893 | − | ID = TGME49_238930; length = 1806 | 1292 |
| TGME49_chrV | 1821412 | 1825437 | + | ID = TGME49_286450; length = 4025 | 1293 |
| TGME49_chrX | 4558668 | 4561661 | − | ID = TGME49_234950; length = 2993 | 1294 |
| TGME49_chrIX | 1512833 | 1516330 | + | ID = TGME49_265510; length = 3497 | 1295 |
| TGME49_chrVIII | 6794045 | 6796697 | + | ID = TGME49_200320; length = 2652 | 1296 |
| TGME49_chrX | 6978264 | 6981039 | + | ID = TGME49_215490; length = 2775 | 1297 |
| TGME49_chrX | 2174211 | 2176205 | − | ID = TGME49_225540; length = 1994 | 1298 |
| TGME49_chrVIII | 1298224 | 1302758 | + | ID = TGME49_231180; length = 4534 | 1299 |
| TGME49_chrII | 2142882 | 2147668 | − | ID = TGME49_297960; length = 4786 | 1300 |
| TGME49_chrXII | 3433690 | 3435922 | + | ID = TGME49_247600; length = 2232 | 1301 |
| TGME49_chrVIIa | 2317501 | 2320428 | − | ID = TGME49_203700; length = 2927 | 1302 |
| TGME49_chrXII | 6674607 | 6677822 | − | ID = TGME49_277490; length = 3215 | 1303 |
| TGME49_chrXI | 4233721 | 4237966 | − | ID = TGME49_314700; length = 4245 | 1304 |
| TGME49_chrIV | 425592 | 427430 | − | ID = TGME49_320230; length = 1838 | 1305 |
| TGME49_chrVIIa | 2514862 | 2517330 | − | ID = TGME49_203420; length = 2468 | 1306 |
| TGME49_chrIX | 4579461 | 4584034 | − | ID = TGME49_292140; length = 4573 | 1307 |
| TGME49_chrXII | 5609336 | 5612206 | + | ID = TGME49_251850; length = 2870 | 1308 |
| TGME49_chrVIIb | 2348892 | 2349464 | + | ID = TGME49_260330; length = 572 | 1309 |
| TGME49_chrVI | 1829041 | 1831040 | − | ID = TGME49_242010; length = 1999 | 1310 |
| TGME49_chrVIII | 2298908 | 2301088 | + | ID = TGME49_232970; length = 2180 | 1311 |
| TGME49_chrVIIb | 5051588 | 5052399 | + | ID = TGME49_255175; length = 811 | 1312 |
| TGME49_chrX | 1835017 | 1837256 | − | ID = TGME49_226068; length = 2239 | 1313 |
| TGME49_chrXI | 3842477 | 3844120 | − | ID = TGME49_313960; length = 1643 | 1314 |
| TGME49_chrVIIb | 821627 | 824086 | − | ID = TGME49_263085; length = 2459 | 1315 |
| TGME49_chrIV | 250795 | 252483 | + | ID = TGME49_320570; length = 1688 | 1316 |
| TGME49_chrX | 2164468 | 2166075 | − | ID = TGME49_225555; length = 1607 | 1317 |
| TGME49_chrX | 1105074 | 1106948 | − | ID = TGME49_227070; length = 1874 | 1318 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 1404269 | 1407193 | + | ID = TGME49_262050; length = 2924 | 1319 |
| TGME49_chrIX | 599004 | 602300 | + | ID = TGME49_267520; length = 3296 | 1320 |
| TGME49_chrVIIa | 3270410 | 3274311 | − | ID = TGME49_202510; length = 3901 | 1321 |
| TGME49_chrVIII | 3516693 | 3521323 | + | ID = TGME49_273410; length = 4630 | 1322 |
| TGME49_chrV | 2626675 | 2628503 | + | ID = TGME49_284670; length = 1828 | 1323 |
| TGME49_chrX | 7344849 | 7347942 | − | ID = TGME49_207020; length = 3093 | 1324 |
| TGME49_chrVIIa | 1741358 | 1745785 | + | ID = TGME49_204500; length = 4427 | 1325 |
| TGME49_chrXI | 4646243 | 4648666 | − | ID = TGME49_315310; length = 2423 | 1326 |
| TGME49_chrVIIb | 4281282 | 4283353 | + | ID = TGME49_257010; length = 2071 | 1327 |
| TGME49_chrIb | 1755720 | 1757922 | + | ID = TGME49_321520; length = 2202 | 1328 |
| TGME49_chrX | 6940384 | 6941995 | + | ID = TGME49_215400; length = 1611 | 1329 |
| TGME49_chrVI | 1108072 | 1112890 | − | ID = TGME49_240243; length = 4818 | 1330 |
| TGME49_chrXII | 4472490 | 4474867 | − | ID = TGME49_249340; length = 2377 | 1331 |
| TGME49_chrVIIa | 970566 | 973439 | − | ID = TGME49_206450; length = 2873 | 1332 |
| TGME49_chrIb | 601001 | 603218 | + | ID = TGME49_208300; length = 2217 | 1333 |
| TGME49_chrIX | 5762838 | 5764549 | + | ID = TGME49_306035; length = 1711 | 1334 |
| TGME49_chrIX | 653845 | 657554 | − | ID = TGME49_267440; length = 3709 | 1335 |
| TGME49_chrX | 2967494 | 2971910 | + | ID = TGME49_224570; length = 4416 | 1336 |
| TGME49_chrVIII | 5286926 | 5289744 | − | ID = TGME49_270310; length = 2818 | 1337 |
| TGME49_chrVIII | 1877930 | 1881330 | + | ID = TGME49_232130; length = 3400 | 1338 |
| TGME49_chrXI | 852387 | 855185 | − | ID = TGME49_309865; length = 2798 | 1339 |
| TGME49_chrXI | 6261741 | 6265340 | + | ID = TGME49_216280; length = 3599 | 1340 |
| TGME49_chrX | 2712114 | 2714287 | − | ID = TGME49_224890; length = 2173 | 1341 |
| TGME49_chrXII | 2592707 | 2596028 | − | ID = TGME49_246010; length = 3321 | 1342 |
| TGME49_chrX | 1673837 | 1675489 | + | ID = TGME49_226380; length = 1652 | 1343 |
| TGME49_chrXII | 4784125 | 4785752 | − | ID = TGME49_249750; length = 1627 | 1344 |
| TGME49_chrVIIb | 1379649 | 1382568 | + | ID = TGME49_262090; length = 2919 | 1345 |
| TGME49_chrVIIb | 292075 | 294154 | − | ID = TGME49_263850; length = 2079 | 1346 |
| TGME49_chrXII | 2582968 | 2585062 | + | ID = TGME49_246000; length = 2094 | 1347 |
| TGME49_chrIX | 5480897 | 5483034 | − | ID = TGME49_305580; length = 2137 | 1348 |
| TGME49_chrIX | 678959 | 682427 | + | ID = TGME49_267370; length = 3468 | 1349 |
| TGME49_chrIX | 1283348 | 1288325 | − | ID = TGME49_266130; length = 4977 | 1350 |
| TGME49_chrXI | 6528191 | 6531898 | + | ID = TGME49_215910; length = 3707 | 1351 |
| TGME49_chrVIIb | 4536725 | 4538969 | + | ID = TGME49_256060; length = 2244 | 1352 |
| TGME49_chrIX | 800121 | 801864 | + | ID = TGME49_267050; length = 1743 | 1353 |
| TGME49_chrXI | 2857820 | 2862733 | + | ID = TGME49_312635; length = 4913 | 1354 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 2173780 | 2176161 | − | ID = TGME49_203870; length = 2381 | 1355 |
| TGME49_chrV | 1761372 | 1763556 | + | ID = TGME49_286610; length = 2184 | 1356 |
| TGME49_chrVIII | 2657912 | 2660930 | + | ID = TGME49_233450; length = 3018 | 1357 |
| TGME49_chrVIIa | 2656175 | 2659506 | + | ID = TGME49_203230; length = 3331 | 1358 |
| TGME49_chrVIIb | 3927316 | 3929847 | − | ID = TGME49_257670; length = 2531 | 1359 |
| TGME49_chrIX | 2429266 | 2431241 | − | ID = TGME49_288265; length = 1975 | 1360 |
| TGME49_chrVIII | 2207468 | 2209626 | − | ID = TGME49_232650; length = 2158 | 1361 |
| TGME49_chrIV | 482747 | 486460 | − | ID = TGME49_320130; length = 3713 | 1362 |
| TGME49_chrVIIb | 1792513 | 1796589 | − | ID = TGME49_261300; length = 4076 | 1363 |
| TGME49_chrX | 6083410 | 6086247 | + | ID = TGME49_214180; length = 2837 | 1364 |
| TGME49_chrX | 6748004 | 6750095 | − | ID = TGME49_215080; length = 2091 | 1365 |
| TGME49_chrX | 4919793 | 4924423 | − | ID = TGME49_235500; length = 4630 | 1366 |
| TGME49_chrVIIa | 3365745 | 3369481 | − | ID = TGME49_202390; length = 3736 | 1367 |
| TGME49_chrVIIa | 88266 | 91194 | + | ID = TGME49_280780; length = 2928 | 1368 |
| TGME49_chrXII | 6725504 | 6728703 | − | ID = TGME49_277080; length = 3199 | 1369 |
| TGME49_chrVIII | 5699778 | 5702719 | + | ID = TGME49_269660; length = 2941 | 1370 |
| TGME49_chrIV | 101470 | 104091 | + | ID = TGME49_320740; length = 2621 | 1371 |
| TGME49_chrXI | 4317799 | 4319648 | − | ID = TGME49_314820; length = 1849 | 1372 |
| TGME49_chrIb | 1727396 | 1729180 | − | ID = TGME49_321570; length = 1784 | 1373 |
| TGME49_chrXI | 3841735 | 3843470 | + | ID = TGME49_313970; length = 1735 | 1374 |
| TGME49_chrVIIb | 3286431 | 3288841 | − | ID = TGME49_258650; length = 2410 | 1375 |
| TGME49_chrIX | 2706389 | 2708077 | − | ID = TGME49_288710; length = 1688 | 1376 |
| TGME49_chrX | 912881 | 916723 | − | ID = TGME49_227570; length = 3842 | 1377 |
| TGME49_chrVIIb | 1762209 | 1764225 | + | ID = TGME49_261410; length = 2016 | 1378 |
| TGME49_chrXI | 2723240 | 2725414 | + | ID = TGME49_312490; length = 2174 | 1379 |
| TGME49_chrIX | 932063 | 933944 | − | ID = TGME49_266840; length = 1881 | 1380 |
| TGME49_chrIa | 296552 | 299464 | + | ID = TGME49_293390; length = 2912 | 1381 |
| TGME49_chrVI | 3125605 | 3127814 | − | ID = TGME49_244210; length = 2209 | 1382 |
| TGME49_chrVIII | 2067930 | 2069608 | − | ID = TGME49_232380; length = 1678 | 1383 |
| TGME49_chrXI | 656827 | 661285 | + | ID = TGME49_309390; length = 4458 | 1384 |
| TGME49_chrXII | 1846841 | 1847991 | − | ID = TGME49_217450; length = 1150 | 1385 |
| TGME49_chrVIIb | 863548 | 865419 | + | ID = TGME49_263000; length = 1871 | 1386 |
| TGME49_chrXI | 900050 | 902305 | + | ID = TGME49_309920; length = 2255 | 1387 |
| TGME49_chrVIIb | 523777 | 525912 | + | ID = TGME49_263490; length = 2135 | 1388 |
| TGME49_chrIV | 452586 | 457475 | − | ID = TGME49_320170; length = 4889 | 1389 |
| TGME49_chrIX | 4345155 | 4348378 | − | ID = TGME49_291690; length = 3223 | 1390 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 5735321 | 5736518 | + | ID = TGME49_237140; length = 1197 | 1391 |
| TGME49_chrV | 971313 | 973576 | − | ID = TGME49_213380; length = 2263 | 1392 |
| TGME49_chrX | 3668011 | 3669970 | + | ID = TGME49_223660; length = 1959 | 1393 |
| TGME49_chrVIII | 2956529 | 2961446 | − | ID = TGME49_274170; length = 4917 | 1394 |
| TGME49_chrIb | 714291 | 719214 | + | ID = TGME49_208470; length = 4923 | 1395 |
| TGME49_chrXII | 4009400 | 4010849 | + | ID = TGME49_248580; length = 1449 | 1396 |
| TGME49_chrV | 2549712 | 2552335 | − | ID = TGME49_285190; length = 2623 | 1397 |
| TGME49_chrII | 1927281 | 1928097 | + | ID = TGME49_297700; length = 816 | 1398 |
| TGME49_chrVIII | 2689521 | 2690407 | − | ID = TGME49_233510; length = 886 | 1399 |
| TGME49_chrVIIa | 2220731 | 2225084 | + | ID = TGME49_203800; length = 4353 | 1400 |
| TGME49_chrVI | 2798189 | 2801702 | + | ID = TGME49_243700; length = 3513 | 1401 |
| TGME49_chrXI | 810675 | 812617 | + | ID = TGME49_309790; length = 1942 | 1402 |
| TGME49_chrIa | 521377 | 525024 | + | ID = TGME49_293720; length = 3647 | 1403 |
| TGME49_chrXII | 4275825 | 4279900 | + | ID = TGME49_248970; length = 4075 | 1404 |
| TGME49_chrII | 748920 | 750747 | − | ID = TGME49_222000; length = 1827 | 1405 |
| TGME49_chrIX | 4400803 | 4404708 | + | ID = TGME49_291920; length = 3905 | 1406 |
| TGME49_chrVIII | 5507253 | 5511071 | − | ID = TGME49_269950; length = 3818 | 1407 |
| TGME49_chrXII | 1398435 | 1401335 | − | ID = TGME49_218590; length = 2900 | 1408 |
| TGME49_chrVIIb | 1154398 | 1159024 | + | ID = TGME49_262568; length = 4626 | 1409 |
| TGME49_chrVIIb | 2834684 | 2838145 | − | ID = TGME49_259260; length = 3461 | 1410 |
| TGME49_chrVIIb | 1020393 | 1022780 | − | ID = TGME49_262800; length = 2387 | 1411 |
| TGME49_chrX | 871374 | 874994 | − | ID = TGME49_227620; length = 3620 | 1412 |
| TGME49_chrIa | 270952 | 273178 | + | ID = TGME49_293350; length = 2226 | 1413 |
| TGME49_chrXI | 4579521 | 4583971 | − | ID = TGME49_315210; length = 4450 | 1414 |
| TGME49_chrX | 2114737 | 2118243 | − | ID = TGME49_225710; length = 3506 | 1415 |
| TGME49_chrXI | 915530 | 919805 | − | ID = TGME49_309930; length = 4275 | 1416 |
| TGME49_chrVIII | 4874658 | 4879348 | − | ID = TGME49_270925; length = 4690 | 1417 |
| TGME49_chrVIIb | 2396904 | 2397972 | − | ID = TGME49_260280; length = 1068 | 1418 |
| TGME49_chrVIII | 4339933 | 4342675 | − | ID = TGME49_271840; length = 2742 | 1419 |
| TGME49_chrII | 1978826 | 1981903 | + | ID = TGME49_297760; length = 3077 | 1420 |
| TGME49_chrVI | 724098 | 726949 | + | ID = TGME49_239510; length = 2851 | 1421 |
| TGME49_chrVIII | 394955 | 397268 | − | ID = TGME49_229710; length = 2313 | 1422 |
| TGME49_chrX | 2538346 | 2540172 | + | ID = TGME49_225080; length = 1826 | 1423 |
| TGME49_chrX | 3957033 | 3959160 | − | ID = TGME49_212260; length = 2127 | 1424 |
| TGME49_chrVIII | 6036204 | 6038366 | − | ID = TGME49_269160; length = 2162 | 1425 |
| TGME49_chrIa | 1507041 | 1511154 | + | ID = TGME49_295770; length = 4113 | 1426 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 256069 | 257838 | − | ID = TGME49_280660; length = 1769 | 1427 |
| TGME49_chrXII | 876562 | 878297 | − | ID = TGME49_219540; length = 1735 | 1428 |
| TGME49_chrVIIa | 4386321 | 4390549 | − | ID = TGME49_282100; length = 4228 | 1429 |
| TGME49_chrX | 7344432 | 7346618 | + | ID = TGME49_207040; length = 2186 | 1430 |
| TGME49_chrVIII | 4560505 | 4562544 | + | ID = TGME49_271335; length = 2039 | 1431 |
| TGME49_chrXI | 4316863 | 4319362 | + | ID = TGME49_314830; length = 2499 | 1432 |
| TGME49_chrVIIb | 1422808 | 1424669 | − | ID = TGME49_262030; length = 1861 | 1433 |
| TGME49_chrVIII | 2285212 | 2287451 | − | ID = TGME49_232830; length = 2239 | 1434 |
| TGME49_chrVIIa | 3992533 | 3996332 | − | ID = TGME49_201170; length = 3799 | 1435 |
| TGME49_chrXI | 1004000 | 1006816 | + | ID = TGME49_310010; length = 2816 | 1436 |
| TGME49_chrIX | 5957299 | 5959752 | − | ID = TGME49_306310; length = 2453 | 1437 |
| TGME49_chrX | 7344432 | 7345679 | + | ID = TGME49_207030; length = 1247 | 1438 |
| TGME49_chrVIIb | 4253602 | 4256192 | + | ID = TGME49_257050; length = 2590 | 1439 |
| TGME49_chrX | 1452312 | 1454768 | − | ID = TGME49_226670; length = 2456 | 1440 |
| TGME49_chrV | 469797 | 472077 | − | ID = TGME49_220570; length = 2280 | 1441 |
| TGME49_chrIX | 2094408 | 2096713 | + | ID = TGME49_264710; length = 2305 | 1442 |
| TGME49_chrVIIa | 3662602 | 3666008 | + | ID = TGME49_202060; length = 3406 | 1443 |
| TGME49_chrXII | 3253841 | 3255658 | − | ID = TGME49_247320; length = 1817 | 1444 |
| TGME49_chrIb | 547531 | 550624 | − | ID = TGME49_208040; length = 3093 | 1445 |
| TGME49_chrIX | 2133128 | 2135664 | + | ID = TGME49_264660; length = 2536 | 1446 |
| TGME49_chrIX | 1292458 | 1295329 | − | ID = TGME49_266120; length = 2871 | 1447 |
| TGME49_chrXI | 1328980 | 1332607 | + | ID = TGME49_310430; length = 3627 | 1448 |
| TGME49_chrX | 6270785 | 6272853 | − | ID = TGME49_214370; length = 2068 | 1449 |
| TGME49_chrVIIb | 251585 | 254066 | − | ID = TGME49_264000; length = 2481 | 1450 |
| TGME49_chrVI | 1612726 | 1614168 | + | ID = TGME49_240990; length = 1442 | 1451 |
| TGME49_chrIX | 1530142 | 1532118 | − | ID = TGME49_265500; length = 1976 | 1452 |
| TGME49_chrIX | 6232749 | 6234329 | − | ID = TGME49_306630; length = 1580 | 1453 |
| TGME49_chrXI | 4753701 | 4755221 | + | ID = TGME49_315495; length = 1520 | 1454 |
| TGME49_chrVIIa | 3844338 | 3846794 | − | ID = TGME49_201700; length = 2456 | 1455 |
| TGME49_chrXII | 1058438 | 1061957 | − | ID = TGME49_219222; length = 3519 | 1456 |
| TGME49_chrVIII | 3632654 | 3634741 | + | ID = TGME49_273140; length = 2087 | 1457 |
| TGME49_chrVIII | 5032871 | 5035049 | − | ID = TGME49_270740; length = 2178 | 1458 |
| TGME49_chrIa | 89272 | 92865 | + | ID = TGME49_293010; length = 3593 | 1459 |
| TGME49_chrXII | 2686419 | 2690798 | − | ID = TGME49_246140; length = 4379 | 1460 |
| TGME49_chrXII | 2197081 | 2200494 | + | ID = TGME49_217880; length = 3413 | 1461 |
| TGME49_chrXI | 4536782 | 4540443 | + | ID = TGME49_315165; length = 3661 | 1462 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 727484 | 728939 | − | ID = TGME49_219690; length = 1455 | 1463 |
| TGME49_chrVIIb | 4699937 | 4702102 | + | ID = TGME49_255715; length = 2165 | 1464 |
| TGME49_chrVIIb | 4573700 | 4576785 | + | ID = TGME49_255980; length = 3085 | 1465 |
| TGME49_chrVIIb | 475047 | 477267 | − | ID = TGME49_263570; length = 2220 | 1466 |
| TGME49_chrV | 1705802 | 1710404 | + | ID = TGME49_286720; length = 4602 | 1467 |
| TGME49_chrV | 2326677 | 2329241 | − | ID = TGME49_285650; length = 2564 | 1468 |
| TGME49_chrIb | 1641650 | 1645144 | + | ID = TGME49_321660; length = 3494 | 1469 |
| TGME49_chrVIII | 2198843 | 2203273 | + | ID = TGME49_232640; length = 4430 | 1470 |
| TGME49_chrV | 1532883 | 1536115 | + | ID = TGME49_287180; length = 3232 | 1471 |
| TGME49_chrV | 1908950 | 1912837 | − | ID = TGME49_286230; length = 3887 | 1472 |
| TGME49_chrXII | 4413457 | 4417115 | + | ID = TGME49_249270; length = 3658 | 1473 |
| TGME49_chrIX | 5898832 | 5900782 | − | ID = TGME49_306250; length = 1950 | 1474 |
| TGME49_chrVIIb | 4154765 | 4156893 | − | ID = TGME49_257290; length = 2128 | 1475 |
| TGME49_chrVIII | 1268914 | 1270935 | + | ID = TGME49_231150; length = 2021 | 1476 |
| TGME49_chrVIIb | 971154 | 973119 | − | ID = TGME49_262870; length = 1965 | 1477 |
| TGME49_chrIV | 282678 | 285486 | + | ID = TGME49_320515; length = 2808 | 1478 |
| TGME49_chrXII | 6880772 | 6883692 | + | ID = TGME49_276880; length = 2920 | 1479 |
| TGME49_chrX | 6032756 | 6036014 | + | ID = TGME49_214110; length = 3258 | 1480 |
| TGME49_chrX | 4061115 | 4063643 | + | ID = TGME49_212100; length = 2528 | 1481 |
| TGME49_chrV | 2498999 | 2501500 | − | ID = TGME49_285240; length = 2501 | 1482 |
| TGME49_chrXII | 1724144 | 1728800 | − | ID = TGME49_218188; length = 4656 | 1483 |
| TGME49_chrIX | 5437186 | 5438779 | − | ID = TGME49_305485; length = 1593 | 1484 |
| TGME49_chrVIII | 6795589 | 6797461 | − | ID = TGME49_200310; length = 1872 | 1485 |
| TGME49_chrIX | 1829415 | 1830688 | − | ID = TGME49_265030; length = 1273 | 1486 |
| TGME49_chrVI | 1828265 | 1830308 | + | ID = TGME49_242020; length = 2043 | 1487 |
| TGME49_chrVIII | 2016463 | 2018840 | − | ID = TGME49_232320; length = 2377 | 1488 |
| TGME49_chrXI | 3740855 | 3743951 | − | ID = TGME49_313852; length = 3096 | 1489 |
| TGME49_chrVIIb | 4275109 | 4277123 | − | ID = TGME49_257030; length = 2014 | 1490 |
| TGME49_chrX | 6767981 | 6769751 | − | ID = TGME49_215120; length = 1770 | 1491 |
| TGME49_chrVIIa | 2075756 | 2076930 | + | ID = TGME49_203970; length = 1174 | 1492 |
| TGME49_chrVIIb | 2416856 | 2418383 | − | ID = TGME49_260260; length = 1527 | 1493 |
| TGME49_chrIX | 3779931 | 3784973 | + | ID = TGME49_290630; length = 5042 | 1494 |
| TGME49_chrVIIb | 581365 | 584740 | + | ID = TGME49_263390; length = 3375 | 1495 |
| TGME49_chrXII | 4466466 | 4468532 | − | ID = TGME49_249330; length = 2066 | 1496 |
| TGME49_chrII | 1858989 | 1860788 | + | ID = TGME49_297530; length = 1799 | 1497 |
| TGME49_chrII | 22256 | 25319 | − | ID = TGME49_220840; length = 3063 | 1498 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 3868643 | 3870136 | + | ID = TGME49_290730; length = 1493 | 1499 |
| TGME49_chrXI | 551152 | 554422 | + | ID = TGME49_309200; length = 3270 | 1500 |
| TGME49_chrIb | 1422277 | 1424478 | − | ID = TGME49_209730; length = 2201 | 1501 |
| TGME49_chrIX | 1830908 | 1832938 | + | ID = TGME49_265020; length = 2030 | 1502 |
| TGME49_chrXII | 2839463 | 2841372 | − | ID = TGME49_246535; length = 1909 | 1503 |
| TGME49_chrVIII | 5830510 | 5832051 | − | ID = TGME49_269413; length = 1541 | 1504 |
| TGME49_chrVIIb | 3160690 | 3162547 | + | ID = TGME49_258826; length = 1857 | 1505 |
| TGME49_chrXI | 4307313 | 4309840 | + | ID = TGME49_314810; length = 2527 | 1506 |
| TGME49_chrVIII | 406789 | 409738 | − | ID = TGME49_229730; length = 2949 | 1507 |
| TGME49_chrXII | 2456140 | 2459097 | + | ID = TGME49_245670; length = 2957 | 1508 |
| TGME49_chrVIIa | 2619487 | 2621645 | − | ID = TGME49_203290; length = 2158 | 1509 |
| TGME49_chrV | 1924282 | 1927117 | + | ID = TGME49_286190; length = 2835 | 1510 |
| TGME49_chrVI | 716743 | 721319 | + | ID = TGME49_239500; length = 4576 | 1511 |
| TGME49_chrX | 5770090 | 5772025 | − | ID = TGME49_237180; length = 1935 | 1512 |
| TGME49_chrXII | 2832970 | 2834932 | − | ID = TGME49_246520; length = 1962 | 1513 |
| TGME49_chrXII | 5499795 | 5502016 | − | ID = TGME49_251620; length = 2221 | 1514 |
| TGME49_chrVIII | 3996074 | 3999088 | + | ID = TGME49_272400; length = 3014 | 1515 |
| TGME49_chrIX | 1961567 | 1963588 | − | ID = TGME49_264860; length = 2021 | 1516 |
| TGME49_chrVIIa | 1028393 | 1032556 | + | ID = TGME49_206380; length = 4163 | 1517 |
| TGME49_chrX | 3004741 | 3008120 | − | ID = TGME49_224530; length = 3379 | 1518 |
| TGME49_chrII | 1710951 | 1714500 | − | ID = TGME49_297350; length = 3549 | 1519 |
| TGME49_chrV | 244391 | 246292 | + | ID = TGME49_220260; length = 1901 | 1520 |
| TGME49_chrX | 4446902 | 4449402 | − | ID = TGME49_234540; length = 2500 | 1521 |
| TGME49_chrVIII | 3410793 | 3412947 | + | ID = TGME49_273540; length = 2154 | 1522 |
| TGME49_chrXI | 3686190 | 3687061 | + | ID = TGME49_313775; length = 871 | 1523 |
| TGME49_chrIV | 1961999 | 1964761 | − | ID = TGME49_211030; length = 2762 | 1524 |
| TGME49_chrVIIb | 4217527 | 4220783 | + | ID = TGME49_257100; length = 3256 | 1525 |
| TGME49_chrIV | 2355261 | 2356404 | − | ID = TGME49_301260; length = 1143 | 1526 |
| TGME49_chrVIIb | 1978655 | 1980752 | + | ID = TGME49_261000; length = 2097 | 1527 |
| TGME49_chrXII | 1707434 | 1711430 | − | ID = TGME49_218195; length = 3996 | 1528 |
| TGME49_chrVI | 2626707 | 2630269 | − | ID = TGME49_243430; length = 3562 | 1529 |
| TGME49_chrVIIb | 3086523 | 3088120 | − | ID = TGME49_258930; length = 1597 | 1530 |
| TGME49_chrIb | 820471 | 822527 | − | ID = TGME49_208710; length = 2056 | 1531 |
| TGME49_chrX | 6097197 | 6099437 | − | ID = TGME49_214190; length = 2240 | 1532 |
| TGME49_chrX | 5747724 | 5750210 | − | ID = TGME49_237150; length = 2486 | 1533 |
| TGME49_chrIb | 1052146 | 1053746 | + | ID = TGME49_209120; length = 1600 | 1534 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 821098 | 823077 | + | ID = TGME49_263080; length = 1979 | 1535 |
| TGME49_chrXII | 1276521 | 1280802 | − | ID = TGME49_218830; length = 4281 | 1536 |
| TGME49_chrXII | 1314254 | 1315857 | − | ID = TGME49_218780; length = 1603 | 1537 |
| TGME49_chrVIII | 3808316 | 3811592 | + | ID = TGME49_272660; length = 3276 | 1538 |
| TGME49_chrXII | 3339927 | 3343970 | − | ID = TGME49_247440; length = 4043 | 1539 |
| TGME49_chrX | 669041 | 669809 | − | ID = TGME49_228020; length = 768 | 1540 |
| TGME49_chrIa | 1801426 | 1803846 | − | ID = TGME49_295380; length = 2420 | 1541 |
| TGME49_chrIX | 1152435 | 1155997 | + | ID = TGME49_266400; length = 3562 | 1542 |
| TGME49_chrXII | 4736176 | 4738097 | − | ID = TGME49_249685; length = 1921 | 1543 |
| TGME49_chrVIII | 6462646 | 6464783 | − | ID = TGME49_268400; length = 2137 | 1544 |
| TGME49_chrX | 2405925 | 2408633 | + | ID = TGME49_225200; length = 2708 | 1545 |
| TGME49_chrX | 4250667 | 4254283 | + | ID = TGME49_234270; length = 3616 | 1546 |
| TGME49_chrIV | 2580676 | 2583197 | − | ID = TGME49_237835; length = 2521 | 1547 |
| TGME49_chrX | 2837717 | 2842141 | − | ID = TGME49_224760; length = 4424 | 1548 |
| TGME49_chrVIIa | 1225490 | 1228154 | + | ID = TGME49_205658; length = 2664 | 1549 |
| TGME49_chrIV | 472782 | 476325 | − | ID = TGME49_320150; length = 3543 | 1550 |
| TGME49_chrVIII | 2495326 | 2497228 | − | ID = TGME49_233200; length = 1902 | 1551 |
| TGME49_chrIX | 1398246 | 1400896 | − | ID = TGME49_265870; length = 2650 | 1552 |
| TGME49_chrVIIb | 779047 | 782310 | − | ID = TGME49_263135; length = 3263 | 1553 |
| TGME49_chrVIIa | 2499387 | 2501343 | + | ID = TGME49_203440; length = 1956 | 1554 |
| TGME49_chrXII | 3179343 | 3181561 | + | ID = TGME49_247230; length = 2218 | 1555 |
| TGME49_chrVIIb | 906498 | 907438 | + | ID = TGME49_262940; length = 940 | 1556 |
| TGME49_chrX | 3106086 | 3109088 | + | ID = TGME49_224290; length = 3002 | 1557 |
| TGME49_chrVIIb | 2972536 | 2974185 | − | ID = TGME49_259100; length = 1649 | 1558 |
| TGME49_chrVIII | 322273 | 327193 | − | ID = TGME49_229620; length = 4920 | 1559 |
| TGME49_chrVI | 2726419 | 2728299 | − | ID = TGME49_243570; length = 1880 | 1560 |
| TGME49_chrIb | 1763476 | 1764810 | − | ID = TGME49_321510; length = 1334 | 1561 |
| TGME49_chrVIII | 1915936 | 1917426 | − | ID = TGME49_232170; length = 1490 | 1562 |
| TGME49_chrXI | 1198381 | 1203275 | − | ID = TGME49_310260; length = 4894 | 1563 |
| TGME49_chrV | 1164970 | 1166774 | − | ID = TGME49_213600; length = 1804 | 1564 |
| TGME49_chrXII | 1120459 | 1123972 | − | ID = TGME49_219125; length = 3513 | 1565 |
| TGME49_chrXI | 3087960 | 3092164 | − | ID = TGME49_313080; length = 4204 | 1566 |
| TGME49_chrXI | 1976585 | 1979964 | + | ID = TGME49_311335; length = 3379 | 1567 |
| TGME49_chrXII | 5059554 | 5061900 | − | ID = TGME49_250340; length = 2346 | 1568 |
| TGME49_chrIX | 708789 | 710487 | + | ID = TGME49_267330; length = 1698 | 1569 |
| TGME49_chrVI | 2874483 | 2878854 | + | ID = TGME49_243910; length = 4371 | 1570 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 3857496 | 3859431 | − | ID = TGME49_223420; length = 1935 | 1571 |
| TGME49_chrVIIa | 176036 | 178132 | + | ID = TGME49_280690; length = 2096 | 1572 |
| TGME49_chrX | 5637919 | 5640447 | + | ID = TGME49_236980; length = 2528 | 1573 |
| TGME49_chrVIII | 5981273 | 5982851 | − | ID = TGME49_269225; length = 1578 | 1574 |
| TGME49_chrIV | 1821118 | 1825235 | + | ID = TGME49_211330; length = 4117 | 1575 |
| TGME49_chrV | 2548699 | 2551643 | + | ID = TGME49_285180; length = 2944 | 1576 |
| TGME49_chrVIIb | 1989290 | 1990938 | + | ID = TGME49_260990; length = 1648 | 1577 |
| TGME49_chrX | 1834669 | 1836342 | + | ID = TGME49_226060; length = 1673 | 1578 |
| TGME49_chrV | 817024 | 819593 | + | ID = TGME49_213050; length = 2569 | 1579 |
| TGME49_chrVIII | 2234318 | 2235909 | + | ID = TGME49_232710; length = 1591 | 1580 |
| TGME49_chrVIIb | 3147875 | 3150412 | + | ID = TGME49_258832; length = 2537 | 1581 |
| TGME49_chrVIIb | 4740043 | 4742016 | − | ID = TGME49_255680; length = 1973 | 1582 |
| TGME49_chrVIII | 3585349 | 3587718 | − | ID = TGME49_273340; length = 2369 | 1583 |
| TGME49_chrVI | 1619493 | 1622431 | − | ID = TGME49_241000; length = 2938 | 1584 |
| TGME49_chrVI | 3235482 | 3240036 | + | ID = TGME49_244400; length = 4554 | 1585 |
| TGME49_chrVIII | 4624312 | 4626375 | − | ID = TGME49_271250; length = 2063 | 1586 |
| TGME49_chrIV | 1260400 | 1264074 | − | ID = TGME49_318525; length = 3674 | 1587 |
| TGME49_chrXII | 2946217 | 2948125 | + | ID = TGME49_246730; length = 1908 | 1588 |
| TGME49_chrV | 1102556 | 1104367 | + | ID = TGME49_213490; length = 1811 | 1589 |
| TGME49_chrVIIb | 1064528 | 1067088 | − | ID = TGME49_262715; length = 2560 | 1590 |
| TGME49_chrIV | 564447 | 565815 | − | ID = TGME49_320040; length = 1368 | 1591 |
| TGME49_chrV | 1295918 | 1298121 | − | ID = TGME49_213760; length = 2203 | 1592 |
| TGME49_chrVIII | 1859181 | 1860943 | − | ID = TGME49_232100; length = 1762 | 1593 |
| TGME49_chrXI | 5852137 | 5854406 | + | ID = TGME49_216840; length = 2269 | 1594 |
| TGME49_chrX | 6047181 | 6050358 | + | ID = TGME49_214130; length = 3177 | 1595 |
| TGME49_chrV | 702364 | 705795 | + | ID = TGME49_212937; length = 3431 | 1596 |
| TGME49_chrX | 644166 | 645619 | − | ID = TGME49_228065; length = 1453 | 1597 |
| TGME49_chrIb | 707596 | 710331 | + | ID = TGME49_208440; length = 2735 | 1598 |
| TGME49_chrVIII | 4254025 | 4256840 | + | ID = TGME49_271970; length = 2815 | 1599 |
| TGME49_chrVIIa | 1752677 | 1754734 | − | ID = TGME49_204490; length = 2057 | 1600 |
| TGME49_chrIX | 3031260 | 3032617 | + | ID = TGME49_289160; length = 1357 | 1601 |
| TGME49_chrIa | 1610589 | 1612536 | − | ID = TGME49_295690; length = 1947 | 1602 |
| TGME49_chrXII | 3652284 | 3655006 | + | ID = TGME49_248100; length = 2722 | 1603 |
| TGME49_chrV | 2253285 | 2254950 | − | ID = TGME49_285760; length = 1665 | 1604 |
| TGME49_chrIa | 644712 | 646745 | − | ID = TGME49_294010; length = 2033 | 1605 |
| TGME49_chrVIIb | 2634842 | 2637275 | − | ID = TGME49_259890; length = 2433 | 1606 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 3357594 | 3360110 | − | ID = TGME49_247460; length = 2516 | 1607 |
| TGME49_chrIb | 458487 | 461835 | − | ID = TGME49_207950; length = 3348 | 1608 |
| TGME49_chrII | 309176 | 312120 | − | ID = TGME49_221390; length = 2944 | 1609 |
| TGME49_chrXII | 5240975 | 5243070 | − | ID = TGME49_250810; length = 2095 | 1610 |
| TGME49_chrIX | 1501064 | 1504713 | − | ID = TGME49_265530; length = 3649 | 1611 |
| TGME49_chrIb | 48324 | 49906 | − | ID = TGME49_207420; length = 1582 | 1612 |
| TGME49_chrVIIa | 2960709 | 2963102 | + | ID = TGME49_202880; length = 2393 | 1613 |
| TGME49_chrXII | 2759303 | 2762582 | − | ID = TGME49_246230; length = 3279 | 1614 |
| TGME49_chrVIIa | 3364291 | 3368281 | + | ID = TGME49_202380; length = 3990 | 1615 |
| TGME49_chrVIII | 5847471 | 5851413 | + | ID = TGME49_269380; length = 3942 | 1616 |
| TGME49_chrXI | 2803915 | 2808538 | + | ID = TGME49_312590; length = 4623 | 1617 |
| TGME49_chrXI | 3587275 | 3589602 | + | ID = TGME49_313665; length = 2327 | 1618 |
| TGME49_chrXII | 4168320 | 4169758 | + | ID = TGME49_248780; length = 1438 | 1619 |
| TGME49_chrX | 5074453 | 5075975 | + | ID = TGME49_235720; length = 1522 | 1620 |
| TGME49_chrII | 2127562 | 2129984 | + | ID = TGME49_297950; length = 2422 | 1621 |
| TGME49_chrVIIb | 894167 | 897847 | − | ID = TGME49_262970; length = 3680 | 1622 |
| TGME49_chrVIII | 2420778 | 2422638 | + | ID = TGME49_233110; length = 1860 | 1623 |
| TGME49_chrXII | 5430634 | 5433016 | − | ID = TGME49_251490; length = 2382 | 1624 |
| TGME49_chrX | 438371 | 442269 | + | ID = TGME49_228280; length = 3898 | 1625 |
| TGME49_chrV | 2053342 | 2058060 | − | ID = TGME49_286020; length = 4718 | 1626 |
| TGME49_chrIX | 1548370 | 1553308 | − | ID = TGME49_265450; length = 4938 | 1627 |
| TGME49_chrIb | 1361665 | 1366149 | − | ID = TGME49_209610; length = 4484 | 1628 |
| TGME49_chrII | 1160506 | 1162386 | − | ID = TGME49_222440; length = 1880 | 1629 |
| TGME49_chrXII | 3825625 | 3827372 | + | ID = TGME49_248370; length = 1747 | 1630 |
| TGME49_chrIa | 695084 | 698240 | + | ID = TGME49_294200; length = 3156 | 1631 |
| TGME49_chrXI | 6391216 | 6392903 | − | ID = TGME49_216130; length = 1687 | 1632 |
| TGME49_chrXI | 496472 | 497645 | + | ID = TGME49_309095; length = 1173 | 1633 |
| TGME49_chrVI | 2105036 | 2106954 | − | ID = TGME49_242610; length = 1918 | 1634 |
| TGME49_chrVIIa | 20277 | 22070 | − | ID = TGME49_279550; length = 1793 | 1635 |
| TGME49_chrVIII | 5588163 | 5591148 | + | ID = TGME49_269810; length = 2985 | 1636 |
| TGME49_chrII | 1643776 | 1646520 | − | ID = TGME49_297245; length = 2744 | 1637 |
| TGME49_chrXII | 1661314 | 1663812 | − | ID = TGME49_218230; length = 2498 | 1638 |
| TGME49_chrVIIa | 1958747 | 1961164 | − | ID = TGME49_204140; length = 2417 | 1639 |
| TGME49_chrIV | 1317765 | 1320416 | + | ID = TGME49_318450; length = 2651 | 1640 |
| TGME49_chrX | 4551871 | 4556156 | − | ID = TGME49_234930; length = 4285 | 1641 |
| TGME49_chrV | 1361167 | 1363437 | − | ID = TGME49_213830; length = 2270 | 1642 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrV | 2135398 | 2138100 | − | ID = TGME49_285940; length = 2702 | 1643 |
| TGME49_chrVIII | 4288270 | 4290925 | + | ID = TGME49_271910; length = 2655 | 1644 |
| TGME49_chrX | 5448896 | 5450860 | + | ID = TGME49_236620; length = 1964 | 1645 |
| TGME49_chrX | 7170482 | 7175111 | − | ID = TGME49_275310; length = 4629 | 1646 |
| TGME49_chrIX | 3092344 | 3096555 | − | ID = TGME49_289218; length = 4211 | 1647 |
| TGME49_chrIV | 866827 | 869130 | + | ID = TGME49_319590; length = 2303 | 1648 |
| TGME49_chrX | 6109656 | 6111516 | − | ID = TGME49_214200; length = 1860 | 1649 |
| TGME49_chrIa | 716367 | 719854 | − | ID = TGME49_294210; length = 3487 | 1650 |
| TGME49_chrIX | 2520742 | 2523456 | − | ID = TGME49_288420; length = 2714 | 1651 |
| TGME49_chrIX | 3369880 | 3371358 | − | ID = TGME49_289660; length = 1478 | 1652 |
| TGME49_chrX | 456771 | 458903 | + | ID = TGME49_228240; length = 2132 | 1653 |
| TGME49_chrVIIb | 2969500 | 2972803 | + | ID = TGME49_259090; length = 3303 | 1654 |
| TGME49_chrVIIb | 711535 | 716415 | − | ID = TGME49_263210; length = 4880 | 1655 |
| TGME49_chrVIII | 2122538 | 2126263 | − | ID = TGME49_232500; length = 3725 | 1656 |
| TGME49_chrIV | 2096934 | 2099104 | − | ID = TGME49_210750; length = 2170 | 1657 |
| TGME49_chrIb | 863212 | 866544 | + | ID = TGME49_208800; length = 3332 | 1658 |
| TGME49_chrVIII | 5219785 | 5222055 | − | ID = TGME49_270520; length = 2270 | 1659 |
| TGME49_chrVI | 1285261 | 1288152 | − | ID = TGME49_240450; length = 2891 | 1660 |
| TGME49_chrVIIa | 3031763 | 3033039 | − | ID = TGME49_202790; length = 1276 | 1661 |
| TGME49_chrXI | 3235407 | 3237049 | − | ID = TGME49_313277; length = 1642 | 1662 |
| TGME49_chrXII | 4460349 | 4461980 | − | ID = TGME49_249325; length = 1631 | 1663 |
| TGME49_chrVIIb | 1062098 | 1065932 | + | ID = TGME49_262710; length = 3834 | 1664 |
| TGME49_chrVIII | 2155428 | 2158102 | + | ID = TGME49_232550; length = 2674 | 1665 |
| TGME49_chrIX | 325672 | 328132 | + | ID = TGME49_267820; length = 2460 | 1666 |
| TGME49_chrXI | 5157299 | 5158701 | + | ID = TGME49_316150; length = 1402 | 1667 |
| TGME49_chrVIIb | 4842347 | 4847324 | + | ID = TGME49_255400; length = 4977 | 1668 |
| TGME49_chrX | 2287678 | 2289457 | − | ID = TGME49_225360; length = 1779 | 1669 |
| TGME49_chrVIIa | 3819058 | 3822835 | + | ID = TGME49_201750; length = 3777 | 1670 |
| TGME49_chrX | 4843932 | 4845765 | − | ID = TGME49_235398; length = 1833 | 1671 |
| TGME49_chrIV | 1145000 | 1147010 | + | ID = TGME49_318690; length = 2010 | 1672 |
| TGME49_chrXII | 5588646 | 5590856 | − | ID = TGME49_251780; length = 2210 | 1673 |
| TGME49_chrXI | 6129114 | 6134065 | − | ID = TGME49_216470; length = 4951 | 1674 |
| TGME49_chrVI | 455338 | 457067 | − | ID = TGME49_239083; length = 1729 | 1675 |
| TGME49_chrVIII | 3289883 | 3294737 | + | ID = TGME49_273750; length = 4854 | 1676 |
| TGME49_chrVIII | 3689219 | 3691099 | + | ID = TGME49_273060; length = 1880 | 1677 |
| TGME49_chrX | 3326589 | 3328196 | − | ID = TGME49_224100; length = 1607 | 1678 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 1060833 | 1063141 | + | ID = TGME49_206320; length = 2308 | 1679 |
| TGME49_chrII | 1301776 | 1305290 | + | ID = TGME49_222910; length = 3514 | 1680 |
| TGME49_chrII | 1512263 | 1514584 | + | ID = TGME49_297065; length = 2321 | 1681 |
| TGME49_chrVIII | 3030733 | 3033855 | + | ID = TGME49_274090; length = 3122 | 1682 |
| TGME49_chrII | 342210 | 344003 | + | ID = TGME49_221430; length = 1793 | 1683 |
| TGME49_chrVI | 1320689 | 1322846 | − | ID = TGME49_240560; length = 2157 | 1684 |
| TGME49_chrXI | 4851796 | 4855798 | + | ID = TGME49_315610; length = 4002 | 1685 |
| TGME49_chrXII | 2866217 | 2868700 | + | ID = TGME49_246590; length = 2483 | 1686 |
| TGME49_chrVIIb | 2395067 | 2397478 | + | ID = TGME49_260270; length = 2411 | 1687 |
| TGME49_chrV | 766839 | 769527 | + | ID = TGME49_213000; length = 2688 | 1688 |
| TGME49_chrXII | 1927136 | 1929197 | − | ID = TGME49_217580; length = 2061 | 1689 |
| TGME49_chrXII | 6597836 | 6600162 | − | ID = TGME49_275568; length = 2326 | 1690 |
| TGME49_chrIX | 5330740 | 5332155 | + | ID = TGME49_305280; length = 1415 | 1691 |
| TGME49_chrX | 6259145 | 6260711 | + | ID = TGME49_214350; length = 1566 | 1692 |
| TGME49_chrIX | 2730243 | 2732515 | − | ID = TGME49_288765; length = 2272 | 1693 |
| TGME49_chrXI | 4169227 | 4173719 | − | ID = TGME49_314515; length = 4492 | 1694 |
| TGME49_chrXI | 1722895 | 1726565 | + | ID = TGME49_311020; length = 3670 | 1695 |
| TGME49_chrXI | 2059780 | 2062470 | + | ID = TGME49_311410; length = 2690 | 1696 |
| TGME49_chrVIIa | 4202011 | 4206408 | + | ID = TGME49_281580; length = 4397 | 1697 |
| TGME49_chrVIIa | 2946359 | 2950755 | + | ID = TGME49_202900; length = 4396 | 1698 |
| TGME49_chrVIIb | 2678088 | 2682997 | + | ID = TGME49_259830; length = 4909 | 1699 |
| TGME49_chrVIIa | 899877 | 903405 | + | ID = TGME49_206510; length = 3528 | 1700 |
| TGME49_chrXI | 3996077 | 3999430 | − | ID = TGME49_314310; length = 3353 | 1701 |
| TGME49_chrXII | 5353411 | 5355727 | + | ID = TGME49_251400; length = 2316 | 1702 |
| TGME49_chrXII | 2176868 | 2180818 | + | ID = TGME49_217860; length = 3950 | 1703 |
| TGME49_chrVIII | 5792673 | 5796876 | − | ID = TGME49_269450; length = 4203 | 1704 |
| TGME49_chrVIII | 6863500 | 6867930 | − | ID = TGME49_200400; length = 4430 | 1705 |
| TGME49_chrIX | 1642011 | 1646868 | − | ID = TGME49_265270; length = 4857 | 1706 |
| TGME49_chrIa | 451232 | 453213 | + | ID = TGME49_293610; length = 1981 | 1707 |
| TGME49_chrVI | 1445741 | 1449188 | + | ID = TGME49_240800; length = 3447 | 1708 |
| TGME49_chrVIIb | 899808 | 902193 | + | ID = TGME49_262950; length = 2385 | 1709 |
| TGME49_chrXII | 5526551 | 5531499 | + | ID = TGME49_251690; length = 4948 | 1710 |
| TGME49_chrIV | 2154878 | 2157331 | + | ID = TGME49_210690; length = 2453 | 1711 |
| TGME49_chrVIIa | 2244701 | 2247997 | + | ID = TGME49_203770; length = 3296 | 1712 |
| TGME49_chrVIIb | 1773969 | 1777524 | − | ID = TGME49_261400; length = 3555 | 1713 |
| TGME49_chrIX | 2087644 | 2089518 | − | ID = TGME49_264730; length = 1874 | 1714 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 5326096 | 5328125 | − | ID = TGME49_236200; length = 2029 | 1715 |
| TGME49_chrIX | 5280180 | 5282539 | + | ID = TGME49_305200; length = 2359 | 1716 |
| TGME49_chrV | 1815047 | 1818388 | + | ID = TGME49_286480; length = 3341 | 1717 |
| TGME49_chrVIIa | 624310 | 629301 | + | ID = TGME49_304700; length = 4991 | 1718 |
| TGME49_chrII | 505138 | 509495 | − | ID = TGME49_221630; length = 4357 | 1719 |
| TGME49_chrVI | 3153014 | 3156401 | + | ID = TGME49_244280; length = 3387 | 1720 |
| TGME49_chrVIII | 3997097 | 3999384 | − | ID = TGME49_272410; length = 2287 | 1721 |
| TGME49_chrXII | 6205376 | 6207991 | + | ID = TGME49_278245; length = 2615 | 1722 |
| TGME49_chrVIII | 5108236 | 5110579 | − | ID = TGME49_270650; length = 2343 | 1723 |
| TGME49_chrIX | 1415881 | 1418195 | + | ID = TGME49_265840; length = 2314 | 1724 |
| TGME49_chrVIIb | 3863097 | 3864612 | − | ID = TGME49_257740; length = 1515 | 1725 |
| TGME49_chrVIII | 4215825 | 4218765 | − | ID = TGME49_272020; length = 2940 | 1726 |
| TGME49_chrVIIa | 1629342 | 1632196 | − | ID = TGME49_205120; length = 2854 | 1727 |
| TGME49_chrVIIa | 463960 | 467129 | + | ID = TGME49_280390; length = 3169 | 1728 |
| TGME49_chrVIIa | 1426542 | 1431194 | − | ID = TGME49_205390; length = 4652 | 1729 |
| TGME49_chrII | 201437 | 204275 | − | ID = TGME49_221275; length = 2838 | 1730 |
| TGME49_chrXII | 2437627 | 2439102 | − | ID = TGME49_245620; length = 1475 | 1731 |
| TGME49_chrVIIb | 2332162 | 2334662 | − | ID = TGME49_260370; length = 2500 | 1732 |
| TGME49_chrVIIa | 788333 | 792905 | + | ID = TGME49_206600; length = 4572 | 1733 |
| TGME49_chrIX | 4108788 | 4113576 | + | ID = TGME49_291090; length = 4788 | 1734 |
| TGME49_chrIX | 4682427 | 4683833 | + | ID = TGME49_292325; length = 1406 | 1735 |
| TGME49_chrXI | 2417445 | 2418466 | − | ID = TGME49_312075; length = 1021 | 1736 |
| TGME49_chrIa | 556012 | 560537 | + | ID = TGME49_293790; length = 4525 | 1737 |
| TGME49_chrIX | 779646 | 784608 | + | ID = TGME49_267090; length = 4962 | 1738 |
| TGME49_chrX | 2592957 | 2594193 | + | ID = TGME49_225005; length = 1236 | 1739 |
| TGME49_chrIX | 2410595 | 2414911 | − | ID = TGME49_288245; length = 4316 | 1740 |
| TGME49_chrVIIb | 2602303 | 2605077 | + | ID = TGME49_259940; length = 2774 | 1741 |
| TGME49_chrX | 5395871 | 5397679 | + | ID = TGME49_236520; length = 1808 | 1742 |
| TGME49_chrIV | 1107275 | 1109514 | + | ID = TGME49_318750; length = 2239 | 1743 |
| TGME49_chrVI | 191582 | 194227 | + | ID = TGME49_238400; length = 2645 | 1744 |
| TGME49_chrX | 6586789 | 6588930 | + | ID = TGME49_214920; length = 2141 | 1745 |
| TGME49_chrXII | 6371094 | 6373426 | − | ID = TGME49_277990; length = 2332 | 1746 |
| TGME49_chrIa | 1812506 | 1814521 | − | ID = TGME49_295350; length = 2015 | 1747 |
| TGME49_chrXII | 6656982 | 6660694 | + | ID = TGME49_277500; length = 3712 | 1748 |
| TGME49_chrXII | 2663643 | 2665815 | + | ID = TGME49_246100; length = 2172 | 1749 |
| TGME49_chrXI | 436997 | 438672 | − | ID = TGME49_309010; length = 1675 | 1750 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 5442829 | 5445816 | − | ID = TGME49_305498; length = 2987 | 1751 |
| TGME49_chrVI | 41637 | 43605 | + | ID = TGME49_238060; length = 1968 | 1752 |
| TGME49_chrXII | 613045 | 617971 | + | ID = TGME49_219828; length = 4926 | 1753 |
| TGME49_chrX | 2026020 | 2028673 | − | ID = TGME49_225820; length = 2653 | 1754 |
| TGME49_chrIX | 3690964 | 3692526 | + | ID = TGME49_290300; length = 1562 | 1755 |
| TGME49_chrIX | 652699 | 654379 | + | ID = TGME49_267435; length = 1680 | 1756 |
| TGME49_chrV | 489825 | 492876 | − | ID = TGME49_220610; length = 3051 | 1757 |
| TGME49_chrVIIb | 486067 | 488472 | + | ID = TGME49_263540; length = 2405 | 1758 |
| TGME49_chrVIII | 3283733 | 3286012 | + | ID = TGME49_273770; length = 2279 | 1759 |
| TGME49_chrIb | 978776 | 983209 | + | ID = TGME49_209010; length = 4433 | 1760 |
| TGME49_chrVI | 1775119 | 1776850 | − | ID = TGME49_241860; length = 1731 | 1761 |
| TGME49_chrIa | 1146951 | 1148726 | − | ID = TGME49_294790; length = 1775 | 1762 |
| TGME49_chrXII | 1041731 | 1043438 | − | ID = TGME49_219250; length = 1707 | 1763 |
| TGME49_chrVIII | 733619 | 737486 | − | ID = TGME49_230350; length = 3867 | 1764 |
| TGME49_chrII | 1603694 | 1605698 | − | ID = TGME49_297190; length = 2004 | 1765 |
| TGME49_chrIX | 2711191 | 2713335 | − | ID = TGME49_288720; length = 2144 | 1766 |
| TGME49_chrX | 1196543 | 1199550 | + | ID = TGME49_226950; length = 3007 | 1767 |
| TGME49_chrIX | 5393544 | 5395750 | + | ID = TGME49_305455; length = 2206 | 1768 |
| TGME49_chrXI | 1499161 | 1503181 | + | ID = TGME49_310660; length = 4020 | 1769 |
| TGME49_chrXI | 5008254 | 5010201 | + | ID = TGME49_315820; length = 1947 | 1770 |
| TGME49_chrVI | 1390368 | 1392791 | − | ID = TGME49_240690; length = 2423 | 1771 |
| TGME49_chrII | 1120393 | 1123132 | + | ID = TGME49_222410; length = 2739 | 1772 |
| TGME49_chrX | 739417 | 741694 | − | ID = TGME49_227920; length = 2277 | 1773 |
| TGME49_chrVIII | 5548282 | 5553068 | − | ID = TGME49_269910; length = 4786 | 1774 |
| TGME49_chrVIII | 503704 | 505886 | − | ID = TGME49_229990; length = 2182 | 1775 |
| TGME49_chrX | 2521891 | 2524155 | + | ID = TGME49_225102; length = 2264 | 1776 |
| TGME49_chrVIIb | 2469232 | 2470805 | + | ID = TGME49_260190; length = 1573 | 1777 |
| TGME49_chrIX | 381279 | 384341 | + | ID = TGME49_267750; length = 3062 | 1778 |
| TGME49_chrXII | 2603118 | 2605598 | + | ID = TGME49_246030; length = 2480 | 1779 |
| TGME49_chrII | 1373856 | 1375582 | + | ID = TGME49_223025; length = 1726 | 1780 |
| TGME49_chrVIIb | 2167761 | 2170472 | − | ID = TGME49_260550; length = 2711 | 1781 |
| TGME49_chrXI | 4240194 | 4244498 | − | ID = TGME49_314710; length = 4304 | 1782 |
| TGME49_chrVIIa | 293961 | 296113 | − | ID = TGME49_280570; length = 2152 | 1783 |
| TGME49_chrIX | 1323487 | 1325964 | − | ID = TGME49_266065; length = 2477 | 1784 |
| TGME49_chrVIII | 1513803 | 1516857 | + | ID = TGME49_231640; length = 3054 | 1785 |
| TGME49_chrV | 342801 | 346665 | + | ID = TGME49_220390; length = 3864 | 1786 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 1663101 | 1666170 | + | ID = TGME49_205030; length = 3069 | 1787 |
| TGME49_chrVI | 2847971 | 2852954 | − | ID = TGME49_243760; length = 4983 | 1788 |
| TGME49_chrIX | 5351150 | 5353348 | + | ID = TGME49_305320; length = 2198 | 1789 |
| TGME49_chrXII | 4131891 | 4133450 | − | ID = TGME49_248730; length = 1559 | 1790 |
| TGME49_chrXI | 133543 | 134623 | + | ID = TGME49_306990; length = 1080 | 1791 |
| TGME49_chrX | 6353248 | 6354650 | − | ID = TGME49_214550; length = 1402 | 1792 |
| TGME49_chrVIII | 6042411 | 6044655 | + | ID = TGME49_269140; length = 2244 | 1793 |
| TGME49_chrIX | 1688833 | 1690933 | − | ID = TGME49_265230; length = 2100 | 1794 |
| TGME49_chrIa | 306442 | 309887 | + | ID = TGME49_293420; length = 3445 | 1795 |
| TGME49_chrVIIa | 1824928 | 1827582 | + | ID = TGME49_204390; length = 2654 | 1796 |
| TGME49_chrXII | 951031 | 952710 | + | ID = TGME49_219430; length = 1679 | 1797 |
| TGME49_chrVI | 581992 | 583744 | − | ID = TGME49_239350; length = 1752 | 1798 |
| TGME49_chrX | 3441657 | 3444661 | − | ID = TGME49_223940; length = 3004 | 1799 |
| TGME49_chrVIII | 846765 | 849139 | + | ID = TGME49_230520; length = 2374 | 1800 |
| TGME49_chrXII | 3323790 | 3326774 | + | ID = TGME49_247400; length = 2984 | 1801 |
| TGME49_chrVIIa | 2920724 | 2923694 | − | ID = TGME49_202960; length = 2970 | 1802 |
| TGME49_chrXI | 4578541 | 4582751 | + | ID = TGME49_315220; length = 4210 | 1803 |
| TGME49_chrIX | 1528778 | 1531783 | + | ID = TGME49_265470; length = 3005 | 1804 |
| TGME49_chrXI | 1239947 | 1242270 | − | ID = TGME49_310290; length = 2323 | 1805 |
| TGME49_chrVIIb | 222702 | 224691 | − | ID = TGME49_264040; length = 1989 | 1806 |
| TGME49_chrVIII | 405193 | 409738 | − | ID = TGME49_229720; length = 4545 | 1807 |
| TGME49_chrVIIa | 625071 | 629635 | − | ID = TGME49_304680; length = 4564 | 1808 |
| TGME49_chrIX | 2507287 | 2509481 | − | ID = TGME49_288400; length = 2194 | 1809 |
| TGME49_chrVIIa | 3260937 | 3263671 | − | ID = TGME49_202530; length = 2734 | 1810 |
| TGME49_chrIX | 227007 | 229288 | + | ID = TGME49_279360; length = 2281 | 1811 |
| TGME49_chrX | 4021655 | 4024338 | + | ID = TGME49_212140; length = 2683 | 1812 |
| TGME49_chrVIIb | 1215908 | 1219966 | + | ID = TGME49_262460; length = 4058 | 1813 |
| TGME49_chrX | 7457937 | 7460592 | − | ID = TGME49_207230; length = 2655 | 1814 |
| TGME49_chrVIII | 1071514 | 1075639 | − | ID = TGME49_230870; length = 4125 | 1815 |
| TGME49_chrX | 5029202 | 5030634 | − | ID = TGME49_235660; length = 1432 | 1816 |
| TGME49_chrVIIb | 4838297 | 4840986 | − | ID = TGME49_255420; length = 2689 | 1817 |
| TGME49_chrVIII | 574328 | 576120 | − | ID = TGME49_230070; length = 1792 | 1818 |
| TGME49_chrVIIa | 1434529 | 1437210 | + | ID = TGME49_205370; length = 2681 | 1819 |
| TGME49_chrVIIb | 3184714 | 3187955 | − | ID = TGME49_258790; length = 3241 | 1820 |
| TGME49_chrVIIb | 452002 | 453575 | + | ID = TGME49_263595; length = 1573 | 1821 |
| TGME49_chrII | 1799177 | 1801013 | − | ID = TGME49_297460; length = 1836 | 1822 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 1348019 | 1350404 | + | ID = TGME49_266010; length = 2385 | 1823 |
| TGME49_chrXI | 422982 | 426252 | − | ID = TGME49_308990; length = 3270 | 1824 |
| TGME49_chrVIIa | 2638640 | 2643428 | + | ID = TGME49_203250; length = 4788 | 1825 |
| TGME49_chrXII | 3112106 | 3117089 | + | ID = TGME49_247030; length = 4983 | 1826 |
| TGME49_chrV | 1786117 | 1787739 | + | ID = TGME49_286550; length = 1622 | 1827 |
| TGME49_chrIb | 1636369 | 1639495 | − | ID = TGME49_321690; length = 3126 | 1828 |
| TGME49_chrXII | 4744062 | 4745703 | − | ID = TGME49_249698; length = 1641 | 1829 |
| TGME49_chrXI | 1049288 | 1054295 | − | ID = TGME49_310080; length = 5007 | 1830 |
| TGME49_chrXII | 2997364 | 3001613 | + | ID = TGME49_246800; length = 4249 | 1831 |
| TGME49_chrVIIa | 276480 | 280573 | − | ID = TGME49_280600; length = 4093 | 1832 |
| TGME49_chrVIIa | 2044834 | 2047221 | − | ID = TGME49_204040; length = 2387 | 1833 |
| TGME49_chrIV | 1443575 | 1445262 | − | ID = TGME49_318290; length = 1687 | 1834 |
| TGME49_chrVIIb | 1358543 | 1363574 | − | ID = TGME49_262125; length = 5031 | 1835 |
| TGME49_chrXII | 1889739 | 1893641 | − | ID = TGME49_217520; length = 3902 | 1836 |
| TGME49_chrVIII | 6218156 | 6222777 | + | ID = TGME49_268890; length = 4621 | 1837 |
| TGME49_chrIX | 212823 | 215942 | − | ID = TGME49_279390; length = 3119 | 1838 |
| TGME49_chrV | 3074668 | 3075701 | − | ID = TGME49_283570; length = 1033 | 1839 |
| TGME49_chrVIIa | 329088 | 331013 | − | ID = TGME49_280540; length = 1925 | 1840 |
| TGME49_chrXII | 1135859 | 1136707 | − | ID = TGME49_219090; length = 848 | 1841 |
| TGME49_chrXI | 562038 | 563532 | − | ID = TGME49_309210; length = 1494 | 1842 |
| TGME49_chrXI | 5079763 | 5082015 | + | ID = TGME49_315930; length = 2252 | 1843 |
| TGME49_chrXII | 4230010 | 4231788 | + | ID = TGME49_248870; length = 1778 | 1844 |
| TGME49_chrVIII | 347018 | 350776 | + | ID = TGME49_229640; length = 3758 | 1845 |
| TGME49_chrIX | 3368958 | 3370369 | + | ID = TGME49_289670; length = 1411 | 1846 |
| TGME49_chrVIII | 2687436 | 2690407 | − | ID = TGME49_233500; length = 2971 | 1847 |
| TGME49_chrVIIb | 611076 | 613065 | − | ID = TGME49_263360; length = 1989 | 1848 |
| TGME49_chrVIIb | 3970006 | 3973027 | − | ID = TGME49_257568; length = 3021 | 1849 |
| TGME49_chrVIIb | 1325239 | 1328902 | + | ID = TGME49_262160; length = 3663 | 1850 |
| TGME49_chrVIII | 4413113 | 4415505 | − | ID = TGME49_271760; length = 2392 | 1851 |
| TGME49_chrVIIa | 3814503 | 3816891 | + | ID = TGME49_201760; length = 2388 | 1852 |
| TGME49_chrXI | 4058535 | 4061396 | + | ID = TGME49_314400; length = 2861 | 1853 |
| TGME49_chrXI | 1854395 | 1859046 | + | ID = TGME49_311210; length = 4651 | 1854 |
| TGME49_chrX | 4632110 | 4634094 | + | ID = TGME49_235140; length = 1984 | 1855 |
| TGME49_chrIX | 5815296 | 5819202 | + | ID = TGME49_306190; length = 3906 | 1856 |
| TGME49_chrVIIb | 2908955 | 2910810 | − | ID = TGME49_259180; length = 1855 | 1857 |
| TGME49_chrVIII | 2421212 | 2423837 | − | ID = TGME49_233100; length = 2625 | 1858 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 431000 | 433353 | − | ID = TGME49_309000; length = 2353 | 1859 |
| TGME49_chrXI | 2271030 | 2275657 | + | ID = TGME49_311770; length = 4627 | 1860 |
| TGME49_chrVIII | 4332070 | 4335007 | + | ID = TGME49_271850; length = 2937 | 1861 |
| TGME49_chrXII | 4989160 | 4990606 | + | ID = TGME49_250020; length = 1446 | 1862 |
| TGME49_chrXII | 2677358 | 2679539 | + | ID = TGME49_246130; length = 2181 | 1863 |
| TGME49_chrVIIa | 305043 | 307438 | + | ID = TGME49_280550; length = 2395 | 1864 |
| TGME49_chrXI | 4668181 | 4671233 | + | ID = TGME49_315360; length = 3052 | 1865 |
| TGME49_chrX | 2035088 | 2038686 | + | ID = TGME49_225790; length = 3598 | 1866 |
| TGME49_chrVIIb | 3259872 | 3262590 | − | ID = TGME49_258690; length = 2718 | 1867 |
| TGME49_chrXII | 4912829 | 4914644 | − | ID = TGME49_249860; length = 1815 | 1868 |
| TGME49_chrVI | 2440086 | 2442352 | − | ID = TGME49_243200; length = 2266 | 1869 |
| TGME49_chrVIII | 3880336 | 3884798 | + | ID = TGME49_272560; length = 4462 | 1870 |
| TGME49_chrXII | 3831607 | 3833051 | − | ID = TGME49_248390; length = 1444 | 1871 |
| TGME49_chrXI | 2262796 | 2265505 | − | ID = TGME49_311760; length = 2709 | 1872 |
| TGME49_chrIa | 741460 | 745719 | − | ID = TGME49_294240; length = 4259 | 1873 |
| TGME49_chrIb | 1782617 | 1787380 | − | ID = TGME49_321470; length = 4763 | 1874 |
| TGME49_chrVIIa | 1669931 | 1670876 | − | ID = TGME49_205020; length = 945 | 1875 |
| TGME49_chrVIII | 6326491 | 6329179 | − | ID = TGME49_268770; length = 2688 | 1876 |
| TGME49_chrV | 166266 | 168190 | − | ID = TGME49_220145; length = 1924 | 1877 |
| TGME49_chrIV | 576195 | 580895 | − | ID = TGME49_320020; length = 4700 | 1878 |
| TGME49_chrVIII | 1298224 | 1301679 | + | ID = TGME49_231175; length = 3455 | 1879 |
| TGME49_chrVIIb | 4964424 | 4968613 | − | ID = TGME49_255250; length = 4189 | 1880 |
| TGME49_chrIX | 709923 | 711569 | − | ID = TGME49_267340; length = 1646 | 1881 |
| TGME49_chrX | 4556936 | 4560782 | + | ID = TGME49_234970; length = 3846 | 1882 |
| TGME49_chrVIIb | 393977 | 397643 | − | ID = TGME49_263690; length = 3666 | 1883 |
| TGME49_chrXII | 5422931 | 5424831 | − | ID = TGME49_251480; length = 1900 | 1884 |
| TGME49_chrIX | 914298 | 915352 | + | ID = TGME49_266880; length = 1054 | 1885 |
| TGME49_chrV | 428812 | 432815 | + | ID = TGME49_220520; length = 4003 | 1886 |
| TGME49_chrXI | 6404954 | 6409920 | − | ID = TGME49_216080; length = 4966 | 1887 |
| TGME49_chrII | 861618 | 866482 | − | ID = TGME49_222080; length = 4864 | 1888 |
| TGME49_chrXII | 5669867 | 5671445 | + | ID = TGME49_251930; length = 1578 | 1889 |
| TGME49_chrVI | 2532929 | 2537138 | + | ID = TGME49_243310; length = 4209 | 1890 |
| TGME49_chrIX | 3807821 | 3810806 | − | ID = TGME49_290640; length = 2985 | 1891 |
| TGME49_chrVIIa | 901698 | 904817 | − | ID = TGME49_206540; length = 3119 | 1892 |
| TGME49_chrIX | 1847463 | 1852082 | + | ID = TGME49_265000; length = 4619 | 1893 |
| TGME49_chrVIIa | 2454532 | 2456953 | + | ID = TGME49_203510; length = 2421 | 1894 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 3604698 | 3606638 | + | ID = TGME49_273290; length = 1940 | 1895 |
| TGME49_chrVIII | 2234752 | 2236893 | − | ID = TGME49_232700; length = 2141 | 1896 |
| TGME49_chrVI | 2449321 | 2450374 | + | ID = TGME49_243220; length = 1053 | 1897 |
| TGME49_chrX | 6937184 | 6938923 | + | ID = TGME49_215385; length = 1739 | 1898 |
| TGME49_chrIX | 680988 | 684814 | − | ID = TGME49_267380; length = 3826 | 1899 |
| TGME49_chrVIIa | 2261027 | 2263156 | − | ID = TGME49_203760; length = 2129 | 1900 |
| TGME49_chrIX | 3145275 | 3148375 | − | ID = TGME49_289280; length = 3100 | 1901 |
| TGME49_chrVIIa | 2489722 | 2491017 | + | ID = TGME49_203470; length = 1295 | 1902 |
| TGME49_chrVIII | 1769885 | 1774294 | − | ID = TGME49_232020; length = 4409 | 1903 |
| TGME49_chrVIIa | 3993533 | 3996332 | − | ID = TGME49_201160; length = 2799 | 1904 |
| TGME49_chrX | 4514799 | 4516300 | + | ID = TGME49_234660; length = 1501 | 1905 |
| TGME49_chrV | 860484 | 863029 | − | ID = TGME49_213100; length = 2545 | 1906 |
| TGME49_chrVIIb | 3591281 | 3593195 | − | ID = TGME49_258085; length = 1914 | 1907 |
| TGME49_chrIV | 1514865 | 1518877 | + | ID = TGME49_318160; length = 4012 | 1908 |
| TGME49_chrX | 3279666 | 3282705 | − | ID = TGME49_224180; length = 3039 | 1909 |
| TGME49_chrVIII | 975775 | 977748 | + | ID = TGME49_230700; length = 1973 | 1910 |
| TGME49_chrVIIb | 3085729 | 3088120 | − | ID = TGME49_258940; length = 2391 | 1911 |
| TGME49_chrXII | 529861 | 532149 | + | ID = TGME49_308050; length = 2288 | 1912 |
| TGME49_chrV | 239790 | 243541 | − | ID = TGME49_220240; length = 3751 | 1913 |
| TGME49_chrII | 1461513 | 1463416 | − | ID = TGME49_223125; length = 1903 | 1914 |
| TGME49_chrXI | 5222117 | 5224159 | − | ID = TGME49_316280; length = 2042 | 1915 |
| TGME49_chrII | 1468306 | 1470065 | + | ID = TGME49_223140; length = 1759 | 1916 |
| TGME49_chrXI | 2353715 | 2358433 | + | ID = TGME49_311890; length = 4718 | 1917 |
| TGME49_chrII | 1582123 | 1586805 | + | ID = TGME49_297170; length = 4682 | 1918 |
| TGME49_chrIX | 199072 | 203223 | + | ID = TGME49_279400; length = 4151 | 1919 |
| TGME49_chrIV | 284392 | 286223 | − | ID = TGME49_320525; length = 1831 | 1920 |
| TGME49_chrIX | 4842934 | 4844771 | − | ID = TGME49_210370; length = 1837 | 1921 |
| TGME49_chrXI | 4452167 | 4456567 | − | ID = TGME49_314970; length = 4400 | 1922 |
| TGME49_chrXI | 2499772 | 2502355 | − | ID = TGME49_312200; length = 2583 | 1923 |
| TGME49_chrIb | 890079 | 892589 | − | ID = TGME49_208830; length = 2510 | 1924 |
| TGME49_chrVIII | 1966362 | 1967945 | − | ID = TGME49_232230; length = 1583 | 1925 |
| TGME49_chrVI | 989945 | 991803 | − | ID = TGME49_239880; length = 1858 | 1926 |
| TGME49_chrVIIb | 3518895 | 3521575 | + | ID = TGME49_258200; length = 2680 | 1927 |
| TGME49_chrV | 216186 | 217667 | − | ID = TGME49_220208; length = 1481 | 1928 |
| TGME49_chrXII | 5640276 | 5641811 | + | ID = TGME49_251885; length = 1535 | 1929 |
| TGME49_chrXII | 3826538 | 3828410 | − | ID = TGME49_248360; length = 1872 | 1930 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 736629 | 737403 | + | ID = TGME49_267290; length = 774 | 1931 |
| TGME49_chrV | 578793 | 583050 | − | ID = TGME49_212740; length = 4257 | 1932 |
| TGME49_chrXII | 2886732 | 2889046 | + | ID = TGME49_246620; length = 2314 | 1933 |
| TGME49_chrXII | 4176365 | 4178211 | + | ID = TGME49_248800; length = 1846 | 1934 |
| TGME49_chrVIII | 5063747 | 5066564 | − | ID = TGME49_270710; length = 2817 | 1935 |
| TGME49_chrV | 1907332 | 1909721 | + | ID = TGME49_286220; length = 2389 | 1936 |
| TGME49_chrXI | 3397474 | 3401749 | − | ID = TGME49_313440; length = 4275 | 1937 |
| TGME49_chrVIIa | 3861824 | 3865091 | + | ID = TGME49_201670; length = 3267 | 1938 |
| TGME49_chrXII | 5569684 | 5571506 | − | ID = TGME49_251760; length = 1822 | 1939 |
| TGME49_chrXII | 2225921 | 2229690 | + | ID = TGME49_217920; length = 3769 | 1940 |
| TGME49_chrIX | 3307872 | 3310644 | + | ID = TGME49_289570; length = 2772 | 1941 |
| TGME49_chrIa | 156682 | 159073 | + | ID = TGME49_293200; length = 2391 | 1942 |
| TGME49_chrXII | 3881332 | 3885535 | − | ID = TGME49_248470; length = 4203 | 1943 |
| TGME49_chrX | 418777 | 421046 | − | ID = TGME49_228330; length = 2269 | 1944 |
| TGME49_chrV | 2274025 | 2276420 | − | ID = TGME49_285720; length = 2395 | 1945 |
| TGME49_chrXI | 2992217 | 2995109 | − | ID = TGME49_312940; length = 2892 | 1946 |
| TGME49_chrIa | 390048 | 391767 | − | ID = TGME49_293520; length = 1719 | 1947 |
| TGME49_chrVIII | 6445709 | 6450718 | − | ID = TGME49_268450; length = 5009 | 1948 |
| TGME49_chrVIIa | 3924398 | 3927902 | − | ID = TGME49_201270; length = 3504 | 1949 |
| TGME49_chrIX | 2612526 | 2615415 | + | ID = TGME49_288560; length = 2889 | 1950 |
| TGME49_chrIX | 5394025 | 5396129 | − | ID = TGME49_305450; length = 2104 | 1951 |
| TGME49_chrVI | 2449321 | 2454332 | + | ID = TGME49_243240; length = 5011 | 1952 |
| TGME49_chrX | 1141678 | 1144996 | + | ID = TGME49_227000; length = 3318 | 1953 |
| TGME49_chrVIIa | 3580633 | 3582769 | − | ID = TGME49_202140; length = 2136 | 1954 |
| TGME49_chrVIII | 712149 | 714535 | + | ID = TGME49_230340; length = 2386 | 1955 |
| TGME49_chrX | 653775 | 657724 | − | ID = TGME49_228050; length = 3949 | 1956 |
| TGME49_chrX | 1529076 | 1530823 | − | ID = TGME49_226580; length = 1747 | 1957 |
| TGME49_chrVIIa | 3334651 | 3338417 | − | ID = TGME49_202430; length = 3766 | 1958 |
| TGME49_chrVIIb | 2163201 | 2165337 | − | ID = TGME49_260570; length = 2136 | 1959 |
| TGME49_chrVIIb | 1043848 | 1045795 | + | ID = TGME49_262740; length = 1947 | 1960 |
| TGME49_chrX | 1311053 | 1316055 | + | ID = TGME49_226825; length = 5002 | 1961 |
| TGME49_chrVIII | 3977496 | 3979941 | − | ID = TGME49_272430; length = 2445 | 1962 |
| TGME49_chrV | 1789192 | 1791334 | + | ID = TGME49_286530; length = 2142 | 1963 |
| TGME49_chrVIIb | 4173922 | 4175290 | + | ID = TGME49_257170; length = 1368 | 1964 |
| TGME49_chrXI | 4591396 | 4593178 | + | ID = TGME49_315230; length = 1782 | 1965 |
| TGME49_chrVIII | 249237 | 251305 | − | ID = TGME49_229420; length = 2068 | 1966 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrV | 646486 | 648649 | − | ID = TGME49_212840; length = 2163 | 1967 |
| TGME49_chrXI | 1120330 | 1122240 | + | ID = TGME49_310180; length = 1910 | 1968 |
| TGME49_chrXI | 5575321 | 5577263 | − | ID = TGME49_316760; length = 1942 | 1969 |
| TGME49_chrVIII | 2874613 | 2878765 | − | ID = TGME49_233870; length = 4152 | 1970 |
| TGME49_chrXII | 5511516 | 5512810 | + | ID = TGME49_251650; length = 1294 | 1971 |
| TGME49_chrIV | 1628157 | 1629047 | + | ID = TGME49_211675; length = 890 | 1972 |
| TGME49_chrV | 1422629 | 1425901 | − | ID = TGME49_213900; length = 3272 | 1973 |
| TGME49_chrVIIa | 186501 | 190276 | + | ID = TGME49_280670; length = 3775 | 1974 |
| TGME49_chrVIIa | 929557 | 930012 | − | ID = TGME49_206500; length = 455 | 1975 |
| TGME49_chrIX | 2971270 | 2973519 | + | ID = TGME49_289080; length = 2249 | 1976 |
| TGME49_chrVIII | 3930340 | 3931981 | − | ID = TGME49_272510; length = 1641 | 1977 |
| TGME49_chrXI | 181107 | 183028 | − | ID = TGME49_306930; length = 1921 | 1978 |
| TGME49_chrIX | 1649663 | 1652849 | + | ID = TGME49_265255; length = 3186 | 1979 |
| TGME49_chrXII | 1073927 | 1076130 | + | ID = TGME49_219200; length = 2203 | 1980 |
| TGME49_chrIV | 2471037 | 2473860 | + | ID = TGME49_301430; length = 2823 | 1981 |
| TGME49_chrXII | 6364866 | 6366334 | + | ID = TGME49_278005; length = 1468 | 1982 |
| TGME49_chrIb | 842071 | 845707 | − | ID = TGME49_208740; length = 3636 | 1983 |
| TGME49_chrVI | 790118 | 795087 | + | ID = TGME49_239600; length = 4969 | 1984 |
| TGME49_chrX | 1424298 | 1426804 | + | ID = TGME49_226700; length = 2506 | 1985 |
| TGME49_chrV | 560109 | 564542 | − | ID = TGME49_287490; length = 4433 | 1986 |
| TGME49_chrX | 2483670 | 2486271 | + | ID = TGME49_225120; length = 2601 | 1987 |
| TGME49_chrVIIa | 1393725 | 1398244 | − | ID = TGME49_205460; length = 4519 | 1988 |
| TGME49_chrXII | 1092592 | 1094200 | + | ID = TGME49_219175; length = 1608 | 1989 |
| TGME49_chrX | 705828 | 707714 | − | ID = TGME49_227960; length = 1886 | 1990 |
| TGME49_chrIX | 4404496 | 4406990 | − | ID = TGME49_291910; length = 2494 | 1991 |
| TGME49_chrX | 6998185 | 6999653 | − | ID = TGME49_215510; length = 1468 | 1992 |
| TGME49_chrX | 4525519 | 4527356 | + | ID = TGME49_234680; length = 1837 | 1993 |
| TGME49_chrX | 1364413 | 1366308 | + | ID = TGME49_226780; length = 1895 | 1994 |
| TGME49_chrVIIb | 1434482 | 1435459 | − | ID = TGME49_262000; length = 977 | 1995 |
| TGME49_chrVIII | 3198328 | 3202978 | − | ID = TGME49_273885; length = 4650 | 1996 |
| TGME49_chrVIII | 5891946 | 5894191 | + | ID = TGME49_269320; length = 2245 | 1997 |
| TGME49_chrII | 1801273 | 1805605 | + | ID = TGME49_297470; length = 4332 | 1998 |
| TGME49_chrII | 1583366 | 1587369 | − | ID = TGME49_297160; length = 4003 | 1999 |
| TGME49_chrXI | 1015690 | 1017565 | − | ID = TGME49_310030; length = 1875 | 2000 |
| TGME49_chrVIII | 284128 | 286310 | + | ID = TGME49_229470; length = 2182 | 2001 |
| TGME49_chrIV | 206127 | 211040 | − | ID = TGME49_320610; length = 4913 | 2002 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIV | 954032 | 956564 | − | ID = TGME49_319510; length = 2532 | 2003 |
| TGME49_chrX | 1102477 | 1104098 | − | ID = TGME49_227080; length = 1621 | 2004 |
| TGME49_chrIX | 3667981 | 3670156 | − | ID = TGME49_290250; length = 2175 | 2005 |
| TGME49_chrVIII | 6519638 | 6522878 | + | ID = TGME49_268360; length = 3240 | 2006 |
| TGME49_chrXI | 5440111 | 5443988 | − | ID = TGME49_316620; length = 3877 | 2007 |
| TGME49_chrVIIa | 2177416 | 2179962 | + | ID = TGME49_203840; length = 2546 | 2008 |
| TGME49_chrVIII | 5084209 | 5085825 | + | ID = TGME49_270680; length = 1616 | 2009 |
| TGME49_chrXI | 2995464 | 2997405 | + | ID = TGME49_312960; length = 1941 | 2010 |
| TGME49_chrII | 1625923 | 1628671 | + | ID = TGME49_297230; length = 2748 | 2011 |
| TGME49_chrXI | 1618900 | 1619991 | + | ID = TGME49_310830; length = 1091 | 2012 |
| TGME49_chrXII | 6751504 | 6754864 | − | ID = TGME49_277060; length = 3360 | 2013 |
| TGME49_chrXI | 6165715 | 6168615 | + | ID = TGME49_216410; length = 2900 | 2014 |
| TGME49_chrV | 2636647 | 2639120 | + | ID = TGME49_284645; length = 2473 | 2015 |
| TGME49_chrVIIb | 4473497 | 4476055 | + | ID = TGME49_256770; length = 2558 | 2016 |
| TGME49_chrVIII | 5253838 | 5255754 | − | ID = TGME49_270350; length = 1916 | 2017 |
| TGME49_chrVI | 995195 | 999093 | − | ID = TGME49_239890; length = 3898 | 2018 |
| TGME49_chrVI | 1546743 | 1551741 | − | ID = TGME49_240900; length = 4998 | 2019 |
| TGME49_chrVIIb | 3570823 | 3572905 | − | ID = TGME49_258110; length = 2082 | 2020 |
| TGME49_chrIX | 1687388 | 1690438 | + | ID = TGME49_265220; length = 3050 | 2021 |
| TGME49_chrVIII | 1861928 | 1864368 | + | ID = TGME49_232120; length = 2440 | 2022 |
| TGME49_chrV | 488616 | 490907 | + | ID = TGME49_220620; length = 2291 | 2023 |
| TGME49_chrVI | 3402464 | 3405837 | − | ID = TGME49_244620; length = 3373 | 2024 |
| TGME49_chrV | 469162 | 471286 | + | ID = TGME49_220585; length = 2124 | 2025 |
| TGME49_chrX | 448104 | 450711 | − | ID = TGME49_228270; length = 2607 | 2026 |
| TGME49_chrIa | 840385 | 841380 | − | ID = TGME49_294350; length = 995 | 2027 |
| TGME49_chrXI | 1642170 | 1643093 | + | ID = TGME49_310875; length = 923 | 2028 |
| TGME49_chrVIII | 4995719 | 4997442 | + | ID = TGME49_270780; length = 1723 | 2029 |
| TGME49_chrVI | 927570 | 932508 | − | ID = TGME49_239800; length = 4938 | 2030 |
| TGME49_chrVIIa | 1843313 | 1845988 | + | ID = TGME49_204370; length = 2675 | 2031 |
| TGME49_chrX | 4549606 | 4553931 | + | ID = TGME49_234940; length = 4325 | 2032 |
| TGME49_chrVI | 1708785 | 1711030 | + | ID = TGME49_241610; length = 2245 | 2033 |
| TGME49_chrX | 4938972 | 4940429 | − | ID = TGME49_235540; length = 1457 | 2034 |
| TGME49_chrVIIb | 164856 | 169420 | + | ID = TGME49_264120; length = 4564 | 2035 |
| TGME49_chrIX | 4027598 | 4029731 | + | ID = TGME49_291000; length = 2133 | 2036 |
| TGME49_chrVIIa | 1419599 | 1421687 | + | ID = TGME49_205402; length = 2088 | 2037 |
| TGME49_chrXI | 436362 | 437746 | + | ID = TGME49_309020; length = 1384 | 2038 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 5176299 | 5179174 | + | ID = TGME49_316190; length = 2875 | 2039 |
| TGME49_chrVIIb | 2712120 | 2714104 | − | ID = TGME49_259690; length = 1984 | 2040 |
| TGME49_chrIb | 1450314 | 1450964 | + | ID = TGME49_209780; length = 650 | 2041 |
| TGME49_chrXII | 5939359 | 5941323 | − | ID = TGME49_278680; length = 1964 | 2042 |
| TGME49_chrXII | 602054 | 603985 | − | ID = TGME49_219850; length = 1931 | 2043 |
| TGME49_chrIX | 4431878 | 4435031 | + | ID = TGME49_291960; length = 3153 | 2044 |
| TGME49_chrV | 2167500 | 2172395 | − | ID = TGME49_285860; length = 4895 | 2045 |
| TGME49_chrIX | 6049752 | 6053318 | + | ID = TGME49_306400; length = 3566 | 2046 |
| TGME49_chrVIIb | 1662568 | 1663864 | − | ID = TGME49_261550; length = 1296 | 2047 |
| TGME49_chrX | 2807197 | 2808264 | + | ID = TGME49_224820; length = 1067 | 2048 |
| TGME49_chrIX | 1941820 | 1943728 | − | ID = TGME49_264875; length = 1908 | 2049 |
| TGME49_chrVI | 41637 | 46647 | + | ID = TGME49_238070; length = 5010 | 2050 |
| TGME49_chrXI | 6420835 | 6425390 | − | ID = TGME49_216070; length = 4555 | 2051 |
| TGME49_chrIX | 469404 | 472283 | + | ID = TGME49_267670; length = 2879 | 2052 |
| TGME49_chrX | 6007176 | 6009045 | − | ID = TGME49_237595; length = 1869 | 2053 |
| TGME49_chrXI | 5608472 | 5610173 | − | ID = TGME49_316900; length = 1701 | 2054 |
| TGME49_chrX | 6171995 | 6176026 | + | ID = TGME49_214250; length = 4031 | 2055 |
| TGME49_chrIX | 2786348 | 2787500 | − | ID = TGME49_288870; length = 1152 | 2056 |
| TGME49_chrIX | 4071340 | 4075503 | − | ID = TGME49_291020; length = 4163 | 2057 |
| TGME49_chrXI | 362611 | 365152 | − | ID = TGME49_308920; length = 2541 | 2058 |
| TGME49_chrXII | 6038102 | 6039598 | − | ID = TGME49_278540; length = 1496 | 2059 |
| TGME49_chrIa | 1383866 | 1386224 | + | ID = TGME49_295080; length = 2358 | 2060 |
| TGME49_chrXI | 1255210 | 1257092 | + | ID = TGME49_310320; length = 1882 | 2061 |
| TGME49_chrX | 5800930 | 5803170 | − | ID = TGME49_237230; length = 2240 | 2062 |
| TGME49_chrIX | 3725934 | 3727613 | + | ID = TGME49_290460; length = 1679 | 2063 |
| TGME49_chrVI | 831846 | 833871 | − | ID = TGME49_239680; length = 2025 | 2064 |
| TGME49_chrX | 184156 | 186759 | − | ID = TGME49_228730; length = 2603 | 2065 |
| TGME49_chrIX | 608936 | 612060 | − | ID = TGME49_267510; length = 3124 | 2066 |
| TGME49_chrVIII | 2604042 | 2605811 | + | ID = TGME49_233350; length = 1769 | 2067 |
| TGME49_chrVI | 3370292 | 3371967 | + | ID = TGME49_244580; length = 1675 | 2068 |
| TGME49_chrVIIb | 4313028 | 4313787 | − | ID = TGME49_256975; length = 759 | 2069 |
| TGME49_chrXI | 5775427 | 5777232 | − | ID = TGME49_216960; length = 1805 | 2070 |
| TGME49_chrVIIb | 2103737 | 2106170 | − | ID = TGME49_260640; length = 2433 | 2071 |
| TGME49_chrX | 1795604 | 1797542 | + | ID = TGME49_226100; length = 1938 | 2072 |
| TGME49_chrX | 418101 | 419981 | + | ID = TGME49_228320; length = 1880 | 2073 |
| TGME49_chrXI | 1340616 | 1343000 | + | ID = TGME49_310440; length = 2384 | 2074 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 3355308 | 3357831 | + | ID = TGME49_289630; length = 2523 | 2075 |
| TGME49_chrVIII | 2192583 | 2194733 | + | ID = TGME49_232620; length = 2150 | 2076 |
| TGME49_chrVIIb | 4636561 | 4638383 | − | ID = TGME49_255900; length = 1822 | 2077 |
| TGME49_chrVIII | 5588163 | 5590158 | + | ID = TGME49_269820; length = 1995 | 2078 |
| TGME49_chrVI | 3247506 | 3250212 | − | ID = TGME49_244408; length = 2706 | 2079 |
| TGME49_chrVIIa | 2051496 | 2056236 | − | ID = TGME49_204010; length = 4740 | 2080 |
| TGME49_chrVIII | 491985 | 494558 | + | ID = TGME49_229980; length = 2573 | 2081 |
| TGME49_chrVIIa | 2056536 | 2058106 | + | ID = TGME49_203985; length = 1570 | 2082 |
| TGME49_chrVIIa | 140276 | 144404 | + | ID = TGME49_280725; length = 4128 | 2083 |
| TGME49_chrVIII | 2250698 | 2252771 | − | ID = TGME49_232750; length = 2073 | 2084 |
| TGME49_chrVIII | 5887047 | 5889397 | − | ID = TGME49_269340; length = 2350 | 2085 |
| TGME49_chrXI | 1052803 | 1054295 | − | ID = TGME49_310090; length = 1492 | 2086 |
| TGME49_chrVI | 1279772 | 1281594 | + | ID = TGME49_240440; length = 1822 | 2087 |
| TGME49_chrVIIb | 756456 | 758017 | − | ID = TGME49_263160; length = 1561 | 2088 |
| TGME49_chrII | 1811993 | 1815135 | + | ID = TGME49_297480; length = 3142 | 2089 |
| TGME49_chrVIIa | 990948 | 995424 | − | ID = TGME49_206430; length = 4476 | 2090 |
| TGME49_chrV | 2986113 | 2990861 | − | ID = TGME49_283770; length = 4748 | 2091 |
| TGME49_chrXII | 850493 | 852277 | − | ID = TGME49_219560; length = 1784 | 2092 |
| TGME49_chrIV | 1344162 | 1349005 | − | ID = TGME49_318430; length = 4843 | 2093 |
| TGME49_chrVIIb | 1056333 | 1059103 | − | ID = TGME49_262730; length = 2770 | 2094 |
| TGME49_chrVIII | 4661713 | 4663360 | − | ID = TGME49_271170; length = 1647 | 2095 |
| TGME49_chrXI | 5942768 | 5945248 | + | ID = TGME49_216720; length = 2480 | 2096 |
| TGME49_chrXI | 1779520 | 1783053 | + | ID = TGME49_311075; length = 3533 | 2097 |
| TGME49_chrIb | 1820664 | 1822422 | + | ID = TGME49_321420; length = 1758 | 2098 |
| TGME49_chrX | 1944153 | 1948496 | + | ID = TGME49_225900; length = 4343 | 2099 |
| TGME49_chrVIIa | 1201335 | 1202972 | + | ID = TGME49_205710; length = 1637 | 2100 |
| TGME49_chrXI | 4872334 | 4874729 | − | ID = TGME49_315640; length = 2395 | 2101 |
| TGME49_chrVIII | 1554633 | 1557549 | + | ID = TGME49_231815; length = 2916 | 2102 |
| TGME49_chrXI | 3051809 | 3056712 | + | ID = TGME49_313030; length = 4903 | 2103 |
| TGME49_chrX | 2840250 | 2842141 | − | ID = TGME49_224750; length = 1891 | 2104 |
| TGME49_chrIX | 2419221 | 2423061 | + | ID = TGME49_288260; length = 3840 | 2105 |
| TGME49_chrII | 443749 | 446045 | − | ID = TGME49_221560; length = 2296 | 2106 |
| TGME49_chrVIIb | 1969192 | 1973085 | − | ID = TGME49_261018; length = 3893 | 2107 |
| TGME49_chrX | 2971389 | 2973789 | − | ID = TGME49_224575; length = 2400 | 2108 |
| TGME49_chrIX | 509919 | 513149 | − | ID = TGME49_267642; length = 3230 | 2109 |
| TGME49_chrXI | 5787432 | 5789807 | − | ID = TGME49_216930; length = 2375 | 2110 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 4469028 | 4471277 | − | ID = TGME49_292000; length = 2249 | 2111 |
| TGME49_chrIX | 4276237 | 4279338 | − | ID = TGME49_291360; length = 3101 | 2112 |
| TGME49_chrVIIb | 2342177 | 2343737 | − | ID = TGME49_260360; length = 1560 | 2113 |
| TGME49_chrXI | 1287445 | 1292319 | + | ID = TGME49_310360; length = 4874 | 2114 |
| TGME49_chrXII | 5070692 | 5074348 | − | ID = TGME49_250360; length = 3656 | 2115 |
| TGME49_chrVIIb | 1569559 | 1572751 | + | ID = TGME49_261710; length = 3192 | 2116 |
| TGME49_chrX | 2583373 | 2586162 | − | ID = TGME49_225020; length = 2789 | 2117 |
| TGME49_chrVIII | 1386339 | 1390571 | − | ID = TGME49_231370; length = 4232 | 2118 |
| TGME49_chrIX | 3341749 | 3343589 | − | ID = TGME49_289600; length = 1840 | 2119 |
| TGME49_chrIX | 4852500 | 4855230 | + | ID = TGME49_210345; length = 2730 | 2120 |
| TGME49_chrVIII | 1999232 | 2003285 | − | ID = TGME49_232300; length = 4053 | 2121 |
| TGME49_chrX | 1217918 | 1218840 | + | ID = TGME49_226930; length = 922 | 2122 |
| TGME49_chrIX | 393414 | 395802 | + | ID = TGME49_267740; length = 2388 | 2123 |
| TGME49_chrVIII | 2239831 | 2241664 | − | ID = TGME49_232720; length = 1833 | 2124 |
| TGME49_chrX | 1778082 | 1780845 | + | ID = TGME49_226220; length = 2763 | 2125 |
| TGME49_chrVIIb | 4325180 | 4329892 | − | ID = TGME49_256970; length = 4712 | 2126 |
| TGME49_chrIV | 185525 | 187612 | + | ID = TGME49_320630; length = 2087 | 2127 |
| TGME49_chrXII | 5016450 | 5018497 | + | ID = TGME49_250090; length = 2047 | 2128 |
| TGME49_chrIX | 5971552 | 5972595 | + | ID = TGME49_306334; length = 1043 | 2129 |
| TGME49_chrIV | 1654904 | 1658845 | − | ID = TGME49_211640; length = 3941 | 2130 |
| TGME49_chrIV | 1691102 | 1693242 | + | ID = TGME49_211470; length = 2140 | 2131 |
| TGME49_chrVIII | 1440721 | 1442757 | + | ID = TGME49_231460; length = 2036 | 2132 |
| TGME49_chrXI | 2173066 | 2177892 | − | ID = TGME49_311640; length = 4826 | 2133 |
| TGME49_chrX | 5232720 | 5234701 | + | ID = TGME49_236000; length = 1981 | 2134 |
| TGME49_chrXI | 2361325 | 2365388 | + | ID = TGME49_311905; length = 4063 | 2135 |
| TGME49_chrVIII | 2482479 | 2486633 | − | ID = TGME49_233180; length = 4154 | 2136 |
| TGME49_chrXII | 205121 | 208744 | − | ID = TGME49_300120; length = 3623 | 2137 |
| TGME49_chrXII | 5293378 | 5296947 | − | ID = TGME49_250870; length = 3569 | 2138 |
| TGME49_chrIX | 4582773 | 4584034 | − | ID = TGME49_292150; length = 1261 | 2139 |
| TGME49_chrVIIb | 2118657 | 2123522 | − | ID = TGME49_260620; length = 4865 | 2140 |
| TGME49_chrXII | 3632829 | 3637477 | + | ID = TGME49_247950; length = 4648 | 2141 |
| TGME49_chrVIII | 3416508 | 3419960 | + | ID = TGME49_273520; length = 3452 | 2142 |
| TGME49_chrX | 7007085 | 7010674 | − | ID = TGME49_215540; length = 3589 | 2143 |
| TGME49_chrX | 2610836 | 2612776 | − | ID = TGME49_224990; length = 1940 | 2144 |
| TGME49_chrXII | 286679 | 290951 | + | ID = TGME49_300000; length = 4272 | 2145 |
| TGME49_chrXI | 1067581 | 1069045 | − | ID = TGME49_310122; length = 1464 | 2146 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 2523724 | 2528425 | − | ID = TGME49_203390; length = 4701 | 2147 |
| TGME49_chrVIII | 6368584 | 6372245 | + | ID = TGME49_268670; length = 3661 | 2148 |
| TGME49_chrIX | 2379171 | 2383345 | + | ID = TGME49_288210; length = 4174 | 2149 |
| TGME49_chrX | 6247060 | 6249835 | − | ID = TGME49_214310; length = 2775 | 2150 |
| TGME49_chrX | 4410724 | 4415344 | − | ID = TGME49_234470; length = 4620 | 2151 |
| TGME49_chrVIII | 483790 | 485820 | + | ID = TGME49_229950; length = 2030 | 2152 |
| TGME49_chrVIIa | 1207940 | 1212921 | + | ID = TGME49_205690; length = 4981 | 2153 |
| TGME49_chrIV | 548750 | 550949 | + | ID = TGME49_320050; length = 2199 | 2154 |
| TGME49_chrXI | 3335719 | 3337418 | + | ID = TGME49_313390; length = 1699 | 2155 |
| TGME49_chrX | 4499729 | 4504428 | + | ID = TGME49_234625; length = 4699 | 2156 |
| TGME49_chrIX | 1306171 | 1308162 | − | ID = TGME49_266100; length = 1991 | 2157 |
| TGME49_chrX | 4987373 | 4988579 | + | ID = TGME49_235620; length = 1206 | 2158 |
| TGME49_chrII | 2049153 | 2053496 | − | ID = TGME49_297820; length = 4343 | 2159 |
| TGME49_chrIb | 1005392 | 1010351 | − | ID = TGME49_209040; length = 4959 | 2160 |
| TGME49_chrIV | 1416910 | 1419099 | + | ID = TGME49_318320; length = 2189 | 2161 |
| TGME49_chrV | 1823713 | 1827597 | − | ID = TGME49_286460; length = 3884 | 2162 |
| TGME49_chrXII | 6505888 | 6507354 | − | ID = TGME49_277800; length = 1466 | 2163 |
| TGME49_chrXII | 3889671 | 3891930 | − | ID = TGME49_248490; length = 2259 | 2164 |
| TGME49_chrVIIa | 1516113 | 1517866 | − | ID = TGME49_205250; length = 1753 | 2165 |
| TGME49_chrVIIa | 4147257 | 4149471 | − | ID = TGME49_281480; length = 2214 | 2166 |
| TGME49_chrVIII | 2668587 | 2671322 | + | ID = TGME49_233480; length = 2735 | 2167 |
| TGME49_chrIX | 5608315 | 5609770 | + | ID = TGME49_305830; length = 1455 | 2168 |
| TGME49_chrX | 5460615 | 5465206 | − | ID = TGME49_236630; length = 4591 | 2169 |
| TGME49_chrIb | 446581 | 448900 | − | ID = TGME49_207930; length = 2319 | 2170 |
| TGME49_chrVI | 2958204 | 2962910 | + | ID = TGME49_244020; length = 4706 | 2171 |
| TGME49_chrXI | 2553635 | 2555730 | − | ID = TGME49_312260; length = 2095 | 2172 |
| TGME49_chrVIII | 5353669 | 5357579 | + | ID = TGME49_270170; length = 3910 | 2173 |
| TGME49_chrXII | 224079 | 225774 | + | ID = TGME49_300090; length = 1695 | 2174 |
| TGME49_chrVIIb | 4614928 | 4619845 | − | ID = TGME49_255960; length = 4917 | 2175 |
| TGME49_chrVIII | 1473271 | 1475198 | − | ID = TGME49_231480; length = 1927 | 2176 |
| TGME49_chrVIIa | 2707675 | 2711017 | + | ID = TGME49_203170; length = 3342 | 2177 |
| TGME49_chrX | 4325394 | 4328594 | + | ID = TGME49_234375; length = 3200 | 2178 |
| TGME49_chrVIIb | 201826 | 206450 | + | ID = TGME49_264075; length = 4624 | 2179 |
| TGME49_chrXI | 3987704 | 3989680 | − | ID = TGME49_314280; length = 1976 | 2180 |
| TGME49_chrIV | 2431107 | 2432795 | + | ID = TGME49_301390; length = 1688 | 2181 |
| TGME49_chrVIIb | 1554047 | 1557249 | − | ID = TGME49_261740; length = 3202 | 2182 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 6077898 | 6080164 | + | ID = TGME49_216570; length = 2266 | 2183 |
| TGME49_chrIX | 5907877 | 5909447 | − | ID = TGME49_306280; length = 1570 | 2184 |
| TGME49_chrIX | 1291274 | 1293712 | + | ID = TGME49_266110; length = 2438 | 2185 |
| TGME49_chrIb | 3431 | 5000 | + | ID = TGME49_207360; length = 1569 | 2186 |
| TGME49_chrIV | 749326 | 751746 | + | ID = TGME49_319740; length = 2420 | 2187 |
| TGME49_chrVIIb | 1574484 | 1575737 | + | ID = TGME49_261700; length = 1253 | 2188 |
| TGME49_chrVI | 1338921 | 1343149 | + | ID = TGME49_240630; length = 4228 | 2189 |
| TGME49_chrXII | 5539534 | 5541403 | − | ID = TGME49_251720; length = 1869 | 2190 |
| TGME49_chrVIIb | 4896623 | 4898784 | + | ID = TGME49_255330; length = 2161 | 2191 |
| TGME49_chrXII | 4733817 | 4737060 | + | ID = TGME49_249690; length = 3243 | 2192 |
| TGME49_chrII | 1383871 | 1385210 | + | ID = TGME49_223050; length = 1339 | 2193 |
| TGME49_chrXI | 4617346 | 4620622 | + | ID = TGME49_315280; length = 3276 | 2194 |
| TGME49_chrXI | 1870125 | 1871822 | + | ID = TGME49_311220; length = 1697 | 2195 |
| TGME49_chrXII | 3843245 | 3845735 | + | ID = TGME49_248425; length = 2490 | 2196 |
| TGME49_chrXII | 5389506 | 5393276 | + | ID = TGME49_251450; length = 3770 | 2197 |
| TGME49_chrVIII | 5980495 | 5982851 | − | ID = TGME49_269228; length = 2356 | 2198 |
| TGME49_chrIV | 1479718 | 1482540 | − | ID = TGME49_318220; length = 2822 | 2199 |
| TGME49_chrVIIa | 3910752 | 3912895 | − | ID = TGME49_201390; length = 2143 | 2200 |
| TGME49_chrVI | 2860199 | 2862974 | − | ID = TGME49_243790; length = 2775 | 2201 |
| TGME49_chrVIIa | 2178513 | 2180276 | − | ID = TGME49_203860; length = 1763 | 2202 |
| TGME49_chrII | 1341931 | 1344535 | + | ID = TGME49_222970; length = 2604 | 2203 |
| TGME49_chrXII | 4348700 | 4350687 | − | ID = TGME49_249160; length = 1987 | 2204 |
| TGME49_chrV | 1817252 | 1819572 | − | ID = TGME49_286485; length = 2320 | 2205 |
| TGME49_chrIX | 4096568 | 4099371 | + | ID = TGME49_291070; length = 2803 | 2206 |
| TGME49_chrV | 1456377 | 1459175 | − | ID = TGME49_213940; length = 2798 | 2207 |
| TGME49_chrIa | 1128268 | 1130676 | − | ID = TGME49_294760; length = 2408 | 2208 |
| TGME49_chrXII | 112149 | 115996 | + | ID = TGME49_300270; length = 3847 | 2209 |
| TGME49_chrIa | 1141182 | 1145699 | − | ID = TGME49_294780; length = 4517 | 2210 |
| TGME49_chrIa | 684768 | 686694 | − | ID = TGME49_294180; length = 1926 | 2211 |
| TGME49_chrXII | 1982533 | 1984559 | − | ID = TGME49_217665; length = 2026 | 2212 |
| TGME49_chrVIIb | 136836 | 141095 | − | ID = TGME49_264150; length = 4259 | 2213 |
| TGME49_chrIX | 3644889 | 3646816 | − | ID = TGME49_290200; length = 1927 | 2214 |
| TGME49_chrXI | 3416844 | 3420688 | + | ID = TGME49_313475; length = 3844 | 2215 |
| TGME49_chrXII | 5558311 | 5563031 | + | ID = TGME49_251750; length = 4720 | 2216 |
| TGME49_chrVIII | 3591126 | 3594224 | − | ID = TGME49_273330; length = 3098 | 2217 |
| TGME49_chrXI | 1907165 | 1911891 | + | ID = TGME49_311250; length = 4726 | 2218 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIb | 606581 | 608427 | + | ID = TGME49_208320; length = 1846 | 2219 |
| TGME49_chrIV | 317723 | 320840 | + | ID = TGME49_320470; length = 3117 | 2220 |
| TGME49_chrIa | 1231366 | 1233810 | + | ID = TGME49_294870; length = 2444 | 2221 |
| TGME49_chrV | 799204 | 803341 | + | ID = TGME49_213030; length = 4137 | 2222 |
| TGME49_chrXII | 4141267 | 4145015 | − | ID = TGME49_248740; length = 3748 | 2223 |
| TGME49_chrVIII | 6831032 | 6832955 | − | ID = TGME49_200370; length = 1923 | 2224 |
| TGME49_chrVIII | 5814181 | 5817773 | + | ID = TGME49_269417; length = 3592 | 2225 |
| TGME49_chrIa | 288432 | 290836 | + | ID = TGME49_293380; length = 2404 | 2226 |
| TGME49_chrX | 375771 | 377308 | + | ID = TGME49_228360; length = 1537 | 2227 |
| TGME49_chrVIIa | 2817075 | 2820018 | + | ID = TGME49_203070; length = 2943 | 2228 |
| TGME49_chrIX | 2642426 | 2644741 | + | ID = TGME49_288630; length = 2315 | 2229 |
| TGME49_chrVIIa | 3778324 | 3780703 | − | ID = TGME49_201810; length = 2379 | 2230 |
| TGME49_chrXI | 2136968 | 2138370 | − | ID = TGME49_311500; length = 1402 | 2231 |
| TGME49_chrX | 6746604 | 6749287 | + | ID = TGME49_215090; length = 2683 | 2232 |
| TGME49_chrVIIa | 428379 | 432545 | − | ID = TGME49_280420; length = 4166 | 2233 |
| TGME49_chrVI | 3187139 | 3188303 | + | ID = TGME49_244320; length = 1164 | 2234 |
| TGME49_chrVI | 1463601 | 1465416 | − | ID = TGME49_240830; length = 1815 | 2235 |
| TGME49_chrX | 6273860 | 6275989 | + | ID = TGME49_214400; length = 2129 | 2236 |
| TGME49_chrVI | 2220309 | 2222591 | + | ID = TGME49_242740; length = 2282 | 2237 |
| TGME49_chrIb | 1351872 | 1355146 | + | ID = TGME49_209590; length = 3274 | 2238 |
| TGME49_chrVIII | 294473 | 299452 | + | ID = TGME49_229490; length = 4979 | 2239 |
| TGME49_chrIV | 1996453 | 1998125 | + | ID = TGME49_210970; length = 1672 | 2240 |
| TGME49_chrVIII | 2608007 | 2611227 | + | ID = TGME49_233370; length = 3220 | 2241 |
| TGME49_chrVIIa | 3795393 | 3798765 | + | ID = TGME49_201775; length = 3372 | 2242 |
| TGME49_chrIa | 1293826 | 1295850 | + | ID = TGME49_294970; length = 2024 | 2243 |
| TGME49_chrIX | 4535750 | 4537308 | − | ID = TGME49_292070; length = 1558 | 2244 |
| TGME49_chrVIIa | 2279952 | 2283671 | − | ID = TGME49_203740; length = 3719 | 2245 |
| TGME49_chrVIIa | 485370 | 487434 | + | ID = TGME49_280380; length = 2064 | 2246 |
| TGME49_chrXI | 1095580 | 1099919 | + | ID = TGME49_310160; length = 4339 | 2247 |
| TGME49_chrVIIb | 2166762 | 2169888 | + | ID = TGME49_260540; length = 3126 | 2248 |
| TGME49_chrX | 5492381 | 5494853 | + | ID = TGME49_236780; length = 2472 | 2249 |
| TGME49_chrVIIa | 525141 | 528720 | − | ID = TGME49_304490; length = 3579 | 2250 |
| TGME49_chrXII | 1251462 | 1253195 | + | ID = TGME49_218840; length = 1733 | 2251 |
| TGME49_chrVIIb | 1044560 | 1046178 | − | ID = TGME49_262750; length = 1618 | 2252 |
| TGME49_chrXII | 4941426 | 4942964 | + | ID = TGME49_249920; length = 1538 | 2253 |
| TGME49_chrVIIb | 1995879 | 1997531 | − | ID = TGME49_260870; length = 1652 | 2254 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 4299258 | 4301184 | − | ID = TGME49_314780; length = 1926 | 2255 |
| TGME49_chrII | 1769905 | 1774752 | − | ID = TGME49_297420; length = 4847 | 2256 |
| TGME49_chrIb | 1320040 | 1321949 | − | ID = TGME49_209540; length = 1909 | 2257 |
| TGME49_chrIX | 6177117 | 6181474 | − | ID = TGME49_306550; length = 4357 | 2258 |
| TGME49_chrV | 1725092 | 1727430 | + | ID = TGME49_286680; length = 2338 | 2259 |
| TGME49_chrVI | 811913 | 814755 | + | ID = TGME49_239630; length = 2842 | 2260 |
| TGME49_chrIX | 3876282 | 3878405 | + | ID = TGME49_290840; length = 2123 | 2261 |
| TGME49_chrII | 1693029 | 1695406 | − | ID = TGME49_297330; length = 2377 | 2262 |
| TGME49_chrIb | 1214022 | 1218129 | + | ID = TGME49_209440; length = 4107 | 2263 |
| TGME49_chrVIII | 1574303 | 1578976 | + | ID = TGME49_231840; length = 4673 | 2264 |
| TGME49_chrVIIb | 4914243 | 4916993 | + | ID = TGME49_255300; length = 2750 | 2265 |
| TGME49_chrXI | 1745014 | 1749860 | − | ID = TGME49_311030; length = 4846 | 2266 |
| TGME49_chrVIII | 4131896 | 4134904 | − | ID = TGME49_272230; length = 3008 | 2267 |
| TGME49_chrXI | 186373 | 190635 | + | ID = TGME49_306910; length = 4262 | 2268 |
| TGME49_chrVIII | 4969459 | 4972682 | + | ID = TGME49_270820; length = 3223 | 2269 |
| TGME49_chrII | 252286 | 255240 | − | ID = TGME49_221320; length = 2954 | 2270 |
| TGME49_chrXII | 4665307 | 4667213 | + | ID = TGME49_249590; length = 1906 | 2271 |
| TGME49_chrXII | 183074 | 185954 | + | ID = TGME49_300140; length = 2880 | 2272 |
| TGME49_chrX | 2107642 | 2109483 | − | ID = TGME49_225730; length = 1841 | 2273 |
| TGME49_chrVIII | 5084209 | 5087859 | + | ID = TGME49_270670; length = 3650 | 2274 |
| TGME49_chrVI | 3141338 | 3146169 | − | ID = TGME49_244250; length = 4831 | 2275 |
| TGME49_chrIX | 1641728 | 1646063 | + | ID = TGME49_265260; length = 4335 | 2276 |
| TGME49_chrIb | 1625087 | 1627665 | − | ID = TGME49_321700; length = 2578 | 2277 |
| TGME49_chrII | 1708595 | 1711391 | + | ID = TGME49_297360; length = 2796 | 2278 |
| TGME49_chrXII | 2561570 | 2563897 | + | ID = TGME49_245770; length = 2327 | 2279 |
| TGME49_chrXI | 3662083 | 3664424 | − | ID = TGME49_313750; length = 2341 | 2280 |
| TGME49_chrIX | 2678976 | 2683389 | + | ID = TGME49_288700; length = 4413 | 2281 |
| TGME49_chrVIIa | 2452533 | 2454348 | − | ID = TGME49_203520; length = 1815 | 2282 |
| TGME49_chrVIII | 371670 | 372973 | − | ID = TGME49_229660; length = 1303 | 2283 |
| TGME49_chrVIII | 1338333 | 1339664 | − | ID = TGME49_231215; length = 1331 | 2284 |
| TGME49_chrXI | 2393435 | 2396761 | + | ID = TGME49_312050; length = 3326 | 2285 |
| TGME49_chrVIIb | 4834044 | 4836547 | − | ID = TGME49_255430; length = 2503 | 2286 |
| TGME49_chrIb | 454627 | 456429 | − | ID = TGME49_207940; length = 1802 | 2287 |
| TGME49_chrXII | 2364575 | 2368999 | + | ID = TGME49_245560; length = 4424 | 2288 |
| TGME49_chrIV | 290608 | 295448 | + | ID = TGME49_320500; length = 4840 | 2289 |
| TGME49_chrX | 2647792 | 2650609 | + | ID = TGME49_224940; length = 2817 | 2290 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrII | 595002 | 596475 | − | ID = TGME49_221720; length = 1473 | 2291 |
| TGME49_chrV | 6880 | 10388 | − | ID = TGME49_296121; length = 3508 | 2292 |
| TGME49_chrX | 4938563 | 4939819 | + | ID = TGME49_235550; length = 1256 | 2293 |
| TGME49_chrII | 24693 | 25319 | − | ID = TGME49_220850; length = 626 | 2294 |
| TGME49_chrXII | 6568190 | 6570515 | − | ID = TGME49_277700; length = 2325 | 2295 |
| TGME49_chrIV | 2058603 | 2061707 | + | ID = TGME49_210787; length = 3104 | 2296 |
| TGME49_chrX | 4451079 | 4454735 | − | ID = TGME49_234550; length = 3656 | 2297 |
| TGME49_chrX | 155871 | 160694 | − | ID = TGME49_228760; length = 4823 | 2298 |
| TGME49_chrX | 7041981 | 7044359 | − | ID = TGME49_215590; length = 2378 | 2299 |
| TGME49_chrVIIb | 1979166 | 1981300 | − | ID = TGME49_261010; length = 2134 | 2300 |
| TGME49_chrVIIa | 266318 | 267937 | + | ID = TGME49_280605; length = 1619 | 2301 |
| TGME49_chrVIII | 2855573 | 2856668 | + | ID = TGME49_233860; length = 1095 | 2302 |
| TGME49_chrIb | 609246 | 614107 | + | ID = TGME49_208340; length = 4861 | 2303 |
| TGME49_chrX | 6384134 | 6388240 | − | ID = TGME49_214580; length = 4106 | 2304 |
| TGME49_chrVI | 280442 | 282228 | + | ID = TGME49_238880; length = 1786 | 2305 |
| TGME49_chrIX | 1848942 | 1852708 | − | ID = TGME49_265005; length = 3766 | 2306 |
| TGME49_chrX | 5418981 | 5422356 | − | ID = TGME49_236550; length = 3375 | 2307 |
| TGME49_chrIa | 1274681 | 1276904 | + | ID = TGME49_294930; length = 2223 | 2308 |
| TGME49_chrIa | 665674 | 667870 | − | ID = TGME49_294050; length = 2196 | 2309 |
| TGME49_chrVIIb | 2761844 | 2763517 | + | ID = TGME49_259580; length = 1673 | 2310 |
| TGME49_chrIV | 1596497 | 1598239 | + | ID = TGME49_211695; length = 1742 | 2311 |
| TGME49_chrVIII | 2332258 | 2334583 | − | ID = TGME49_233000; length = 2325 | 2312 |
| TGME49_chrVIIb | 3451188 | 3453211 | − | ID = TGME49_258370; length = 2023 | 2313 |
| TGME49_chrIX | 5257875 | 5259734 | + | ID = TGME49_305160; length = 1859 | 2314 |
| TGME49_chrVIII | 5392733 | 5393889 | − | ID = TGME49_270130; length = 1156 | 2315 |
| TGME49_chrXI | 5688551 | 5689284 | − | ID = TGME49_217178; length = 733 | 2316 |
| TGME49_chrIa | 1150051 | 1152041 | − | ID = TGME49_294800; length = 1990 | 2317 |
| TGME49_chrVIIa | 691948 | 694230 | − | ID = TGME49_304755; length = 2282 | 2318 |
| TGME49_chrX | 4196707 | 4198737 | + | ID = TGME49_234220; length = 2030 | 2319 |
| TGME49_chrVI | 709612 | 711661 | − | ID = TGME49_239480; length = 2049 | 2320 |
| TGME49_chrXII | 2645668 | 2648078 | − | ID = TGME49_246070; length = 2410 | 2321 |
| TGME49_chrVIIb | 381484 | 385908 | + | ID = TGME49_263700; length = 4424 | 2322 |
| TGME49_chrXI | 3822805 | 3823979 | + | ID = TGME49_313940; length = 1174 | 2323 |
| TGME49_chrVIII | 5492973 | 5494998 | − | ID = TGME49_269970; length = 2025 | 2324 |
| TGME49_chrII | 1955364 | 1959181 | − | ID = TGME49_297725; length = 3817 | 2325 |
| TGME49_chrVIIa | 4402459 | 4404312 | + | ID = TGME49_282150; length = 1853 | 2326 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 3723634 | 3724688 | − | ID = TGME49_223590; length = 1054 | 2327 |
| TGME49_chrX | 3023442 | 3025405 | − | ID = TGME49_224510; length = 1963 | 2328 |
| TGME49_chrVIII | 1956674 | 1958845 | − | ID = TGME49_232210; length = 2171 | 2329 |
| TGME49_chrIX | 2177881 | 2182679 | + | ID = TGME49_264600; length = 4798 | 2330 |
| TGME49_chrVI | 3228134 | 3231037 | − | ID = TGME49_244380; length = 2903 | 2331 |
| TGME49_chrXII | 161554 | 164207 | + | ID = TGME49_300190; length = 2653 | 2332 |
| TGME49_chrV | 2386955 | 2388910 | − | ID = TGME49_285490; length = 1955 | 2333 |
| TGME49_chrXI | 5923806 | 5928393 | − | ID = TGME49_216750; length = 4587 | 2334 |
| TGME49_chrVIII | 5218604 | 5220893 | + | ID = TGME49_270510; length = 2289 | 2335 |
| TGME49_chrXII | 448136 | 451773 | − | ID = TGME49_307850; length = 3637 | 2336 |
| TGME49_chrXI | 329830 | 333208 | + | ID = TGME49_308890; length = 3378 | 2337 |
| TGME49_chrVIIb | 4982223 | 4984936 | + | ID = TGME49_255230; length = 2713 | 2338 |
| TGME49_chrVI | 1338921 | 1340659 | + | ID = TGME49_240620; length = 1738 | 2339 |
| TGME49_chrVIIa | 2710672 | 2712535 | − | ID = TGME49_203175; length = 1863 | 2340 |
| TGME49_chrIa | 783634 | 786312 | + | ID = TGME49_294300; length = 2678 | 2341 |
| TGME49_chrVIIa | 2207067 | 2211546 | − | ID = TGME49_203820; length = 4479 | 2342 |
| TGME49_chrVIIb | 1410124 | 1411940 | + | ID = TGME49_262040; length = 1816 | 2343 |
| TGME49_chrV | 1762123 | 1764217 | − | ID = TGME49_286620; length = 2094 | 2344 |
| TGME49_chrXI | 2444171 | 2445480 | − | ID = TGME49_312120; length = 1309 | 2345 |
| TGME49_chrIX | 2304200 | 2309017 | + | ID = TGME49_288030; length = 4817 | 2346 |
| TGME49_chrXII | 3107046 | 3108961 | + | ID = TGME49_247020; length = 1915 | 2347 |
| TGME49_chrXII | 1088408 | 1090747 | − | ID = TGME49_219190; length = 2339 | 2348 |
| TGME49_chrVIII | 5243101 | 5244559 | − | ID = TGME49_270380; length = 1458 | 2349 |
| TGME49_chrIX | 3661389 | 3662897 | + | ID = TGME49_290240; length = 1508 | 2350 |
| TGME49_chrIb | 1465240 | 1466759 | − | ID = TGME49_209810; length = 1519 | 2351 |
| TGME49_chrVIIb | 4093997 | 4097159 | + | ID = TGME49_257360; length = 3162 | 2352 |
| TGME49_chrIX | 2730019 | 2732515 | − | ID = TGME49_288760; length = 2496 | 2353 |
| TGME49_chrXI | 1804715 | 1808023 | + | ID = TGME49_311100; length = 3308 | 2354 |
| TGME49_chrX | 4252113 | 4254822 | − | ID = TGME49_234250; length = 2709 | 2355 |
| TGME49_chrXI | 3602353 | 3604400 | − | ID = TGME49_313677; length = 2047 | 2356 |
| TGME49_chrVIII | 2912818 | 2914466 | + | ID = TGME49_233940; length = 1648 | 2357 |
| TGME49_chrX | 7000639 | 7004503 | + | ID = TGME49_215530; length = 3864 | 2358 |
| TGME49_chrVIII | 2289768 | 2291993 | − | ID = TGME49_232940; length = 2225 | 2359 |
| TGME49_chrX | 5258198 | 5260065 | − | ID = TGME49_236060; length = 1867 | 2360 |
| TGME49_chrVIII | 1884485 | 1889437 | + | ID = TGME49_232150; length = 4952 | 2361 |
| TGME49_chrXII | 1882976 | 1885676 | + | ID = TGME49_217510; length = 2700 | 2362 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 1049905 | 1054351 | − | ID = TGME49_227280; length = 4446 | 2363 |
| TGME49_chrIa | 1246263 | 1247746 | − | ID = TGME49_294880; length = 1483 | 2364 |
| TGME49_chrXII | 5892198 | 5894986 | − | ID = TGME49_278770; length = 2788 | 2365 |
| TGME49_chrV | 160407 | 162730 | − | ID = TGME49_220132; length = 2323 | 2366 |
| TGME49_chrX | 3757076 | 3761771 | + | ID = TGME49_223520; length = 4695 | 2367 |
| TGME49_chrVIII | 3809166 | 3812131 | − | ID = TGME49_272670; length = 2965 | 2368 |
| TGME49_chrVI | 2816314 | 2820874 | − | ID = TGME49_243720; length = 4560 | 2369 |
| TGME49_chrX | 1866919 | 1870597 | + | ID = TGME49_226010; length = 3678 | 2370 |
| TGME49_chrIa | 1655906 | 1660726 | + | ID = TGME49_295640; length = 4820 | 2371 |
| TGME49_chrXII | 2497045 | 2499685 | + | ID = TGME49_245730; length = 2640 | 2372 |
| TGME49_chrIb | 1368907 | 1370576 | + | ID = TGME49_209640; length = 1669 | 2373 |
| TGME49_chrVIIa | 1055163 | 1058273 | − | ID = TGME49_206340; length = 3110 | 2374 |
| TGME49_chrX | 2106968 | 2108843 | + | ID = TGME49_225720; length = 1875 | 2375 |
| TGME49_chrVIIa | 647552 | 651135 | − | ID = TGME49_304710; length = 3583 | 2376 |
| TGME49_chrVIIb | 2433977 | 2435254 | + | ID = TGME49_260230; length = 1277 | 2377 |
| TGME49_chrVIII | 5093749 | 5096679 | + | ID = TGME49_270660; length = 2930 | 2378 |
| TGME49_chrIX | 4712512 | 4716695 | + | ID = TGME49_292375; length = 4183 | 2379 |
| TGME49_chrIX | 3824648 | 3829311 | + | ID = TGME49_290670; length = 4663 | 2380 |
| TGME49_chrVIIa | 2937184 | 2941974 | + | ID = TGME49_202930; length = 4790 | 2381 |
| TGME49_chrIb | 264375 | 266961 | + | ID = TGME49_207760; length = 2586 | 2382 |
| TGME49_chrX | 1064095 | 1066354 | + | ID = TGME49_227150; length = 2259 | 2383 |
| TGME49_chrVIIa | 2238651 | 2240842 | + | ID = TGME49_203780; length = 2191 | 2384 |
| TGME49_chrXII | 5511516 | 5514022 | + | ID = TGME49_251660; length = 2506 | 2385 |
| TGME49_chrIX | 2729523 | 2732515 | − | ID = TGME49_288755; length = 2992 | 2386 |
| TGME49_chrXI | 6523631 | 6524512 | − | ID = TGME49_215930; length = 881 | 2387 |
| TGME49_chrVIIa | 1477054 | 1478405 | + | ID = TGME49_205310; length = 1351 | 2388 |
| TGME49_chrIa | 1299896 | 1301681 | + | ID = TGME49_294980; length = 1785 | 2389 |
| TGME49_chrXII | 5478826 | 5481198 | + | ID = TGME49_251600; length = 2372 | 2390 |
| TGME49_chrIX | 195627 | 197977 | + | ID = TGME49_279410; length = 2350 | 2391 |
| TGME49_chrIX | 2585255 | 2587746 | − | ID = TGME49_288500; length = 2491 | 2392 |
| TGME49_chrX | 551024 | 553273 | + | ID = TGME49_228130; length = 2249 | 2393 |
| TGME49_chrVIII | 1246299 | 1247749 | − | ID = TGME49_231110; length = 1450 | 2394 |
| TGME49_chrIX | 6076772 | 6079949 | + | ID = TGME49_306440; length = 3177 | 2395 |
| TGME49_chrXI | 112403 | 113739 | + | ID = TGME49_307030; length = 1336 | 2396 |
| TGME49_chrVIIa | 1486724 | 1489206 | − | ID = TGME49_205300; length = 2482 | 2397 |
| TGME49_chrIX | 3901723 | 3904302 | + | ID = TGME49_290870; length = 2579 | 2398 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 3000871 | 3002525 | − | ID = TGME49_289110; length = 1654 | 2399 |
| TGME49_chrXII | 6457403 | 6459638 | − | ID = TGME49_277880; length = 2235 | 2400 |
| TGME49_chrXI | 1383113 | 1385121 | − | ID = TGME49_310490; length = 2008 | 2401 |
| TGME49_chrXII | 3586775 | 3589201 | + | ID = TGME49_247790; length = 2426 | 2402 |
| TGME49_chrVI | 2515479 | 2520512 | − | ID = TGME49_243290; length = 5033 | 2403 |
| TGME49_chrV | 2197440 | 2199492 | + | ID = TGME49_285825; length = 2052 | 2404 |
| TGME49_chrVIIb | 2639665 | 2642073 | − | ID = TGME49_259880; length = 2408 | 2405 |
| TGME49_chrIV | 431416 | 433165 | − | ID = TGME49_320220; length = 1749 | 2406 |
| TGME49_chrX | 5202475 | 5203919 | + | ID = TGME49_235960; length = 1444 | 2407 |
| TGME49_chrIa | 1716758 | 1718720 | − | ID = TGME49_295590; length = 1962 | 2408 |
| TGME49_chrXI | 5155486 | 5157169 | − | ID = TGME49_316140; length = 1683 | 2409 |
| TGME49_chrIX | 3156705 | 3158620 | + | ID = TGME49_289300; length = 1915 | 2410 |
| TGME49_chrXI | 1433031 | 1437316 | − | ID = TGME49_310530; length = 4285 | 2411 |
| TGME49_chrXII | 6860302 | 6862811 | + | ID = TGME49_276900; length = 2509 | 2412 |
| TGME49_chrXI | 4976219 | 4980235 | + | ID = TGME49_315780; length = 4016 | 2413 |
| TGME49_chrV | 2340890 | 2344008 | + | ID = TGME49_285530; length = 3118 | 2414 |
| TGME49_chrIX | 1539888 | 1543369 | − | ID = TGME49_265460; length = 3481 | 2415 |
| TGME49_chrX | 447801 | 449204 | + | ID = TGME49_228250; length = 1403 | 2416 |
| TGME49_chrVI | 3140054 | 3144151 | + | ID = TGME49_244260; length = 4097 | 2417 |
| TGME49_chrVIII | 1584008 | 1588110 | + | ID = TGME49_231850; length = 4102 | 2418 |
| TGME49_chrXII | 2862004 | 2863907 | − | ID = TGME49_246570; length = 1903 | 2419 |
| TGME49_chrXI | 2664415 | 2666362 | + | ID = TGME49_312410; length = 1947 | 2420 |
| TGME49_chrVIIb | 4219478 | 4221342 | − | ID = TGME49_257110; length = 1864 | 2421 |
| TGME49_chrVIIa | 771238 | 775785 | + | ID = TGME49_206620; length = 4547 | 2422 |
| TGME49_chrII | 1988671 | 1990219 | + | ID = TGME49_297780; length = 1548 | 2423 |
| TGME49_chrIX | 2205860 | 2206820 | + | ID = TGME49_264468; length = 960 | 2424 |
| TGME49_chrVIIb | 3575786 | 3577531 | − | ID = TGME49_258100; length = 1745 | 2425 |
| TGME49_chrIV | 2324732 | 2325789 | − | ID = TGME49_301218; length = 1057 | 2426 |
| TGME49_chrXII | 3033076 | 3037430 | + | ID = TGME49_246960; length = 4354 | 2427 |
| TGME49_chrXI | 6360743 | 6365335 | − | ID = TGME49_216180; length = 4592 | 2428 |
| TGME49_chrVIIa | 4364743 | 4368384 | − | ID = TGME49_282055; length = 3641 | 2429 |
| TGME49_chrVIII | 4265575 | 4269776 | + | ID = TGME49_271950; length = 4201 | 2430 |
| TGME49_chrIX | 327730 | 328648 | − | ID = TGME49_267830; length = 918 | 2431 |
| TGME49_chrII | 1381881 | 1383797 | − | ID = TGME49_223040; length = 1916 | 2432 |
| TGME49_chrVIIb | 3189128 | 3193873 | − | ID = TGME49_258780; length = 4745 | 2433 |
| TGME49_chrX | 6602519 | 6604937 | + | ID = TGME49_214940; length = 2418 | 2434 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 6221111 | 6222788 | + | ID = TGME49_278220; length = 1677 | 2435 |
| TGME49_chrIX | 2394576 | 2396348 | + | ID = TGME49_288220; length = 1772 | 2436 |
| TGME49_chrXI | 1696849 | 1700575 | − | ID = TGME49_310960; length = 3726 | 2437 |
| TGME49_chrX | 1788172 | 1791138 | + | ID = TGME49_226110; length = 2966 | 2438 |
| TGME49_chrXI | 2442282 | 2445480 | − | ID = TGME49_312110; length = 3198 | 2439 |
| TGME49_chrIX | 219922 | 222865 | + | ID = TGME49_279370; length = 2943 | 2440 |
| TGME49_chrXI | 4873358 | 4874729 | − | ID = TGME49_315650; length = 1371 | 2441 |
| TGME49_chrX | 7446398 | 7448098 | − | ID = TGME49_207200; length = 1700 | 2442 |
| TGME49_chrV | 2245097 | 2246666 | − | ID = TGME49_285780; length = 1569 | 2443 |
| TGME49_chrVIIa | 515933 | 519026 | + | ID = TGME49_304480; length = 3093 | 2444 |
| TGME49_chrIb | 1740080 | 1742565 | + | ID = TGME49_321540; length = 2485 | 2445 |
| TGME49_chrXI | 4257933 | 4259598 | + | ID = TGME49_314740; length = 1665 | 2446 |
| TGME49_chrIb | 761021 | 764259 | + | ID = TGME49_208540; length = 3238 | 2447 |
| TGME49_chrVI | 3450966 | 3453208 | − | ID = TGME49_244680; length = 2242 | 2448 |
| TGME49_chrXI | 4755042 | 4759341 | − | ID = TGME49_315490; length = 4299 | 2449 |
| TGME49_chrX | 7372773 | 7375242 | − | ID = TGME49_207070; length = 2469 | 2450 |
| TGME49_chrXI | 1587139 | 1588848 | − | ID = TGME49_310770; length = 1709 | 2451 |
| TGME49_chrVIII | 943428 | 945265 | − | ID = TGME49_230660; length = 1837 | 2452 |
| TGME49_chrX | 552123 | 553994 | − | ID = TGME49_228145; length = 1871 | 2453 |
| TGME49_chrIX | 3459714 | 3462359 | − | ID = TGME49_289790; length = 2645 | 2454 |
| TGME49_chrVIIa | 3339066 | 3342796 | + | ID = TGME49_202410; length = 3730 | 2455 |
| TGME49_chrXI | 6491504 | 6494435 | + | ID = TGME49_215980; length = 2931 | 2456 |
| TGME49_chrXII | 2583712 | 2585703 | − | ID = TGME49_245990; length = 1991 | 2457 |
| TGME49_chrVI | 2637439 | 2640089 | − | ID = TGME49_243440; length = 2650 | 2458 |
| TGME49_chrV | 2386130 | 2388506 | + | ID = TGME49_285480; length = 2376 | 2459 |
| TGME49_chrXII | 3015620 | 3017791 | − | ID = TGME49_246910; length = 2171 | 2460 |
| TGME49_chrVIII | 4302700 | 4305790 | − | ID = TGME49_271888; length = 3090 | 2461 |
| TGME49_chrVIIa | 1866251 | 1869833 | − | ID = TGME49_204350; length = 3582 | 2462 |
| TGME49_chrX | 5570013 | 5572759 | − | ID = TGME49_236910; length = 2746 | 2463 |
| TGME49_chrVIII | 3179578 | 3181888 | + | ID = TGME49_273905; length = 2310 | 2464 |
| TGME49_chrX | 6220314 | 6222244 | − | ID = TGME49_214295; length = 1930 | 2465 |
| TGME49_chrIX | 2323164 | 2325191 | − | ID = TGME49_288040; length = 2027 | 2466 |
| TGME49_chrX | 5603877 | 5606138 | − | ID = TGME49_236950; length = 2261 | 2467 |
| TGME49_chrVI | 3027874 | 3028418 | + | ID = TGME49_244105; length = 544 | 2468 |
| TGME49_chrVIIb | 2894337 | 2897600 | − | ID = TGME49_259200; length = 3263 | 2469 |
| TGME49_chrVIII | 5588163 | 5592490 | + | ID = TGME49_269800; length = 4327 | 2470 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 2114298 | 2117359 | + | ID = TGME49_225690; length = 3061 | 2471 |
| TGME49_chrXII | 4806777 | 4808523 | + | ID = TGME49_249810; length = 1746 | 2472 |
| TGME49_chrIX | 199072 | 199671 | + | ID = TGME49_279405; length = 599 | 2473 |
| TGME49_chrX | 2768326 | 2773227 | − | ID = TGME49_224860; length = 4901 | 2474 |
| TGME49_chrIa | 1487388 | 1491082 | − | ID = TGME49_295920; length = 3694 | 2475 |
| TGME49_chrX | 2226755 | 2227625 | − | ID = TGME49_225460; length = 870 | 2476 |
| TGME49_chrVIIa | 4203574 | 4207561 | − | ID = TGME49_281575; length = 3987 | 2477 |
| TGME49_chrIX | 5143608 | 5146410 | + | ID = TGME49_304990; length = 2802 | 2478 |
| TGME49_chrII | 700644 | 704009 | + | ID = TGME49_221930; length = 3365 | 2479 |
| TGME49_chrVIII | 4887753 | 4889510 | + | ID = TGME49_270900; length = 1757 | 2480 |
| TGME49_chrVIIb | 238808 | 241001 | − | ID = TGME49_264010; length = 2193 | 2481 |
| TGME49_chrX | 6494458 | 6497510 | − | ID = TGME49_214780; length = 3052 | 2482 |
| TGME49_chrX | 3945025 | 3947454 | + | ID = TGME49_212275; length = 2429 | 2483 |
| TGME49_chrXI | 784810 | 787257 | + | ID = TGME49_309752; length = 2447 | 2484 |
| TGME49_chrVIIb | 654090 | 658976 | + | ID = TGME49_263280; length = 4886 | 2485 |
| TGME49_chrVI | 1116533 | 1119178 | + | ID = TGME49_240255; length = 2645 | 2486 |
| TGME49_chrVIII | 3232920 | 3235018 | − | ID = TGME49_273840; length = 2098 | 2487 |
| TGME49_chrX | 4499729 | 4502574 | + | ID = TGME49_234622; length = 2845 | 2488 |
| TGME49_chrV | 1439721 | 1442480 | − | ID = TGME49_213920; length = 2759 | 2489 |
| TGME49_chrVIIb | 3409366 | 3413789 | + | ID = TGME49_258450; length = 4423 | 2490 |
| TGME49_chrVIIb | 1424754 | 1426396 | + | ID = TGME49_262010; length = 1642 | 2491 |
| TGME49_chrIX | 371574 | 373882 | + | ID = TGME49_267760; length = 2308 | 2492 |
| TGME49_chrVIII | 5584328 | 5586338 | + | ID = TGME49_269830; length = 2010 | 2493 |
| TGME49_chrVI | 465237 | 466979 | + | ID = TGME49_239110; length = 1742 | 2494 |
| TGME49_chrX | 2669894 | 2671902 | − | ID = TGME49_224932; length = 2008 | 2495 |
| TGME49_chrVIIa | 4422201 | 4425705 | − | ID = TGME49_282170; length = 3504 | 2496 |
| TGME49_chrXI | 611994 | 614956 | − | ID = TGME49_309280; length = 2962 | 2497 |
| TGME49_chrIb | 717976 | 721681 | − | ID = TGME49_208460; length = 3705 | 2498 |
| TGME49_chrXII | 1423485 | 1426090 | − | ID = TGME49_218570; length = 2605 | 2499 |
| TGME49_chrXII | 230042 | 234619 | − | ID = TGME49_300080; length = 4577 | 2500 |
| TGME49_chrXII | 2457647 | 2459970 | − | ID = TGME49_245660; length = 2323 | 2501 |
| TGME49_chrVIII | 6761552 | 6766520 | − | ID = TGME49_200250; length = 4968 | 2502 |
| TGME49_chrXII | 2287999 | 2289797 | − | ID = TGME49_245460; length = 1798 | 2503 |
| TGME49_chrXII | 3767325 | 3771010 | + | ID = TGME49_248270; length = 3685 | 2504 |
| TGME49_chrVIIb | 4267062 | 4268545 | + | ID = TGME49_257040; length = 1483 | 2505 |
| TGME49_chrXI | 5739747 | 5741353 | + | ID = TGME49_216980; length = 1606 | 2506 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 3566006 | 3567436 | + | ID = TGME49_202160; length = 1430 | 2507 |
| TGME49_chrVIII | 321618 | 326501 | + | ID = TGME49_229630; length = 4883 | 2508 |
| TGME49_chrXI | 4518461 | 4520837 | − | ID = TGME49_315140; length = 2376 | 2509 |
| TGME49_chrX | 5949504 | 5953689 | + | ID = TGME49_237530; length = 4185 | 2510 |
| TGME49_chrX | 3780406 | 3782419 | + | ID = TGME49_223490; length = 2013 | 2511 |
| TGME49_chrII | 1156231 | 1160734 | + | ID = TGME49_222660; length = 4503 | 2512 |
| TGME49_chrVI | 2851748 | 2852954 | − | ID = TGME49_243770; length = 1206 | 2513 |
| TGME49_chrVI | 539374 | 541507 | + | ID = TGME49_239310; length = 2133 | 2514 |
| TGME49_chrXII | 2997764 | 3002544 | − | ID = TGME49_246780; length = 4780 | 2515 |
| TGME49_chrXII | 849594 | 852277 | − | ID = TGME49_219570; length = 2683 | 2516 |
| TGME49_chrX | 2240720 | 2242446 | + | ID = TGME49_225435; length = 1726 | 2517 |
| TGME49_chrVIII | 2005504 | 2007905 | − | ID = TGME49_232310; length = 2401 | 2518 |
| TGME49_chrVIIb | 82870 | 85185 | − | ID = TGME49_264210; length = 2315 | 2519 |
| TGME49_chrII | 267810 | 272793 | + | ID = TGME49_221340; length = 4983 | 2520 |
| TGME49_chrV | 2468810 | 2471121 | + | ID = TGME49_285268; length = 2311 | 2521 |
| TGME49_chrIX | 2445296 | 2446946 | − | ID = TGME49_288320; length = 1650 | 2522 |
| TGME49_chrVIIa | 133327 | 135436 | − | ID = TGME49_280740; length = 2109 | 2523 |
| TGME49_chrIb | 864047 | 867064 | − | ID = TGME49_208790; length = 3017 | 2524 |
| TGME49_chrX | 6764674 | 6769143 | + | ID = TGME49_215130; length = 4469 | 2525 |
| TGME49_chrX | 2306330 | 2309400 | − | ID = TGME49_225340; length = 3070 | 2526 |
| TGME49_chrVIII | 3300013 | 3302035 | − | ID = TGME49_273740; length = 2022 | 2527 |
| TGME49_chrIX | 2102213 | 2103786 | + | ID = TGME49_264700; length = 1573 | 2528 |
| TGME49_chrXI | 288223 | 289585 | − | ID = TGME49_308820; length = 1362 | 2529 |
| TGME49_chrX | 7191885 | 7195726 | − | ID = TGME49_275340; length = 3841 | 2530 |
| TGME49_chrIX | 3487672 | 3492693 | − | ID = TGME49_289850; length = 5021 | 2531 |
| TGME49_chrX | 7028124 | 7032199 | − | ID = TGME49_215570; length = 4075 | 2532 |
| TGME49_chrVIIa | 2186716 | 2190767 | + | ID = TGME49_203830; length = 4051 | 2533 |
| TGME49_chrVIII | 4251639 | 4253470 | − | ID = TGME49_271980; length = 1831 | 2534 |
| TGME49_chrIb | 1643069 | 1646070 | − | ID = TGME49_321680; length = 3001 | 2535 |
| TGME49_chrIX | 5602450 | 5604206 | + | ID = TGME49_305820; length = 1756 | 2536 |
| TGME49_chrVIII | 2991968 | 2993305 | − | ID = TGME49_274140; length = 1337 | 2537 |
| TGME49_chrVIII | 5299297 | 5301755 | − | ID = TGME49_270273; length = 2458 | 2538 |
| TGME49_chrX | 2150245 | 2152288 | − | ID = TGME49_225570; length = 2043 | 2539 |
| TGME49_chrVI | 394289 | 399092 | − | ID = TGME49_239010; length = 4803 | 2540 |
| TGME49_chrV | 1875620 | 1880133 | − | ID = TGME49_286270; length = 4513 | 2541 |
| TGME49_chrXI | 1366381 | 1368421 | − | ID = TGME49_310455; length = 2040 | 2542 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 4113710 | 4117497 | + | ID = TGME49_248720; length = 3787 | 2543 |
| TGME49_chrXII | 2653676 | 2656148 | − | ID = TGME49_246080; length = 2472 | 2544 |
| TGME49_chrV | 1349479 | 1353386 | − | ID = TGME49_213810; length = 3907 | 2545 |
| TGME49_chrVIIa | 2290516 | 2292314 | + | ID = TGME49_203720; length = 1798 | 2546 |
| TGME49_chrIV | 1101627 | 1104332 | − | ID = TGME49_318770; length = 2705 | 2547 |
| TGME49_chrVIIb | 428872 | 432171 | + | ID = TGME49_263610; length = 3299 | 2548 |
| TGME49_chrIX | 6094343 | 6098588 | − | ID = TGME49_306450; length = 4245 | 2549 |
| TGME49_chrVIIa | 945669 | 947912 | − | ID = TGME49_206480; length = 2243 | 2550 |
| TGME49_chrVI | 1061389 | 1062893 | + | ID = TGME49_240200; length = 1504 | 2551 |
| TGME49_chrX | 5276493 | 5278337 | − | ID = TGME49_236080; length = 1844 | 2552 |
| TGME49_chrIX | 4400803 | 4405615 | + | ID = TGME49_291930; length = 4812 | 2553 |
| TGME49_chrIV | 1830458 | 1834833 | + | ID = TGME49_211310; length = 4375 | 2554 |
| TGME49_chrIV | 800777 | 803054 | + | ID = TGME49_319658; length = 2277 | 2555 |
| TGME49_chrII | 355915 | 357775 | − | ID = TGME49_221440; length = 1860 | 2556 |
| TGME49_chrXI | 1857706 | 1859770 | − | ID = TGME49_311200; length = 2064 | 2557 |
| TGME49_chrIV | 173575 | 175464 | + | ID = TGME49_320640; length = 1889 | 2558 |
| TGME49_chrIX | 4981120 | 4983371 | − | ID = TGME49_307575; length = 2251 | 2559 |
| TGME49_chrII | 1514515 | 1516458 | − | ID = TGME49_297060; length = 1943 | 2560 |
| TGME49_chrVIIa | 3755368 | 3756835 | + | ID = TGME49_201830; length = 1467 | 2561 |
| TGME49_chrVI | 1484701 | 1486911 | − | ID = TGME49_240860; length = 2210 | 2562 |
| TGME49_chrXI | 451688 | 453382 | − | ID = TGME49_309030; length = 1694 | 2563 |
| TGME49_chrVIIb | 655477 | 659865 | − | ID = TGME49_263290; length = 4388 | 2564 |
| TGME49_chrX | 309061 | 310991 | + | ID = TGME49_228440; length = 1930 | 2565 |
| TGME49_chrVIIa | 4363284 | 4367705 | + | ID = TGME49_282070; length = 4421 | 2566 |
| TGME49_chrX | 3399177 | 3401893 | − | ID = TGME49_224000; length = 2716 | 2567 |
| TGME49_chrIX | 3110902 | 3114645 | − | ID = TGME49_289240; length = 3743 | 2568 |
| TGME49_chrX | 7149209 | 7152824 | + | ID = TGME49_215775; length = 3615 | 2569 |
| TGME49_chrIV | 566220 | 568593 | + | ID = TGME49_320030; length = 2373 | 2570 |
| TGME49_chrVIII | 4360273 | 4363025 | − | ID = TGME49_271800; length = 2752 | 2571 |
| TGME49_chrXII | 2149793 | 2150458 | − | ID = TGME49_217810; length = 665 | 2572 |
| TGME49_chrX | 1677412 | 1680531 | + | ID = TGME49_226370; length = 3119 | 2573 |
| TGME49_chrIX | 2009537 | 2012433 | − | ID = TGME49_264805; length = 2896 | 2574 |
| TGME49_chrXII | 898597 | 901257 | + | ID = TGME49_219500; length = 2660 | 2575 |
| TGME49_chrVIII | 5068704 | 5071169 | − | ID = TGME49_270700; length = 2465 | 2576 |
| TGME49_chrVIIa | 2027671 | 2030677 | + | ID = TGME49_204050; length = 3006 | 2577 |
| TGME49_chrVIII | 1649426 | 1651273 | − | ID = TGME49_231920; length = 1847 | 2578 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 5008120 | 5009885 | + | ID = TGME49_250060; length = 1765 | 2579 |
| TGME49_chrVIII | 388039 | 391218 | − | ID = TGME49_229690; length = 3179 | 2580 |
| TGME49_chrIX | 2452386 | 2456727 | + | ID = TGME49_288340; length = 4341 | 2581 |
| TGME49_chrVIII | 3821895 | 3824021 | − | ID = TGME49_272645; length = 2126 | 2582 |
| TGME49_chrXI | 1390231 | 1391395 | + | ID = TGME49_310515; length = 1164 | 2583 |
| TGME49_chrXI | 1151478 | 1152895 | − | ID = TGME49_310200; length = 1417 | 2584 |
| TGME49_chrVI | 3450042 | 3452022 | + | ID = TGME49_244690; length = 1980 | 2585 |
| TGME49_chrVI | 8252 | 9653 | + | ID = TGME49_238010; length = 1401 | 2586 |
| TGME49_chrVIIa | 1054453 | 1057137 | + | ID = TGME49_206330; length = 2684 | 2587 |
| TGME49_chrVIIb | 3985832 | 3987219 | + | ID = TGME49_257540; length = 1387 | 2588 |
| TGME49_chrIX | 797312 | 799366 | − | ID = TGME49_267070; length = 2054 | 2589 |
| TGME49_chrVIIa | 3113269 | 3117191 | + | ID = TGME49_202670; length = 3922 | 2590 |
| TGME49_chrIX | 1108922 | 1111021 | − | ID = TGME49_266480; length = 2099 | 2591 |
| TGME49_chrVIII | 6007557 | 6009244 | − | ID = TGME49_269190; length = 1687 | 2592 |
| TGME49_chrII | 1888623 | 1893021 | − | ID = TGME49_297647; length = 4398 | 2593 |
| TGME49_chrV | 871531 | 873751 | − | ID = TGME49_213240; length = 2220 | 2594 |
| TGME49_chrVIII | 63466 | 67252 | + | ID = TGME49_229170; length = 3786 | 2595 |
| TGME49_chrV | 1777822 | 1780056 | + | ID = TGME49_286570; length = 2234 | 2596 |
| TGME49_chrX | 2225100 | 2226843 | + | ID = TGME49_225450; length = 1743 | 2597 |
| TGME49_chrVIII | 561740 | 564177 | − | ID = TGME49_230030; length = 2437 | 2598 |
| TGME49_chrX | 1938993 | 1940952 | + | ID = TGME49_225910; length = 1959 | 2599 |
| TGME49_chrIb | 471344 | 476049 | + | ID = TGME49_207965; length = 4705 | 2600 |
| TGME49_chrIX | 4978916 | 4982404 | + | ID = TGME49_307580; length = 3488 | 2601 |
| TGME49_chrVIIa | 160728 | 162946 | − | ID = TGME49_280710; length = 2218 | 2602 |
| TGME49_chrVIIa | 275203 | 280157 | + | ID = TGME49_280590; length = 4954 | 2603 |
| TGME49_chrVIIb | 858403 | 859587 | + | ID = TGME49_263030; length = 1184 | 2604 |
| TGME49_chrVIII | 6600438 | 6602216 | + | ID = TGME49_268250; length = 1778 | 2605 |
| TGME49_chrVIIa | 4395894 | 4398590 | + | ID = TGME49_282140; length = 2696 | 2606 |
| TGME49_chrIa | 192097 | 195881 | + | ID = TGME49_293250; length = 3784 | 2607 |
| TGME49_chrV | 2252900 | 2254312 | + | ID = TGME49_285750; length = 1412 | 2608 |
| TGME49_chrXI | 1317160 | 1319239 | + | ID = TGME49_310400; length = 2079 | 2609 |
| TGME49_chrVIII | 1664718 | 1667016 | + | ID = TGME49_231950; length = 2298 | 2610 |
| TGME49_chrIX | 2899729 | 2901760 | − | ID = TGME49_288990; length = 2031 | 2611 |
| TGME49_chrX | 6972539 | 6973901 | + | ID = TGME49_215470; length = 1362 | 2612 |
| TGME49_chrIX | 4396776 | 4400328 | − | ID = TGME49_291890; length = 3552 | 2613 |
| TGME49_chrIX | 772170 | 775776 | − | ID = TGME49_267120; length = 3606 | 2614 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 1110455 | 1114100 | + | ID = TGME49_310173; length = 3645 | 2615 |
| TGME49_chrXII | 5711051 | 5713503 | − | ID = TGME49_278990; length = 2452 | 2616 |
| TGME49_chrIV | 1118559 | 1122425 | − | ID = TGME49_318730; length = 3866 | 2617 |
| TGME49_chrVIIa | 1259192 | 1261805 | − | ID = TGME49_205625; length = 2613 | 2618 |
| TGME49_chrX | 6941543 | 6942949 | − | ID = TGME49_215390; length = 1406 | 2619 |
| TGME49_chrX | 4385644 | 4390371 | + | ID = TGME49_234440; length = 4727 | 2620 |
| TGME49_chrX | 4525519 | 4528145 | + | ID = TGME49_234690; length = 2626 | 2621 |
| TGME49_chrXI | 3917090 | 3919270 | − | ID = TGME49_314090; length = 2180 | 2622 |
| TGME49_chrXI | 6370740 | 6375773 | + | ID = TGME49_216155; length = 5033 | 2623 |
| TGME49_chrV | 1925673 | 1927982 | − | ID = TGME49_286200; length = 2309 | 2624 |
| TGME49_chrXII | 6381841 | 6386433 | + | ID = TGME49_277950; length = 4592 | 2625 |
| TGME49_chrX | 804068 | 805942 | + | ID = TGME49_227810; length = 1874 | 2626 |
| TGME49_chrVIIb | 4668460 | 4670573 | + | ID = TGME49_255870; length = 2113 | 2627 |
| TGME49_chrVIII | 2292223 | 2295223 | + | ID = TGME49_232960; length = 3000 | 2628 |
| TGME49_chrVIII | 5310860 | 5313259 | − | ID = TGME49_270250; length = 2399 | 2629 |
| TGME49_chrXII | 802072 | 803527 | + | ID = TGME49_219630; length = 1455 | 2630 |
| TGME49_chrVIII | 4546700 | 4548626 | + | ID = TGME49_271360; length = 1926 | 2631 |
| TGME49_chrXI | 599056 | 600665 | + | ID = TGME49_309265; length = 1609 | 2632 |
| TGME49_chrVIII | 3924549 | 3926856 | − | ID = TGME49_272530; length = 2307 | 2633 |
| TGME49_chrXI | 1255766 | 1257660 | − | ID = TGME49_310310; length = 1894 | 2634 |
| TGME49_chrVIIb | 2762832 | 2764576 | − | ID = TGME49_259590; length = 1744 | 2635 |
| TGME49_chrX | 2456056 | 2459220 | − | ID = TGME49_225140; length = 3164 | 2636 |
| TGME49_chrVIII | 5775921 | 5778051 | + | ID = TGME49_269460; length = 2130 | 2637 |
| TGME49_chrVI | 3016532 | 3018964 | − | ID = TGME49_244090; length = 2432 | 2638 |
| TGME49_chrVIIa | 1677841 | 1681517 | + | ID = TGME49_205000; length = 3676 | 2639 |
| TGME49_chrXI | 3582351 | 3585505 | − | ID = TGME49_313650; length = 3154 | 2640 |
| TGME49_chrII | 1271109 | 1273811 | − | ID = TGME49_222860; length = 2702 | 2641 |
| TGME49_chrXII | 577408 | 579217 | − | ID = TGME49_308096; length = 1809 | 2642 |
| TGME49_chrXII | 3175514 | 3177639 | − | ID = TGME49_247195; length = 2125 | 2643 |
| TGME49_chrVIIa | 2571840 | 2574320 | − | ID = TGME49_203330; length = 2480 | 2644 |
| TGME49_chrVIIa | 2523240 | 2527928 | + | ID = TGME49_203380; length = 4688 | 2645 |
| TGME49_chrIV | 1941441 | 1942608 | + | ID = TGME49_211080; length = 1167 | 2646 |
| TGME49_chrXII | 6089434 | 6093280 | − | ID = TGME49_278460; length = 3846 | 2647 |
| TGME49_chrXII | 6081058 | 6083036 | − | ID = TGME49_278490; length = 1978 | 2648 |
| TGME49_chrXII | 2941137 | 2943790 | + | ID = TGME49_246720; length = 2653 | 2649 |
| TGME49_chrVI | 3196293 | 3199662 | − | ID = TGME49_244335; length = 3369 | 2650 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 1031571 | 1036168 | − | ID = TGME49_262780; length = 4597 | 2651 |
| TGME49_chrVI | 1303181 | 1305102 | − | ID = TGME49_240510; length = 1921 | 2652 |
| TGME49_chrIV | 2021658 | 2023438 | − | ID = TGME49_210840; length = 1780 | 2653 |
| TGME49_chrVIII | 3226422 | 3228068 | − | ID = TGME49_273850; length = 1646 | 2654 |
| TGME49_chrVIIb | 3101472 | 3103925 | − | ID = TGME49_258900; length = 2453 | 2655 |
| TGME49_chrXI | 1160835 | 1164143 | + | ID = TGME49_310220; length = 3308 | 2656 |
| TGME49_chrXI | 551152 | 552779 | + | ID = TGME49_309195; length = 1627 | 2657 |
| TGME49_chrXI | 2837821 | 2840040 | − | ID = TGME49_312622; length = 2219 | 2658 |
| TGME49_chrII | 1387041 | 1390571 | + | ID = TGME49_223060; length = 3530 | 2659 |
| TGME49_chrIV | 1941441 | 1943297 | + | ID = TGME49_211070; length = 1856 | 2660 |
| TGME49_chrXI | 785847 | 788515 | − | ID = TGME49_309740; length = 2668 | 2661 |
| TGME49_chrX | 3052243 | 3054585 | − | ID = TGME49_224470; length = 2342 | 2662 |
| TGME49_chrIX | 4277659 | 4279338 | − | ID = TGME49_291370; length = 1679 | 2663 |
| TGME49_chrXI | 826261 | 828335 | − | ID = TGME49_309800; length = 2074 | 2664 |
| TGME49_chrXII | 6840262 | 6842703 | + | ID = TGME49_276930; length = 2441 | 2665 |
| TGME49_chrIV | 346077 | 348428 | − | ID = TGME49_320450; length = 2351 | 2666 |
| TGME49_chrXII | 1649988 | 1651365 | − | ID = TGME49_218250; length = 1377 | 2667 |
| TGME49_chrXII | 5151010 | 5152773 | + | ID = TGME49_250730; length = 1763 | 2668 |
| TGME49_chrX | 4002470 | 4005528 | + | ID = TGME49_212160; length = 3058 | 2669 |
| TGME49_chrVIIb | 2126932 | 2129789 | + | ID = TGME49_260600; length = 2857 | 2670 |
| TGME49_chrXI | 4406805 | 4410963 | − | ID = TGME49_314910; length = 4158 | 2671 |
| TGME49_chrVIII | 6257556 | 6259358 | + | ID = TGME49_268835; length = 1802 | 2672 |
| TGME49_chrXII | 1875381 | 1876656 | + | ID = TGME49_217490; length = 1275 | 2673 |
| TGME49_chrIX | 3856756 | 3857919 | − | ID = TGME49_290710; length = 1163 | 2674 |
| TGME49_chrVIII | 470060 | 474349 | + | ID = TGME49_229930; length = 4289 | 2675 |
| TGME49_chrXI | 4025920 | 4030724 | + | ID = TGME49_314358; length = 4804 | 2676 |
| TGME49_chrIb | 460087 | 461835 | − | ID = TGME49_207955; length = 1748 | 2677 |
| TGME49_chrVIIa | 2490731 | 2493062 | − | ID = TGME49_203480; length = 2331 | 2678 |
| TGME49_chrII | 562040 | 565277 | + | ID = TGME49_221685; length = 3237 | 2679 |
| TGME49_chrV | 2462151 | 2465375 | − | ID = TGME49_285290; length = 3224 | 2680 |
| TGME49_chrV | 645279 | 647282 | + | ID = TGME49_212850; length = 2003 | 2681 |
| TGME49_chrVIII | 5331414 | 5333301 | + | ID = TGME49_270210; length = 1887 | 2682 |
| TGME49_chrVIIb | 912343 | 914333 | − | ID = TGME49_262935; length = 1990 | 2683 |
| TGME49_chrVIIa | 4126871 | 4128947 | + | ID = TGME49_281450; length = 2076 | 2684 |
| TGME49_chrVI | 2158909 | 2160846 | + | ID = TGME49_242650; length = 1937 | 2685 |
| TGME49_chrVIIb | 4129894 | 4131374 | − | ID = TGME49_257330; length = 1480 | 2686 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 1555009 | 1560065 | − | ID = TGME49_218380; length = 5056 | 2687 |
| TGME49_chrXII | 3798058 | 3802342 | − | ID = TGME49_248300; length = 4284 | 2688 |
| TGME49_chrX | 2773657 | 2776323 | + | ID = TGME49_224850; length = 2666 | 2689 |
| TGME49_chrXII | 859876 | 861462 | − | ID = TGME49_219550; length = 1586 | 2690 |
| TGME49_chrVIIb | 3133820 | 3137682 | + | ID = TGME49_258840; length = 3862 | 2691 |
| TGME49_chrIX | 4560778 | 4562922 | + | ID = TGME49_292120; length = 2144 | 2692 |
| TGME49_chrIX | 1317799 | 1319959 | + | ID = TGME49_266070; length = 2160 | 2693 |
| TGME49_chrVIIa | 58368 | 61406 | − | ID = TGME49_280810; length = 3038 | 2694 |
| TGME49_chrVIII | 6365189 | 6366539 | − | ID = TGME49_268690; length = 1350 | 2695 |
| TGME49_chrXI | 6058978 | 6060618 | − | ID = TGME49_216600; length = 1640 | 2696 |
| TGME49_chrVI | 1334799 | 1336826 | − | ID = TGME49_240590; length = 2027 | 2697 |
| TGME49_chrV | 1973489 | 1975650 | − | ID = TGME49_286130; length = 2161 | 2698 |
| TGME49_chrVIIb | 1101193 | 1106043 | − | ID = TGME49_262655; length = 4850 | 2699 |
| TGME49_chrII | 403605 | 405254 | + | ID = TGME49_221510; length = 1649 | 2700 |
| TGME49_chrIV | 1735322 | 1737748 | − | ID = TGME49_211420; length = 2426 | 2701 |
| TGME49_chrVIII | 4650985 | 4654271 | + | ID = TGME49_271182; length = 3286 | 2702 |
| TGME49_chrVIIb | 921322 | 925018 | − | ID = TGME49_262930; length = 3696 | 2703 |
| TGME49_chrVI | 2311797 | 2313889 | − | ID = TGME49_242800; length = 2092 | 2704 |
| TGME49_chrIX | 4820131 | 4821972 | + | ID = TGME49_210390; length = 1841 | 2705 |
| TGME49_chrII | 1626675 | 1629738 | − | ID = TGME49_297220; length = 3063 | 2706 |
| TGME49_chrXII | 3445460 | 3450482 | + | ID = TGME49_247630; length = 5022 | 2707 |
| TGME49_chrX | 4800098 | 4801840 | − | ID = TGME49_235350; length = 1742 | 2708 |
| TGME49_chrVIII | 651925 | 653885 | − | ID = TGME49_230160; length = 1960 | 2709 |
| TGME49_chrVIII | 6674933 | 6676585 | + | ID = TGME49_268035; length = 1652 | 2710 |
| TGME49_chrXI | 26464 | 30284 | − | ID = TGME49_307260; length = 3820 | 2711 |
| TGME49_chrVI | 3115170 | 3117323 | − | ID = TGME49_244200; length = 2153 | 2712 |
| TGME49_chrXII | 899075 | 901898 | − | ID = TGME49_219510; length = 2823 | 2713 |
| TGME49_chrX | 7169371 | 7172828 | + | ID = TGME49_275320; length = 3457 | 2714 |
| TGME49_chrXII | 2953442 | 2955259 | + | ID = TGME49_246740; length = 1817 | 2715 |
| TGME49_chrIa | 1445468 | 1449325 | + | ID = TGME49_295990; length = 3857 | 2716 |
| TGME49_chrVIIb | 4614055 | 4617990 | + | ID = TGME49_255940; length = 3935 | 2717 |
| TGME49_chrIb | 1471673 | 1474994 | − | ID = TGME49_209820; length = 3321 | 2718 |
| TGME49_chrVI | 918303 | 921331 | + | ID = TGME49_239795; length = 3028 | 2719 |
| TGME49_chrVIIa | 1343739 | 1346394 | + | ID = TGME49_205540; length = 2655 | 2720 |
| TGME49_chrXI | 3259153 | 3260521 | − | ID = TGME49_313305; length = 1368 | 2721 |
| TGME49_chrIX | 5461619 | 5466485 | + | ID = TGME49_305560; length = 4866 | 2722 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrV | 2997437 | 2999458 | + | ID = TGME49_283740; length = 2021 | 2723 |
| TGME49_chrIX | 4903736 | 4907468 | + | ID = TGME49_210270; length = 3732 | 2724 |
| TGME49_chrVIIa | 3323217 | 3327698 | − | ID = TGME49_202450; length = 4481 | 2725 |
| TGME49_chrX | 5306045 | 5306976 | + | ID = TGME49_236153; length = 931 | 2726 |
| TGME49_chrIV | 1166825 | 1168908 | + | ID = TGME49_318650; length = 2083 | 2727 |
| TGME49_chrVIIb | 982149 | 984168 | − | ID = TGME49_262840; length = 2019 | 2728 |
| TGME49_chrIX | 5435334 | 5438062 | + | ID = TGME49_305490; length = 2728 | 2729 |
| TGME49_chrXI | 2989152 | 2990445 | − | ID = TGME49_312930; length = 1293 | 2730 |
| TGME49_chrIX | 3632418 | 3634414 | − | ID = TGME49_290180; length = 1996 | 2731 |
| TGME49_chrVIIa | 1843982 | 1846698 | − | ID = TGME49_204380; length = 2716 | 2732 |
| TGME49_chrVIII | 1887186 | 1890535 | − | ID = TGME49_232140; length = 3349 | 2733 |
| TGME49_chrIV | 823132 | 825847 | − | ID = TGME49_319630; length = 2715 | 2734 |
| TGME49_chrVI | 2636729 | 2639733 | + | ID = TGME49_243450; length = 3004 | 2735 |
| TGME49_chrX | 3856731 | 3858953 | + | ID = TGME49_223410; length = 2222 | 2736 |
| TGME49_chrXII | 4678421 | 4682858 | − | ID = TGME49_249600; length = 4437 | 2737 |
| TGME49_chrXI | 4509922 | 4511567 | − | ID = TGME49_315130; length = 1645 | 2738 |
| TGME49_chrIa | 1153066 | 1154657 | + | ID = TGME49_294812; length = 1591 | 2739 |
| TGME49_chrIX | 706165 | 708319 | − | ID = TGME49_267350; length = 2154 | 2740 |
| TGME49_chrXII | 4392567 | 4397271 | + | ID = TGME49_249250; length = 4704 | 2741 |
| TGME49_chrVIII | 3620478 | 3622646 | + | ID = TGME49_273200; length = 2168 | 2742 |
| TGME49_chrIX | 3048775 | 3052445 | − | ID = TGME49_289180; length = 3670 | 2743 |
| TGME49_chrX | 5786435 | 5789375 | + | ID = TGME49_237220; length = 2940 | 2744 |
| TGME49_chrX | 3448596 | 3453595 | + | ID = TGME49_223920; length = 4999 | 2745 |
| TGME49_chrVI | 1618811 | 1622040 | + | ID = TGME49_241010; length = 3229 | 2746 |
| TGME49_chrXII | 2808694 | 2813152 | − | ID = TGME49_246500; length = 4458 | 2747 |
| TGME49_chrIX | 952354 | 954209 | − | ID = TGME49_266820; length = 1855 | 2748 |
| TGME49_chrX | 152090 | 154165 | − | ID = TGME49_228770; length = 2075 | 2749 |
| TGME49_chrXII | 3243448 | 3245120 | + | ID = TGME49_247305; length = 1672 | 2750 |
| TGME49_chrX | 1028684 | 1030566 | − | ID = TGME49_227320; length = 1882 | 2751 |
| TGME49_chrVI | 453972 | 456175 | + | ID = TGME49_239087; length = 2203 | 2752 |
| TGME49_chrVIII | 370373 | 371876 | + | ID = TGME49_229670; length = 1503 | 2753 |
| TGME49_chrXII | 2205095 | 2207381 | − | ID = TGME49_217890; length = 2286 | 2754 |
| TGME49_chrVIII | 1171719 | 1176344 | + | ID = TGME49_230990; length = 4625 | 2755 |
| TGME49_chrX | 6719697 | 6721912 | − | ID = TGME49_215040; length = 2215 | 2756 |
| TGME49_chrXII | 3623594 | 3625340 | − | ID = TGME49_247920; length = 1746 | 2757 |
| TGME49_chrIX | 5921208 | 5925102 | − | ID = TGME49_306290; length = 3894 | 2758 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 945683 | 947561 | + | ID = TGME49_262890; length = 1878 | 2759 |
| TGME49_chrVIII | 3793351 | 3798091 | − | ID = TGME49_272695; length = 4740 | 2760 |
| TGME49_chrVIIb | 283563 | 284791 | − | ID = TGME49_263870; length = 1228 | 2761 |
| TGME49_chrXI | 2898675 | 2900997 | + | ID = TGME49_312680; length = 2322 | 2762 |
| TGME49_chrXI | 4269493 | 4271271 | + | ID = TGME49_314760; length = 1778 | 2763 |
| TGME49_chrIV | 743496 | 746016 | − | ID = TGME49_319860; length = 2520 | 2764 |
| TGME49_chrXII | 5944752 | 5946781 | − | ID = TGME49_278670; length = 2029 | 2765 |
| TGME49_chrVIIb | 329609 | 331237 | + | ID = TGME49_263760; length = 1628 | 2766 |
| TGME49_chrVIIb | 3612696 | 3614760 | − | ID = TGME49_258070; length = 2064 | 2767 |
| TGME49_chrII | 446960 | 451815 | + | ID = TGME49_221580; length = 4855 | 2768 |
| TGME49_chrXII | 5142000 | 5143982 | + | ID = TGME49_250710; length = 1982 | 2769 |
| TGME49_chrVIIa | 348808 | 351228 | − | ID = TGME49_280500; length = 2420 | 2770 |
| TGME49_chrXII | 1626315 | 1628343 | + | ID = TGME49_218280; length = 2028 | 2771 |
| TGME49_chrVIII | 4982170 | 4987009 | − | ID = TGME49_270810; length = 4839 | 2772 |
| TGME49_chrXI | 5211986 | 5213771 | − | ID = TGME49_316250; length = 1785 | 2773 |
| TGME49_chrVIIa | 1419599 | 1424205 | + | ID = TGME49_205398; length = 4606 | 2774 |
| TGME49_chrXII | 736337 | 738273 | + | ID = TGME49_219678; length = 1936 | 2775 |
| TGME49_chrXII | 1969472 | 1971512 | − | ID = TGME49_217640; length = 2040 | 2776 |
| TGME49_chrX | 2158857 | 2163020 | − | ID = TGME49_225560; length = 4163 | 2777 |
| TGME49_chrV | 1527084 | 1529358 | − | ID = TGME49_287210; length = 2274 | 2778 |
| TGME49_chrXII | 2985681 | 2987023 | − | ID = TGME49_246763; length = 1342 | 2779 |
| TGME49_chrIV | 1188460 | 1192145 | + | ID = TGME49_318610; length = 3685 | 2780 |
| TGME49_chrVIIb | 3118623 | 3122518 | − | ID = TGME49_258870; length = 3895 | 2781 |
| TGME49_chrVIII | 4338895 | 4340907 | + | ID = TGME49_271830; length = 2012 | 2782 |
| TGME49_chrXI | 120398 | 121691 | + | ID = TGME49_307015; length = 1293 | 2783 |
| TGME49_chrVIIb | 4652230 | 4655422 | + | ID = TGME49_255880; length = 3192 | 2784 |
| TGME49_chrVIII | 2229753 | 2232098 | − | ID = TGME49_232680; length = 2345 | 2785 |
| TGME49_chrXII | 3201946 | 3205868 | − | ID = TGME49_247250; length = 3922 | 2786 |
| TGME49_chrVIII | 1995325 | 1996498 | + | ID = TGME49_232290; length = 1173 | 2787 |
| TGME49_chrXII | 2349495 | 2351982 | + | ID = TGME49_245530; length = 2487 | 2788 |
| TGME49_chrVIII | 5296820 | 5298844 | − | ID = TGME49_270277; length = 2024 | 2789 |
| TGME49_chrXII | 6474091 | 6476198 | − | ID = TGME49_277860; length = 2107 | 2790 |
| TGME49_chrXI | 1331785 | 1333925 | − | ID = TGME49_310420; length = 2140 | 2791 |
| TGME49_chrX | 6606599 | 6611152 | + | ID = TGME49_214950; length = 4553 | 2792 |
| TGME49_chrIb | 1838024 | 1840558 | + | ID = TGME49_321400; length = 2534 | 2793 |
| TGME49_chrX | 1867675 | 1871933 | − | ID = TGME49_226020; length = 4258 | 2794 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 6812170 | 6815991 | + | ID = TGME49_200350; length = 3821 | 2795 |
| TGME49_chrXII | 4797395 | 4799343 | − | ID = TGME49_249780; length = 1948 | 2796 |
| TGME49_chrVIII | 5106894 | 5110114 | + | ID = TGME49_270640; length = 3220 | 2797 |
| TGME49_chrXI | 1856929 | 1859770 | − | ID = TGME49_311190; length = 2841 | 2798 |
| TGME49_chrVIIa | 3429130 | 3430859 | − | ID = TGME49_202320; length = 1729 | 2799 |
| TGME49_chrVIIb | 181366 | 185076 | + | ID = TGME49_264100; length = 3710 | 2800 |
| TGME49_chrVIIb | 3646582 | 3648630 | − | ID = TGME49_258020; length = 2048 | 2801 |
| TGME49_chrV | 2798448 | 2800018 | + | ID = TGME49_284160; length = 1570 | 2802 |
| TGME49_chrXII | 5430181 | 5431564 | + | ID = TGME49_251500; length = 1383 | 2803 |
| TGME49_chrIa | 684229 | 685834 | + | ID = TGME49_294190; length = 1605 | 2804 |
| TGME49_chrX | 4514799 | 4517679 | + | ID = TGME49_234670; length = 2880 | 2805 |
| TGME49_chrIb | 19922 | 22201 | − | ID = TGME49_207380; length = 2279 | 2806 |
| TGME49_chrXII | 2837852 | 2840190 | + | ID = TGME49_246540; length = 2338 | 2807 |
| TGME49_chrVIIa | 3259896 | 3262598 | + | ID = TGME49_202520; length = 2702 | 2808 |
| TGME49_chrXI | 2665525 | 2666765 | − | ID = TGME49_312400; length = 1240 | 2809 |
| TGME49_chrII | 355180 | 357222 | + | ID = TGME49_221450; length = 2042 | 2810 |
| TGME49_chrX | 2433230 | 2435647 | + | ID = TGME49_225190; length = 2417 | 2811 |
| TGME49_chrVIII | 57748 | 60111 | − | ID = TGME49_229150; length = 2363 | 2812 |
| TGME49_chrVIIb | 4885643 | 4888514 | + | ID = TGME49_255340; length = 2871 | 2813 |
| TGME49_chrV | 725744 | 726888 | + | ID = TGME49_212955; length = 1144 | 2814 |
| TGME49_chrVI | 1580744 | 1581416 | − | ID = TGME49_240940; length = 672 | 2815 |
| TGME49_chrVIII | 928298 | 930205 | − | ID = TGME49_230640; length = 1907 | 2816 |
| TGME49_chrXII | 2832742 | 2834747 | + | ID = TGME49_246530; length = 2005 | 2817 |
| TGME49_chrVIII | 56761 | 59366 | + | ID = TGME49_229160; length = 2605 | 2818 |
| TGME49_chrIX | 3666729 | 3669016 | + | ID = TGME49_290260; length = 2287 | 2819 |
| TGME49_chrVIII | 6374094 | 6376344 | − | ID = TGME49_268660; length = 2250 | 2820 |
| TGME49_chrIV | 1692110 | 1694217 | − | ID = TGME49_211480; length = 2107 | 2821 |
| TGME49_chrVIIb | 2272974 | 2275367 | − | ID = TGME49_260440; length = 2393 | 2822 |
| TGME49_chrVIII | 4880298 | 4882600 | + | ID = TGME49_270910; length = 2302 | 2823 |
| TGME49_chrXII | 985332 | 987309 | + | ID = TGME49_219300; length = 1977 | 2824 |
| TGME49_chrX | 5430041 | 5431958 | + | ID = TGME49_236570; length = 1917 | 2825 |
| TGME49_chrVIIa | 1847823 | 1850467 | + | ID = TGME49_204360; length = 2644 | 2826 |
| TGME49_chrXII | 3743680 | 3747903 | + | ID = TGME49_248225; length = 4223 | 2827 |
| TGME49_chrX | 3783781 | 3785405 | + | ID = TGME49_223485; length = 1624 | 2828 |
| TGME49_chrXI | 4270243 | 4271815 | − | ID = TGME49_314750; length = 1572 | 2829 |
| TGME49_chrX | 1078543 | 1080826 | + | ID = TGME49_227115; length = 2283 | 2830 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 4659619 | 4662247 | − | ID = TGME49_249575; length = 2628 | 2831 |
| TGME49_chrVIIb | 2023964 | 2026656 | − | ID = TGME49_260825; length = 2692 | 2832 |
| TGME49_chrIX | 4639418 | 4641832 | + | ID = TGME49_292245; length = 2414 | 2833 |
| TGME49_chrVIII | 5798086 | 5801508 | + | ID = TGME49_269430; length = 3422 | 2834 |
| TGME49_chrX | 5080892 | 5083213 | − | ID = TGME49_235730; length = 2321 | 2835 |
| TGME49_chrIX | 283315 | 284597 | − | ID = TGME49_279310; length = 1282 | 2836 |
| TGME49_chrXII | 919752 | 924441 | − | ID = TGME49_219485; length = 4689 | 2837 |
| TGME49_chrIX | 2544921 | 2548040 | + | ID = TGME49_288450; length = 3119 | 2838 |
| TGME49_chrXI | 5343323 | 5345659 | − | ID = TGME49_316480; length = 2336 | 2839 |
| TGME49_chrVI | 207532 | 210236 | + | ID = TGME49_238410; length = 2704 | 2840 |
| TGME49_chrXI | 216523 | 218588 | + | ID = TGME49_306880; length = 2065 | 2841 |
| TGME49_chrXI | 513332 | 516847 | + | ID = TGME49_309130; length = 3515 | 2842 |
| TGME49_chrIX | 5351945 | 5353735 | − | ID = TGME49_305310; length = 1790 | 2843 |
| TGME49_chrIX | 1260940 | 1263377 | + | ID = TGME49_266260; length = 2437 | 2844 |
| TGME49_chrVIII | 6773085 | 6775554 | + | ID = TGME49_200290; length = 2469 | 2845 |
| TGME49_chrII | 1859313 | 1862244 | − | ID = TGME49_297520; length = 2931 | 2846 |
| TGME49_chrVIIb | 4221737 | 4224344 | + | ID = TGME49_257090; length = 2607 | 2847 |
| TGME49_chrVIII | 2074694 | 2076558 | − | ID = TGME49_232400; length = 1864 | 2848 |
| TGME49_chrX | 5184565 | 5187267 | − | ID = TGME49_235920; length = 2702 | 2849 |
| TGME49_chrVIIb | 3862212 | 3863945 | + | ID = TGME49_257730; length = 1733 | 2850 |
| TGME49_chrIX | 3935623 | 3938663 | + | ID = TGME49_290920; length = 3040 | 2851 |
| TGME49_chrIb | 609246 | 611891 | + | ID = TGME49_208330; length = 2645 | 2852 |
| TGME49_chrX | 5569094 | 5572139 | + | ID = TGME49_236920; length = 3045 | 2853 |
| TGME49_chrVIIb | 4551227 | 4555100 | − | ID = TGME49_256040; length = 3873 | 2854 |
| TGME49_chrX | 753755 | 755679 | − | ID = TGME49_227890; length = 1924 | 2855 |
| TGME49_chrVI | 686164 | 689115 | − | ID = TGME49_239475; length = 2951 | 2856 |
| TGME49_chrXI | 3941340 | 3945803 | + | ID = TGME49_314240; length = 4463 | 2857 |
| TGME49_chrVIIb | 3175832 | 3180410 | − | ID = TGME49_258810; length = 4578 | 2858 |
| TGME49_chrVIII | 4081769 | 4082967 | + | ID = TGME49_272300; length = 1198 | 2859 |
| TGME49_chrVIIb | 1535057 | 1538674 | − | ID = TGME49_261780; length = 3617 | 2860 |
| TGME49_chrXI | 3345412 | 3347300 | − | ID = TGME49_313400; length = 1888 | 2861 |
| TGME49_chrVIII | 2239078 | 2241114 | + | ID = TGME49_232730; length = 2036 | 2862 |
| TGME49_chrX | 3985430 | 3987663 | + | ID = TGME49_212190; length = 2233 | 2863 |
| TGME49_chrXII | 6261861 | 6263784 | + | ID = TGME49_278160; length = 1923 | 2864 |
| TGME49_chrX | 1134133 | 1136564 | + | ID = TGME49_227015; length = 2431 | 2865 |
| TGME49_chrIX | 4927380 | 4929331 | − | ID = TGME49_210255; length = 1951 | 2866 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIII | 494173 | 497365 | − | ID = TGME49_229970; length = 3192 | 2867 |
| TGME49_chrXI | 4603674 | 4605166 | − | ID = TGME49_315250; length = 1492 | 2868 |
| TGME49_chrVIIa | 385701 | 390631 | − | ID = TGME49_280465; length = 4930 | 2869 |
| TGME49_chrXI | 5186674 | 5188422 | + | ID = TGME49_316210; length = 1748 | 2870 |
| TGME49_chrVIII | 2721138 | 2725943 | − | ID = TGME49_233610; length = 4805 | 2871 |
| TGME49_chrX | 3076450 | 3078386 | − | ID = TGME49_224340; length = 1936 | 2872 |
| TGME49_chrVIII | 1070714 | 1074839 | + | ID = TGME49_230880; length = 4125 | 2873 |
| TGME49_chrXI | 6120810 | 6122479 | + | ID = TGME49_216480; length = 1669 | 2874 |
| TGME49_chrXI | 1268350 | 1270276 | − | ID = TGME49_310330; length = 1926 | 2875 |
| TGME49_chrVIII | 3749856 | 3752478 | + | ID = TGME49_272740; length = 2622 | 2876 |
| TGME49_chrX | 1479988 | 1481931 | + | ID = TGME49_226620; length = 1943 | 2877 |
| TGME49_chrXI | 5886992 | 5889236 | + | ID = TGME49_216780; length = 2244 | 2878 |
| TGME49_chrX | 952154 | 954291 | − | ID = TGME49_227420; length = 2137 | 2879 |
| TGME49_chrVIIa | 1028911 | 1033633 | − | ID = TGME49_206390; length = 4722 | 2880 |
| TGME49_chrX | 4474277 | 4477145 | − | ID = TGME49_234570; length = 2868 | 2881 |
| TGME49_chrVIII | 1404701 | 1406518 | + | ID = TGME49_231410; length = 1817 | 2882 |
| TGME49_chrV | 374249 | 377042 | − | ID = TGME49_220430; length = 2793 | 2883 |
| TGME49_chrX | 3360958 | 3364401 | − | ID = TGME49_224060; length = 3443 | 2884 |
| TGME49_chrXII | 3454490 | 3456588 | + | ID = TGME49_247648; length = 2098 | 2885 |
| TGME49_chrVI | 2498549 | 2500123 | + | ID = TGME49_243280; length = 1574 | 2886 |
| TGME49_chrXI | 2440230 | 2444604 | + | ID = TGME49_312130; length = 4374 | 2887 |
| TGME49_chrIX | 652699 | 656532 | + | ID = TGME49_267430; length = 3833 | 2888 |
| TGME49_chrVIII | 5516858 | 5520480 | + | ID = TGME49_269930; length = 3622 | 2889 |
| TGME49_chrXII | 5130690 | 5133986 | + | ID = TGME49_250700; length = 3296 | 2890 |
| TGME49_chrX | 6943159 | 6945000 | + | ID = TGME49_215410; length = 1841 | 2891 |
| TGME49_chrIV | 2086998 | 2089481 | + | ID = TGME49_210760; length = 2483 | 2892 |
| TGME49_chrIX | 5323005 | 5326221 | + | ID = TGME49_305270; length = 3216 | 2893 |
| TGME49_chrVIII | 6235276 | 6239397 | + | ID = TGME49_268870; length = 4121 | 2894 |
| TGME49_chrVIII | 6571884 | 6573723 | − | ID = TGME49_268290; length = 1839 | 2895 |
| TGME49_chrX | 7064259 | 7067143 | + | ID = TGME49_215650; length = 2884 | 2896 |
| TGME49_chrVIIb | 736866 | 738425 | − | ID = TGME49_263190; length = 1559 | 2897 |
| TGME49_chrX | 3318080 | 3319616 | − | ID = TGME49_224120; length = 1536 | 2898 |
| TGME49_chrIV | 1113568 | 1114995 | − | ID = TGME49_318738; length = 1427 | 2899 |
| TGME49_chrX | 3417971 | 3419580 | + | ID = TGME49_223970; length = 1609 | 2900 |
| TGME49_chrII | 1643140 | 1646065 | + | ID = TGME49_297270; length = 2925 | 2901 |
| TGME49_chrIX | 2241950 | 2246458 | + | ID = TGME49_264430; length = 4508 | 2902 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrII | 892236 | 894195 | + | ID = TGME49_222130; length = 1959 | 2903 |
| TGME49_chrII | 775384 | 778953 | + | ID = TGME49_222040; length = 3569 | 2904 |
| TGME49_chrVIII | 6236000 | 6240061 | − | ID = TGME49_268880; length = 4061 | 2905 |
| TGME49_chrXI | 1487516 | 1489916 | + | ID = TGME49_310630; length = 2400 | 2906 |
| TGME49_chrXI | 4480297 | 4482368 | + | ID = TGME49_315120; length = 2071 | 2907 |
| TGME49_chrV | 651209 | 653981 | + | ID = TGME49_212860; length = 2772 | 2908 |
| TGME49_chrXII | 5634615 | 5636719 | − | ID = TGME49_251860; length = 2104 | 2909 |
| TGME49_chrIX | 5826709 | 5829287 | − | ID = TGME49_306195; length = 2578 | 2910 |
| TGME49_chrVIIb | 4025611 | 4030642 | + | ID = TGME49_257470; length = 5031 | 2911 |
| TGME49_chrIb | 726992 | 728777 | − | ID = TGME49_208490; length = 1785 | 2912 |
| TGME49_chrVIIb | 3639823 | 3643240 | − | ID = TGME49_258030; length = 3417 | 2913 |
| TGME49_chrX | 183654 | 185507 | + | ID = TGME49_228720; length = 1853 | 2914 |
| TGME49_chrX | 1104418 | 1106139 | + | ID = TGME49_227060; length = 1721 | 2915 |
| TGME49_chrVIII | 265034 | 267090 | − | ID = TGME49_229450; length = 2056 | 2916 |
| TGME49_chrXII | 2685283 | 2688777 | + | ID = TGME49_246160; length = 3494 | 2917 |
| TGME49_chrXII | 1493469 | 1496095 | − | ID = TGME49_218500; length = 2626 | 2918 |
| TGME49_chrX | 293471 | 295200 | + | ID = TGME49_228470; length = 1729 | 2919 |
| TGME49_chrIa | 1148681 | 1150982 | + | ID = TGME49_294805; length = 2301 | 2920 |
| TGME49_chrXII | 5149388 | 5150805 | − | ID = TGME49_250720; length = 1417 | 2921 |
| TGME49_chrIV | 2465302 | 2467886 | + | ID = TGME49_301420; length = 2584 | 2922 |
| TGME49_chrVI | 902188 | 906938 | + | ID = TGME49_239780; length = 4750 | 2923 |
| TGME49_chrVIIb | 511337 | 515116 | + | ID = TGME49_263505; length = 3779 | 2924 |
| TGME49_chrIa | 50386 | 52683 | − | ID = TGME49_292960; length = 2297 | 2925 |
| TGME49_chrIb | 1410398 | 1412319 | − | ID = TGME49_209710; length = 1921 | 2926 |
| TGME49_chrII | 60741 | 63309 | − | ID = TGME49_220910; length = 2568 | 2927 |
| TGME49_chrXI | 2502970 | 2504148 | + | ID = TGME49_312210; length = 1178 | 2928 |
| TGME49_chrIX | 979074 | 983263 | − | ID = TGME49_266760; length = 4189 | 2929 |
| TGME49_chrVIII | 5800277 | 5801876 | − | ID = TGME49_269438; length = 1599 | 2930 |
| TGME49_chrXI | 6434992 | 6437143 | − | ID = TGME49_216053; length = 2151 | 2931 |
| TGME49_chrXII | 1281017 | 1283487 | + | ID = TGME49_218810; length = 2470 | 2932 |
| TGME49_chrX | 6632419 | 6636375 | + | ID = TGME49_214970; length = 3956 | 2933 |
| TGME49_chrII | 2224182 | 2225712 | + | ID = TGME49_298050; length = 1530 | 2934 |
| TGME49_chrXII | 1252520 | 1254167 | − | ID = TGME49_218850; length = 1647 | 2935 |
| TGME49_chrXI | 201833 | 203587 | + | ID = TGME49_306900; length = 1754 | 2936 |
| TGME49_chrII | 1937751 | 1940101 | + | ID = TGME49_297720; length = 2350 | 2937 |
| TGME49_chrXI | 1643494 | 1645015 | − | ID = TGME49_310880; length = 1521 | 2938 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIa | 1626000 | 1628841 | − | ID = TGME49_295662; length = 2841 | 2939 |
| TGME49_chrIb | 643892 | 647186 | − | ID = TGME49_208380; length = 3294 | 2940 |
| TGME49_chrX | 6495939 | 6497510 | − | ID = TGME49_214783; length = 1571 | 2941 |
| TGME49_chrX | 3324291 | 3327072 | + | ID = TGME49_224090; length = 2781 | 2942 |
| TGME49_chrII | 1010666 | 1012466 | − | ID = TGME49_222280; length = 1800 | 2943 |
| TGME49_chrIV | 2377638 | 2379502 | + | ID = TGME49_301300; length = 1864 | 2944 |
| TGME49_chrIV | 953527 | 955274 | + | ID = TGME49_319500; length = 1747 | 2945 |
| TGME49_chrX | 6767415 | 6769751 | − | ID = TGME49_215110; length = 2336 | 2946 |
| TGME49_chrVIIb | 2029278 | 2031836 | − | ID = TGME49_260820; length = 2558 | 2947 |
| TGME49_chrIX | 254786 | 256497 | − | ID = TGME49_279340; length = 1711 | 2948 |
| TGME49_chrXII | 1756941 | 1759557 | + | ID = TGME49_217340; length = 2616 | 2949 |
| TGME49_chrXI | 4121268 | 4122993 | + | ID = TGME49_314480; length = 1725 | 2950 |
| TGME49_chrIX | 3847198 | 3850189 | + | ID = TGME49_290700; length = 2991 | 2951 |
| TGME49_chrIX | 5199766 | 5203644 | + | ID = TGME49_305050; length = 3878 | 2952 |
| TGME49_chrVIIa | 969639 | 972289 | + | ID = TGME49_206440; length = 2650 | 2953 |
| TGME49_chrIb | 140290 | 142474 | + | ID = TGME49_207590; length = 2184 | 2954 |
| TGME49_chrIb | 1109164 | 1113311 | − | ID = TGME49_209190; length = 4147 | 2955 |
| TGME49_chrX | 2374165 | 2376239 | + | ID = TGME49_225250; length = 2074 | 2956 |
| TGME49_chrVI | 2345044 | 2347093 | + | ID = TGME49_242840; length = 2049 | 2957 |
| TGME49_chrIX | 1613783 | 1618496 | + | ID = TGME49_265320; length = 4713 | 2958 |
| TGME49_chrXI | 3994405 | 3998830 | + | ID = TGME49_314320; length = 4425 | 2959 |
| TGME49_chrV | 1686358 | 1689982 | − | ID = TGME49_286760; length = 3624 | 2960 |
| TGME49_chrXI | 2907482 | 2911745 | − | ID = TGME49_312690; length = 4263 | 2961 |
| TGME49_chrVI | 883138 | 887371 | + | ID = TGME49_239748; length = 4233 | 2962 |
| TGME49_chrX | 2183300 | 2187485 | + | ID = TGME49_225520; length = 4185 | 2963 |
| TGME49_chrXI | 5574723 | 5577030 | + | ID = TGME49_316770; length = 2307 | 2964 |
| TGME49_chrII | 531485 | 533086 | + | ID = TGME49_221665; length = 1601 | 2965 |
| TGME49_chrIX | 3510218 | 3512191 | + | ID = TGME49_289900; length = 1973 | 2966 |
| TGME49_chrX | 6214945 | 6217062 | + | ID = TGME49_214290; length = 2117 | 2967 |
| TGME49_chrVIIb | 2983618 | 2984755 | − | ID = TGME49_259080; length = 1137 | 2968 |
| TGME49_chrVIIb | 157650 | 161052 | − | ID = TGME49_264140; length = 3402 | 2969 |
| TGME49_chrXII | 353508 | 355474 | − | ID = TGME49_299780; length = 1966 | 2970 |
| TGME49_chrX | 3193336 | 3197198 | + | ID = TGME49_224235; length = 3862 | 2971 |
| TGME49_chrXII | 351854 | 354229 | + | ID = TGME49_299670; length = 2375 | 2972 |
| TGME49_chrVIIb | 4691742 | 4696076 | + | ID = TGME49_255730; length = 4334 | 2973 |
| TGME49_chrVIII | 2314750 | 2316635 | − | ID = TGME49_232980; length = 1885 | 2974 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIb | 1053747 | 1054786 | − | ID = TGME49_209112; length = 1039 | 2975 |
| TGME49_chrVI | 1271088 | 1275407 | − | ID = TGME49_240410; length = 4319 | 2976 |
| TGME49_chrIX | 1913750 | 1916033 | − | ID = TGME49_264900; length = 2283 | 2977 |
| TGME49_chrX | 691619 | 694702 | + | ID = TGME49_227980; length = 3083 | 2978 |
| TGME49_chrVIII | 5629048 | 5630894 | + | ID = TGME49_269740; length = 1846 | 2979 |
| TGME49_chrVIIb | 3410289 | 3414291 | − | ID = TGME49_258458; length = 4002 | 2980 |
| TGME49_chrVIII | 6430030 | 6432264 | − | ID = TGME49_268570; length = 2234 | 2981 |
| TGME49_chrIV | 1221132 | 1223825 | − | ID = TGME49_318570; length = 2693 | 2982 |
| TGME49_chrVIII | 2137156 | 2141623 | − | ID = TGME49_232520; length = 4467 | 2983 |
| TGME49_chrIb | 928521 | 933382 | − | ID = TGME49_208970; length = 4861 | 2984 |
| TGME49_chrVIIa | 89778 | 91426 | − | ID = TGME49_280790; length = 1648 | 2985 |
| TGME49_chrIX | 2800240 | 2802305 | + | ID = TGME49_288910; length = 2065 | 2986 |
| TGME49_chrV | 584166 | 587344 | − | ID = TGME49_212760; length = 3178 | 2987 |
| TGME49_chrVIII | 5602273 | 5604583 | + | ID = TGME49_269770; length = 2310 | 2988 |
| TGME49_chrX | 4428749 | 4429928 | + | ID = TGME49_234507; length = 1179 | 2989 |
| TGME49_chrXII | 1198382 | 1200277 | − | ID = TGME49_218950; length = 1895 | 2990 |
| TGME49_chrX | 274179 | 278462 | − | ID = TGME49_228620; length = 4283 | 2991 |
| TGME49_chrIV | 1177760 | 1179793 | + | ID = TGME49_318620; length = 2033 | 2992 |
| TGME49_chrIa | 547592 | 550266 | + | ID = TGME49_293770; length = 2674 | 2993 |
| TGME49_chrXI | 6518085 | 6519956 | | ID = TGME49_215940; length = 1871 | 2994 |
| TGME49_chrVI | 1400236 | 1402037 | + | ID = TGME49_240710; length = 1801 | 2995 |
| TGME49_chrXII | 3705841 | 3707649 | − | ID = TGME49_248150; length = 1808 | 2996 |
| TGME49_chrX | 6868965 | 6872314 | − | ID = TGME49_215260; length = 3349 | 2997 |
| TGME49_chrIX | 4980085 | 4983371 | − | ID = TGME49_307570; length = 3286 | 2998 |
| TGME49_chrIX | 6241762 | 6243674 | − | ID = TGME49_306650; length = 1912 | 2999 |
| TGME49_chrX | 7014609 | 7017444 | + | ID = TGME49_215560; length = 2835 | 3000 |
| TGME49_chrXI | 3686860 | 3689632 | − | ID = TGME49_313770; length = 2772 | 3001 |
| TGME49_chrIX | 2632220 | 2636771 | − | ID = TGME49_288600; length = 4551 | 3002 |
| TGME49_chrII | 83969 | 86643 | + | ID = TGME49_220950; length = 2674 | 3003 |
| TGME49_chrVIIb | 4483832 | 4488559 | + | ID = TGME49_256700; length = 4727 | 3004 |
| TGME49_chrVIIb | 920403 | 922803 | + | ID = TGME49_262920; length = 2400 | 3005 |
| TGME49_chrIX | 3726863 | 3728579 | − | ID = TGME49_290340; length = 1716 | 3006 |
| TGME49_chrIV | 2265513 | 2268004 | − | ID = TGME49_301000; length = 2491 | 3007 |
| TGME49_chrVIII | 4617442 | 4619870 | − | ID = TGME49_271270; length = 2428 | 3008 |
| TGME49_chrVIII | 4916184 | 4918619 | − | ID = TGME49_270880; length = 2435 | 3009 |
| TGME49_chrXI | 541082 | 545032 | − | ID = TGME49_309180; length = 3950 | 3010 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVI | 1421170 | 1423356 | − | ID = TGME49_240730; length = 2186 | 3011 |
| TGME49_chrX | 5311235 | 5312787 | + | ID = TGME49_236190; length = 1552 | 3012 |
| TGME49_chrVIIa | 1934090 | 1936122 | − | ID = TGME49_204270; length = 2032 | 3013 |
| TGME49_chrX | 3689921 | 3692588 | + | ID = TGME49_223620; length = 2667 | 3014 |
| TGME49_chrIV | 666975 | 669700 | − | ID = TGME49_319920; length = 2725 | 3015 |
| TGME49_chrVIII | 2702317 | 2704841 | + | ID = TGME49_233540; length = 2524 | 3016 |
| TGME49_chrXII | 4230314 | 4232511 | − | ID = TGME49_248860; length = 2197 | 3017 |
| TGME49_chrXI | 2675685 | 2678516 | + | ID = TGME49_312430; length = 2831 | 3018 |
| TGME49_chrXII | 4242327 | 4243685 | − | ID = TGME49_248880; length = 1358 | 3019 |
| TGME49_chrVIIa | 3478649 | 3480506 | − | ID = TGME49_202255; length = 1857 | 3020 |
| TGME49_chrXII | 157841 | 160945 | − | ID = TGME49_300220; length = 3104 | 3021 |
| TGME49_chrIX | 1858908 | 1862051 | + | ID = TGME49_264990; length = 3143 | 3022 |
| TGME49_chrIV | 1126774 | 1128732 | − | ID = TGME49_318720; length = 1958 | 3023 |
| TGME49_chrVIIb | 342230 | 347024 | − | ID = TGME49_263750; length = 4794 | 3024 |
| TGME49_chrVIIa | 3431716 | 3434599 | + | ID = TGME49_202300; length = 2883 | 3025 |
| TGME49_chrIX | 3364029 | 3366093 | − | ID = TGME49_289640; length = 2064 | 3026 |
| TGME49_chrIV | 1846118 | 1847509 | + | ID = TGME49_211300; length = 1391 | 3027 |
| TGME49_chrVI | 1939321 | 1941969 | + | ID = TGME49_242290; length = 2648 | 3028 |
| TGME49_chrIb | 1838024 | 1841751 | + | ID = TGME49_321390; length = 3727 | 3029 |
| TGME49_chrXII | 3025443 | 3028262 | − | ID = TGME49_246930; length = 2819 | 3030 |
| TGME49_chrIb | 982520 | 984651 | − | ID = TGME49_209005; length = 2131 | 3031 |
| TGME49_chrIX | 5440014 | 5444552 | + | ID = TGME49_305510; length = 4538 | 3032 |
| TGME49_chrIb | 1785634 | 1787380 | − | ID = TGME49_321460; length = 1746 | 3033 |
| TGME49_chrIX | 1269529 | 1271869 | − | ID = TGME49_266150; length = 2340 | 3034 |
| TGME49_chrIV | 136530 | 141115 | + | ID = TGME49_320680; length = 4585 | 3035 |
| TGME49_chrII | 2129147 | 2131563 | − | ID = TGME49_297940; length = 2416 | 3036 |
| TGME49_chrX | 5311706 | 5313875 | − | ID = TGME49_236160; length = 2169 | 3037 |
| TGME49_chrIX | 1175142 | 1176935 | − | ID = TGME49_266390; length = 1793 | 3038 |
| TGME49_chrXII | 3270428 | 3272692 | + | ID = TGME49_247340; length = 2264 | 3039 |
| TGME49_chrVIIa | 4386523 | 4390549 | − | ID = TGME49_282110; length = 4026 | 3040 |
| TGME49_chrXI | 5712542 | 5714427 | + | ID = TGME49_217020; length = 1885 | 3041 |
| TGME49_chrIb | 508930 | 511554 | − | ID = TGME49_207990; length = 2624 | 3042 |
| TGME49_chrIV | 509090 | 514052 | + | ID = TGME49_320090; length = 4962 | 3043 |
| TGME49_chrXII | 2323596 | 2325670 | − | ID = TGME49_245500; length = 2074 | 3044 |
| TGME49_chrII | 1838793 | 1840776 | − | ID = TGME49_297500; length = 1983 | 3045 |
| TGME49_chrIa | 1848076 | 1849826 | + | ID = TGME49_295310; length = 1750 | 3046 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 118366 | 123372 | + | ID = TGME49_280750; length = 5006 | 3047 |
| TGME49_chrIV | 2323619 | 2324963 | + | ID = TGME49_301222; length = 1344 | 3048 |
| TGME49_chrVIIb | 2525803 | 2527506 | + | ID = TGME49_260010; length = 1703 | 3049 |
| TGME49_chrVIII | 2604789 | 2607085 | − | ID = TGME49_233340; length = 2296 | 3050 |
| TGME49_chrVIIb | 629441 | 632828 | − | ID = TGME49_263327; length = 3387 | 3051 |
| TGME49_chrVI | 718257 | 722058 | − | ID = TGME49_239490; length = 3801 | 3052 |
| TGME49_chrVIII | 1219171 | 1224214 | − | ID = TGME49_231060; length = 5043 | 3053 |
| TGME49_chrX | 7366485 | 7369133 | − | ID = TGME49_207060; length = 2648 | 3054 |
| TGME49_chrIX | 326465 | 328648 | − | ID = TGME49_267840; length = 2183 | 3055 |
| TGME49_chrVIIb | 3400841 | 3404561 | + | ID = TGME49_258470; length = 3720 | 3056 |
| TGME49_chrVIII | 3674014 | 3677250 | + | ID = TGME49_273075; length = 3236 | 3057 |
| TGME49_chrVIIa | 2121339 | 2125267 | − | ID = TGME49_203940; length = 3928 | 3058 |
| TGME49_chrXII | 2197081 | 2199723 | + | ID = TGME49_217875; length = 2642 | 3059 |
| TGME49_chrXI | 569487 | 571481 | + | ID = TGME49_309230; length = 1994 | 3060 |
| TGME49_chrX | 660185 | 662395 | − | ID = TGME49_228040; length = 2210 | 3061 |
| TGME49_chrVIII | 2294089 | 2295780 | − | ID = TGME49_232955; length = 1691 | 3062 |
| TGME49_chrXII | 5476685 | 5478806 | − | ID = TGME49_251590; length = 2121 | 3063 |
| TGME49_chrIb | 633161 | 636374 | + | ID = TGME49_208370; length = 3213 | 3064 |
| TGME49_chrXII | 6262592 | 6264233 | − | ID = TGME49_278170; length = 1641 | 3065 |
| TGME49_chrXII | 6259327 | 6260911 | − | ID = TGME49_278180; length = 1584 | 3066 |
| TGME49_chrVIIb | 2848299 | 2850481 | + | ID = TGME49_259230; length = 2182 | 3067 |
| TGME49_chrIV | 1768003 | 1771226 | + | ID = TGME49_211385; length = 3223 | 3068 |
| TGME49_chrVIII | 1720655 | 1723473 | − | ID = TGME49_231994; length = 2818 | 3069 |
| TGME49_chrIX | 4080078 | 4082079 | + | ID = TGME49_291040; length = 2001 | 3070 |
| TGME49_chrVI | 1317414 | 1319297 | − | ID = TGME49_240540; length = 1883 | 3071 |
| TGME49_chrV | 1652865 | 1654841 | + | ID = TGME49_286810; length = 1976 | 3072 |
| TGME49_chrVIIb | 3251619 | 3253665 | − | ID = TGME49_258700; length = 2046 | 3073 |
| TGME49_chrVIIb | 1370354 | 1372539 | + | ID = TGME49_262110; length = 2185 | 3074 |
| TGME49_chrVIIb | 1449509 | 1451279 | + | ID = TGME49_261970; length = 1770 | 3075 |
| TGME49_chrXI | 781501 | 783875 | − | ID = TGME49_309730; length = 2374 | 3076 |
| TGME49_chrVIIb | 1649346 | 1654154 | − | ID = TGME49_261580; length = 4808 | 3077 |
| TGME49_chrVIII | 181487 | 183193 | − | ID = TGME49_229340; length = 1706 | 3078 |
| TGME49_chrX | 2911649 | 2913447 | − | ID = TGME49_224650; length = 1798 | 3079 |
| TGME49_chrIb | 306500 | 307968 | + | ID = TGME49_207810; length = 1468 | 3080 |
| TGME49_chrXII | 951504 | 953111 | − | ID = TGME49_219440; length = 1607 | 3081 |
| TGME49_chrX | 6921384 | 6924980 | + | ID = TGME49_215360; length = 3596 | 3082 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIa | 387758 | 391767 | − | ID = TGME49_293510; length = 4009 | 3083 |
| TGME49_chrVIIb | 2729364 | 2731606 | + | ID = TGME49_259650; length = 2242 | 3084 |
| TGME49_chrX | 592859 | 595829 | − | ID = TGME49_228100; length = 2970 | 3085 |
| TGME49_chrX | 7029939 | 7032199 | − | ID = TGME49_215580; length = 2260 | 3086 |
| TGME49_chrIb | 1191601 | 1193002 | − | ID = TGME49_209290; length = 1401 | 3087 |
| TGME49_chrX | 3027268 | 3029865 | − | ID = TGME49_224500; length = 2597 | 3088 |
| TGME49_chrXII | 6897732 | 6900123 | + | ID = TGME49_276830; length = 2391 | 3089 |
| TGME49_chrXII | 6809802 | 6813303 | + | ID = TGME49_276980; length = 3501 | 3090 |
| TGME49_chrV | 1851350 | 1853522 | − | ID = TGME49_286410; length = 2172 | 3091 |
| TGME49_chrXI | 4946164 | 4950718 | + | ID = TGME49_315760; length = 4554 | 3092 |
| TGME49_chrIV | 1996453 | 2000862 | + | ID = TGME49_210960; length = 4409 | 3093 |
| TGME49_chrX | 7087474 | 7089312 | + | ID = TGME49_215690; length = 1838 | 3094 |
| TGME49_chrXI | 2289637 | 2291430 | − | ID = TGME49_311780; length = 1793 | 3095 |
| TGME49_chrVIII | 2627341 | 2629242 | − | ID = TGME49_233400; length = 1901 | 3096 |
| TGME49_chrX | 6836429 | 6838321 | + | ID = TGME49_215250; length = 1892 | 3097 |
| TGME49_chrX | 5400481 | 5403238 | + | ID = TGME49_236530; length = 2757 | 3098 |
| TGME49_chrV | 2938627 | 2941078 | + | ID = TGME49_283820; length = 2451 | 3099 |
| TGME49_chrVIIa | 1810563 | 1815332 | + | ID = TGME49_204400; length = 4769 | 3100 |
| TGME49_chrXII | 5747706 | 5751318 | + | ID = TGME49_278930; length = 3612 | 3101 |
| TGME49_chrXII | 6168265 | 6171686 | − | ID = TGME49_278290; length = 3421 | 3102 |
| TGME49_chrV | 1344460 | 1347471 | − | ID = TGME49_213800; length = 3011 | 3103 |
| TGME49_chrII | 41471 | 44914 | − | ID = TGME49_220890; length = 3443 | 3104 |
| TGME49_chrIb | 709441 | 711471 | − | ID = TGME49_208430; length = 2030 | 3105 |
| TGME49_chrXII | 5633131 | 5634774 | + | ID = TGME49_251870; length = 1643 | 3106 |
| TGME49_chrVIIa | 1364199 | 1366359 | + | ID = TGME49_205500; length = 2160 | 3107 |
| TGME49_chrVIIb | 2204527 | 2206884 | + | ID = TGME49_260490; length = 2357 | 3108 |
| TGME49_chrX | 4374032 | 4376202 | − | ID = TGME49_234420; length = 2170 | 3109 |
| TGME49_chrVIII | 5008760 | 5011510 | − | ID = TGME49_270770; length = 2750 | 3110 |
| TGME49_chrV | 1237226 | 1239000 | + | ID = TGME49_213690; length = 1774 | 3111 |
| TGME49_chrV | 955818 | 959487 | − | ID = TGME49_213360; length = 3669 | 3112 |
| TGME49_chrVIII | 2206818 | 2209210 | + | ID = TGME49_232655; length = 2392 | 3113 |
| TGME49_chrX | 3635680 | 3638226 | − | ID = TGME49_223725; length = 2546 | 3114 |
| TGME49_chrVI | 1734581 | 1739230 | − | ID = TGME49_241830; length = 4649 | 3115 |
| TGME49_chrIV | 1832476 | 1835918 | − | ID = TGME49_211320; length = 3442 | 3116 |
| TGME49_chrX | 1197026 | 1200743 | − | ID = TGME49_226960; length = 3717 | 3117 |
| TGME49_chrVIII | 5603298 | 5605973 | − | ID = TGME49_269775; length = 2675 | 3118 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 3587693 | 3590070 | − | ID = TGME49_258090; length = 2377 | 3119 |
| TGME49_chrX | 6305337 | 6307575 | − | ID = TGME49_214470; length = 2238 | 3120 |
| TGME49_chrX | 2389500 | 2393945 | − | ID = TGME49_225230; length = 4445 | 3121 |
| TGME49_chrX | 968991 | 973953 | + | ID = TGME49_227380; length = 4962 | 3122 |
| TGME49_chrII | 1194300 | 1198358 | + | ID = TGME49_222700; length = 4058 | 3123 |
| TGME49_chrXII | 5594326 | 5596456 | − | ID = TGME49_251800; length = 2130 | 3124 |
| TGME49_chrV | 2700214 | 2702822 | − | ID = TGME49_284590; length = 2608 | 3125 |
| TGME49_chrVIII | 6385919 | 6387483 | + | ID = TGME49_268630; length = 1564 | 3126 |
| TGME49_chrVIIa | 2542159 | 2544885 | − | ID = TGME49_203370; length = 2726 | 3127 |
| TGME49_chrIX | 4954974 | 4957346 | − | ID = TGME49_210230; length = 2372 | 3128 |
| TGME49_chrIa | 1011312 | 1015928 | − | ID = TGME49_294620; length = 4616 | 3129 |
| TGME49_chrVIII | 3319333 | 3323273 | − | ID = TGME49_273690; length = 3940 | 3130 |
| TGME49_chrIa | 1089755 | 1093766 | − | ID = TGME49_294710; length = 4011 | 3131 |
| TGME49_chrII | 683949 | 685295 | + | ID = TGME49_221905; length = 1346 | 3132 |
| TGME49_chrX | 5344224 | 5344882 | − | ID = TGME49_236230; length = 658 | 3133 |
| TGME49_chrVIII | 6137141 | 6141591 | − | ID = TGME49_269015; length = 4450 | 3134 |
| TGME49_chrVIII | 3855036 | 3855734 | + | ID = TGME49_272593; length = 698 | 3135 |
| TGME49_chrVI | 2498990 | 2500814 | − | ID = TGME49_243265; length = 1824 | 3136 |
| TGME49_chrVI | 1383916 | 1388756 | − | ID = TGME49_240680; length = 4840 | 3137 |
| TGME49_chrX | 1826751 | 1828019 | − | ID = TGME49_226072; length = 1268 | 3138 |
| TGME49_chrXII | 4263605 | 4265733 | − | ID = TGME49_248940; length = 2128 | 3139 |
| TGME49_chrX | 4833704 | 4835258 | − | ID = TGME49_235390; length = 1554 | 3140 |
| TGME49_chrIX | 5492734 | 5495529 | + | ID = TGME49_305600; length = 2795 | 3141 |
| TGME49_chrIV | 1597207 | 1599157 | − | ID = TGME49_211700; length = 1950 | 3142 |
| TGME49_chrVIIb | 2200394 | 2201672 | − | ID = TGME49_260510; length = 1278 | 3143 |
| TGME49_chrX | 6491939 | 6496460 | + | ID = TGME49_214790; length = 4521 | 3144 |
| TGME49_chrXII | 929521 | 931802 | + | ID = TGME49_219450; length = 2281 | 3145 |
| TGME49_chrXII | 1474197 | 1475820 | − | ID = TGME49_218540; length = 1623 | 3146 |
| TGME49_chrX | 2406861 | 2409830 | − | ID = TGME49_225220; length = 2969 | 3147 |
| TGME49_chrX | 1658166 | 1660752 | − | ID = TGME49_226410; length = 2586 | 3148 |
| TGME49_chrIV | 2117702 | 2122018 | − | ID = TGME49_210730; length = 4316 | 3149 |
| TGME49_chrVI | 2322359 | 2326694 | − | ID = TGME49_242820; length = 4335 | 3150 |
| TGME49_chrX | 6720390 | 6721912 | − | ID = TGME49_215050; length = 1522 | 3151 |
| TGME49_chrXII | 3330336 | 3332740 | − | ID = TGME49_247410; length = 2404 | 3152 |
| TGME49_chrX | 4799828 | 4801328 | + | ID = TGME49_235360; length = 1500 | 3153 |
| TGME49_chrX | 1080206 | 1081448 | − | ID = TGME49_227130; length = 1242 | 3154 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 1529034 | 1531895 | − | ID = TGME49_218420; length = 2861 | 3155 |
| TGME49_chrXI | 4761956 | 4764431 | + | ID = TGME49_315510; length = 2475 | 3156 |
| TGME49_chrXII | 4506382 | 4509664 | + | ID = TGME49_249390; length = 3282 | 3157 |
| TGME49_chrX | 1539018 | 1541043 | + | ID = TGME49_226550; length = 2025 | 3158 |
| TGME49_chrX | 676709 | 678567 | + | ID = TGME49_228000; length = 1858 | 3159 |
| TGME49_chrXII | 6040410 | 6044218 | + | ID = TGME49_278518; length = 3808 | 3160 |
| TGME49_chrVIIa | 2053467 | 2056236 | − | ID = TGME49_204000; length = 2769 | 3161 |
| TGME49_chrIX | 674942 | 676609 | − | ID = TGME49_267400; length = 1667 | 3162 |
| TGME49_chrV | 1174251 | 1179266 | + | ID = TGME49_213620; length = 5015 | 3163 |
| TGME49_chrIb | 1074486 | 1077281 | − | ID = TGME49_209140; length = 2795 | 3164 |
| TGME49_chrXI | 3475816 | 3477674 | − | ID = TGME49_313560; length = 1858 | 3165 |
| TGME49_chrXI | 293500 | 294822 | + | ID = TGME49_308840; length = 1322 | 3166 |
| TGME49_chrXI | 2557571 | 2561791 | − | ID = TGME49_312270; length = 4220 | 3167 |
| TGME49_chrVIII | 4531960 | 4533762 | + | ID = TGME49_271375; length = 1802 | 3168 |
| TGME49_chrXI | 3875153 | 3877145 | − | ID = TGME49_314000; length = 1992 | 3169 |
| TGME49_chrVIIb | 214816 | 216778 | + | ID = TGME49_264050; length = 1962 | 3170 |
| TGME49_chrXII | 3488810 | 3491174 | + | ID = TGME49_247690; length = 2364 | 3171 |
| TGME49_chrXI | 156674 | 158998 | − | ID = TGME49_306960; length = 2324 | 3172 |
| TGME49_chrVI | 1295147 | 1297637 | − | ID = TGME49_240490; length = 2490 | 3173 |
| TGME49_chrXI | 5342954 | 5345109 | + | ID = TGME49_316490; length = 2155 | 3174 |
| TGME49_chrVIIb | 3590265 | 3592441 | + | ID = TGME49_258080; length = 2176 | 3175 |
| TGME49_chrXI | 1590207 | 1593920 | − | ID = TGME49_310780; length = 3713 | 3176 |
| TGME49_chrX | 5240808 | 5243220 | − | ID = TGME49_236010; length = 2412 | 3177 |
| TGME49_chrIX | 2095104 | 2097103 | − | ID = TGME49_264720; length = 1999 | 3178 |
| TGME49_chrXI | 2343071 | 2344870 | − | ID = TGME49_311870; length = 1799 | 3179 |
| TGME49_chrVIII | 6268529 | 6273255 | + | ID = TGME49_268820; length = 4726 | 3180 |
| TGME49_chrX | 5004448 | 5006565 | + | ID = TGME49_235640; length = 2117 | 3181 |
| TGME49_chrXI | 1373831 | 1375397 | + | ID = TGME49_310470; length = 1566 | 3182 |
| TGME49_chrIX | 5257875 | 5261530 | + | ID = TGME49_305170; length = 3655 | 3183 |
| TGME49_chrXII | 1897106 | 1899724 | + | ID = TGME49_217550; length = 2618 | 3184 |
| TGME49_chrXII | 6036700 | 6038574 | + | ID = TGME49_278530; length = 1874 | 3185 |
| TGME49_chrVIIa | 3793013 | 3794469 | − | ID = TGME49_201785; length = 1456 | 3186 |
| TGME49_chrVIIa | 4025422 | 4029337 | + | ID = TGME49_201120; length = 3915 | 3187 |
| TGME49_chrV | 581559 | 583050 | − | ID = TGME49_212750; length = 1491 | 3188 |
| TGME49_chrXII | 5992156 | 5994337 | + | ID = TGME49_278620; length = 2181 | 3189 |
| TGME49_chrVI | 554234 | 557286 | + | ID = TGME49_239340; length = 3052 | 3190 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 6472869 | 6475497 | + | ID = TGME49_216000; length = 2628 | 3191 |
| TGME49_chrIX | 3637783 | 3640204 | − | ID = TGME49_290190; length = 2421 | 3192 |
| TGME49_chrVI | 2669369 | 2670449 | + | ID = TGME49_243490; length = 1080 | 3193 |
| TGME49_chrXII | 3820580 | 3822334 | + | ID = TGME49_248350; length = 1754 | 3194 |
| TGME49_chrV | 695402 | 700329 | − | ID = TGME49_212900; length = 4927 | 3195 |
| TGME49_chrXI | 3960715 | 3962825 | + | ID = TGME49_314250; length = 2110 | 3196 |
| TGME49_chrVIIb | 3619190 | 3621196 | + | ID = TGME49_258050; length = 2006 | 3197 |
| TGME49_chrIX | 2493133 | 2494671 | − | ID = TGME49_288390; length = 1538 | 3198 |
| TGME49_chrX | 3691463 | 3693211 | − | ID = TGME49_223630; length = 1748 | 3199 |
| TGME49_chrX | 2407746 | 2409830 | − | ID = TGME49_225210; length = 2084 | 3200 |
| TGME49_chrVIIa | 1171935 | 1174196 | − | ID = TGME49_205760; length = 2261 | 3201 |
| TGME49_chrX | 5661881 | 5663299 | − | ID = TGME49_237000; length = 1418 | 3202 |
| TGME49_chrX | 6515604 | 6517875 | + | ID = TGME49_214830; length = 2271 | 3203 |
| TGME49_chrII | 364035 | 366572 | + | ID = TGME49_221460; length = 2537 | 3204 |
| TGME49_chrVIII | 3181451 | 3182748 | − | ID = TGME49_273915; length = 1297 | 3205 |
| TGME49_chrXI | 2990969 | 2994121 | + | ID = TGME49_312950; length = 3152 | 3206 |
| TGME49_chrXI | 3807555 | 3811116 | + | ID = TGME49_313930; length = 3561 | 3207 |
| TGME49_chrVIIb | 3951522 | 3953639 | + | ID = TGME49_257595; length = 2117 | 3208 |
| TGME49_chrX | 4325394 | 4329853 | + | ID = TGME49_234380; length = 4459 | 3209 |
| TGME49_chrVIII | 6386810 | 6388130 | − | ID = TGME49_268640; length = 1320 | 3210 |
| TGME49_chrVIIa | 1076863 | 1079600 | + | ID = TGME49_206290; length = 2737 | 3211 |
| TGME49_chrIX | 1261687 | 1263721 | − | ID = TGME49_266270; length = 2034 | 3212 |
| TGME49_chrV | 160175 | 161766 | + | ID = TGME49_220140; length = 1591 | 3213 |
| TGME49_chrVIII | 5945676 | 5948163 | + | ID = TGME49_269280; length = 2487 | 3214 |
| TGME49_chrXI | 3960715 | 3965719 | + | ID = TGME49_314260; length = 5004 | 3215 |
| TGME49_chrXII | 2765307 | 2768904 | + | ID = TGME49_246340; length = 3597 | 3216 |
| TGME49_chrVI | 2079734 | 2081710 | + | ID = TGME49_242590; length = 1976 | 3217 |
| TGME49_chrIV | 2078838 | 2080697 | + | ID = TGME49_210778; length = 1859 | 3218 |
| TGME49_chrVIIa | 717178 | 721171 | + | ID = TGME49_206695; length = 3993 | 3219 |
| TGME49_chrXII | 440948 | 443883 | − | ID = TGME49_307840; length = 2935 | 3220 |
| TGME49_chrXI | 3698435 | 3702023 | + | ID = TGME49_313810; length = 3588 | 3221 |
| TGME49_chrVIII | 3942775 | 3945251 | − | ID = TGME49_272490; length = 2476 | 3222 |
| TGME49_chrVIIa | 609399 | 611880 | − | ID = TGME49_304650; length = 2481 | 3223 |
| TGME49_chrVIII | 759334 | 761144 | − | ID = TGME49_230410; length = 1810 | 3224 |
| TGME49_chrX | 6801459 | 6804369 | + | ID = TGME49_215180; length = 2910 | 3225 |
| TGME49_chrXI | 2039625 | 2043830 | + | ID = TGME49_311390; length = 4205 | 3226 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 4548008 | 4550577 | − | ID = TGME49_249450; length = 2569 | 3227 |
| TGME49_chrXII | 3071741 | 3075581 | + | ID = TGME49_246990; length = 3840 | 3228 |
| TGME49_chrVIII | 555529 | 558130 | − | ID = TGME49_230020; length = 2601 | 3229 |
| TGME49_chrIX | 2625217 | 2629487 | − | ID = TGME49_288570; length = 4270 | 3230 |
| TGME49_chrVIII | 4338895 | 4341797 | + | ID = TGME49_271820; length = 2902 | 3231 |
| TGME49_chrXI | 5023123 | 5027594 | − | ID = TGME49_315845; length = 4471 | 3232 |
| TGME49_chrXI | 3894915 | 3895467 | + | ID = TGME49_314038; length = 552 | 3233 |
| TGME49_chrX | 592274 | 594953 | + | ID = TGME49_228080; length = 2679 | 3234 |
| TGME49_chrVIIa | 790922 | 794038 | − | ID = TGME49_206605; length = 3116 | 3235 |
| TGME49_chrX | 12618 | 17436 | − | ID = TGME49_200700; length = 4818 | 3236 |
| TGME49_chrII | 113565 | 116395 | + | ID = TGME49_221190; length = 2830 | 3237 |
| TGME49_chrXI | 1603620 | 1606558 | + | ID = TGME49_310810; length = 2938 | 3238 |
| TGME49_chrXII | 5728540 | 5730511 | − | ID = TGME49_278960; length = 1971 | 3239 |
| TGME49_chrVIII | 2113265 | 2117768 | − | ID = TGME49_232450; length = 4503 | 3240 |
| TGME49_chrVI | 2693010 | 2694809 | − | ID = TGME49_243510; length = 1799 | 3241 |
| TGME49_chrXII | 2133547 | 2135173 | − | ID = TGME49_217790; length = 1626 | 3242 |
| TGME49_chrX | 439688 | 443866 | − | ID = TGME49_228290; length = 4178 | 3243 |
| TGME49_chrXI | 838551 | 840380 | − | ID = TGME49_309840; length = 1829 | 3244 |
| TGME49_chrVI | 910173 | 911950 | + | ID = TGME49_239790; length = 1777 | 3245 |
| TGME49_chrXI | 5861035 | 5863057 | − | ID = TGME49_216830; length = 2022 | 3246 |
| TGME49_chrVIII | 2085152 | 2087343 | − | ID = TGME49_232420; length = 2191 | 3247 |
| TGME49_chrXI | 6457120 | 6462057 | + | ID = TGME49_216020; length = 4937 | 3248 |
| TGME49_chrXI | 4837616 | 4841215 | + | ID = TGME49_315600; length = 3599 | 3249 |
| TGME49_chrVIIb | 696220 | 698492 | + | ID = TGME49_263220; length = 2272 | 3250 |
| TGME49_chrXI | 5253011 | 5255174 | − | ID = TGME49_316350; length = 2163 | 3251 |
| TGME49_chrXI | 6203760 | 6205467 | + | ID = TGME49_216370; length = 1707 | 3252 |
| TGME49_chrVIII | 5584745 | 5587000 | − | ID = TGME49_269840; length = 2255 | 3253 |
| TGME49_chrVIIa | 546593 | 549758 | + | ID = TGME49_304630; length = 3165 | 3254 |
| TGME49_chrIb | 1563716 | 1566724 | + | ID = TGME49_209945; length = 3008 | 3255 |
| TGME49_chrVI | 16939 | 19862 | − | ID = TGME49_238020; length = 2923 | 3256 |
| TGME49_chrVIII | 4444950 | 4446452 | − | ID = TGME49_271625; length = 1502 | 3257 |
| TGME49_chrVIIa | 4276998 | 4281215 | − | ID = TGME49_281920; length = 4217 | 3258 |
| TGME49_chrIa | 512763 | 514787 | − | ID = TGME49_293690; length = 2024 | 3259 |
| TGME49_chrXII | 54016 | 56494 | − | ID = TGME49_300360; length = 2478 | 3260 |
| TGME49_chrVIII | 5238119 | 5240134 | − | ID = TGME49_270450; length = 2015 | 3261 |
| TGME49_chrX | 3660096 | 3662573 | + | ID = TGME49_223672; length = 2477 | 3262 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIV | 1137830 | 1140106 | + | ID = TGME49_318700; length = 2276 | 3263 |
| TGME49_chrVIII | 5285859 | 5288814 | + | ID = TGME49_270300; length = 2955 | 3264 |
| TGME49_chrVI | 546954 | 551539 | + | ID = TGME49_239330; length = 4585 | 3265 |
| TGME49_chrVI | 94162 | 97062 | − | ID = TGME49_238165; length = 2900 | 3266 |
| TGME49_chrXII | 5675187 | 5677936 | + | ID = TGME49_251940; length = 2749 | 3267 |
| TGME49_chrVIII | 6560093 | 6561570 | − | ID = TGME49_268300; length = 1477 | 3268 |
| TGME49_chrXII | 5992982 | 5995016 | − | ID = TGME49_278630; length = 2034 | 3269 |
| TGME49_chrXI | 2203975 | 2206339 | − | ID = TGME49_311680; length = 2364 | 3270 |
| TGME49_chrXII | 2855036 | 2857439 | − | ID = TGME49_246555; length = 2403 | 3271 |
| TGME49_chrVIII | 5713358 | 5716949 | + | ID = TGME49_269650; length = 3591 | 3272 |
| TGME49_chrVIIb | 1063168 | 1067088 | − | ID = TGME49_262720; length = 3920 | 3273 |
| TGME49_chrX | 4603574 | 4605486 | − | ID = TGME49_235010; length = 1912 | 3274 |
| TGME49_chrII | 1076568 | 1079158 | + | ID = TGME49_222370; length = 2590 | 3275 |
| TGME49_chrVIII | 367389 | 369573 | − | ID = TGME49_229650; length = 2184 | 3276 |
| TGME49_chrXII | 3099886 | 3101996 | + | ID = TGME49_247010; length = 2110 | 3277 |
| TGME49_chrVIIb | 1127048 | 1129656 | + | ID = TGME49_262610; length = 2608 | 3278 |
| TGME49_chrVIII | 3232358 | 3234398 | + | ID = TGME49_273830; length = 2040 | 3279 |
| TGME49_chrVIII | 3923611 | 3925862 | + | ID = TGME49_272520; length = 2251 | 3280 |
| TGME49_chrIV | 278199 | 282008 | − | ID = TGME49_320540; length = 3809 | 3281 |
| TGME49_chrX | 493321 | 495081 | − | ID = TGME49_228210; length = 1760 | 3282 |
| TGME49_chrVIII | 1768528 | 1773014 | + | ID = TGME49_232030; length = 4486 | 3283 |
| TGME49_chrVIII | 5272156 | 5276079 | − | ID = TGME49_270330; length = 3923 | 3284 |
| TGME49_chrVIII | 6183118 | 6185406 | − | ID = TGME49_268960; length = 2288 | 3285 |
| TGME49_chrIV | 758992 | 760757 | − | ID = TGME49_319730; length = 1765 | 3286 |
| TGME49_chrIV | 948350 | 951893 | − | ID = TGME49_319520; length = 3543 | 3287 |
| TGME49_chrIX | 2438866 | 2442135 | + | ID = TGME49_288300; length = 3269 | 3288 |
| TGME49_chrVIIb | 4640463 | 4643361 | − | ID = TGME49_255895; length = 2898 | 3289 |
| TGME49_chrX | 5206510 | 5208863 | + | ID = TGME49_235970; length = 2353 | 3290 |
| TGME49_chrVIIb | 4570661 | 4571741 | − | ID = TGME49_256010; length = 1080 | 3291 |
| TGME49_chrX | 1627981 | 1632602 | − | ID = TGME49_226450; length = 4621 | 3292 |
| TGME49_chrXI | 615166 | 617797 | + | ID = TGME49_309300; length = 2631 | 3293 |
| TGME49_chrVIII | 3318828 | 3322791 | + | ID = TGME49_273670; length = 3963 | 3294 |
| TGME49_chrVIIb | 856438 | 857983 | − | ID = TGME49_263050; length = 1545 | 3295 |
| TGME49_chrIX | 4005052 | 4007328 | − | ID = TGME49_290970; length = 2276 | 3296 |
| TGME49_chrXI | 2645045 | 2647433 | + | ID = TGME49_312380; length = 2388 | 3297 |
| TGME49_chrIb | 927952 | 932691 | + | ID = TGME49_208980; length = 4739 | 3298 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 1515798 | 1517465 | + | ID = TGME49_226590; length = 1667 | 3299 |
| TGME49_chrX | 1285743 | 1290308 | − | ID = TGME49_226860; length = 4565 | 3300 |
| TGME49_chrVIII | 6167383 | 6169354 | − | ID = TGME49_268985; length = 1971 | 3301 |
| TGME49_chrX | 3025485 | 3029064 | + | ID = TGME49_224490; length = 3579 | 3302 |
| TGME49_chrIV | 2047627 | 2048983 | − | ID = TGME49_210800; length = 1356 | 3303 |
| TGME49_chrIX | 998733 | 1003398 | + | ID = TGME49_266710; length = 4665 | 3304 |
| TGME49_chrX | 4396194 | 4397204 | + | ID = TGME49_234450; length = 1010 | 3305 |
| TGME49_chrII | 1112777 | 1115543 | − | ID = TGME49_222390; length = 2766 | 3306 |
| TGME49_chrIV | 812222 | 814651 | + | ID = TGME49_319640; length = 2429 | 3307 |
| TGME49_chrV | 1460170 | 1461527 | + | ID = TGME49_213960; length = 1357 | 3308 |
| TGME49_chrIa | 182514 | 184547 | − | ID = TGME49_293230; length = 2033 | 3309 |
| TGME49_chrVIIb | 2271547 | 2274550 | + | ID = TGME49_260430; length = 3003 | 3310 |
| TGME49_chrII | 924486 | 928859 | + | ID = TGME49_222170; length = 4373 | 3311 |
| TGME49_chrX | 1874663 | 1877819 | − | ID = TGME49_226000; length = 3156 | 3312 |
| TGME49_chrIX | 3289012 | 3292661 | + | ID = TGME49_289540; length = 3649 | 3313 |
| TGME49_chrXI | 4923699 | 4926214 | + | ID = TGME49_315720; length = 2515 | 3314 |
| TGME49_chrXII | 2633358 | 2636013 | − | ID = TGME49_246050; length = 2655 | 3315 |
| TGME49_chrVIIb | 3442643 | 3444853 | − | ID = TGME49_258390; length = 2210 | 3316 |
| TGME49_chrIb | 1471114 | 1474353 | + | ID = TGME49_209830; length = 3239 | 3317 |
| TGME49_chrXII | 6529058 | 6534063 | − | ID = TGME49_277770; length = 5005 | 3318 |
| TGME49_chrV | 423922 | 426714 | + | ID = TGME49_220510; length = 2792 | 3319 |
| TGME49_chrVIIb | 1746391 | 1751219 | − | ID = TGME49_261450; length = 4828 | 3320 |
| TGME49_chrIV | 1632693 | 1634603 | − | ID = TGME49_211670; length = 1910 | 3321 |
| TGME49_chrVIII | 3963511 | 3965457 | + | ID = TGME49_272440; length = 1946 | 3322 |
| TGME49_chrIX | 5666236 | 5668173 | + | ID = TGME49_305920; length = 1937 | 3323 |
| TGME49_chrXII | 5902655 | 5905896 | − | ID = TGME49_278753; length = 3241 | 3324 |
| TGME49_chrXI | 1574116 | 1575491 | + | ID = TGME49_310760; length = 1375 | 3325 |
| TGME49_chrVI | 1692909 | 1695468 | + | ID = TGME49_241300; length = 2559 | 3326 |
| TGME49_chrIb | 601374 | 605206 | − | ID = TGME49_208200; length = 3832 | 3327 |
| TGME49_chrXI | 5520848 | 5523439 | + | ID = TGME49_316730; length = 2591 | 3328 |
| TGME49_chrXII | 3127172 | 3130041 | − | ID = TGME49_247040; length = 2869 | 3329 |
| TGME49_chrIb | 1399838 | 1402434 | + | ID = TGME49_209690; length = 2596 | 3330 |
| TGME49_chrX | 5779951 | 5782510 | − | ID = TGME49_237200; length = 2559 | 3331 |
| TGME49_chrXII | 5724237 | 5726426 | − | ID = TGME49_278965; length = 2189 | 3332 |
| TGME49_chrXI | 3466374 | 3470440 | + | ID = TGME49_313550; length = 4066 | 3333 |
| TGME49_chrVIIb | 4749722 | 4752553 | + | ID = TGME49_255650; length = 2831 | 3334 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 5611490 | 5613721 | + | ID = TGME49_305840; length = 2231 | 3335 |
| TGME49_chrIX | 4291304 | 4293908 | − | ID = TGME49_291600; length = 2604 | 3336 |
| TGME49_chrXI | 3453849 | 3456185 | + | ID = TGME49_313520; length = 2336 | 3337 |
| TGME49_chrXII | 4749942 | 4752741 | + | ID = TGME49_249710; length = 2799 | 3338 |
| TGME49_chrIa | 1782761 | 1785919 | + | ID = TGME49_295390; length = 3158 | 3339 |
| TGME49_chrXI | 732325 | 734891 | + | ID = TGME49_309580; length = 2566 | 3340 |
| TGME49_chrX | 6496294 | 6497510 | − | ID = TGME49_214787; length = 1216 | 3341 |
| TGME49_chrX | 3655540 | 3656902 | − | ID = TGME49_223690; length = 1362 | 3342 |
| TGME49_chrVIIb | 583138 | 585745 | − | ID = TGME49_263400; length = 2607 | 3343 |
| TGME49_chrXI | 175012 | 177263 | − | ID = TGME49_306940; length = 2251 | 3344 |
| TGME49_chrX | 6253503 | 6255193 | − | ID = TGME49_214330; length = 1690 | 3345 |
| TGME49_chrVIII | 2174546 | 2176594 | − | ID = TGME49_232580; length = 2048 | 3346 |
| TGME49_chrXI | 5840587 | 5844665 | + | ID = TGME49_216860; length = 4078 | 3347 |
| TGME49_chrIb | 1543519 | 1546904 | + | ID = TGME49_209910; length = 3385 | 3348 |
| TGME49_chrX | 3769236 | 3773701 | + | ID = TGME49_223500; length = 4465 | 3349 |
| TGME49_chrVI | 1585973 | 1590736 | − | ID = TGME49_240960; length = 4763 | 3350 |
| TGME49_chrV | 609849 | 613843 | + | ID = TGME49_212810; length = 3994 | 3351 |
| TGME49_chrII | 1315546 | 1319755 | + | ID = TGME49_222940; length = 4209 | 3352 |
| TGME49_chrXI | 2932469 | 2934408 | + | ID = TGME49_312830; length = 1939 | 3353 |
| TGME49_chrXII | 5198502 | 5201968 | − | ID = TGME49_250770; length = 3466 | 3354 |
| TGME49_chrVIII | 3444778 | 3446250 | + | ID = TGME49_273490; length = 1472 | 3355 |
| TGME49_chrV | 1399034 | 1402700 | − | ID = TGME49_213870; length = 3666 | 3356 |
| TGME49_chrXII | 2256968 | 2259255 | − | ID = TGME49_245432; length = 2287 | 3357 |
| TGME49_chrIa | 1423949 | 1426873 | − | ID = TGME49_296015; length = 2924 | 3358 |
| TGME49_chrVIIb | 4379347 | 4381247 | − | ID = TGME49_256900; length = 1900 | 3359 |
| TGME49_chrIX | 3193824 | 3196200 | + | ID = TGME49_289330; length = 2376 | 3360 |
| TGME49_chrXII | 2463875 | 2465663 | + | ID = TGME49_245680; length = 1788 | 3361 |
| TGME49_chrXI | 308195 | 311017 | − | ID = TGME49_308860; length = 2822 | 3362 |
| TGME49_chrXI | 6078723 | 6081550 | − | ID = TGME49_216580; length = 2827 | 3363 |
| TGME49_chrVIII | 609952 | 611492 | − | ID = TGME49_230110; length = 1540 | 3364 |
| TGME49_chrXI | 378842 | 382347 | + | ID = TGME49_308950; length = 3505 | 3365 |
| TGME49_chrXII | 5499356 | 5500559 | + | ID = TGME49_251630; length = 1203 | 3366 |
| TGME49_chrVI | 3641420 | 3643484 | + | ID = TGME49_292610; length = 2064 | 3367 |
| TGME49_chrII | 1468746 | 1470751 | − | ID = TGME49_223130; length = 2005 | 3368 |
| TGME49_chrV | 1397770 | 1400442 | + | ID = TGME49_213880; length = 2672 | 3369 |
| TGME49_chrXI | 1041192 | 1043750 | − | ID = TGME49_310070; length = 2558 | 3370 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIa | 837889 | 840906 | + | ID = TGME49_294360; length = 3017 | 3371 |
| TGME49_chrV | 2173738 | 2175720 | − | ID = TGME49_285850; length = 1982 | 3372 |
| TGME49_chrX | 6414014 | 6416110 | − | ID = TGME49_214600; length = 2096 | 3373 |
| TGME49_chrVIII | 6252860 | 6255582 | − | ID = TGME49_268850; length = 2722 | 3374 |
| TGME49_chrX | 1713807 | 1716377 | − | ID = TGME49_226330; length = 2570 | 3375 |
| TGME49_chrX | 6206363 | 6211100 | − | ID = TGME49_214270; length = 4737 | 3376 |
| TGME49_chrXII | 5579562 | 5582287 | − | ID = TGME49_251770; length = 2725 | 3377 |
| TGME49_chrIV | 2065253 | 2067243 | − | ID = TGME49_210783; length = 1990 | 3378 |
| TGME49_chrVIIb | 4008596 | 4011217 | + | ID = TGME49_257500; length = 2621 | 3379 |
| TGME49_chrII | 1545348 | 1549822 | + | ID = TGME49_297120; length = 4474 | 3380 |
| TGME49_chrXII | 3676372 | 3680205 | − | ID = TGME49_248120; length = 3833 | 3381 |
| TGME49_chrVIIa | 1331384 | 1334559 | + | ID = TGME49_205558; length = 3175 | 3382 |
| TGME49_chrIX | 2596471 | 2598483 | + | ID = TGME49_288530; length = 2012 | 3383 |
| TGME49_chrXI | 2103770 | 2107867 | − | ID = TGME49_311470; length = 4097 | 3384 |
| TGME49_chrXII | 1911601 | 1912822 | + | ID = TGME49_217570; length = 1221 | 3385 |
| TGME49_chrVIII | 3216368 | 3219488 | + | ID = TGME49_273860; length = 3120 | 3386 |
| TGME49_chrVIII | 4616470 | 4619161 | + | ID = TGME49_271260; length = 2691 | 3387 |
| TGME49_chrIX | 6203119 | 6204949 | − | ID = TGME49_306590; length = 1830 | 3388 |
| TGME49_chrX | 865963 | 867849 | − | ID = TGME49_227640; length = 1886 | 3389 |
| TGME49_chrIX | 3016565 | 3020010 | + | ID = TGME49_289130; length = 3445 | 3390 |
| TGME49_chrIb | 498140 | 499444 | − | ID = TGME49_207980; length = 1304 | 3391 |
| TGME49_chrX | 5674742 | 5676571 | − | ID = TGME49_237015; length = 1829 | 3392 |
| TGME49_chrX | 1645346 | 1649764 | − | ID = TGME49_226430; length = 4418 | 3393 |
| TGME49_chrVI | 3181640 | 3183599 | − | ID = TGME49_244300; length = 1959 | 3394 |
| TGME49_chrIV | 132847 | 135011 | − | ID = TGME49_320700; length = 2164 | 3395 |
| TGME49_chrIX | 4534068 | 4536660 | + | ID = TGME49_292080; length = 2592 | 3396 |
| TGME49_chrIX | 2631176 | 2636201 | + | ID = TGME49_288610; length = 5025 | 3397 |
| TGME49_chrVIII | 3309949 | 3314650 | − | ID = TGME49_273720; length = 4701 | 3398 |
| TGME49_chrXI | 6373312 | 6376490 | − | ID = TGME49_216160; length = 3178 | 3399 |
| TGME49_chrVI | 2847279 | 2852109 | + | ID = TGME49_243780; length = 4830 | 3400 |
| TGME49_chrX | 6937876 | 6940165 | − | ID = TGME49_215380; length = 2289 | 3401 |
| TGME49_chrIX | 2722000 | 2725631 | − | ID = TGME49_288740; length = 3631 | 3402 |
| TGME49_chrXI | 5792072 | 5794118 | + | ID = TGME49_216910; length = 2046 | 3403 |
| TGME49_chrVIII | 1385211 | 1389924 | + | ID = TGME49_231380; length = 4713 | 3404 |
| TGME49_chrXI | 3986515 | 3988412 | + | ID = TGME49_314295; length = 1897 | 3405 |
| TGME49_chrXII | 2003898 | 2008672 | − | ID = TGME49_217680; length = 4774 | 3406 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 530467 | 532341 | − | ID = TGME49_267600; length = 1874 | 3407 |
| TGME49_chrXI | 4606041 | 4607359 | + | ID = TGME49_315260; length = 1318 | 3408 |
| TGME49_chrVIII | 3576863 | 3580229 | + | ID = TGME49_273350; length = 3366 | 3409 |
| TGME49_chrII | 233786 | 235666 | − | ID = TGME49_221310; length = 1880 | 3410 |
| TGME49_chrXII | 4287010 | 4288915 | + | ID = TGME49_248990; length = 1905 | 3411 |
| TGME49_chrII | 695953 | 698239 | − | ID = TGME49_221818; length = 2286 | 3412 |
| TGME49_chrX | 6983149 | 6985034 | + | ID = TGME49_215500; length = 1885 | 3413 |
| TGME49_chrV | 799775 | 804114 | − | ID = TGME49_213020; length = 4339 | 3414 |
| TGME49_chrVIIb | 5061398 | 5064594 | + | ID = TGME49_255160; length = 3196 | 3415 |
| TGME49_chrVI | 3417882 | 3420561 | + | ID = TGME49_244645; length = 2679 | 3416 |
| TGME49_chrXII | 3073064 | 3076076 | − | ID = TGME49_246982; length = 3012 | 3417 |
| TGME49_chrVIIa | 1500269 | 1505002 | + | ID = TGME49_205265; length = 4733 | 3418 |
| TGME49_chrVIII | 2112448 | 2114445 | + | ID = TGME49_232475; length = 1997 | 3419 |
| TGME49_chrXII | 1187769 | 1192566 | − | ID = TGME49_218960; length = 4797 | 3420 |
| TGME49_chrVI | 1800045 | 1804730 | − | ID = TGME49_241880; length = 4685 | 3421 |
| TGME49_chrIX | 5505937 | 5508990 | − | ID = TGME49_305610; length = 3053 | 3422 |
| TGME49_chrVI | 253436 | 258317 | − | ID = TGME49_238500; length = 4881 | 3423 |
| TGME49_chrVIIb | 3933802 | 3935262 | − | ID = TGME49_257650; length = 1460 | 3424 |
| TGME49_chrVIII | 6330739 | 6334570 | − | ID = TGME49_268760; length = 3831 | 3425 |
| TGME49_chrVIII | 793083 | 797090 | − | ID = TGME49_230440; length = 4007 | 3426 |
| TGME49_chrVIIa | 186501 | 187589 | + | ID = TGME49_280680; length = 1088 | 3427 |
| TGME49_chrXII | 6705701 | 6707565 | − | ID = TGME49_277220; length = 1864 | 3428 |
| TGME49_chrII | 2003854 | 2005661 | − | ID = TGME49_297790; length = 1807 | 3429 |
| TGME49_chrVI | 2742265 | 2744014 | − | ID = TGME49_243590; length = 1749 | 3430 |
| TGME49_chrX | 7067044 | 7071859 | − | ID = TGME49_215640; length = 4815 | 3431 |
| TGME49_chrVIIa | 1741358 | 1742899 | + | ID = TGME49_204505; length = 1541 | 3432 |
| TGME49_chrXI | 1843155 | 1846445 | + | ID = TGME49_311180; length = 3290 | 3433 |
| TGME49_chrVI | 948026 | 952595 | − | ID = TGME49_239820; length = 4569 | 3434 |
| TGME49_chrXII | 1834934 | 1837076 | − | ID = TGME49_217430; length = 2142 | 3435 |
| TGME49_chrXI | 3142479 | 3147503 | + | ID = TGME49_313160; length = 5024 | 3436 |
| TGME49_chrX | 7130359 | 7132487 | + | ID = TGME49_215730; length = 2128 | 3437 |
| TGME49_chrVIII | 2286666 | 2287451 | − | ID = TGME49_232840; length = 785 | 3438 |
| TGME49_chrXI | 1636892 | 1638984 | − | ID = TGME49_310860; length = 2092 | 3439 |
| TGME49_chrVIIa | 4276229 | 4277993 | + | ID = TGME49_281930; length = 1764 | 3440 |
| TGME49_chrVIII | 6329519 | 6334023 | + | ID = TGME49_268750; length = 4504 | 3441 |
| TGME49_chrVI | 528450 | 531729 | − | ID = TGME49_239290; length = 3279 | 3442 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 1355067 | 1359343 | − | ID = TGME49_205530; length = 4276 | 3443 |
| TGME49_chrXI | 5877907 | 5880229 | − | ID = TGME49_216800; length = 2322 | 3444 |
| TGME49_chrVIIb | 2679663 | 2683799 | − | ID = TGME49_259835; length = 4136 | 3445 |
| TGME49_chrIX | 5598442 | 5601226 | − | ID = TGME49_305800; length = 2784 | 3446 |
| TGME49_chrIa | 676197 | 678509 | − | ID = TGME49_294100; length = 2312 | 3447 |
| TGME49_chrXII | 4807452 | 4810501 | − | ID = TGME49_249800; length = 3049 | 3448 |
| TGME49_chrXI | 2952334 | 2953239 | − | ID = TGME49_312850; length = 905 | 3449 |
| TGME49_chrVI | 85967 | 88465 | + | ID = TGME49_238150; length = 2498 | 3450 |
| TGME49_chrVI | 1774870 | 1776217 | + | ID = TGME49_241870; length = 1347 | 3451 |
| TGME49_chrX | 2443820 | 2445343 | + | ID = TGME49_225160; length = 1523 | 3452 |
| TGME49_chrV | 2256865 | 2258465 | + | ID = TGME49_285740; length = 1600 | 3453 |
| TGME49_chrVIIa | 3055087 | 3057294 | − | ID = TGME49_202760; length = 2207 | 3454 |
| TGME49_chrXI | 5215999 | 5218760 | + | ID = TGME49_316270; length = 2761 | 3455 |
| TGME49_chrIV | 1641289 | 1644518 | − | ID = TGME49_211650; length = 3229 | 3456 |
| TGME49_chrX | 5720126 | 5723099 | + | ID = TGME49_237110; length = 2973 | 3457 |
| TGME49_chrXII | 2748458 | 2750074 | + | ID = TGME49_246210; length = 1616 | 3458 |
| TGME49_chrVIII | 5322899 | 5326644 | + | ID = TGME49_270220; length = 3745 | 3459 |
| TGME49_chrXII | 889364 | 891927 | − | ID = TGME49_219520; length = 2563 | 3460 |
| TGME49_chrVI | 1379941 | 1381383 | + | ID = TGME49_240670; length = 1442 | 3461 |
| TGME49_chrXI | 1373831 | 1378479 | + | ID = TGME49_310480; length = 4648 | 3462 |
| TGME49_chrXII | 1208189 | 1212694 | − | ID = TGME49_218930; length = 4505 | 3463 |
| TGME49_chrXII | 3616444 | 3617866 | − | ID = TGME49_247850; length = 1422 | 3464 |
| TGME49_chrV | 1485948 | 1487275 | + | ID = TGME49_287270; length = 1327 | 3465 |
| TGME49_chrV | 1321800 | 1325747 | − | ID = TGME49_213780; length = 3947 | 3466 |
| TGME49_chrIV | 1216840 | 1218366 | − | ID = TGME49_318580; length = 1526 | 3467 |
| TGME49_chrVIIa | 3969642 | 3972217 | − | ID = TGME49_201220; length = 2575 | 3468 |
| TGME49_chrX | 4930960 | 4934578 | − | ID = TGME49_235515; length = 3618 | 3469 |
| TGME49_chrX | 1848514 | 1851776 | + | ID = TGME49_226040; length = 3262 | 3470 |
| TGME49_chrIa | 1201664 | 1204376 | − | ID = TGME49_294830; length = 2712 | 3471 |
| TGME49_chrVIII | 4210000 | 4212465 | − | ID = TGME49_272030; length = 2465 | 3472 |
| TGME49_chrXII | 511743 | 514831 | − | ID = TGME49_308020; length = 3088 | 3473 |
| TGME49_chrVIIb | 2608548 | 2610923 | + | ID = TGME49_259920; length = 2375 | 3474 |
| TGME49_chrX | 5290611 | 5294071 | − | ID = TGME49_236120; length = 3460 | 3475 |
| TGME49_chrVIIa | 3849344 | 3854159 | + | ID = TGME49_201680; length = 4815 | 3476 |
| TGME49_chrVIII | 6557517 | 6561570 | − | ID = TGME49_268310; length = 4053 | 3477 |
| TGME49_chrX | 5806926 | 5808940 | − | ID = TGME49_237240; length = 2014 | 3478 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 922178 | 924766 | + | ID = TGME49_227450; length = 2588 | 3479 |
| TGME49_chrIX | 2659018 | 2661986 | − | ID = TGME49_288650; length = 2968 | 3480 |
| TGME49_chrVI | 2759019 | 2762419 | − | ID = TGME49_243620; length = 3400 | 3481 |
| TGME49_chrX | 6474784 | 6479194 | + | ID = TGME49_214760; length = 4410 | 3482 |
| TGME49_chrVIIb | 1670163 | 1672456 | − | ID = TGME49_261530; length = 2293 | 3483 |
| TGME49_chrXI | 5801565 | 5802917 | − | ID = TGME49_216900; length = 1352 | 3484 |
| TGME49_chrX | 6979927 | 6981500 | − | ID = TGME49_215480; length = 1573 | 3485 |
| TGME49_chrXII | 4078485 | 4082874 | + | ID = TGME49_248677; length = 4389 | 3486 |
| TGME49_chrX | 153327 | 1537059 | − | ID = TGME49_226570; length = 3782 | 3487 |
| TGME49_chrIX | 1670658 | 1673385 | + | ID = TGME49_265240; length = 2727 | 3488 |
| TGME49_chrX | 5351130 | 5352320 | + | ID = TGME49_236250; length = 1190 | 3489 |
| TGME49_chrXII | 302852 | 304279 | − | ID = TGME49_299980; length = 1427 | 3490 |
| TGME49_chrIb | 1403953 | 1405251 | + | ID = TGME49_209700; length = 1298 | 3491 |
| TGME49_chrX | 3003705 | 3007325 | + | ID = TGME49_224520; length = 3620 | 3492 |
| TGME49_chrIV | 194285 | 196070 | + | ID = TGME49_320620; length = 1785 | 3493 |
| TGME49_chrVIII | 5189323 | 5191091 | − | ID = TGME49_270570; length = 1768 | 3494 |
| TGME49_chrX | 971149 | 975816 | − | ID = TGME49_227390; length = 4667 | 3495 |
| TGME49_chrV | 1145386 | 1146565 | + | ID = TGME49_213560; length = 1179 | 3496 |
| TGME49_chrXII | 5661190 | 5663297 | − | ID = TGME49_251910; length = 2107 | 3497 |
| TGME49_chrIb | 1685989 | 1690920 | − | ID = TGME49_321630; length = 4931 | 3498 |
| TGME49_chrIa | 662350 | 666276 | + | ID = TGME49_294060; length = 3926 | 3499 |
| TGME49_chrXI | 3347499 | 3350293 | + | ID = TGME49_313410; length = 2794 | 3500 |
| TGME49_chrXI | 611336 | 614210 | + | ID = TGME49_309290; length = 2874 | 3501 |
| TGME49_chrIX | 4385909 | 4387593 | − | ID = TGME49_291860; length = 1684 | 3502 |
| TGME49_chrXII | 2671176 | 2675189 | − | ID = TGME49_246110; length = 4013 | 3503 |
| TGME49_chrXII | 565309 | 566062 | − | ID = TGME49_308075; length = 753 | 3504 |
| TGME49_chrXII | 4727155 | 4729832 | − | ID = TGME49_249670; length = 2677 | 3505 |
| TGME49_chrVI | 447757 | 449748 | − | ID = TGME49_239070; length = 1991 | 3506 |
| TGME49_chrII | 287426 | 290540 | − | ID = TGME49_221360; length = 3114 | 3507 |
| TGME49_chrVIIb | 1873350 | 1876420 | + | ID = TGME49_261070; length = 3070 | 3508 |
| TGME49_chrVIII | 4011550 | 4016029 | − | ID = TGME49_272390; length = 4479 | 3509 |
| TGME49_chrVIII | 2610522 | 2615562 | − | ID = TGME49_233360; length = 5040 | 3510 |
| TGME49_chrVIII | 5437065 | 5439034 | − | ID = TGME49_270070; length = 1969 | 3511 |
| TGME49_chrVI | 75690 | 77850 | − | ID = TGME49_238130; length = 2160 | 3512 |
| TGME49_chrVIIa | 1530903 | 1532616 | − | ID = TGME49_205230; length = 1713 | 3513 |
| TGME49_chrVIIb | 2754602 | 2756634 | − | ID = TGME49_259610; length = 2032 | 3514 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 1158079 | 1160818 | − | ID = TGME49_310210; length = 2739 | 3515 |
| TGME49_chrVIII | 530520 | 533240 | − | ID = TGME49_230000; length = 2720 | 3516 |
| TGME49_chrIX | 5528569 | 5530025 | + | ID = TGME49_305635; length = 1456 | 3517 |
| TGME49_chrXII | 1633375 | 1637998 | + | ID = TGME49_218260; length = 4623 | 3518 |
| TGME49_chrVIII | 3530338 | 3532583 | − | ID = TGME49_273400; length = 2245 | 3519 |
| TGME49_chrXI | 2200480 | 2202879 | − | ID = TGME49_311670; length = 2399 | 3520 |
| TGME49_chrIX | 4305726 | 4310108 | − | ID = TGME49_291630; length = 4382 | 3521 |
| TGME49_chrIa | 1266145 | 1267436 | − | ID = TGME49_294902; length = 1291 | 3522 |
| TGME49_chrIb | 209955 | 214235 | + | ID = TGME49_207690; length = 4280 | 3523 |
| TGME49_chrXII | 2858847 | 2863310 | + | ID = TGME49_246580; length = 4463 | 3524 |
| TGME49_chrXII | 823067 | 826469 | + | ID = TGME49_219610; length = 3402 | 3525 |
| TGME49_chrVIIa | 3833493 | 3834672 | + | ID = TGME49_201710; length = 1179 | 3526 |
| TGME49_chrVIIb | 3296060 | 3297939 | + | ID = TGME49_258625; length = 1879 | 3527 |
| TGME49_chrVI | 867209 | 869418 | − | ID = TGME49_239710; length = 2209 | 3528 |
| TGME49_chrVIIa | 1275423 | 1276455 | − | ID = TGME49_205615; length = 1032 | 3529 |
| TGME49_chrXII | 4708702 | 4710344 | − | ID = TGME49_249630; length = 1642 | 3530 |
| TGME49_chrX | 4171748 | 4175262 | − | ID = TGME49_234165; length = 3514 | 3531 |
| TGME49_chrXII | 120499 | 122563 | + | ID = TGME49_300260; length = 2064 | 3532 |
| TGME49_chrVI | 498397 | 501660 | − | ID = TGME49_239260; length = 3263 | 3533 |
| TGME49_chrVIII | 493816 | 497365 | − | ID = TGME49_229960; length = 3549 | 3534 |
| TGME49_chrVIIa | 3616280 | 3620711 | − | ID = TGME49_202090; length = 4431 | 3535 |
| TGME49_chrX | 6973684 | 6974864 | − | ID = TGME49_215460; length = 1180 | 3536 |
| TGME49_chrX | 6725890 | 6729429 | − | ID = TGME49_215060; length = 3539 | 3537 |
| TGME49_chrXI | 2762805 | 2765415 | − | ID = TGME49_312520; length = 2610 | 3538 |
| TGME49_chrVIIa | 989384 | 994150 | + | ID = TGME49_206415; length = 4766 | 3539 |
| TGME49_chrIb | 1033057 | 1035956 | − | ID = TGME49_209080; length = 2899 | 3540 |
| TGME49_chrVIIb | 363934 | 367739 | + | ID = TGME49_263720; length = 3805 | 3541 |
| TGME49_chrIX | 3679329 | 3681333 | + | ID = TGME49_290290; length = 2004 | 3542 |
| TGME49_chrXI | 1327241 | 1328715 | − | ID = TGME49_310410; length = 1474 | 3543 |
| TGME49_chrIb | 162965 | 165017 | + | ID = TGME49_207630; length = 2052 | 3544 |
| TGME49_chrVIII | 3411630 | 3413948 | − | ID = TGME49_273550; length = 2318 | 3545 |
| TGME49_chrIX | 4237613 | 4239542 | − | ID = TGME49_291310; length = 1929 | 3546 |
| TGME49_chrV | 2711277 | 2713061 | + | ID = TGME49_284560; length = 1784 | 3547 |
| TGME49_chrVI | 66661 | 71093 | − | ID = TGME49_238100; length = 4432 | 3548 |
| TGME49_chrIb | 1108181 | 1112225 | + | ID = TGME49_209200; length = 4044 | 3549 |
| TGME49_chrX | 1125018 | 1129103 | + | ID = TGME49_227030; length = 4085 | 3550 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 1476720 | 1480771 | + | ID = TGME49_218510; length = 4051 | 3551 |
| TGME49_chrVIII | 3028294 | 3030583 | − | ID = TGME49_274110; length = 2289 | 3552 |
| TGME49_chrIX | 727730 | 732199 | − | ID = TGME49_267312; length = 4469 | 3553 |
| TGME49_chrVI | 1723775 | 1727714 | + | ID = TGME49_241820; length = 3939 | 3554 |
| TGME49_chrVIII | 560930 | 562293 | + | ID = TGME49_230040; length = 1363 | 3555 |
| TGME49_chrII | 1419626 | 1421332 | + | ID = TGME49_223070; length = 1706 | 3556 |
| TGME49_chrXI | 2816725 | 2818748 | + | ID = TGME49_312600; length = 2023 | 3557 |
| TGME49_chrX | 7085873 | 7087326 | − | ID = TGME49_215680; length = 1453 | 3558 |
| TGME49_chrIV | 1162958 | 1165755 | − | ID = TGME49_318675; length = 2797 | 3559 |
| TGME49_chrIV | 1932608 | 1935398 | − | ID = TGME49_211150; length = 2790 | 3560 |
| TGME49_chrXII | 3024176 | 3027111 | + | ID = TGME49_246940; length = 2935 | 3561 |
| TGME49_chrVIIb | 1718394 | 1720099 | + | ID = TGME49_261475; length = 1705 | 3562 |
| TGME49_chrVIII | 5188589 | 5190591 | + | ID = TGME49_270560; length = 2002 | 3563 |
| TGME49_chrX | 6922474 | 6926889 | − | ID = TGME49_215350; length = 4415 | 3564 |
| TGME49_chrIX | 2114633 | 2116655 | + | ID = TGME49_264670; length = 2022 | 3565 |
| TGME49_chrIX | 5302620 | 5305770 | + | ID = TGME49_305240; length = 3150 | 3566 |
| TGME49_chrXI | 3722265 | 3724229 | + | ID = TGME49_313840; length = 1964 | 3567 |
| TGME49_chrX | 3679396 | 3681487 | + | ID = TGME49_223650; length = 2091 | 3568 |
| TGME49_chrXI | 1612255 | 1614074 | + | ID = TGME49_310820; length = 1819 | 3569 |
| TGME49_chrXI | 4303663 | 4305739 | − | ID = TGME49_314790; length = 2076 | 3570 |
| TGME49_chrVIIa | 3037960 | 3042664 | − | ID = TGME49_202780; length = 4704 | 3571 |
| TGME49_chrVIII | 5353669 | 5354773 | + | ID = TGME49_270180; length = 1104 | 3572 |
| TGME49_chrXI | 5186674 | 5188879 | + | ID = TGME49_316220; length = 2205 | 3573 |
| TGME49_chrXII | 6491430 | 6491855 | − | ID = TGME49_277830; length = 425 | 3574 |
| TGME49_chrIV | 1178360 | 1180121 | − | ID = TGME49_318640; length = 1761 | 3575 |
| TGME49_chrIb | 1391208 | 1393087 | + | ID = TGME49_209670; length = 1879 | 3576 |
| TGME49_chrIb | 801471 | 804370 | + | ID = TGME49_208590; length = 2899 | 3577 |
| TGME49_chrVIII | 415461 | 417463 | − | ID = TGME49_229740; length = 2002 | 3578 |
| TGME49_chrII | 1274986 | 1276921 | + | ID = TGME49_222880; length = 1935 | 3579 |
| TGME49_chrX | 2466640 | 2469050 | + | ID = TGME49_225125; length = 2410 | 3580 |
| TGME49_chrVIIb | 3277596 | 3280720 | − | ID = TGME49_258660; length = 3124 | 3581 |
| TGME49_chrVIIb | 1395785 | 1399179 | − | ID = TGME49_262070; length = 3394 | 3582 |
| TGME49_chrXII | 6597047 | 6599362 | + | ID = TGME49_277560; length = 2315 | 3583 |
| TGME49_chrX | 7215853 | 7217846 | − | ID = TGME49_275380; length = 1993 | 3584 |
| TGME49_chrX | 6766166 | 6769751 | − | ID = TGME49_215100; length = 3585 | 3585 |
| TGME49_chrX | 5386834 | 5389094 | − | ID = TGME49_236400; length = 2260 | 3586 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrII | 1531544 | 1535065 | − | ID = TGME49_297100; length = 3521 | 3587 |
| TGME49_chrXI | 2073091 | 2077650 | − | ID = TGME49_311440; length = 4559 | 3588 |
| TGME49_chrVIIa | 3216124 | 3218042 | − | ID = TGME49_202572; length = 1918 | 3589 |
| TGME49_chrIa | 1388041 | 1391447 | + | ID = TGME49_295090; length = 3406 | 3590 |
| TGME49_chrX | 896541 | 897868 | − | ID = TGME49_227600; length = 1327 | 3591 |
| TGME49_chrXII | 6222021 | 6223691 | − | ID = TGME49_278230; length = 1670 | 3592 |
| TGME49_chrIX | 5825997 | 5828317 | + | ID = TGME49_306210; length = 2320 | 3593 |
| TGME49_chrX | 3282886 | 3284073 | + | ID = TGME49_224170; length = 1187 | 3594 |
| TGME49_chrVIII | 377418 | 380433 | − | ID = TGME49_229680; length = 3015 | 3595 |
| TGME49_chrV | 3104191 | 3107086 | + | ID = TGME49_283510; length = 2895 | 3596 |
| TGME49_chrV | 2202009 | 2203415 | − | ID = TGME49_285820; length = 1406 | 3597 |
| TGME49_chrIV | 1970430 | 1971908 | − | ID = TGME49_211015; length = 1478 | 3598 |
| TGME49_chrVI | 1052919 | 1057698 | + | ID = TGME49_240090; length = 4779 | 3599 |
| TGME49_chrVI | 1330533 | 1332686 | − | ID = TGME49_240580; length = 2153 | 3600 |
| TGME49_chrX | 5296360 | 5298183 | + | ID = TGME49_236140; length = 1823 | 3601 |
| TGME49_chrVIIa | 1575851 | 1578088 | + | ID = TGME49_205150; length = 2237 | 3602 |
| TGME49_chrVIIb | 3668995 | 3670754 | + | ID = TGME49_257990; length = 1759 | 3603 |
| TGME49_chrIb | 27811 | 29823 | + | ID = TGME49_207400; length = 2012 | 3604 |
| TGME49_chrVIII | 3674014 | 3678518 | + | ID = TGME49_273070; length = 4504 | 3605 |
| TGME49_chrIV | 2020728 | 2022776 | + | ID = TGME49_210830; length = 2048 | 3606 |
| TGME49_chrIa | 501242 | 504308 | + | ID = TGME49_293680; length = 3066 | 3607 |
| TGME49_chrVIII | 4188294 | 4190240 | + | ID = TGME49_272040; length = 1946 | 3608 |
| TGME49_chrVIIb | 1593274 | 1595045 | + | ID = TGME49_261670; length = 1771 | 3609 |
| TGME49_chrVI | 2345044 | 2347765 | + | ID = TGME49_242845; length = 2721 | 3610 |
| TGME49_chrVIIb | 892798 | 896825 | + | ID = TGME49_262960; length = 4027 | 3611 |
| TGME49_chrVIIb | 4576535 | 4578100 | − | ID = TGME49_255990; length = 1565 | 3612 |
| TGME49_chrVIIb | 3564269 | 3567431 | − | ID = TGME49_258120; length = 3162 | 3613 |
| TGME49_chrV | 841156 | 844040 | − | ID = TGME49_213067; length = 2884 | 3614 |
| TGME49_chrVIIb | 400077 | 401984 | − | ID = TGME49_263680; length = 1907 | 3615 |
| TGME49_chrVIII | 5651257 | 5654273 | − | ID = TGME49_269720; length = 3016 | 3616 |
| TGME49_chrXI | 5824519 | 5825439 | − | ID = TGME49_216875; length = 920 | 3617 |
| TGME49_chrIa | 289525 | 291377 | − | ID = TGME49_293370; length = 1852 | 3618 |
| TGME49_chrVIIb | 340984 | 345618 | + | ID = TGME49_263740; length = 4634 | 3619 |
| TGME49_chrVI | 3334624 | 3336932 | − | ID = TGME49_244515; length = 2308 | 3620 |
| TGME49_chrVIII | 6462178 | 6464044 | + | ID = TGME49_268390; length = 1866 | 3621 |
| TGME49_chrII | 1825535 | 1830439 | − | ID = TGME49_297495; length = 4904 | 3622 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVI | 151812 | 155358 | + | ID = TGME49_238250; length = 3546 | 3623 |
| TGME49_chrX | 4153234 | 4155867 | + | ID = TGME49_211870; length = 2633 | 3624 |
| TGME49_chrVIIa | 3118368 | 3121954 | − | ID = TGME49_202660; length = 3586 | 3625 |
| TGME49_chrXII | 3689537 | 3692256 | − | ID = TGME49_248140; length = 2719 | 3626 |
| TGME49_chrXI | 3279967 | 3283134 | − | ID = TGME49_313330; length = 3167 | 3627 |
| TGME49_chrVIII | 3960669 | 3963072 | − | ID = TGME49_272460; length = 2403 | 3628 |
| TGME49_chrX | 5463469 | 5465206 | − | ID = TGME49_236635; length = 1737 | 3629 |
| TGME49_chrV | 1402650 | 1404500 | + | ID = TGME49_213890; length = 1850 | 3630 |
| TGME49_chrX | 4153234 | 4155275 | + | ID = TGME49_211880; length = 2041 | 3631 |
| TGME49_chrX | 1266993 | 1269615 | + | ID = TGME49_226880; length = 2622 | 3632 |
| TGME49_chrIX | 1528778 | 1530786 | + | ID = TGME49_265480; length = 2008 | 3633 |
| TGME49_chrIX | 1745845 | 1747343 | − | ID = TGME49_265150; length = 1498 | 3634 |
| TGME49_chrVI | 884386 | 888183 | − | ID = TGME49_239740; length = 3797 | 3635 |
| TGME49_chrXI | 5317194 | 5320938 | + | ID = TGME49_316460; length = 3744 | 3636 |
| TGME49_chrVIIb | 776365 | 780112 | + | ID = TGME49_263130; length = 3747 | 3637 |
| TGME49_chrXI | 6442825 | 6444555 | − | ID = TGME49_216050; length = 1730 | 3638 |
| TGME49_chrX | 2318525 | 2320515 | + | ID = TGME49_225310; length = 1990 | 3639 |
| TGME49_chrVIII | 4296304 | 4298540 | − | ID = TGME49_271892; length = 2236 | 3640 |
| TGME49_chrVIII | 3611438 | 3613139 | + | ID = TGME49_273280; length = 1701 | 3641 |
| TGME49_chrV | 2172830 | 2174806 | + | ID = TGME49_285840; length = 1976 | 3642 |
| TGME49_chrIa | 271448 | 273727 | − | ID = TGME49_293340; length = 2279 | 3643 |
| TGME49_chrVIIb | 2660463 | 2662578 | + | ID = TGME49_259850; length = 2115 | 3644 |
| TGME49_chrVIIb | 2924755 | 2925875 | − | ID = TGME49_259168; length = 1120 | 3645 |
| TGME49_chrXII | 6094335 | 6096858 | + | ID = TGME49_278440; length = 2523 | 3646 |
| TGME49_chrIX | 5146130 | 5146913 | − | ID = TGME49_304980; length = 783 | 3647 |
| TGME49_chrXI | 3600688 | 3604400 | − | ID = TGME49_313673; length = 3712 | 3648 |
| TGME49_chrVIIb | 1802206 | 1804702 | − | ID = TGME49_261260; length = 2496 | 3649 |
| TGME49_chrXI | 6116659 | 6118655 | − | ID = TGME49_216500; length = 1996 | 3650 |
| TGME49_chrXII | 1854971 | 1859523 | + | ID = TGME49_217470; length = 4552 | 3651 |
| TGME49_chrX | 293996 | 296317 | − | ID = TGME49_228490; length = 2321 | 3652 |
| TGME49_chrIX | 5318345 | 5320794 | + | ID = TGME49_305260; length = 2449 | 3653 |
| TGME49_chrVI | 2399019 | 2400763 | + | ID = TGME49_242900; length = 1744 | 3654 |
| TGME49_chrVIIa | 1642474 | 1645461 | − | ID = TGME49_205080; length = 2987 | 3655 |
| TGME49_chrVIII | 6123971 | 6127883 | − | ID = TGME49_269035; length = 3912 | 3656 |
| TGME49_chrV | 2543184 | 2545309 | − | ID = TGME49_285200; length = 2125 | 3657 |
| TGME49_chrXII | 4492697 | 4496623 | + | ID = TGME49_249365; length = 3926 | 3658 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVI | 303372 | 308255 | + | ID = TGME49_238915; length = 4883 | 3659 |
| TGME49_chrII | 179710 | 182938 | + | ID = TGME49_221260; length = 3228 | 3660 |
| TGME49_chrXII | 4294888 | 4296930 | − | ID = TGME49_249000; length = 2042 | 3661 |
| TGME49_chrIX | 3505245 | 3508638 | − | ID = TGME49_289880; length = 3393 | 3662 |
| TGME49_chrVIIb | 2869299 | 2871159 | + | ID = TGME49_259210; length = 1860 | 3663 |
| TGME49_chrVIIa | 3777648 | 3779712 | + | ID = TGME49_201800; length = 2064 | 3664 |
| TGME49_chrXI | 3072074 | 3074339 | − | ID = TGME49_313055; length = 2265 | 3665 |
| TGME49_chrVIIa | 4157220 | 4159151 | − | ID = TGME49_281500; length = 1931 | 3666 |
| TGME49_chrVIIb | 57559 | 61364 | − | ID = TGME49_264225; length = 3805 | 3667 |
| TGME49_chrXI | 1876735 | 1880862 | + | ID = TGME49_311230; length = 4127 | 3668 |
| TGME49_chrVIIb | 4440597 | 4442145 | + | ID = TGME49_256810; length = 1548 | 3669 |
| TGME49_chrVIIa | 3072309 | 3074641 | + | ID = TGME49_202730; length = 2332 | 3670 |
| TGME49_chrVIII | 295302 | 299523 | − | ID = TGME49_229480; length = 4221 | 3671 |
| TGME49_chrXI | 3700842 | 3703550 | − | ID = TGME49_313800; length = 2708 | 3672 |
| TGME49_chrIb | 783599 | 787408 | − | ID = TGME49_208560; length = 3809 | 3673 |
| TGME49_chrVIII | 6337954 | 6339540 | + | ID = TGME49_268730; length = 1586 | 3674 |
| TGME49_chrXI | 2630045 | 2632405 | + | ID = TGME49_312360; length = 2360 | 3675 |
| TGME49_chrIX | 1235277 | 1239596 | − | ID = TGME49_266300; length = 4319 | 3676 |
| TGME49_chrIX | 894353 | 898324 | + | ID = TGME49_266920; length = 3971 | 3677 |
| TGME49_chrVIII | 4158964 | 4160790 | + | ID = TGME49_272180; length = 1826 | 3678 |
| TGME49_chrX | 2443820 | 2448305 | + | ID = TGME49_225150; length = 4485 | 3679 |
| TGME49_chrIa | 236822 | 238568 | + | ID = TGME49_293290; length = 1746 | 3680 |
| TGME49_chrIX | 5825997 | 5827653 | + | ID = TGME49_306200; length = 1656 | 3681 |
| TGME49_chrIX | 2354796 | 2356195 | − | ID = TGME49_288050; length = 1399 | 3682 |
| TGME49_chrVIII | 3128353 | 3129861 | − | ID = TGME49_273995; length = 1508 | 3683 |
| TGME49_chrVIIb | 282534 | 283983 | + | ID = TGME49_263860; length = 1449 | 3684 |
| TGME49_chrV | 1285449 | 1287602 | − | ID = TGME49_213748; length = 2153 | 3685 |
| TGME49_chrIX | 4127078 | 4130241 | + | ID = TGME49_291120; length = 3163 | 3686 |
| TGME49_chrVIII | 2747263 | 2749263 | + | ID = TGME49_233720; length = 2000 | 3687 |
| TGME49_chrXII | 3414639 | 3417680 | − | ID = TGME49_247550; length = 3041 | 3688 |
| TGME49_chrX | 6010344 | 6014213 | + | ID = TGME49_214080; length = 3869 | 3689 |
| TGME49_chrXI | 763150 | 767129 | + | ID = TGME49_309720; length = 3979 | 3690 |
| TGME49_chrVI | 118877 | 121839 | + | ID = TGME49_238200; length = 2962 | 3691 |
| TGME49_chrXI | 829867 | 831550 | − | ID = TGME49_309810; length = 1683 | 3692 |
| TGME49_chrVI | 2360228 | 2365079 | − | ID = TGME49_242860; length = 4851 | 3693 |
| TGME49_chrX | 3978545 | 3981345 | + | ID = TGME49_212200; length = 2800 | 3694 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 6852419 | 6855685 | − | ID = TGME49_276920; length = 3266 | 3695 |
| TGME49_chrVIIb | 4943943 | 4948498 | + | ID = TGME49_255260; length = 4555 | 3696 |
| TGME49_chrXII | 4707577 | 4709680 | + | ID = TGME49_249650; length = 2103 | 3697 |
| TGME49_chrVIIb | 4709972 | 4711447 | − | ID = TGME49_255710; length = 1475 | 3698 |
| TGME49_chrIX | 2083440 | 2086073 | − | ID = TGME49_264740; length = 2633 | 3699 |
| TGME49_chrV | 2850906 | 2853929 | − | ID = TGME49_284040; length = 3023 | 3700 |
| TGME49_chrX | 5951513 | 5954484 | − | ID = TGME49_237520; length = 2971 | 3701 |
| TGME49_chrVIII | 5113899 | 5115543 | + | ID = TGME49_270630; length = 1644 | 3702 |
| TGME49_chrIb | 781751 | 786180 | + | ID = TGME49_208570; length = 4429 | 3703 |
| TGME49_chrX | 2377395 | 2379215 | + | ID = TGME49_225240; length = 1820 | 3704 |
| TGME49_chrX | 3134556 | 3137082 | + | ID = TGME49_224275; length = 2526 | 3705 |
| TGME49_chrV | 1005836 | 1007767 | + | ID = TGME49_213410; length = 1931 | 3706 |
| TGME49_chrXI | 3469048 | 3470899 | − | ID = TGME49_313540; length = 1851 | 3707 |
| TGME49_chrVIII | 1049473 | 1053414 | − | ID = TGME49_230830; length = 3941 | 3708 |
| TGME49_chrVI | 3300769 | 3304052 | − | ID = TGME49_244470; length = 3283 | 3709 |
| TGME49_chrXI | 793193 | 797745 | − | ID = TGME49_309760; length = 4552 | 3710 |
| TGME49_chrXII | 736911 | 739042 | − | ID = TGME49_219682; length = 2131 | 3711 |
| TGME49_chrV | 1764292 | 1768196 | + | ID = TGME49_286595; length = 3904 | 3712 |
| TGME49_chrVI | 2678544 | 2680887 | + | ID = TGME49_243500; length = 2343 | 3713 |
| TGME49_chrVI | 2944414 | 2946280 | + | ID = TGME49_244000; length = 1866 | 3714 |
| TGME49_chrVI | 3253287 | 3255288 | + | ID = TGME49_244430; length = 2001 | 3715 |
| TGME49_chrX | 6205595 | 6210365 | + | ID = TGME49_214280; length = 4770 | 3716 |
| TGME49_chrIX | 4037286 | 4041660 | − | ID = TGME49_291005; length = 4374 | 3717 |
| TGME49_chrIX | 4585284 | 4586943 | − | ID = TGME49_292160; length = 1659 | 3718 |
| TGME49_chrIa | 1088361 | 1093316 | + | ID = TGME49_294720; length = 4955 | 3719 |
| TGME49_chrVIII | 2805898 | 2808434 | + | ID = TGME49_233810; length = 2536 | 3720 |
| TGME49_chrV | 860119 | 861470 | + | ID = TGME49_213115; length = 1351 | 3721 |
| TGME49_chrIa | 1560221 | 1563486 | + | ID = TGME49_295720; length = 3265 | 3722 |
| TGME49_chrIV | 2667136 | 2669610 | + | ID = TGME49_317720; length = 2474 | 3723 |
| TGME49_chrVI | 1655341 | 1658987 | + | ID = TGME49_241155; length = 3646 | 3724 |
| TGME49_chrVIIb | 430148 | 433668 | − | ID = TGME49_263630; length = 3520 | 3725 |
| TGME49_chrIX | 4677697 | 4679657 | − | ID = TGME49_292300; length = 1960 | 3726 |
| TGME49_chrX | 3531731 | 3534835 | + | ID = TGME49_223845; length = 3104 | 3727 |
| TGME49_chrX | 6552144 | 6552859 | + | ID = TGME49_214860; length = 715 | 3728 |
| TGME49_chrVIII | 1928635 | 1933235 | + | ID = TGME49_232190; length = 4600 | 3729 |
| TGME49_chrVIIb | 4963848 | 4965565 | + | ID = TGME49_255245; length = 1717 | 3730 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 2272267 | 2276540 | − | ID = TGME49_311765; length = 4273 | 3731 |
| TGME49_chrXI | 3206386 | 3210859 | − | ID = TGME49_313235; length = 4473 | 3732 |
| TGME49_chrVIII | 1149159 | 1152853 | + | ID = TGME49_230970; length = 3694 | 3733 |
| TGME49_chrII | 447679 | 452475 | − | ID = TGME49_221570; length = 4796 | 3734 |
| TGME49_chrXII | 386080 | 388449 | − | ID = TGME49_307760; length = 2369 | 3735 |
| TGME49_chrVIII | 676375 | 678638 | + | ID = TGME49_230200; length = 2263 | 3736 |
| TGME49_chrXII | 3180527 | 3182528 | − | ID = TGME49_247220; length = 2001 | 3737 |
| TGME49_chrVIII | 5945676 | 5950322 | + | ID = TGME49_269270; length = 4646 | 3738 |
| TGME49_chrVIII | 451670 | 454022 | + | ID = TGME49_229900; length = 2352 | 3739 |
| TGME49_chrXII | 2632703 | 2633950 | + | ID = TGME49_246060; length = 1247 | 3740 |
| TGME49_chrXI | 2930147 | 2932129 | − | ID = TGME49_312820; length = 1982 | 3741 |
| TGME49_chrIX | 4590678 | 4593804 | + | ID = TGME49_292180; length = 3126 | 3742 |
| TGME49_chrV | 2650784 | 2654467 | − | ID = TGME49_284630; length = 3683 | 3743 |
| TGME49_chrX | 2024148 | 2027899 | + | ID = TGME49_225810; length = 3751 | 3744 |
| TGME49_chrVIIa | 4226184 | 4229009 | + | ID = TGME49_281630; length = 2825 | 3745 |
| TGME49_chrXII | 4960618 | 4964965 | − | ID = TGME49_249960; length = 4347 | 3746 |
| TGME49_chrXII | 1134635 | 1136707 | − | ID = TGME49_219100; length = 2072 | 3747 |
| TGME49_chrVIII | 684588 | 686890 | − | ID = TGME49_230205; length = 2302 | 3748 |
| TGME49_chrIV | 1209441 | 1210630 | − | ID = TGME49_318590; length = 1189 | 3749 |
| TGME49_chrVI | 2692449 | 2693266 | + | ID = TGME49_243520; length = 817 | 3750 |
| TGME49_chrV | 1838282 | 1841112 | − | ID = TGME49_286420; length = 2830 | 3751 |
| TGME49_chrVIII | 920039 | 922135 | − | ID = TGME49_230610; length = 2096 | 3752 |
| TGME49_chrX | 2698033 | 2701877 | − | ID = TGME49_224905; length = 3844 | 3753 |
| TGME49_chrXI | 2114575 | 2119619 | + | ID = TGME49_311485; length = 5044 | 3754 |
| TGME49_chrXII | 1401285 | 1403127 | + | ID = TGME49_218580; length = 1842 | 3755 |
| TGME49_chrVIIb | 4874138 | 4879043 | − | ID = TGME49_255370; length = 4905 | 3756 |
| TGME49_chrVIII | 4334110 | 4336235 | − | ID = TGME49_271860; length = 2125 | 3757 |
| TGME49_chrVIII | 1955865 | 1958248 | + | ID = TGME49_232220; length = 2383 | 3758 |
| TGME49_chrVIIa | 4058231 | 4061062 | + | ID = TGME49_281400; length = 2831 | 3759 |
| TGME49_chrXII | 5605748 | 5608371 | − | ID = TGME49_251830; length = 2623 | 3760 |
| TGME49_chrX | 7145189 | 7146960 | + | ID = TGME49_215750; length = 1771 | 3761 |
| TGME49_chrIX | 5304271 | 5305970 | − | ID = TGME49_305230; length = 1699 | 3762 |
| TGME49_chrIb | 1709895 | 1713439 | + | ID = TGME49_321600; length = 3544 | 3763 |
| TGME49_chrXII | 5667819 | 5669852 | − | ID = TGME49_251920; length = 2033 | 3764 |
| TGME49_chrXI | 1032945 | 1037980 | − | ID = TGME49_310050; length = 5035 | 3765 |
| TGME49_chrXI | 5106537 | 5108324 | − | ID = TGME49_315958; length = 1787 | 3766 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIb | 1117766 | 1121043 | − | ID = TGME49_262630; length = 3277 | 3767 |
| TGME49_chrIb | 772266 | 774883 | + | ID = TGME49_208550; length = 2617 | 3768 |
| TGME49_chrIb | 627070 | 629071 | − | ID = TGME49_208350; length = 2001 | 3769 |
| TGME49_chrX | 6319660 | 6321243 | + | ID = TGME49_214500; length = 1583 | 3770 |
| TGME49_chrVIIb | 2192639 | 2196472 | − | ID = TGME49_260520; length = 3833 | 3771 |
| TGME49_chrVI | 898593 | 901403 | − | ID = TGME49_239755; length = 2810 | 3772 |
| TGME49_chrXI | 4168642 | 4173147 | + | ID = TGME49_314530; length = 4505 | 3773 |
| TGME49_chrIa | 111718 | 114297 | − | ID = TGME49_293050; length = 2579 | 3774 |
| TGME49_chrXII | 2783691 | 2785982 | − | ID = TGME49_246450; length = 2291 | 3775 |
| TGME49_chrXI | 1288133 | 1292845 | − | ID = TGME49_310350; length = 4712 | 3776 |
| TGME49_chrXII | 162730 | 165254 | − | ID = TGME49_300200; length = 2524 | 3777 |
| TGME49_chrIX | 3575960 | 3579143 | − | ID = TGME49_290000; length = 3183 | 3778 |
| TGME49_chrXII | 3356485 | 3359532 | + | ID = TGME49_247470; length = 3047 | 3779 |
| TGME49_chrVIII | 2112448 | 2113740 | + | ID = TGME49_232460; length = 1292 | 3780 |
| TGME49_chrVIIa | 3520331 | 3522747 | − | ID = TGME49_202210; length = 2416 | 3781 |
| TGME49_chrVIIb | 1807507 | 1811746 | − | ID = TGME49_261250; length = 4239 | 3782 |
| TGME49_chrVIIb | 1326486 | 1331064 | − | ID = TGME49_262170; length = 4578 | 3783 |
| TGME49_chrXII | 4742982 | 4745450 | + | ID = TGME49_249702; length = 2468 | 3784 |
| TGME49_chrV | 2699767 | 2701801 | + | ID = TGME49_284580; length = 2034 | 3785 |
| TGME49_chrXI | 2716805 | 2718646 | + | ID = TGME49_312480; length = 1841 | 3786 |
| TGME49_chrIX | 772823 | 775776 | − | ID = TGME49_267110; length = 2953 | 3787 |
| TGME49_chrVI | 1683551 | 1687309 | + | ID = TGME49_241240; length = 3758 | 3788 |
| TGME49_chrIV | 1708862 | 1710770 | + | ID = TGME49_211440; length = 1908 | 3789 |
| TGME49_chrVIIb | 2348892 | 2350447 | + | ID = TGME49_260325; length = 1555 | 3790 |
| TGME49_chrX | 1012359 | 1015635 | + | ID = TGME49_227335; length = 3276 | 3791 |
| TGME49_chrX | 6603260 | 6606386 | − | ID = TGME49_214930; length = 3126 | 3792 |
| TGME49_chrVIII | 434978 | 437027 | + | ID = TGME49_229780; length = 2049 | 3793 |
| TGME49_chrVIII | 1536361 | 1538858 | − | ID = TGME49_231780; length = 2497 | 3794 |
| TGME49_chrVI | 890233 | 892412 | + | ID = TGME49_239752; length = 2179 | 3795 |
| TGME49_chrX | 775064 | 778810 | + | ID = TGME49_227840; length = 3746 | 3796 |
| TGME49_chrVIII | 5128576 | 5133324 | − | ID = TGME49_270620; length = 4748 | 3797 |
| TGME49_chrV | 1696352 | 1699779 | + | ID = TGME49_286740; length = 3427 | 3798 |
| TGME49_chrIX | 4570167 | 4571563 | − | ID = TGME49_292130; length = 1396 | 3799 |
| TGME49_chrIb | 1506997 | 1508664 | − | ID = TGME49_209870; length = 1667 | 3800 |
| TGME49_chrXI | 5888682 | 5890417 | − | ID = TGME49_216785; length = 1735 | 3801 |
| TGME49_chrXI | 216523 | 219848 | + | ID = TGME49_306870; length = 3325 | 3802 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrVIIa | 3745951 | 3750483 | − | ID = TGME49_201850; length = 4532 | 3803 |
| TGME49_chrXII | 5911846 | 5916676 | − | ID = TGME49_278740; length = 4830 | 3804 |
| TGME49_chrVIIb | 3025423 | 3026890 | − | ID = TGME49_259020; length = 1467 | 3805 |
| TGME49_chrXI | 1475654 | 1480111 | − | ID = TGME49_310610; length = 4457 | 3806 |
| TGME49_chrXII | 5760821 | 5764702 | + | ID = TGME49_278910; length = 3881 | 3807 |
| TGME49_chrIX | 5163063 | 5165571 | − | ID = TGME49_305010; length = 2508 | 3808 |
| TGME49_chrIa | 808274 | 811964 | + | ID = TGME49_294340; length = 3690 | 3809 |
| TGME49_chrXII | 425609 | 430368 | − | ID = TGME49_307810; length = 4759 | 3810 |
| TGME49_chrIX | 189607 | 191648 | − | ID = TGME49_279430; length = 2041 | 3811 |
| TGME49_chrXII | 6699406 | 6704060 | − | ID = TGME49_277240; length = 4654 | 3812 |
| TGME49_chrX | 3862116 | 3866423 | + | ID = TGME49_223390; length = 4307 | 3813 |
| TGME49_chrIb | 163682 | 165355 | − | ID = TGME49_207620; length = 1673 | 3814 |
| TGME49_chrVIIb | 628606 | 632828 | − | ID = TGME49_263330; length = 4222 | 3815 |
| TGME49_chrVIII | 4276676 | 4280983 | − | ID = TGME49_271935; length = 4307 | 3816 |
| TGME49_chrV | 1151826 | 1153503 | + | ID = TGME49_213580; length = 1677 | 3817 |
| TGME49_chrIX | 3597344 | 3600415 | − | ID = TGME49_290030; length = 3071 | 3818 |
| TGME49_chrVIIa | 1207940 | 1209729 | + | ID = TGME49_205700; length = 1789 | 3819 |
| TGME49_chrXII | 1716091 | 1718180 | − | ID = TGME49_218192; length = 2089 | 3820 |
| TGME49_chrVI | 1072208 | 1074913 | + | ID = TGME49_240220; length = 2705 | 3821 |
| TGME49_chrIX | 3344898 | 3346813 | + | ID = TGME49_289615; length = 1915 | 3822 |
| TGME49_chrXII | 193234 | 197614 | − | ID = TGME49_300130; length = 4380 | 3823 |
| TGME49_chrIX | 5678742 | 5680658 | − | ID = TGME49_305930; length = 1916 | 3824 |
| TGME49_chrIa | 511367 | 514250 | + | ID = TGME49_293700; length = 2883 | 3825 |
| TGME49_chrXI | 3234644 | 3236534 | + | ID = TGME49_313280; length = 1890 | 3826 |
| TGME49_chrIa | 1342885 | 1345816 | − | ID = TGME49_295035; length = 2931 | 3827 |
| TGME49_chrIX | 476754 | 479709 | + | ID = TGME49_267660; length = 2955 | 3828 |
| TGME49_chrXII | 5454860 | 5457281 | − | ID = TGME49_251550; length = 2421 | 3829 |
| TGME49_chrX | 6552144 | 6556896 | + | ID = TGME49_214870; length = 4752 | 3830 |
| TGME49_chrVIIa | 3180348 | 3184059 | + | ID = TGME49_202590; length = 3711 | 3831 |
| TGME49_chrIX | 5280883 | 5283665 | − | ID = TGME49_305190; length = 2782 | 3832 |
| TGME49_chrX | 3701807 | 3706821 | − | ID = TGME49_223610; length = 5014 | 3833 |
| TGME49_chrVIII | 4742918 | 4744434 | − | ID = TGME49_271070; length = 1516 | 3834 |
| TGME49_chrX | 6329257 | 6330831 | − | ID = TGME49_214510; length = 1574 | 3835 |
| TGME49_chrVIIb | 4135277 | 4137872 | + | ID = TGME49_257300; length = 2595 | 3836 |
| TGME49_chrVIIb | 3296604 | 3298791 | − | ID = TGME49_258630; length = 2187 | 3837 |
| TGME49_chrVIII | 2597579 | 2599382 | − | ID = TGME49_233330; length = 1803 | 3838 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 551024 | 552313 | + | ID = TGME49_228140; length = 1289 | 3839 |
| TGME49_chrIX | 4614733 | 4617149 | + | ID = TGME49_292220; length = 2416 | 3840 |
| TGME49_chrIV | 110065 | 114937 | + | ID = TGME49_320720; length = 4872 | 3841 |
| TGME49_chrIX | 3383102 | 3384808 | − | ID = TGME49_289690; length = 1706 | 3842 |
| TGME49_chrXI | 3166849 | 3168996 | + | ID = TGME49_313200; length = 2147 | 3843 |
| TGME49_chrVIII | 1658293 | 1660173 | + | ID = TGME49_231940; length = 1880 | 3844 |
| TGME49_chrXI | 749160 | 751293 | + | ID = TGME49_309600; length = 2133 | 3845 |
| TGME49_chrX | 5340571 | 5342425 | − | ID = TGME49_236220; length = 1854 | 3846 |
| TGME49_chrIX | 4109881 | 4114158 | − | ID = TGME49_291080; length = 4277 | 3847 |
| TGME49_chrVIIb | 579048 | 580735 | − | ID = TGME49_263410; length = 1687 | 3848 |
| TGME49_chrIb | 1354758 | 1356812 | − | ID = TGME49_209585; length = 2054 | 3849 |
| TGME49_chrII | 114763 | 116965 | − | ID = TGME49_221180; length = 2202 | 3850 |
| TGME49_chrX | 7457352 | 7459980 | + | ID = TGME49_207240; length = 2628 | 3851 |
| TGME49_chrXI | 3622165 | 3624128 | + | ID = TGME49_313700; length = 1963 | 3852 |
| TGME49_chrXI | 4594911 | 4596494 | + | ID = TGME49_315240; length = 1583 | 3853 |
| TGME49_chrVIIa | 3667870 | 3670309 | − | ID = TGME49_202050; length = 2439 | 3854 |
| TGME49_chrVIII | 3750977 | 3753691 | − | ID = TGME49_272760; length = 2714 | 3855 |
| TGME49_chrV | 2731928 | 2734972 | − | ID = TGME49_284540; length = 3044 | 3856 |
| TGME49_chrIX | 5312955 | 5315417 | + | ID = TGME49_305250; length = 2462 | 3857 |
| TGME49_chrVIII | 1242184 | 1246962 | + | ID = TGME49_231120; length = 4778 | 3858 |
| TGME49_chrII | 1270561 | 1272652 | + | ID = TGME49_222870; length = 2091 | 3859 |
| TGME49_chrIa | 1394581 | 1398592 | + | ID = TGME49_295100; length = 4011 | 3860 |
| TGME49_chrII | 695109 | 697038 | + | ID = TGME49_221922; length = 1929 | 3861 |
| TGME49_chrIV | 231725 | 234333 | + | ID = TGME49_320588; length = 2608 | 3862 |
| TGME49_chrXII | 473177 | 474441 | + | ID = TGME49_307980; length = 1264 | 3863 |
| TGME49_chrVIIb | 3849337 | 3852143 | + | ID = TGME49_257755; length = 2806 | 3864 |
| TGME49_chrVIIa | 1664628 | 1666761 | − | ID = TGME49_205040; length = 2133 | 3865 |
| TGME49_chrVIIb | 3685950 | 3689788 | + | ID = TGME49_257970; length = 3838 | 3866 |
| TGME49_chrX | 1921524 | 1925824 | + | ID = TGME49_225930; length = 4300 | 3867 |
| TGME49_chrX | 7302683 | 7304952 | − | ID = TGME49_275480; length = 2269 | 3868 |
| TGME49_chrIX | 2710220 | 2712817 | + | ID = TGME49_288730; length = 2597 | 3869 |
| TGME49_chrVIIb | 3551916 | 3554846 | − | ID = TGME49_258150; length = 2930 | 3870 |
| TGME49_chrXII | 3395404 | 3397801 | − | ID = TGME49_247530; length = 2397 | 3871 |
| TGME49_chrXII | 2036318 | 2041237 | − | ID = TGME49_217710; length = 4919 | 3872 |
| TGME49_chrVIII | 6601085 | 6602909 | − | ID = TGME49_268260; length = 1824 | 3873 |
| TGME49_chrVIIb | 2477511 | 2479458 | − | ID = TGME49_260180; length = 1947 | 3874 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXII | 847627 | 848796 | + | ID = TGME49_219580; length = 1169 | 3875 |
| TGME49_chrXI | 5245329 | 5247973 | + | ID = TGME49_316340; length = 2644 | 3876 |
| TGME49_chrVIII | 1595952 | 1597448 | − | ID = TGME49_231865; length = 1496 | 3877 |
| TGME49_chrX | 4882399 | 4885373 | − | ID = TGME49_235460; length = 2974 | 3878 |
| TGME49_chrXII | 1510400 | 1513768 | + | ID = TGME49_218470; length = 3368 | 3879 |
| TGME49_chrXII | 1275377 | 1278904 | + | ID = TGME49_218820; length = 3527 | 3880 |
| TGME49_chrIX | 4321869 | 4323613 | − | ID = TGME49_291670; length = 1744 | 3881 |
| TGME49_chrIX | 1600603 | 1603702 | + | ID = TGME49_265370; length = 3099 | 3882 |
| TGME49_chrXII | 2166215 | 2167918 | − | ID = TGME49_217830; length = 1703 | 3883 |
| TGME49_chrIV | 1694292 | 1697186 | + | ID = TGME49_211460; length = 2894 | 3884 |
| TGME49_chrX | 6884604 | 6886087 | + | ID = TGME49_215300; length = 1483 | 3885 |
| TGME49_chrXI | 4030644 | 4031150 | − | ID = TGME49_314350; length = 506 | 3886 |
| TGME49_chrXI | 5713685 | 5715292 | − | ID = TGME49_217030; length = 1607 | 3887 |
| TGME49_chrVIIa | 3187548 | 3190806 | + | ID = TGME49_202580; length = 3258 | 3888 |
| TGME49_chrIX | 1479516 | 1483804 | + | ID = TGME49_265650; length = 4288 | 3889 |
| TGME49_chrXII | 1108042 | 1109700 | + | ID = TGME49_219140; length = 1658 | 3890 |
| TGME49_chrIa | 144640 | 149293 | − | ID = TGME49_293180; length = 4653 | 3891 |
| TGME49_chrVIIa | 3402771 | 3404549 | + | ID = TGME49_202350; length = 1778 | 3892 |
| TGME49_chrV | 1107121 | 1109027 | + | ID = TGME49_213500; length = 1906 | 3893 |
| TGME49_chrV | 1652865 | 1655496 | + | ID = TGME49_286800; length = 2631 | 3894 |
| TGME49_chrX | 6732035 | 6733904 | − | ID = TGME49_215070; length = 1869 | 3895 |
| TGME49_chrVIII | 3331943 | 3336912 | + | ID = TGME49_273650; length = 4969 | 3896 |
| TGME49_chrXII | 6757204 | 6757912 | − | ID = TGME49_277055; length = 708 | 3897 |
| TGME49_chrXI | 4086745 | 4089078 | − | ID = TGME49_314415; length = 2333 | 3898 |
| TGME49_chrVIIb | 228036 | 231382 | + | ID = TGME49_264020; length = 3346 | 3899 |
| TGME49_chrVIIa | 4227427 | 4230194 | − | ID = TGME49_281620; length = 2767 | 3900 |
| TGME49_chrV | 1874807 | 1879170 | + | ID = TGME49_286260; length = 4363 | 3901 |
| TGME49_chrVI | 3027874 | 3029432 | + | ID = TGME49_244110; length = 1558 | 3902 |
| TGME49_chrIV | 1709601 | 1711557 | − | ID = TGME49_211450; length = 1956 | 3903 |
| TGME49_chrXII | 2220861 | 2225036 | + | ID = TGME49_217915; length = 4175 | 3904 |
| TGME49_chrXI | 828620 | 830503 | + | ID = TGME49_309820; length = 1883 | 3905 |
| TGME49_chrVIII | 5192539 | 5195213 | + | ID = TGME49_270550; length = 2674 | 3906 |
| TGME49_chrX | 6927629 | 6929143 | + | ID = TGME49_215370; length = 1514 | 3907 |
| TGME49_chrXI | 5224384 | 5226744 | + | ID = TGME49_316300; length = 2360 | 3908 |
| TGME49_chrVI | 2959203 | 2963259 | − | ID = TGME49_244010; length = 4056 | 3909 |
| TGME49_chrXI | 5774652 | 5776514 | + | ID = TGME49_216950; length = 1862 | 3910 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIa | 1804411 | 1808455 | + | ID = TGME49_295360; length = 4044 | 3911 |
| TGME49_chrVI | 1021188 | 1023814 | + | ID = TGME49_240050; length = 2626 | 3912 |
| TGME49_chrIa | 184672 | 186967 | + | ID = TGME49_293240; length = 2295 | 3913 |
| TGME49_chrVIIb | 1578553 | 1580579 | − | ID = TGME49_261690; length = 2026 | 3914 |
| TGME49_chrXI | 1557851 | 1562530 | + | ID = TGME49_310740; length = 4679 | 3915 |
| TGME49_chrX | 3314815 | 3319616 | − | ID = TGME49_224130; length = 4801 | 3916 |
| TGME49_chrXII | 4563657 | 4568429 | + | ID = TGME49_249480; length = 4772 | 3917 |
| TGME49_chrIb | 1032466 | 1034841 | + | ID = TGME49_209090; length = 2375 | 3918 |
| TGME49_chrVI | 2534155 | 2537835 | − | ID = TGME49_243298; length = 3680 | 3919 |
| TGME49_chrX | 3597511 | 3600273 | + | ID = TGME49_223770; length = 2762 | 3920 |
| TGME49_chrXII | 2678206 | 2682410 | − | ID = TGME49_246120; length = 4204 | 3921 |
| TGME49_chrIX | 4818578 | 4819481 | − | ID = TGME49_210400; length = 903 | 3922 |
| TGME49_chrXI | 2316523 | 2321340 | − | ID = TGME49_311840; length = 4817 | 3923 |
| TGME49_chrIV | 2420083 | 2421297 | − | ID = TGME49_301370; length = 1214 | 3924 |
| TGME49_chrIV | 1822182 | 1826088 | − | ID = TGME49_211340; length = 3906 | 3925 |
| TGME49_chrXII | 3764475 | 3766489 | + | ID = TGME49_248260; length = 2014 | 3926 |
| TGME49_chrVIII | 1207669 | 1210044 | − | ID = TGME49_231030; length = 2375 | 3927 |
| TGME49_chrX | 6868549 | 6871573 | + | ID = TGME49_215280; length = 3024 | 3928 |
| TGME49_chrVIIb | 1643729 | 1645825 | + | ID = TGME49_261590; length = 2096 | 3929 |
| TGME49_chrXI | 1624852 | 1625815 | − | ID = TGME49_310840; length = 963 | 3930 |
| TGME49_chrXII | 269284 | 271834 | − | ID = TGME49_300030; length = 2550 | 3931 |
| TGME49_chrIX | 3914323 | 3919217 | + | ID = TGME49_290890; length = 4894 | 3932 |
| TGME49_chrVIII | 3498835 | 3500944 | − | ID = TGME49_273460; length = 2109 | 3933 |
| TGME49_chrXI | 3267474 | 3271294 | + | ID = TGME49_313322; length = 3820 | 3934 |
| TGME49_chrX | 1135303 | 1139273 | − | ID = TGME49_227020; length = 3970 | 3935 |
| TGME49_chrVIIa | 2000440 | 2005367 | − | ID = TGME49_204100; length = 4927 | 3936 |
| TGME49_chrX | 2136745 | 2141573 | − | ID = TGME49_225590; length = 4828 | 3937 |
| TGME49_chrIa | 497577 | 499864 | + | ID = TGME49_293670; length = 2287 | 3938 |
| TGME49_chrIX | 2730465 | 2732515 | − | ID = TGME49_288770; length = 2050 | 3939 |
| TGME49_chrXI | 6095645 | 6097770 | + | ID = TGME49_216510; length = 2125 | 3940 |
| TGME49_chrVIII | 6110637 | 6114023 | − | ID = TGME49_269050; length = 3386 | 3941 |
| TGME49_chrV | 2296305 | 2301022 | + | ID = TGME49_285660; length = 4717 | 3942 |
| TGME49_chrIb | 1593481 | 1595867 | + | ID = TGME49_209970; length = 2386 | 3943 |
| TGME49_chrVIIb | 917523 | 919993 | − | ID = TGME49_262933; length = 2470 | 3944 |
| TGME49_chrVIIa | 3567094 | 3568251 | − | ID = TGME49_202170; length = 1157 | 3945 |
| TGME49_chrVI | 1302262 | 1303984 | + | ID = TGME49_240520; length = 1722 | 3946 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrXI | 6376445 | 6376951 | + | ID = TGME49_216150; length = 506 | 3947 |
| TGME49_chrIV | 1387512 | 1390320 | − | ID = TGME49_318370; length = 2808 | 3948 |
| TGME49_chrVIII | 1248684 | 1250326 | + | ID = TGME49_231125; length = 1642 | 3949 |
| TGME49_chrIX | 1805400 | 1807228 | − | ID = TGME49_265080; length = 1828 | 3950 |
| TGME49_chrIX | 3677519 | 3678219 | + | ID = TGME49_290280; length = 700 | 3951 |
| TGME49_chrII | 1020449 | 1025166 | − | ID = TGME49_222300; length = 4717 | 3952 |
| TGME49_chrX | 912303 | 916274 | + | ID = TGME49_227560; length = 3971 | 3953 |
| TGME49_chrXI | 5699102 | 5701538 | + | ID = TGME49_217050; length = 2436 | 3954 |
| TGME49_chrIX | 211482 | 214977 | + | ID = TGME49_279380; length = 3495 | 3955 |
| TGME49_chrVIII | 5960219 | 5963166 | − | ID = TGME49_269260; length = 2947 | 3956 |
| TGME49_chrXII | 1341036 | 1345114 | − | ID = TGME49_218740; length = 4078 | 3957 |
| TGME49_chrX | 5989380 | 5991089 | − | ID = TGME49_237560; length = 1709 | 3958 |
| TGME49_chrIV | 481795 | 483580 | + | ID = TGME49_320120; length = 1785 | 3959 |
| TGME49_chrVIII | 3598010 | 3600888 | − | ID = TGME49_273320; length = 2878 | 3960 |
| TGME49_chrIX | 3065937 | 3068225 | − | ID = TGME49_289190; length = 2288 | 3961 |
| TGME49_chrX | 1873929 | 1876445 | + | ID = TGME49_225990; length = 2516 | 3962 |
| TGME49_chrXII | 3889205 | 3891343 | + | ID = TGME49_248500; length = 2138 | 3963 |
| TGME49_chrXII | 3445460 | 3446440 | + | ID = TGME49_247620; length = 980 | 3964 |
| TGME49_chrX | 713964 | 716364 | + | ID = TGME49_227948; length = 2400 | 3965 |
| TGME49_chrX | 7423562 | 7425356 | + | ID = TGME49_207170; length = 1794 | 3966 |
| TGME49_chrV | 1716156 | 1718652 | − | ID = TGME49_286710; length = 2496 | 3967 |
| TGME49_chrV | 1238094 | 1240156 | − | ID = TGME49_213680; length = 2062 | 3968 |
| TGME49_chrIb | 1132036 | 1134997 | + | ID = TGME49_209230; length = 2961 | 3969 |
| TGME49_chrX | 5892850 | 5895594 | − | ID = TGME49_237460; length = 2744 | 3970 |
| TGME49_chrIX | 1635792 | 1638798 | − | ID = TGME49_265280; length = 3006 | 3971 |
| TGME49_chrII | 2193632 | 2198046 | + | ID = TGME49_298020; length = 4414 | 3972 |
| TGME49_chrVIIb | 4584305 | 4588201 | + | ID = TGME49_255970; length = 3896 | 3973 |
| TGME49_chrXII | 4413869 | 4418183 | − | ID = TGME49_249260; length = 4314 | 3974 |
| TGME49_chrXII | 1375295 | 1377205 | − | ID = TGME49_218610; length = 1910 | 3975 |
| TGME49_chrII | 2159735 | 2161907 | − | ID = TGME49_297990; length = 2172 | 3976 |
| TGME49_chrVI | 3390012 | 3392557 | − | ID = TGME49_244600; length = 2545 | 3977 |
| TGME49_chrIX | 2379675 | 2384376 | − | ID = TGME49_288190; length = 4701 | 3978 |
| TGME49_chrIX | 5721253 | 5723275 | + | ID = TGME49_306010; length = 2022 | 3979 |
| TGME49_chrXI | 1588995 | 1592976 | + | ID = TGME49_310790; length = 3981 | 3980 |
| TGME49_chrII | 1526942 | 1530423 | − | ID = TGME49_297090; length = 3481 | 3981 |
| TGME49_chrIV | 212060 | 214189 | + | ID = TGME49_320592; length = 2129 | 3982 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrIX | 302614 | 305702 | − | ID = TGME49_267875; length = 3088 | 3983 |
| TGME49_chrX | 6964191 | 6968709 | − | ID = TGME49_215440; length = 4518 | 3984 |
| TGME49_chrXI | 3138372 | 3140384 | − | ID = TGME49_313140; length = 2012 | 3985 |
| TGME49_chrVIIb | 305794 | 307179 | − | ID = TGME49_263830; length = 1385 | 3986 |
| TGME49_chrXII | 249631 | 253074 | − | ID = TGME49_300048; length = 3443 | 3987 |
| TGME49_chrVIIb | 4653479 | 4655650 | − | ID = TGME49_255890; length = 2171 | 3988 |
| TGME49_chrVIIb | 1873350 | 1875365 | + | ID = TGME49_261075; length = 2015 | 3989 |
| TGME49_chrX | 5306045 | 5308393 | + | ID = TGME49_236158; length = 2348 | 3990 |
| TGME49_chrIa | 780454 | 781800 | + | ID = TGME49_294285; length = 1346 | 3991 |
| TGME49_chrVIIa | 2946359 | 2947823 | + | ID = TGME49_202910; length = 1464 | 3992 |
| TGME49_chrXII | 3857367 | 3862038 | − | ID = TGME49_248445; length = 4671 | 3993 |
| TGME49_chrIb | 1450314 | 1452140 | + | ID = TGME49_209790; length = 1826 | 3994 |
| TGME49_chrXII | 2082658 | 2086018 | + | ID = TGME49_217740; length = 3360 | 3995 |
| TGME49_chrVI | 3028353 | 3030855 | − | ID = TGME49_244100; length = 2502 | 3996 |
| TGME49_chrXI | 2970744 | 2973324 | + | ID = TGME49_312905; length = 2580 | 3997 |
| TGME49_chrIb | 1210143 | 1211342 | − | ID = TGME49_209420; length = 1199 | 3998 |
| TGME49_chrVIII | 225120 | 227610 | + | ID = TGME49_229390; length = 2490 | 3999 |
| TGME49_chrVIII | 2354860 | 2357994 | − | ID = TGME49_233030; length = 3134 | 4000 |
| TGME49_chrVIII | 3259418 | 3261475 | + | ID = TGME49_273790; length = 2057 | 4001 |
| TGME49_chrX | 1752272 | 1756039 | + | ID = TGME49_226260; length = 3767 | 4002 |
| TGME49_chrXI | 5923228 | 5926772 | + | ID = TGME49_216740; length = 3544 | 4003 |
| TGME49_chrVIIb | 4131702 | 4133633 | + | ID = TGME49_257310; length = 1931 | 4004 |
| TGME49_chrVIIa | 1169485 | 1173218 | + | ID = TGME49_205750; length = 3733 | 4005 |
| TGME49_chrVIIb | 255202 | 259201 | − | ID = TGME49_263990; length = 3999 | 4006 |
| TGME49_chrIV | 1230510 | 1233030 | − | ID = TGME49_318560; length = 2520 | 4007 |
| TGME49_chrVIIb | 1618717 | 1621489 | − | ID = TGME49_261650; length = 2772 | 4008 |
| TGME49_chrV | 3151111 | 3154171 | + | ID = TGME49_283450; length = 3060 | 4009 |
| TGME49_chrVIII | 5745993 | 5747995 | + | ID = TGME49_269600; length = 2002 | 4010 |
| TGME49_chrVIIb | 1719667 | 1720796 | − | ID = TGME49_261480; length = 1129 | 4011 |
| TGME49_chrVIIa | 489530 | 490382 | + | ID = TGME49_280375; length = 852 | 4012 |
| TGME49_chrVIII | 3141675 | 3145631 | − | ID = TGME49_273970; length = 3956 | 4013 |
| TGME49_chrXI | 5516873 | 5518970 | + | ID = TGME49_316710; length = 2097 | 4014 |
| TGME49_chrIa | 1508323 | 1512231 | − | ID = TGME49_295850; length = 3908 | 4015 |
| TGME49_chrX | 4338721 | 4343260 | − | ID = TGME49_234400; length = 4539 | 4016 |
| TGME49_chrX | 309061 | 312804 | + | ID = TGME49_228430; length = 3743 | 4017 |
| TGME49_chrIb | 8721 | 12586 | − | ID = TGME49_207365; length = 3865 | 4018 |

TABLE 1-continued

Suitable endogenous promoters

| Chromosome | starting position on chromosome | end position on chromosome | strand | Endogenous promoter of gene name (ID), and length of promoter sequence | SEQ ID NO: |
|---|---|---|---|---|---|
| TGME49_chrX | 6251950 | 6254576 | + | ID = TGME49_214340; length = 2626 | 4019 |
| TGME49_chrVIII | 739200 | 742279 | − | ID = TGME49_230380; length = 3079 | 4020 |
| TGME49_chrX | 1570278 | 1574363 | + | ID = TGME49_226500; length = 4085 | 4021 |
| TGME49_chrX | 681974 | 683378 | + | ID = TGME49_227990; length = 1404 | 4022 |
| TGME49_chrXI | 6467604 | 6468954 | + | ID = TGME49_216010; length = 1350 | 4023 |
| TGME49_chrVIIa | 3933627 | 3938631 | + | ID = TGME49_201250; length = 5004 | 4024 |
| TGME49_chrVIIa | 3007574 | 3010494 | − | ID = TGME49_202830; length = 2920 | 4025 |
| TGME49_chrX | 3256800 | 3258378 | − | ID = TGME49_224200; length = 1578 | 4026 |
| TGME49_chrXI | 4639183 | 4641514 | − | ID = TGME49_315300; length = 2331 | 4027 |
| TGME49_chrVI | 1947456 | 1949773 | + | ID = TGME49_242300; length = 2317 | 4028 |
| TGME49_chrXII | 4726342 | 4728931 | + | ID = TGME49_249680; length = 2589 | 4029 |
| TGME49_chrVIIb | 2488617 | 2490012 | − | ID = TGME49_260170; length = 1395 | 4030 |

Table 1. Provided are non-limiting examples of endogenous promoters which can be used along with the construct(s) of some embodiments of the invention. The predicted promoter sequences were obtained based on histone marks data around the genes.

Table 2 lists suitable constitutive and inducible promoters which can be cloned into the nucleic acid construct of some embodiments of the invention.

TABLE 2 constitutive and inducible promoters

| promoter name | mode | promoter SEQ ID NO: |
|---|---|---|
| 5RT70 | constitutive promoter | 4031 |
| DHFR | constitutive promoter | 4032 |
| MIC2 | constitutive promoter | 4033 |
| MIC8 | constitutive promoter | 4034 |
| SAG1 | constitutive promoter | 4035 |
| TetO7SAG1 | inducible promoter | 4036 |
| TetO7SAG4 | inducible promoter | 4037 |
| TUB1 | constitutive promoter | 4038 |
| TUB8 | constitutive promoter | 4039 |

Table 2.

As mentioned, the heterologous polynucleotide comprising a first nucleic acid sequence encoding a Toxoplasma secreted protein.

As used herein the phrase "Toxoplasma secreted protein" refers to at least a functional fragment (amino acid sequence) of a Toxoplasma polypeptide which is sufficient in order to be secreted to a host cell when infected in-vitro by the Toxoplasma.

According to some embodiments of the invention, the Toxoplasma secreted protein or the functional fragment thereof is capable of being secreted to a host cell when infected in-vivo by the Toxoplasma.

According to some embodiments of the invention, the first nucleic acid sequence encoding a functional fragment of the Toxoplasma secreted protein.

According to some embodiments of the invention, the first nucleic acid sequence encoding the full-length open reading frame (ORF) of the Toxoplasma secreted protein.

According to some embodiments of the invention, the Toxoplasma secreted protein is secreted from a rhoptry of the Toxoplasma.

According to some embodiments of the invention, the Toxoplasma secreted protein which is secreted from the rhoptry comprises Toxofilin and/or ROP1.

According to some embodiments of the invention, the Toxoplasma secreted protein which is secreted from the rhoptry comprises the amino acid sequence selected from the group consisting of SEQ ID NOs:344-465.

According to some embodiments of the invention, the Toxoplasma secreted protein is a non-rhoptry protein.

According to some embodiments of the invention, the Toxoplasma secreted protein is selected from the group consisting of a microneme protein and a dense granule protein.

According to some embodiments of the invention, the Toxoplasma secreted protein is secreted from a dense granule of the Toxoplasma.

According to some embodiments of the invention, the Toxoplasma secreted protein which is secreted from the dense granule comprises a GRA16, and/or GRA24.

According to some embodiments of the invention, the Toxoplasma secreted protein is secreted from a microneme of the Toxoplasma.

According to some embodiments of the invention, the protein secreted from the microneme comprises the amino acid sequence selected from the group consisting of SEQ ID NOs:280-322.

According to some embodiments of the invention, the protein secreted from the dense granule comprises the amino acid sequence selected from the group consisting of SEQ ID NOs:234-279.

According to some embodiments of the invention, the Toxoplasma secreted protein comprises *Toxoplasma gondii* macrophage migration inhibitory factor (TgMIF).

Table 3 below lists Toxoplasma-secreted proteins which can be cloned into the nucleic acid construct of some embodiments of the invention, organized according to the organelle to which the protein is localized or predicted to be localized to.

TABLE 3

Toxoplasma proteins

| Gene ID | Gene Product Description | Organism | organelle | Polyn. SEQ ID | Polyp. SEQ ID |
|---|---|---|---|---|---|
| TGME49_289620 | cathepsin CPC1 (CPC1) | *T. gondii* ME49 | Dense Granules | 1 | 234 |
| TGME49_276130 | cathepsin CPC2 (CPC2) | *T. gondii* ME49 | Dense Granules | 2 | 235 |
| TGME49_268900 | dense granular protein GRA10 (GRA10) | *T. gondii* ME49 | Dense Granules | 3 | 236 |
| TGME49_297880 | dense granule protein DG32 | *T. gondii* ME49 | Dense Granules | 4 | 237 |
| TGME49_270250 | dense granule protein GRA1 (GRA1) | *T. gondii* ME49 | Dense Granules | 5 | 238 |
| TGME49_212410 | dense granule protein GRA11 | *T. gondii* ME49 | Dense Granules | 6 | 239 |
| TGME49_237800 | dense granule protein GRA11 | *T. gondii* ME49 | Dense Granules | 7 | 240 |
| TGME49_275850 | dense granule protein GRA12 (GRA12) | *T. gondii* ME49 | Dense Granules | 8 | 241 |
| TGME49_288650 | dense granule protein GRA12 (GRA12) | *T. gondii* ME49 | Dense Granules | 9 | 242 |
| TGME49_239740 | dense granule protein GRA14 (GRAM) | *T. gondii* ME49 | Dense Granules | 10 | 243 |
| TGME49_275470 | dense granule protein GRAI5 (GRAM) | *T. gondii* ME49 | Dense Granules | 11 | 244 |
| TGME49_227620 | dense granule protein GRA2 (GRA2) | *T. gondii* ME49 | Dense Granules | 12 | 245 |
| TGME49_227280 | dense granule protein GRA3 (GRA3) | *T. gondii* ME49 | Dense Granules | 13 | 246 |
| TGME49_310780 | dense granule protein GRA4 (GRA4) | *T. gondii* ME49 | Dense Granules | 14 | 247 |
| TGME49_286450 | dense granule protein GRA5 (GRA5) | *T. gondii* ME49 | Dense Granules | 15 | 248 |
| TGME49_275440 | dense granule protein GRA6 (GRA6) | *T. gondii* ME49 | Dense Granules | 16 | 249 |
| TGME49_203310 | dense granule protein GRA7 (GRA7) | *T. gondii* ME49 | Dense Granules | 17 | 250 |
| TGME49_254720 | dense granule protein GRA8 (GRA8) | *T. gondii* ME49 | Dense Granules | 18 | 251 |
| TGME49_251540 | dense granule protein GRA9 (GRA9) | *T. gondii* ME49 | Dense Granules | 19 | 252 |
| TGME49_222170 | dense-granule antigen DG32 | *T. gondii* ME49 | Dense Granules | 20 | 253 |
| TGME49_208830 | GRAM | *T. gondii* ME49 | Dense Granules | 21 | 254 |
| TGME49_200010 | GRA20 | *T. gondii* ME49 | Dense Granules | 22 | 255 |
| TGME49_241610 | GRA21 | *T. gondii* ME49 | Dense Granules | 23 | 256 |
| TGME49_230180 | GRA24 | *T. gondii* ME49 | Dense Granules | 24 | 257 |
| TGME49_290700 | GRA25 | *T. gondii* ME49 | Dense Granules | 25 | 258 |
| TGME49_231960 | GRA28 | *T. gondii* ME49 | Dense Granules | 26 | 259 |
| TGME49_269690 | GRA29 | *T. gondii* ME49 | Dense Granules | 27 | 260 |
| TGME49_232000 | GRA30 | *T. gondii* ME49 | Dense Granules | 28 | 261 |
| TGME49_220240 | GRA31 | *T. gondii* ME49 | Dense Granules | 29 | 262 |
| TGME49_212300 | GRA32 | *T. gondii* ME49 | Dense Granules | 30 | 263 |
| TGME49_247440 | GRA33 | *T. gondii* ME49 | Dense Granules | 31 | 264 |

TABLE 3-continued

Toxoplasma proteins

| Gene ID | Gene Product Description | Organism | organelle | Polyn. SEQ ID | Polyp. SEQ ID |
|---|---|---|---|---|---|
| TGME49_226380 | GRA35 | T. gondii ME49 | Dense Granules | 32 | 265 |
| TGME49_213067 | GRA36 | T. gondii ME49 | Dense Granules | 33 | 266 |
| TGME49_236890 | GRA37 | T. gondii ME49 | Dense Granules | 34 | 267 |
| TGME49_312420 | GRA38 | T. gondii ME49 | Dense Granules | 35 | 268 |
| TGME49_289380 | GRA39 | T. gondii ME49 | Dense Granules | 36 | 269 |
| TGME49_219810 | GRA40 | T. gondii ME49 | Dense Granules | 37 | 270 |
| TGME49_200360 | hypothetical protein | T. gondii ME49 | Dense Granules | 38 | 271 |
| TGME49_203290 | hypothetical protein | T. gondii ME49 | Dense Granules | 39 | 272 |
| TGME49_310790 | hypothetical protein | T. gondii ME49 | Dense Granules | 40 | 273 |
| TGME49_277240 | NTPase I | T. gondii ME49 | Dense Granules | 41 | 274 |
| TGME49_277270 | NTPase II | T. gondii ME49 | Dense Granules | 42 | 275 |
| TGME49_217430 | protease inhibitor PI1 (PI1) | T. gondii ME49 | Dense Granules | 43 | 276 |
| TGME49_208450 | protease inhibitor PI2 (PI2) | T. gondii ME49 | Dense Granules | 44 | 277 |
| TGGT1_411330 | putative dense granule protein GRA11 | T. gondii GT1 | Dense Granules | 45 | 278 |
| TGME49_275860 | putative dense granule protein GRA12 | T. gondii VEG | Dense Granules | 46 | 279 |
| TGME49_261710 | ankyrin repeat-containing protein | T. gondii ME49 | Micronemes | 47 | 280 |
| TGME49_300130 | apical membrane antigen 1 domain-containing protein | T. gondii ME49 | Micronemes | 48 | 281 |
| TGME49_255260 | apical membrane antigen AMA1 | T. gondii ME49 | Micronemes | 49 | 282 |
| TGME49_293770 | chitinase-like protein CLP1 (CLP1) | T. gondii ME49 | Micronemes | 50 | 283 |
| TGME49_204340 | GRA34 | T. gondii ME49 | Micronemes | 51 | 284 |
| TGME49_221480 | hypothetical protein | T. gondii ME49 | Micronemes | 52 | 285 |
| TGME49_289100 | MIC18 | T. gondii ME49 | Micronemes | 53 | 286 |
| TGME49_294790 | MIC19 | T. gondii ME49 | Micronemes | 54 | 287 |
| TGME49_214940 | MIC2-associated protein M2AP | T. gondii ME49 | Micronemes | 55 | 288 |
| TGME49_283540 | MIC20 | T. gondii ME49 | Micronemes | 56 | 289 |
| TGME49_291890 | microneme protein MIC1 (MIC1) | T. gondii ME49 | Micronemes | 57 | 290 |
| TGME49_250710 | microneme protein MIC10 (MIC10) | T. gondii ME49 | Micronemes | 58 | 291 |
| TGME49_204530 | microneme protein MIC11 (MIC11) | T. gondii ME49 | Micronemes | 59 | 292 |
| TGME49_267680 | microneme protein MIC12 (MIC12) | T. gondii ME49 | Micronemes | 60 | 293 |
| TGME49_260190 | microneme protein MIC13 (MIC13) | T. gondii ME49 | Micronemes | 61 | 294 |
| TGME49_218310 | microneme protein MIC14 (MIC14) | T. gondii ME49 | Micronemes | 62 | 295 |
| TGME49_247195 | microneme protein MIC15 (MIC15) | T. gondii ME49 | Micronemes | 63 | 296 |
| TGME49_289630 | microneme protein MIC16 (MIC16) | T. gondii ME49 | Micronemes | 64 | 297 |
| TGME49_200250 | microneme protein MIC17A (MIC17A) | T. gondii ME49 | Micronemes | 65 | 298 |
| TGME49_200240 | microneme protein MIC17B (MIC17B) | T. gondii ME49 | Micronemes | 66 | 299 |
| TGME49_200230 | microneme protein MIC17C (MIC17C) | T. gondii ME49 | Micronemes | 67 | 300 |
| TGME49_201780 | microneme protein MIC2 (MIC2) | T. gondii ME49 | Micronemes | 68 | 301 |

TABLE 3-continued

Toxoplasma proteins

| Gene ID | Gene Product Description | Organism | organelle | Polyn. SEQ ID | Polyp. SEQ ID |
|---|---|---|---|---|---|
| TGME49_319560 | microneme protein MIC3 (MIC3) | T. gondii ME49 | Micronemes | 69 | 302 |
| TGME49_208030 | microneme protein MIC4 (MIC4) | T. gondii ME49 | Micronemes | 70 | 303 |
| TGME49_277080 | microneme protein MIC5 (MIC5) | T. gondii ME49 | Micronemes | 71 | 304 |
| TGME49_218520 | microneme protein MIC6 (MIC6) | T. gondii ME49 | Micronemes | 72 | 305 |
| TGME49_261780 | microneme protein MIC7 (MIC7) | T. gondii ME49 | Micronemes | 73 | 306 |
| TGME49_245490 | microneme protein MIC8 (MIC8) | T. gondii ME49 | Micronemes | 74 | 307 |
| TGME49_245485 | microneme protein MIC9 (MIC9) | T. gondii ME49 | Micronemes | 75 | 308 |
| TGME49_208730 | microneme protein, putative | T. gondii ME49 | Micronemes | 76 | 309 |
| TGME49_208740 | microneme protein, putative | T. gondii ME49 | Micronemes | 77 | 310 |
| TGME49_254430 | microneme protein, putative | T. gondii ME49 | Micronemes | 78 | 311 |
| TGME49_275798 | microneme protein, putative | T. gondii ME49 | Micronemes | 79 | 312 |
| TGME49_244180 | microneme-like protein | T. gondii ME49 | Micronemes | 80 | 313 |
| TGME49_286740 | microneme-like protein | T. gondii ME49 | Micronemes | 81 | 314 |
| TGME49_200270 | PAN/Apple domain-containing protein | T. gondii ME49 | Micronemes | 82 | 315 |
| TGME49_286150 | PAN/Apple domain-containing protein | T. gondii ME49 | Micronemes | 83 | 316 |
| TGME49_204130 | perforin-like protein PLP1 (PLP1) | T. gondii ME49 | Micronemes | 84 | 317 |
| TGVEG_439620 | putative microneme protein | T. gondii VEG | Micronemes | 85 | 318 |
| TGME49_200290 | rhomboid protease R0M1 (R0M1) | T. gondii ME49 | Micronemes | 86 | 319 |
| TGME49_293900 | sporozoite protein with an altered thrombospondin repeat SPATR | T. gondii ME49 | Micronemes | 87 | 320 |
| TGME49_204050 | subtilisin SUB1 (SUB1) | T. gondii ME49 | Micronemes | 88 | 321 |
| TGME49_206510 | toxolysin TLN4 (TLN4) | T. gondii ME49 | Micronemes | 89 | 322 |
| TGME49_209030 | actin ACT1 (ACT1) | T. gondii ME49 | Other | 90 | 323 |
| TGME49_214290 | DJ-1 family protein | T. gondii ME49 | Other | 91 | 324 |
| TGME49_268850 | enolase 2 | T. gondii ME49 | Other | 92 | 325 |
| TGME49_236040 | fructose-1,6-bisphosphate aldolase | T. gondii ME49 | Other | 93 | 326 |
| TGME49_289690 | glyceraldehyde-3-phosphate dehydrogenase GAPDH1 (GAPDH1) | T. gondii ME49 | Other | 94 | 327 |
| TGME49_290040 | macrophage migration inhibitory factor, putative | T. gondii ME49 | Other | 95 | 328 |
| TGME49_211680 | protein disulfide isomerase | T. gondii ME49 | Other | 96 | 329 |
| TGME49_273610 | Secretory phospholipase A2 | T. gondii ME49 | Other | 97 | 330 |
| TGME49_273620 | Secretory phospholipase A2 | T. gondii GT1 | Other | 98 | 331 |
| TGME49_271570 | Toxoplasma gondii family D protein | T. gondii ME49 | Other | 99 | 332 |
| TGME49_205470 | translation elongation factor 2 family protein, putative | T. gondii ME49 | Other | 100 | 333 |
| TGME49_288360 | tryptophanyl-tRNA synthetase (TrpRS2) | T. gondii ME49 | Other | 101 | 334 |
| TGME49_208590 | vacuolar ATP synthase subunit 54kD, putative | T. gondii ME49 | Other | 102 | 335 |
| TGME49_256970 | vacuolar ATP synthase subunit A, putative | T. gondii ME49 | Other | 103 | 336 |
| TGME49_219800 | vacuolar ATP synthase subunit b, putative | T. gondii ME49 | Other | 104 | 337 |

TABLE 3-continued

Toxoplasma proteins

| Gene ID | Gene Product Description | Organism | organelle | Polyn. SEQ ID | Polyp. SEQ ID |
|---|---|---|---|---|---|
| TGME49_315620 | vacuolar ATP synthase subunit C, putative | T. gondii ME49 | Other | 105 | 338 |
| TGME49_259010 | vacuolar ATP synthase subunit d, putative | T. gondii ME49 | Other | 106 | 339 |
| TGME49_305290 | vacuolar atp synthase subunit e, putative | T. gondii ME49 | Other | 107 | 340 |
| TGME49_310960 | vacuolar atp synthase subunit f, putative | T. gondii ME49 | Other | 108 | 341 |
| TGME49_246560 | vacuolar ATP synthase subunit g, putative | T. gondii ME49 | Other | 109 | 342 |
| TGME49_212310 | vacuolar ATP synthetase | T. gondii ME49 | Other | 110 | 343 |
| TGME49_314250 | bradyzoite rhoptry protein BRP1 (BRP1) | T. gondii ME49 | Rhoptries | 111 | 344 |
| TGME49_209985 | cAMP-dependent protein kinase | T. gondii ME49 | Rhoptries | 112 | 345 |
| TGME49_249670 | cathepsin B | T. gondii ME49 | Rhoptries | 113 | 346 |
| TGME49_252200 | cell cycle regulator with zn-finger domain-containing protein | T. gondii ME49 | Rhoptries | 114 | 347 |
| TGME49_210095 | hypothetical protein | T. gondii ME49 | Rhoptries | 115 | 348 |
| TGME49_296015 | hypothetical protein | T. gondii ME49 | Rhoptries | 116 | 349 |
| TGME49_297070 | hypothetical protein | T. gondii ME49 | Rhoptries | 117 | 350 |
| TGME49_311320 | hypothetical protein | T. gondii ME49 | Rhoptries | 118 | 351 |
| TGME49_321700 | hypothetical protein | T. gondii ME49 | Rhoptries | 119 | 352 |
| TGME49_321710 | hypothetical protein | T. gondii ME49 | Rhoptries | 120 | 353 |
| TGME49_322120 | hypothetical protein | T. gondii ME49 | Rhoptries | 121 | 354 |
| TGME49_323320 | hypothetical protein | T. gondii ME49 | Rhoptries | 122 | 355 |
| TGGT1_410610 | hypothetical protein | T. gondii GT1 | Rhoptries | 123 | 356 |
| TGME49_242118 | myosin-light-chain kinase | T. gondii ME49 | Rhoptries | 124 | 357 |
| TGME49_322000 | myosin-light-chain kinase | T. gondii ME49 | Rhoptries | 125 | 358 |
| TGME49_322010 | myosin-light-chain kinase | T. gondii ME49 | Rhoptries | 126 | 359 |
| TGME49_322100 | myosin-light-chain kinase | T. gondii ME49 | Rhoptries | 127 | 360 |
| TGME49_323300 | myosin-light-chain kinase | T. gondii ME49 | Rhoptries | 128 | 361 |
| TGME49_252500 | polo kinase | T. gondii ME49 | Rhoptries | 129 | 362 |
| TGME49_258225 | Predicted rhoptry protein kinase (ROPK) | T. gondii GT1 | Rhoptries | 130 | 363 |
| TGME49_234950 | protein kinase (incomplete catalytic triad) | T. gondii ME49 | Rhoptries | 131 | 364 |
| TGME49_274170 | protein kinase (incomplete catalytic triad) | T. gondii ME49 | Rhoptries | 132 | 365 |
| TGME49_281675 | protein kinase, putative | T. gondii ME49 | Rhoptries | 133 | 366 |
| TGME49_270320 | protein phosphatase 2C domain-containing protein | T. gondii ME49 | Rhoptries | 134 | 367 |
| TGME49_282055 | protein phosphatase PP2C-hn (PP2CHN) | T. gondii ME49 | Rhoptries | 135 | 368 |
| TGVEG_281675A | putative protein kinase | T. gondii VEG | Rhoptries | 136 | 369 |
| TGVEG_281675B | putative protein kinase | T. gondii VEG | Rhoptries | 137 | 370 |
| TGME49_289680 | Ras-related protein Rab11 | T. gondii ME49 | Rhoptries | 138 | 371 |
| TGGT1_411350 | rhoptry kinase family (incomplete catalytic triad) protein | T. gondii GT1 | Rhoptries | 139 | 372 |
| TGGT1_409600 | rhoptry kinase family protein | T. gondii GT1 | Rhoptries | 140 | 373 |
| TGGT1_411360 | rhoptry kinase family protein | T. gondii GT1 | Rhoptries | 141 | 374 |

TABLE 3-continued

Toxoplasma proteins

| Gene ID | Gene Product Description | Organism | organelle | Polyn. SEQ ID | Polyp. SEQ ID |
|---|---|---|---|---|---|
| TGVEG_440850 | rhoptry kinase family protein | T. gondii VEG | Rhoptries | 142 | 375 |
| TGVEG_440860 | rhoptry kinase family protein | T. gondii VEG | Rhoptries | 143 | 376 |
| TGVEG_442710 | rhoptry kinase family protein | T. gondii VEG | Rhoptries | 144 | 377 |
| TGME49_308093 | rhoptry kinase family protein (incomplete catalytic triad) | T. gondii ME49 | Rhoptries | 145 | 378 |
| TGME49_308096 | rhoptry kinase family protein (incomplete catalytic triad) | T. gondii ME49 | Rhoptries | 146 | 379 |
| TGME49_227810 | rhoptry kinase family protein ROP11 (incomplete catalytic triad) (ROP11) | T. gondii ME49 | Rhoptries | 147 | 380 |
| TGME49_242240 | rhoptry kinase family protein ROP19A (ROP19A) | T. gondii ME49 | Rhoptries | 148 | 381 |
| TGME49_242250 | rhoptry kinase family protein ROP19B (ROP19B) | T. gondii ME49 | Rhoptries | 149 | 382 |
| TGME49_258230 | rhoptry kinase family protein ROP20 (ROP20) | T. gondii ME49 | Rhoptries | 150 | 383 |
| TGME49_263220 | rhoptry kinase family protein ROP21 (ROP21) | T. gondii ME49 | Rhoptries | 151 | 384 |
| TGME49_207700 | rhoptry kinase family protein ROP22 (incomplete catalytic triad) (ROP22) | T. gondii ME49 | Rhoptries | 152 | 385 |
| TGME49_239600 | rhoptry kinase family protein ROP23 (incomplete catalytic triad) (ROP23) | T. gondii ME49 | Rhoptries | 153 | 386 |
| TGME49_252360 | rhoptry kinase family protein ROP24 (incomplete catalytic triad) (ROP24) | T. gondii ME49 | Rhoptries | 154 | 387 |
| TGME49_202780 | rhoptry kinase family protein ROP25 (ROP25) | T. gondii ME49 | Rhoptries | 155 | 388 |
| TGME49_211260 | rhoptry kinase family protein ROP26 (incomplete catalytic triad) (ROP26) | T. gondii ME49 | Rhoptries | 156 | 389 |
| TGME49_313330 | rhoptry kinase family protein ROP27 (ROP27) | T. gondii ME49 | Rhoptries | 157 | 390 |
| TGME49_258370 | rhoptry kinase family protein ROP28 (ROP28) | T. gondii ME49 | Rhoptries | 158 | 391 |
| TGME49_242230 | rhoptry kinase family protein ROP29 (ROP29) | T. gondii ME49 | Rhoptries | 159 | 392 |
| TGME49_227010 | rhoptry kinase family protein ROP30 (ROP30) | T. gondii ME49 | Rhoptries | 160 | 393 |
| TGME49_258800 | rhoptry kinase family protein ROP31 (ROP31) | T. gondii ME49 | Rhoptries | 161 | 394 |
| TGME49_270920 | rhoptry kinase family protein ROP32 (ROP32) | T. gondii ME49 | Rhoptries | 162 | 395 |
| TGME49_201130 | rhoptry kinase family protein ROP33 (ROP33) | T. gondii ME49 | Rhoptries | 163 | 396 |
| TGME49_240090 | rhoptry kinase family protein ROP34, putative | T. gondii ME49 | Rhoptries | 164 | 397 |
| TGME49_304740 | rhoptry kinase family protein ROP35 (ROP35) | T. gondii ME49 | Rhoptries | 165 | 398 |
| TGME49_207610 | rhoptry kinase family protein ROP36 (incomplete catalytic triad) (ROP36) | T. gondii ME49 | Rhoptries | 166 | 399 |
| TGME49_294560 | rhoptry kinase family protein ROP37 (incomplete catalytic triad) (ROP37) | T. gondii ME49 | Rhoptries | 167 | 400 |
| TGME49_242110 | rhoptry kinase family protein ROP38 (ROP38) | T. gondii ME49 | Rhoptries | 168 | 401 |
| TGME49_262050 | rhoptry kinase family protein ROP39 (ROP39) | T. gondii ME49 | Rhoptries | 169 | 402 |
| TGME49_291960 | rhoptry kinase family protein ROP40 (incomplete catalytic triad) (ROP40) | T. gondii ME49 | Rhoptries | 170 | 403 |
| TGME49_266100 | rhoptry kinase family protein ROP41 (ROP41) | T. gondii ME49 | Rhoptries | 171 | 404 |
| TGME49_230470 | rhoptry kinase family protein ROP46, putative | T. gondii ME49 | Rhoptries | 172 | 405 |
| TGME49_249470 | Rhoptry kinase family protein, truncated (incomplete catalytic triad) | T. gondii ME49 | Rhoptries | 173 | 406 |

TABLE 3-continued

Toxoplasma proteins

| Gene ID | Gene Product Description | Organism | organelle | Polyn. SEQ ID | Polyp. SEQ ID |
|---|---|---|---|---|---|
| TGME49_253330 | Rhoptry kinase family protein, truncated (incomplete catalytic triad) | T. gondii ME49 | Rhoptries | 174 | 407 |
| TGVEG_322130 | rhoptry kinase family ROP19B | T. gondii VEG | Rhoptries | 175 | 408 |
| TGVEG_269885A | rhoptry metalloprotease toxolysin TLN1 | T. gondii VEG | Rhoptries | 176 | 409 |
| TGVEG_269885B | rhoptry metalloprotease toxolysin TLN1 | T. gondii VEG | Rhoptries | 177 | 410 |
| TGME49_269885 | rhoptry metalloprotease toxolysin TLN1 (TLN1) | T. gondii ME49 | Rhoptries | 178 | 411 |
| TGVEG_310010A | rhoptry neck protein RON1 | T. gondii VEG | Rhoptries | 179 | 412 |
| TGVEG_310010B | rhoptry neck protein RON1 | T. gondii VEG | Rhoptries | 180 | 413 |
| TGME49_310010 | rhoptry neck protein RON1 (RON1) | T. gondii ME49 | Rhoptries | 181 | 414 |
| TGME49_261750 | rhoptry neck protein RON10 (RON10) | T. gondii ME49 | Rhoptries | 182 | 415 |
| TGME49_300100 | rhoptry neck protein RON2 (RON2) | T. gondii ME49 | Rhoptries | 183 | 416 |
| TGME49_223920 | rhoptry neck protein RON3 (RON3) | T. gondii ME49 | Rhoptries | 184 | 417 |
| TGME49_229010 | rhoptry neck protein RON4 (RON4) | T. gondii ME49 | Rhoptries | 185 | 418 |
| TGME49_311470 | rhoptry neck protein RON5 (RON5) | T. gondii ME49 | Rhoptries | 186 | 419 |
| TGVEG_297960A | rhoptry neck protein RON6 | T. gondii VEG | Rhoptries | 187 | 420 |
| TGVEG_297960B | rhoptry neck protein RON6 | T. gondii VEG | Rhoptries | 188 | 421 |
| TGME49_297960 | rhoptry neck protein RON6 (RON6) | T. gondii ME49 | Rhoptries | 189 | 422 |
| TGME49_306060 | rhoptry neck protein RON8 (RON8) | T. gondii ME49 | Rhoptries | 190 | 423 |
| TGVEG_308810A | rhoptry neck protein RON9 | T. gondii VEG | Rhoptries | 191 | 424 |
| TGVEG_308810B | rhoptry neck protein RON9 | T. gondii VEG | Rhoptries | 192 | 425 |
| TGME49_308810 | rhoptry neck protein RON9 (RON9) | T. gondii ME49 | Rhoptries | 193 | 426 |
| TGME49_265120 | rhoptry neck protein, putative | T. gondii ME49 | Rhoptries | 194 | 427 |
| TGME49_327200 | rhoptry neck protein, putative | T. gondii ME49 | Rhoptries | 195 | 428 |
| TGME49_309590 | rhoptry protein ROP1 (ROP1) | T. gondii ME49 | Rhoptries | 196 | 429 |
| TGME49_315490 | rhoptry protein ROP10 (ROP10) | T. gondii ME49 | Rhoptries | 197 | 430 |
| TGME49_203990 | rhoptry protein ROP12 (ROP12) | T. gondii ME49 | Rhoptries | 198 | 431 |
| TGME49_312270 | rhoptry protein ROP13 (ROP13) | T. gondii ME49 | Rhoptries | 199 | 432 |
| TGME49_315220 | rhoptry protein ROP14 (ROP14) | T. gondii ME49 | Rhoptries | 200 | 433 |
| TGME49_211290 | rhoptry protein ROP15 (ROP15) | T. gondii ME49 | Rhoptries | 201 | 434 |
| TGME49_262730 | rhoptry protein ROP16 (ROP16) | T. gondii ME49 | Rhoptries | 202 | 435 |
| TGME49_258580 | rhoptry protein ROP17 (ROP17) | T. gondii ME49 | Rhoptries | 203 | 436 |
| TGME49_205250 | rhoptry protein ROP18 (ROP18) | T. gondii ME49 | Rhoptries | 204 | 437 |
| TGME49_215785 | rhoptry protein ROP2A (ROP2A) | T. gondii ME49 | Rhoptries | 205 | 438 |
| TGME49_295125 | rhoptry protein ROP4 (ROP4) | T. gondii ME49 | Rhoptries | 206 | 439 |
| TGGT1_411430 | rhoptry protein ROP5 | T. gondii GT1 | Rhoptries | 207 | 440 |
| TGVEG_442220 | rhoptry protein ROP5 | T. gondii VEG | Rhoptries | 208 | 441 |
| TGME49_308090 | rhoptry protein ROP5 (ROP5) | T. gondii ME49 | Rhoptries | 209 | 442 |

TABLE 3-continued

Toxoplasma proteins

| Gene ID | Gene Product Description | Organism | organelle | Polyn. SEQ ID | Polyp. SEQ ID |
|---|---|---|---|---|---|
| TGME49_258660 | rhoptry protein ROP6 (ROP6) | T. gondii ME49 | Rhoptries | 210 | 443 |
| TGGT1_365080 | rhoptry protein ROP7 | T. gondii GT1 | Rhoptries | 211 | 444 |
| TGME49_295110 | rhoptry protein ROP7 (ROP7) | T. gondii ME49 | Rhoptries | 212 | 445 |
| TGVEG_363030 | rhoptry protein ROP8 | T. gondii VEG | Rhoptries | 213 | 446 |
| TGME49_215775 | rhoptry protein ROP8 (ROP8) | T. gondii ME49 | Rhoptries | 214 | 447 |
| TGME49_243730 | rhoptry protein ROP9 (ROP9) | T. gondii ME49 | Rhoptries | 215 | 448 |
| TGME49_295105 | rhoptry protein, putative | T. gondii ME49 | Rhoptries | 216 | 449 |
| TGME49_315210 | rhoptry protein, putative | T. gondii ME49 | Rhoptries | 217 | 450 |
| TGME49_315940 | rhoptry protein, putative | T. gondii ME49 | Rhoptries | 218 | 451 |
| TGME49_230350 | RON11 | T. gondii ME49 | Rhoptries | 219 | 452 |
| TGME49_232020 | RON12 | T. gondii ME49 | Rhoptries | 220 | 453 |
| TGME49_294400 | RON2L1 | T. gondii ME49 | Rhoptries | 221 | 454 |
| TGME49_296020 | ROP2L11 | T. gondii VEG | Rhoptries | 222 | 455 |
| TGME49_296000 | ROP2L12 | T. gondii ME49 | Rhoptries | 223 | 456 |
| TGME49_242100 | ROP38 | T. gondii ME49 | Rhoptries | 224 | 457 |
| TGME49_261740 | ROP47 | T. gondii ME49 | Rhoptries | 225 | 458 |
| TGME49_218270 | ROP48 | T. gondii ME49 | Rhoptries | 226 | 459 |
| TGME49_308075 | ROP5 | T. gondii VEG | Rhoptries | 227 | 460 |
| TGME49_241000 | ROP51 | T. gondii ME49 | Rhoptries | 228 | 461 |
| TGME49_210370 | ROP54 | T. gondii ME49 | Rhoptries | 229 | 462 |
| TGME49_300290 | SNARE domain-containing protein | T. gondii ME49 | Rhoptries | 230 | 463 |
| TGME49_299060 | sodium/hydrogen exchanger NHE2 | T. gondii ME49 | Rhoptries | 231 | 464 |
| TGME49_314500 | subtilisin SUB2 (SUB2) | T. gondii ME49 | Rhoptries | 232 | 465 |
| TGME49_214080 | toxofilin | T. gondii ME49 | Rhoptries | 233 | 466 |

Table 3. "polyn." = polynucleotide; "polyp" = polypeptide.

According to some embodiments of the invention, the heterologous polynucleotide further comprises a Toxoplasma untranslated region (UTR) nucleic acid sequence.

According to some embodiments of the invention, the Toxoplasma untranslated region (UTR) nucleic acid sequence is upstream and/or downstream of the open reading frame of the heterologous polynucleotide (e.g., which encodes the Toxoplasma secreted protein fused in frame with the pharmaceutical polypeptide).

According to some embodiments of the invention, the Toxoplasma 5'-untranslated region (5'-UTR) is placed upstream of the Toxoplasma secreted protein open reading frame.

According to some embodiments of the invention, the Toxoplasma 3'-untranslated region (3'-UTR) is placed downstream of the open reading frame encoding the Toxoplasma secreted protein fused in frame with the pharmaceutical polypeptide.

According to some embodiments of the invention, the Toxoplasma 3' untranslated region (3'-UTR) nucleic acid sequence is the GRA2 3'-UTR, GRA16 3'-UTR, GRA24 3'-UTR, SAG1 3'-UTR, or the DHFR 3'-UTR.

According to some embodiments of the invention, the Toxoplasma 5' untranslated region (5'-UTR) nucleic acid sequence is the GRA2 5'-UTR, GRA16 5'-UTR, GRA24 5'-UTR, SAG1 5'-UTR, or the DHFR 5'-UTR.

According to some embodiments of the invention, the Toxoplasma untranslated region (UTR) nucleic acid sequence is the Toxofilin 3'-UTR.

As mentioned, the heterologous polynucleotide comprises a second nucleic acid sequence encoding a pharmaceutical polypeptide being fused in frame downstream of the Toxoplasma secreted protein.

As used herein the phrase "pharmaceutical polypeptide" refers to a polypeptide having a therapeutic effect, e.g., capable of treating a pathology, when introduced into cell(s) of a subject in need thereof.

It should be noted that for certain diseases, the pharmaceutical polypeptide may be effective when reaching a certain organ, tissue, cell, cell compartment or cellular localization within the subject. For example, for treating a neurological disease, the pharmaceutical composition is preferably targeted to the nervous system, e.g., neurons, glia or other cells. Additionally or alternatively, for certain diseases, the pharmaceutical polypeptide should reach a certain cellular localization such as the cell nucleus in case the target of the pharmaceutical composition is situated (positioned) within the cell nucleus. For example, in the case of MECP2, the active protein binds to DNA within the nucleus and regulates gene expression.

According to some embodiments of the invention, the nucleic acid construct further comprises at least one in frame cleavage site, which allows detachment of the pharmaceutical polypeptide from the Toxoplasma secreted protein.

According to some embodiments of the invention, the pharmaceutical polypeptide comprises a wild type amino acid sequence corresponding to the endogenous protein capable of treating the pathology.

According to some embodiments of the invention, the pharmaceutical polypeptide comprises an antibody capable of treating the pathology.

According to some embodiments of the invention, the pharmaceutical polypeptide comprises an antigen capable of treating the pathology.

According to some embodiments of the invention, the pharmaceutical polypeptide comprises a toxin capable of treating the pathology.

According to some embodiments of the invention, the pharmaceutical polypeptide comprises an enzyme, a structural polypeptide, a motility polypeptide, a regulatory polypeptide, a storage polypeptide, a signaling/ligand polypeptide, a receptor polypeptide, a sensory polypeptide, an antibody, a protein channel and/or a transport polypeptide.

According to some embodiments of the invention, the pharmaceutical polypeptide is Galactocerebrosidase (GALC).

According to some embodiments of the invention, the pharmaceutical polypeptide is Galactocerebrosidase (GALC) isoform 1, isoform 2, isoform 3, isoform 4 or isoform 5.

According to some embodiments of the invention, the pharmaceutical polypeptide is Methyl-CpG Binding Protein 2 (MECP2).

According to some embodiments of the invention, the pharmaceutical polypeptide is Methyl-CpG Binding Protein 2 (MECP2) isoform 1 or MECP2 isoform 2.

According to some embodiments of the invention, the pharmaceutical polypeptide is Glial Cell Derived Neurotrophic Factor (GDNF).

According to some embodiments of the invention, the pharmaceutical polypeptide is Glial Cell Derived Neurotrophic Factor (GDNF) isoform 1, isoform 2, isoform 3, isoform 4 or isoform 5.

According to some embodiments of the invention, the pharmaceutical polypeptide is Aspartoacylase (ASPA).

According to some embodiments of the invention, the pharmaceutical polypeptide is Survival Motor Neuron Protein (SMN1).

According to some embodiments of the invention, the pharmaceutical polypeptide is Survival Motor Neuron Protein isoform SMN, isoform SMN-delta5, isoform SMN-delta7, or isoform SMN-delta57.

According to some embodiments of the invention, the pharmaceutical polypeptide is Parkin (PARK2).

According to some embodiments of the invention, the pharmaceutical polypeptide is Parkin (PARK2) isoform 1, isoform 2, isoform 3, isoform 4, isoform 5, isoform 6, isoform 7, or isoform 8.

According to some embodiments of the invention, the pharmaceutical polypeptide is Transcription Factor EB (TFEB).

According to some embodiments of the invention, the pharmaceutical polypeptide is Transcription Factor EB (TFEB) isoform 1 or isoform 2.

According to some embodiments of the invention, the pharmaceutical polypeptide is a TALEN (TALE nuclease).

According to some embodiments of the invention, the pharmaceutical polypeptide is a TALE TF (TALE transcription factor).

Table 4 hereinbelow, lists exemplary therapeutic proteins, which can be secreted to the subject by the Toxoplasma of some embodiments of the invention.

TABLE 4 exemplary pharmaceutical proteins

| Gene Name/Symbol | Polypeptide GenBank Accession Number | SEQ ID NO: | Polynucleotide GenBank Accession Number (coding sequence) | SEQ ID NO: |
|---|---|---|---|---|
| TFEB | NP_001258874.1 | 4610 | NM_001271945.1 | 4600 |
| TFEB | NP_001161299.2 | 4618 | NM_001167827.2 | 4619 |
| TFEB | NP_001258873.1 | 4620 | NM_001271944.1 | 4621 |
| TFEB | NP_009093.1 | 4622 | NM_007162.2 | 4623 |
| TFEB | NP_001258872.1 | 4624 | NM_001271943.1 | 4625 |
| HGSNAT | NP_689632 | 4301 | NM_152419 | 4040 |
| MEF2C | NP_001124477 | 4302 | NM_001131005 | 4041 |
| MEF2C | NP_002388 | 4303 | NM_002397 | 4042 |
| NRTN | NP_004549 | 4304 | NM_004558 | 4043 |
| PGF | NP_002623 | 4305 | NM_002632 | 4044 |
| RPE65 | NP_000320 | 4306 | NM_000329 | 4045 |
| GDNF | NP_000505 | 4307 | NM_000514 | 4046 |
| GDNF | NP_954701 | 4308 | NM_199231 | 4047 |
| CNGB3 | NP_061971 | 4309 | NM_019098 | 4048 |
| BDNF | NP_001137277 | 4310 | NM_001143816 | 4049 |
| BDNF | NP_001137279 | 4311 | NM_001143814 | 4050 |
| BDNF | NP_001137288 | 4312 | NM_001143813 | 4051 |
| BDNF | NP_001137278 | 4313 | NM_001143812 | 4052 |
| BDNF | NP_733931 | 4314 | NM_001143806 | 4053 |
| BDNF | NP_733930 | 4315 | NM_001143811 | 4054 |
| BDNF | NP_733929 | 4316 | NM_001709 | 4055 |
| BDNF | NP_733927 | 4317 | NM_001143805 | 4056 |
| BDNF | NP_733928 | 4318 | NM_001143810 | 4057 |
| BDNF | NP_001700 | 4319 | NM_170735 | 4058 |
| BDNF | NP_001137281 | 4320 | NM_170734 | 4059 |
| BDNF | NP_001137282 | 4321 | NM_170733 | 4060 |
| BDNF | NP_001137280 | 4322 | NM_170732 | 4061 |
| BDNF | NP_001137285 | 4323 | NM_170731 | 4062 |
| BDNF | NP_001137286 | 4324 | NM_001143809 | 4063 |
| BDNF | NP_001137283 | 4325 | NM_001143807 | 4064 |
| BDNF | NP_001137284 | 4326 | NM_001143808 | 4065 |
| APP | NP_001129601 | 4327 | NM_000484 | 4066 |
| APP | NP_958817 | 4328 | NM_201414 | 4067 |
| APP | NP_958816 | 4329 | NM_001136131 | 4068 |
| APP | NP_001129602 | 4330 | NM_201413 | 4069 |
| APP | NP_001129488 | 4331 | NM_001136130 | 4070 |
| APP | NP_000475 | 4332 | NM_001136016 | 4071 |
| APP | NP_001129603 | 4333 | NM_001136129 | 4072 |
| ASPA | NP_000040 | 4334 | NM_001128085 | 4073 |
| ASPA | NP_001121557 | 4335 | NM_000049 | 4074 |
| S1PR1 | NP_001391 | 4336 | NM_001400 | 4075 |
| IDS | NP_001160022 | 4337 | NM_001166550 | 4076 |
| IDS | NP_006114 | 4338 | NM_006123 | 4077 |
| IDS | NP_000193 | 4339 | NM_000202 | 4078 |
| HTRA2 | NP_659540 | 4340 | NM_013247 | 4079 |
| HTRA2 | NP_037379 | 4341 | NM_145074 | 4080 |
| CDNF | NP_001025125 | 4342 | NM_001029954 | 4081 |
| DNAJC5 | NP_079495 | 4343 | NM_025219 | 4082 |
| IDUA | NP_000194 | 4344 | NM_000203 | 4083 |

TABLE 4-continued exemplary pharmaceutical proteins

| Gene Name/Symbol | Polypeptide GenBank Accession Number | SEQ ID NO: | Polynucleotide GenBank Accession Number (coding sequence) | SEQ ID NO: |
|---|---|---|---|---|
| SPON1 | NP_006099 | 4345 | NM_006108 | 4084 |
| NMNAT2 | NP_733820 | 4346 | NM_015039 | 4085 |
| NMNAT2 | NP_055854 | 4347 | NM_170706 | 4086 |
| FMR1 | NP_002015 | 4348 | NM_002024 | 4087 |
| MECP2 | NP_004983 | 4349 | NM_001110792 | 4088 |
| MECP2 | NP_001104262 | 4350 | NM_004992 | 4089 |
| GNS | NP_002067 | 4351 | NM_002076 | 4090 |
| VEGFB | NP_003368 | 4352 | NM_003377 | 4091 |
| HIF1A | NP_851397 | 4353 | NM_181054 | 4092 |
| HIF1A | NP_001521 | 4354 | NM_001530 | 4093 |
| SERPINF1 | NP_002606 | 4355 | NM_002615 | 4094 |
| VEGFA | NP_001165093 | 4356 | NM_001025369 | 4095 |
| VEGFA | NP_001165094 | 4357 | NM_001025366 | 4096 |
| VEGFA | NP_001020540 | 4358 | NM_001025367 | 4097 |
| VEGFA | NP_001020541 | 4359 | NM_001025368 | 4098 |
| VEGFA | NP_003367 | 4360 | NM_003376 | 4099 |
| VEGFA | NP_001165101 | 4361 | NM_001171627 | 4100 |
| VEGFA | NP_001020537 | 4362 | NM_001171626 | 4101 |
| VEGFA | NP_001165100 | 4363 | NM_001171629 | 4102 |
| VEGFA | NP_001020539 | 4364 | NM_001171628 | 4103 |
| VEGFA | NP_001020538 | 4365 | NM_001171624 | 4104 |
| VEGFA | NP_001028928 | 4366 | NM_001171630 | 4105 |
| VEGFA | NP_001165098 | 4367 | NM_001171625 | 4106 |
| VEGFA | NP_001165097 | 4368 | NM_001171622 | 4107 |
| VEGFA | NP_001165096 | 4369 | NM_001171623 | 4108 |
| VEGFA | NP_001165095 | 4370 | NM_001033756 | 4109 |
| VEGFA | NP_001165099 | 4371 | NM_001025370 | 4110 |
| STC1 | NP_003146 | 4372 | NM_003155 | 4111 |
| NGB | NP_067080 | 4373 | NM_021257 | 4112 |
| NFE2L2 | NP_001138884 | 4374 | NM_006164 | 4113 |
| NFE2L2 | NP_006155 | 4375 | NM_001145412 | 4114 |
| NFE2L2 | NP_001138885 | 4376 | NM_001145413 | 4115 |
| MAPK7 | NP_620603 | 4377 | NM_002749 | 4116 |
| MAPK7 | NP_620602 | 4378 | NM_139034 | 4117 |
| MAPK7 | NP_620601 | 4379 | NM_139033 | 4118 |
| MAPK7 | NP_002740 | 4380 | NM_139032 | 4119 |
| NMNAT1 | NP_073624 | 4381 | NM_022787 | 4120 |
| NGF | NP_002497 | 4382 | NM_002506 | 4121 |
| NAGLU | NP_000254 | 4383 | NM_000263 | 4122 |
| CLU | NP_001822 | 4384 | NM_001831 | 4123 |
| MME | NP_009218 | 4385 | NM_000902 | 4124 |
| MME | NP_009219 | 4386 | NM_007289 | 4125 |
| MME | NP_000893 | 4387 | NM_007287 | 4126 |
| MME | NP_009220 | 4388 | NM_007288 | 4127 |
| CTSA | NP_001121167 | 4389 | NM_001167594 | 4128 |
| CTSA | NP_000299 | 4390 | NM_000308 | 4129 |
| CTSA | NP_001161066 | 4391 | NM_001167695 | 4130 |
| PPT1 | NP_000301 | 4392 | NM_000310 | 4131 |
| PPT1 | NP_001136076 | 4393 | NM_001142604 | 4132 |
| TIMP2 | NP_003246 | 4394 | NM_003255 | 4133 |
| MANF | NP_006001 | 4395 | NM_006010 | 4134 |
| TIMP1 | NP_003245 | 4396 | NM_003254 | 4135 |
| GAD2 | NP_000809 | 4397 | NM_001134366 | 4136 |
| GAD2 | NP_001127838 | 4398 | NM_000818 | 4137 |
| GALC | NP_000144 | 4399 | NM_000153 | 4138 |
| GAD1 | NP_000808 | 4400 | NM_013445 | 4139 |
| GAD1 | NP_038473 | 4401 | NM_000817 | 4140 |
| NTF3 | NP_002518 | 4402 | NM_002527 | 4141 |
| NTF3 | NP_001096124 | 4403 | NM_001102654 | 4142 |
| GUSB | NP_000172 | 4404 | NM_000181 | 4143 |
| HGF | NP_001010932 | 4405 | NM_001010933 | 4144 |
| HGF | NP_001010931 | 4406 | NM_001010932 | 4145 |
| HGF | NP_001010934 | 4407 | NM_001010931 | 4146 |
| HGF | NP_000592 | 4408 | NM_000601 | 4147 |
| HGF | NP_001010933 | 4409 | NM_001010934 | 4148 |
| SERPINI1 | NP_005016 | 4410 | NM_005025 | 4149 |
| SERPINI1 | NP_001116224 | 4411 | NM_001122752 | 4150 |
| RGS2 | NP_002914 | 4412 | NM_002923 | 4151 |
| NPY | NP_000896 | 4413 | NM_000905 | 4152 |
| UCP2 | NP_003346 | 4414 | NM_003355 | 4153 |
| SST | NP_001039 | 4415 | NM_001048 | 4154 |
| SGSH | NP_000190 | 4416 | NM_000199 | 4155 |
| CYP2J2 | NP_000766 | 4417 | NM_000775 | 4156 |
| GM2A | NP_000396 | 4418 | NM_000405 | 4157 |
| GM2A | NP_001161079 | 4419 | NM_001167607 | 4158 |
| HEXA | NP_000511 | 4420 | NM_000520 | 4159 |
| UCHE1 | NP_004172 | 4421 | NM_004181 | 4160 |
| HEXB | NP_000512 | 4422 | NM_000521 | 4161 |
| PINK1 | NP_115785 | 4423 | NM_032409 | 4162 |
| PRDX3 | NP_006784 | 4424 | NM_006793 | 4163 |
| PRDX1 | NP_859048 | 4425 | NM_002574 | 4164 |
| PRDX1 | NP_859047 | 4426 | NM_181696 | 4165 |
| PRDX1 | NP_002565 | 4427 | NM_181697 | 4166 |
| GEB1 | NP_001129074 | 4428 | NM_001135602 | 4167 |
| GEB1 | NP_001073279 | 4429 | NM_000404 | 4168 |
| GEB1 | NP_000395 | 4430 | NM_001079811 | 4169 |
| TPP1 | NP_000382 | 4431 | NM_000391 | 4170 |
| ANG | NP_001136 | 4432 | NM_001097577 | 4171 |
| ANG | NP_001091046 | 4433 | NM_001145 | 4172 |
| HMOX1 | NP_002124 | 4434 | NM_002133 | 4173 |
| NRG1 | NP_039258 | 4435 | NM_001160001 | 4174 |
| NRG1 | NP_001153479 | 4436 | NM_001159995 | 4175 |
| NRG1 | NP_001153476 | 4437 | NM_001160007 | 4176 |
| NRG1 | NP_001153477 | 4438 | NM_001160008 | 4177 |
| NRG1 | NP_039254 | 4439 | NM_001159996 | 4178 |
| NRG1 | NP_039256 | 4440 | NM_001159999 | 4179 |
| NRG1 | NP_001153467 | 4441 | NM_001160002 | 4180 |
| NRG1 | NP_001153468 | 4442 | NM_001160004 | 4181 |
| NRG1 | NP_039250 | 4443 | NM_004495 | 4182 |
| NRG1 | NP_001153471 | 4444 | NM_001160005 | 4183 |
| NRG1 | NP_001153480 | 4445 | NM_013964 | 4184 |
| NRG1 | NP_039251 | 4446 | NM_013960 | 4185 |
| NRG1 | NP_039252 | 4447 | NM_013962 | 4186 |
| NRG1 | NP_039253 | 4448 | NM_013959 | 4187 |
| NRG1 | NP_001153474 | 4449 | NM_013958 | 4188 |
| NRG1 | NP_004486 | 4450 | NM_013957 | 4189 |
| NRG1 | NP_001153473 | 4451 | NM_013956 | 4190 |
| NFIL3 | NP_005375 | 4452 | NM_005384 | 4191 |
| MAN2B1 | NP_000519 | 4453 | NM_000528 | 4192 |
| DHCR24 | NP_055577 | 4454 | NM_014762 | 4193 |
| DDC | NP_001076440 | 4455 | NM_001082971 | 4194 |
| DDC | NP_000781 | 4456 | NM_000790 | 4195 |
| TP53 | NP_001119588 | 4457 | NM_001126113 | 4196 |
| TP53 | NP_001119589 | 4458 | NM_001126112 | 4197 |
| TP53 | NP_001119585 | 4459 | NM_000546 | 4198 |
| TP53 | NP_001119584 | 4460 | NM_001126116 | 4199 |
| TP53 | NP_001119587 | 4461 | NM_001126117 | 4200 |
| TP53 | NP_001119586 | 4462 | NM_001126114 | 4201 |
| TP53 | NP_000537 | 4463 | NM_001126115 | 4202 |
| ADNP | NP_056154 | 4464 | NM_181442 | 4203 |
| ADNP | NP_852107 | 4465 | NM_015339 | 4204 |
| GAN | NP_071324 | 4466 | NM_022041 | 4205 |
| GAL | NP_057057 | 4467 | NM_015973 | 4206 |
| SMN1 | NP_000335 | 4468 | NM_022874 | 4207 |
| SMN1 | NP_075015 | 4469 | NM_017411 | 4208 |
| SMN1 | NP_075014 | 4470 | NM_000344 | 4209 |
| SMN1 | NP_059107 | 4471 | NM_022876 | 4210 |
| SMN1 | NP_075013 | 4510 | NM_022875 | 4211 |
| SMN1 | NP_075012 | 4511 | NM_022877 | 4212 |
| PROC | NP_000303 | 4512 | NM_000312 | 4213 |
| TRAP1 | NP_057376 | 4513 | NM_016292 | 4214 |
| I118BP | NP_001138527 | 4514 | NM_173042 | 4215 |
| I118BP | NP_001138529 | 4515 | NM_001145057 | 4216 |
| I118BP | NP_766630 | 4516 | NM_001145055 | 4217 |
| I118BP | NP_001034749 | 4517 | NM_001039660 | 4218 |
| I118BP | NP_001034748 | 4518 | NM_001039659 | 4219 |
| PRDX6 | NP_004896 | 4519 | NM_004905 | 4220 |
| TXN | NP_003320 | 4520 | NM_003329 | 4221 |
| GAA | NP_000143 | 4521 | NM_000152 | 4222 |
| GAA | NP_001073271 | 4522 | NM_001079803 | 4223 |
| GAA | NP_001073272 | 4523 | NM_001079804 | 4224 |
| GHRL | NP_001128416 | 4524 | NM_001134945 | 4225 |
| GHRL | NP_001128417 | 4525 | NM_001134944 | 4226 |
| GHRL | NP_001128413 | 4526 | NM_001134946 | 4227 |
| GHRL | NP_057446 | 4527 | NM_016362 | 4228 |
| GHRL | NP_001128418 | 4528 | NM_001134941 | 4229 |

TABLE 4-continued exemplary pharmaceutical proteins

| Gene Name/Symbol | Polypeptide GenBank Accession Number | SEQ ID NO: | Polynucleotide GenBank Accession Number (coding sequence) | SEQ ID NO: |
|---|---|---|---|---|
| CSF3 | NP_757373 | 4529 | NM_000759 | 4230 |
| CSF3 | NP_757374 | 4530 | NM_172220 | 4231 |
| CSF3 | NP_000750 | 4531 | NM_172219 | 4232 |
| UBE3A | NP_000453 | 4532 | NM_130838 | 4233 |
| UBE3A | NP_570854 | 4533 | NM_130839 | 4234 |
| UBE3A | NP_570853 | 4534 | NM_000462 | 4235 |
| ABCD1 | NP_000024 | 4535 | NM_000033 | 4236 |
| NDP | NP_000257 | 4536 | NM_000266 | 4237 |
| TH | NP_954986 | 4537 | NM_199292 | 4238 |
| TH | NP_954987 | 4538 | NM_199293 | 4239 |
| TH | NP_000351 | 4539 | NM_000360 | 4240 |
| GCH1 | NP_000152 | 4540 | NM_000161 | 4241 |
| GCH1 | NP_001019241 | 4541 | NM_001024070 | 4242 |
| GCH1 | NP_001019242 | 4542 | NM_001024071 | 4243 |
| GCH1 | NP_001019195 | 4543 | NM_001024024 | 4244 |
| BCL2 | NP_000648 | 4544 | NM_000633 | 4245 |
| BCL2 | NP_000624 | 4545 | NM_000657 | 4246 |
| ENO2 | NP_001966 | 4546 | NM_001975 | 4247 |
| EPO | NP_000790 | 4547 | NM_000799 | 4248 |
| GBA | NP_001005741 | 4548 | NM_001005742 | 4249 |
| GBA | NP_001165283 | 4549 | NM_001005741 | 4250 |
| GBA | NP_001005742 | 4550 | NM_001171811 | 4251 |
| GBA | NP_001165282 | 4551 | NM_001171812 | 4252 |
| GBA | NP_000148 | 4552 | NM_000157 | 4253 |
| AGA | NP_000018 | 4553 | NM_000027 | 4254 |
| AGA | NP_001165459 | 4554 | NM_001171988 | 4255 |
| UPF1 | NP_002902 | 4555 | NM_002911 | 4256 |
| PSAP | NP_001035931 | 4556 | NM_001042465 | 4257 |
| PSAP | NP_002769 | 4557 | NM_001042466 | 4258 |
| PSAP | NP_001035930 | 4558 | NM_002778 | 4259 |
| ANXA1 | NP_000691 | 4559 | NM_000700 | 4260 |
| IGF1 | NP_001104753 | 4560 | NM_001111284 | 4261 |
| IGF1 | NP_001104754 | 4561 | NM_001111283 | 4262 |
| IGF1 | NP_000609 | 4562 | NM_000618 | 4263 |
| IGF2 | NP_001035835 | 4563 | NM_001007139 | 4264 |
| IGF2 | NP_000603 | 4564 | NM_000612 | 4265 |
| IGF2 | NP_001007140 | 4565 | NM_000207 | 4266 |
| IGF2 | NP_001121070 | 4566 | NM_001127598 | 4267 |
| IGF2 | NP_000198 | 4567 | NM_001042376 | 4268 |
| PARK2 | NP_054642 | 4568 | NM_013988 | 4269 |
| PARK2 | NP_054643 | 4569 | NM_013987 | 4270 |
| PARK2 | NP_004553 | 4570 | NM_004562 | 4271 |
| FUCA1 | NP_000138 | 4571 | NM_000147 | 4272 |
| SIRT1 | NP_001135970 | 4572 | NM_012238 | 4273 |
| SIRT1 | NP_036370 | 4573 | NM_001142498 | 4274 |
| PARK7 | NP_001116849 | 4574 | NM_007262 | 4275 |
| PARK7 | NP_009193 | 4575 | NM_001123377 | 4276 |
| ANXA2 | NP_004030 | 4576 | NM_004039 | 4277 |
| ANXA2 | NP_001002857 | 4577 | NM_001136015 | 4278 |
| ANXA2 | NP_001002858 | 4578 | NM_001002858 | 4279 |
| ANXA2 | NP_001129487 | 4579 | NM_001002857 | 4280 |
| GCG | NP_002045 | 4580 | NM_002054 | 4281 |
| LEP | NP_000221 | 4581 | NM_000230 | 4282 |
| SH3BP5 | NP_004835 | 4582 | NM_001018009 | 4283 |
| SH3BP5 | NP_001018009 | 4583 | NM_004844 | 4284 |
| CNTF | NP_000605 | 4584 | NM_053023 | 4285 |
| CNTF | NP_444251 | 4585 | NM_000614 | 4286 |
| GLA | NP_000160 | 4586 | NM_000169 | 4287 |
| KCNN3 | NP_740752 | 4587 | NM_170782 | 4288 |
| KCNN3 | NP_002240 | 4588 | NM_002249 | 4289 |
| ARSA | NP_001078896 | 4589 | NM_000487 | 4290 |
| ARSA | NP_001078897 | 4590 | NM_001085428 | 4291 |
| ARSA | NP_000478 | 4591 | NM_001085426 | 4292 |
| ARSA | NP_001078894 | 4592 | NM_001085427 | 4293 |
| ARSA | NP_001078895 | 4593 | NM_001085425 | 4294 |
| SUMF1 | NP_001158147 | 4594 | NM_001164674 | 4295 |
| SUMF1 | NP_001158146 | 4595 | NM_001164675 | 4296 |
| SUMF1 | NP_877437 | 4596 | NM_182760 | 4297 |
| CRH | NP_000747 | 4597 | NM_000756 | 4298 |
| SMPD1 | NP_000534 | 4598 | NM_000543 | 4299 |
| SMPD1 | NP_001007594 | 4599 | NM_001007593 | 4300 |

Table 4.

It should be noted that any of the sequences described herein (e.g., the Toxoplasma secreted protein and/or the therapeutic polypeptides) can be codon optimized for expression in a target cell (e.g., Toxoplasma). Examples of such sequence modifications include, but are not limited to, an altered G/C content to more closely approach that typically found in the target cell species of interest, and the removal of codons atypically found in the target cell a species commonly referred to as codon optimization.

The phrase "codon optimization" refers to the selection of appropriate DNA nucleotides for use within a structural gene or fragment thereof that approaches codon usage within the target cell of interest. Therefore, an optimized gene or nucleic acid sequence refers to a gene in which the nucleotide sequence of a native or naturally occurring gene has been modified in order to utilize statistically-preferred or statistically-favored codons within the target cell. The nucleotide sequence typically is examined at the DNA level and the coding region optimized for expression in the target cell species determined using any suitable procedure. In this method, the standard deviation of codon usage, a measure of codon usage bias, may be calculated by first finding the squared proportional deviation of usage of each codon of the native gene relative to that of highly expressed target cell genes, followed by a calculation of the average squared deviation. The formula used is: 1 SDCU=n=1N[(Xn−Yn)/Yn]2/N, where Xn refers to the frequency of usage of codon n in highly expressed target cell genes, where Yn to the frequency of usage of codon n in the gene of interest and N refers to the total number of codons in the gene of interest.

One method of optimizing the nucleic acid sequence in accordance with the preferred codon usage for a particular target cell type is based on the direct use, without performing any extra statistical calculations, of codon optimization Tables such as those provided on-line at the Codon Usage Database through the Codon usage tabulated from international DNA sequence databases: status for the year 2000. Y Nakamura, T Gojobori, T Ikemura—Nucleic acids research, 2000—Oxford Univ Press. The Codon Usage Database contains codon usage tables for a number of different species, with each codon usage Table having been statistically determined based on the data present in Genbank.

By using the above Tables to determine the most preferred or most favored codons for each amino acid in a particular species (for example, *Toxoplasma gondii*), a naturally-occurring nucleotide sequence encoding a protein of interest can be codon optimized for that particular target cell species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular target cell species. Therefore, codon optimization of the native nucleotide sequence may comprise determining which codons, within the native nucleotide sequence, are not statistically-favored with regards to a particular target cell, and modifying these codons in accordance with a codon usage table of the particular target cell to produce a codon optimized derivative. A modified nucleotide sequence may be fully or partially optimized for target cell codon usage provided that the protein encoded by the modified nucleotide sequence is produced at a level higher than the protein encoded by the corresponding naturally occurring or native gene. Additionally or alternatively, codon optimized/usage sequence can fold better than the protein encoded by the corresponding naturally occurring or native gene. Additionally or alternatively, codon optimized/usage sequence is targeted better to the target organelle(s) than the protein encoded by the corresponding naturally occurring or native gene. Additionally or alternatively, codon optimized/usage sequence is less degraded than the protein encoded by the corresponding naturally occurring or native gene.

For example, the following Table 5 of Toxoplasma codon usage can be used.

TABLE 5

| Triplet | Amino acid (one letter code) | Fraction | Frequency: per thousand |
|---|---|---|---|
| UUU | F | 0.35 | 13.3 |
| UUC | F | 0.65 | 25 |
| UUA | L | 0.03 | 2.6 |
| UUG | L | 0.17 | 14.5 |
| CUU | L | 0.17 | 15 |
| CUC | L | 0.31 | 27.1 |
| CUA | L | 0.04 | 3.8 |
| CUG | L | 0.28 | 24 |
| AUU | I | 0.38 | 12.2 |
| AUC | I | 0.53 | 17.4 |
| AUA | I | 0.09 | 2.9 |
| AUG | M | 1 | 18.3 |
| GUU | V | 0.22 | 14.7 |
| GUC | V | 0.38 | 25.4 |
| GUA | V | 0.08 | 5.7 |
| GUG | V | 0.32 | 21.4 |
| UCU | S | 0.23 | 20.3 |
| UCC | S | 0.17 | 15.2 |
| UCA | S | 0.09 | 8.1 |
| UCG | S | 0.22 | 19 |
| CCU | P | 0.27 | 15.4 |
| CCC | P | 0.24 | 13.6 |
| CCA | P | 0.18 | 10.4 |
| CCG | P | 0.3 | 17.3 |
| ACU | T | 0.22 | 12.3 |
| ACC | T | 0.24 | 13 |
| ACA | T | 0.24 | 13.2 |
| ACG | T | 0.3 | 16.4 |
| GCU | A | 0.21 | 20.5 |
| GCC | A | 0.24 | 22.6 |
| GCA | A | 0.22 | 20.8 |
| GCG | A | 0.33 | 31.5 |
| UAU | Y | 0.26 | 5.1 |
| UAC | Y | 0.74 | 14.5 |
| UAA | * | 0.34 | 0.6 |
| UAG | * | 0.23 | 0.4 |
| CAU | H | 0.37 | 7.9 |
| CAC | H | 0.63 | 13.4 |
| CAA | Q | 0.36 | 13.7 |
| CAG | Q | 0.64 | 24.5 |
| AAU | N | 0.35 | 10.1 |
| AAC | N | 0.65 | 18.9 |
| AAA | K | 0.38 | 18.4 |
| AAG | K | 0.62 | 29.8 |
| GAU | D | 0.32 | 16.3 |
| GAC | D | 0.68 | 34.3 |
| GAA | E | 0.45 | 32.7 |
| GAG | E | 0.55 | 40.6 |
| UGU | C | 0.37 | 7.2 |
| UGC | C | 0.63 | 12.4 |
| UGA | * | 0.43 | 0.8 |
| UGG | W | 1 | 10.8 |
| CGU | R | 0.12 | 8.2 |
| CGC | R | 0.25 | 17.5 |
| CGA | R | 0.18 | 12.7 |
| CGG | R | 0.14 | 10.1 |
| AGU | S | 0.11 | 9.3 |
| AGC | S | 0.18 | 16.1 |
| AGA | R | 0.18 | 12.8 |
| AGG | R | 0.12 | 8.7 |
| GGU | G | 0.18 | 14.6 |
| GGC | G | 0.36 | 28.5 |
| GGA | G | 0.27 | 21.4 |
| GGG | G | 0.18 | 14.6 |

Table 5.

According to some embodiments of the invention, the heterologous polynucleotide further comprises a nucleic acid sequence encoding a selectable marker.

According to some embodiments of the invention, the selectable marker comprises chloramphenicol acetyltransferase (CAT), DHFR-TS, BLE, HXGPRT, UPRT, TK, CD, a fluorescent protein (such as GFP, YFP, RFP, mCherry or other) or an epitope tag (such as HA, Myc, Ty-1, FLAG or other).

According to some embodiments of the invention, the selectable marker comprises HXGPRT.

Toxoplasma tachyzoites deficient in HXGPRT activity can be selected in the presence of 6-thioxanthine (6-TX), whereas strains expressing HXGPRT activity can be selected in mycophenolic acid (MPA) and/or xanthine (Pfefferkorn and Borotz, 1994, Pfefferkorn E. R., Borotz S. (1994) Exp. Parasitol. 79, 374-382).

According to some embodiments of the invention, the selectable marker comprises chloramphenicol acetyltransferase (CAT) (for positive selection using Chloramphenicol), DHFR-TS (for positive selection using Pyrethamine), BLE (for positive selection using Phleomycin), HXGPRT (for positive selection using Mycophenolic acid+xanthine or negative selection using 6-thioxanthine, UPRT (for negative selection using 5'-fluo-2'-deoxyuridine), TK (for positive selection using Ganciclovir), CD (for positive selection using 5-fluorocytosine), a fluorescent protein (such as GFP, YFP, RFP, mCherry or other) or an epitope tag (such as HA, Myc, Ty-1, FLAG or other).

According to some embodiments of the invention, the nucleic acid construct further comprises a third nucleic acid sequence encoding an inducible self-destruction element.

According to some embodiments of the invention, the inducible self destruction element is in the same frame as the therapeutic cassette.

According to some embodiments of the invention, the inducible self destruction element is in a separate reading frame, regulated by different regulatory elements. For instance, the therapeutic cassette can be driven by a latent-stage promoter, while the self-destruction cassette will be driven by a drug-inducible promoter.

According to some embodiments of the invention, the inducible self-destruction element is active in response to a drug.

According to some embodiments of the invention, the drug comprises an antibiotic.

According to some embodiments of the invention, the third nucleic acid sequence encoding the inducible self-destruction element is comprised in the same nucleic acid construct which comprises the heterologous polynucleotide comprising the first nucleic acid sequence encoding the Toxoplasma secreted protein in frame fused upstream to the second nucleic acid sequence encoding the pharmaceutical polypeptide.

According to some embodiments of the invention, the third nucleic acid sequence encoding the inducible self-destruction element is comprised in a separate nucleic acid construct with respect to the nucleic acid construct which comprises the heterologous polynucleotide comprising the first nucleic acid sequence encoding the Toxoplasma secreted protein in frame fused upstream to the second nucleic acid sequence encoding the pharmaceutical polypeptide.

According to some embodiments of the invention, the Toxoplasma untranslated region (UTR) nucleic acid sequence is upstream and/or downstream of the open reading frame of the selectable marker and/or of the self-destruction element.

According to an aspect of some embodiments of the present invention there is provided a nucleic acid construct system comprising at least two nucleic acid constructs, wherein a first nucleic acid construct of the at least two nucleic acid constructs is the nucleic acid construct of some embodiments of the invention, and a second nucleic construct of the at least two nucleic acid constructs comprises a polynucleotide encoding a selectable marker.

Typical cloning vectors may also contain a transcription and translation initiation sequence, transcription and translation terminator and a polyadenylation signal.

Following is a non-limiting list of Toxoplasma nucleic acid constructs which can be used as a backbone to generate the nucleic acid construct of some embodiments of the invention: pGRA, pUPRT, pROP1, pTUB1, pTUB8, pLIC, pTOXO, pMIC2, pHX, pCAT, pDHFR, pBlueScript, pTetO7SAG1, pTetO7SAG4, pSAG1, pSAG4, pHTU, pTKO, pLoxP-DHFR, pminCAT/HXGPRT+, pminCAT/HXGPRT−, pDHFR-TSc3/M3, pDHFR-TSc3/M2M3, pminiHXGPRT, and pUC19. These vectors can be obtained from various sources, such as the nonprofit plasmid repository "addgene"; the NIH AIDS Reagent Program; Agilent Technologies; NEB; Thermo Fisher Scientific; Sigma Aldrich; GenScript; and MoBiTec GmbH.

Table 6 hereinbelow provides non-limiting exemplary vectors and catalogue numbers.

TABLE 6

Vector Backbones

| Construct name | Manufacturer | Catalogue number |
|---|---|---|
| pLIC | Addgene | 27989 |
| pCAT | Addgene | 59018 |
| pTetO7SAG1 | Addgene | 59017 |
| pSAG1 | Addgene | 54467 |
| pUPRT | Addgene | 58528 |
| pLoxP-DHFR | Addgene | 70147 |
| pminCAT/HXGPRT+ | NIH AIDS Reagent Program | 2850 |
| pminCAT/HXGPRT− | NIH AIDS Reagent Program | 2851 |
| pDHFR-TSc3/M3 | NIH AIDS Reagent Program | 2853 |
| pDHFR-TSc3/M2M3 | NIH AIDS Reagent Program | 2854 |
| pminiHXGPRT | NIH AIDS Reagent Program | 2855 |
| pBlueScript | Agilent Technologies | 200252, 200251, 212205, 212206, 212207, 212208, 212240, 212250 |
| pUC19 | Addgene;<br>NEB;<br>Thermo Fisher Scientific;<br>Sigma Aldrich;<br>MoBiTec GmbH | 50005;<br>N3041;<br>SD0061;<br>D3404;<br>V33202 |

Table 6.

According to an aspect of some embodiments of the present invention there is provided a Toxoplasma transformed with the nucleic acid construct of some embodiments of the invention or with the nucleic acid construct system of some embodiments of the invention.

As used herein the term "Toxoplasma" refers to the intracellular, parasitic protozoan *Toxoplasma gondii.*

Non-limiting examples of a *Toxoplasma gondii* strains which can be used along with the construct and methods of some embodiments of the invention include:

(i) Type I—including but not limited to: GT1, RH, ENT, VEL, TgCatCo1 and CAST.

(ii) Type II—including but not limited to: ME49, Beverly, PDS, PLK, PTG, DEG, PIH, TgNmBr1 and PRU.

(iii) Type III—including but not limited to: VEG, C56, CTG, CEP, TgGoatUS4 and STRL.

(iv) Type Atypical—including but not limited to: TgCT-PrC3, TgBbUS1, TgRabbitBr1 and TgPigUS15.

According to some embodiments of the invention, the Toxoplasma is not attenuated.

As is conventional in the art, the term "attenuated" refers to a weakened and/or less vigorous strain of *T. gondii* as compared to a native (wild type) *T. gondii* which is non-genetically modified. Usually, an attenuated mutant of *T. gondii* is capable of stimulating an immune response and creating immunity but not causing illness. Attenuation can be achieved by conventional methods including, but not limited, to γ-irradiation or the generation of a pyrimidine auxotroph.

Non-limiting examples of attenuated Toxoplasma are described in US 20120045477 Al and U.S. Pat. No. 8,673,289 B2, which are fully incorporated herein by reference.

It should be noted that *T. gondii* replication is essential for its ability to disseminate in the body and reach distal tissues during the acute stage of infection, its ability to persist in the infected cells and its ability to establish chronic cysts in the host.

According to some embodiments of the invention, the Toxoplasma of some embodiments of the invention is characterized by a higher proliferation rate as compared to the proliferation rate of an attenuated Toxoplasma.

According to some embodiments of the invention, the Toxoplasma of some embodiments of the invention is not an auxotroph.

According to some embodiments of the invention, the Toxoplasma of some embodiments of the invention comprises a functional endogenous pathway suitable for de-novo biosynthesis of pyrimidines.

According to some embodiments of the invention, the Toxoplasma of some embodiments of the invention is capable of differentiation into the Bradizoite stage.

According to some embodiments of the invention, the Toxoplasma of some embodiments of the invention is capable of RNA synthesis and/or DNA replication.

According to some embodiments of the invention, the Toxoplasma of some embodiments of the invention is capable of RNA synthesis.

According to some embodiments of the invention, the Toxoplasma of some embodiments of the invention is capable of DNA replication.

According to some embodiments of the invention, the Toxoplasma of some embodiments of the invention comprises an endogenous functional Carbamoyl phosphate synthetase II (CPSII) enzyme (as described in U.S. Pat. No. 8,673,289), e.g., as provided in any of SEQ ID NOs: 4612-4617.

The constructs and Toxoplasma of some embodiments of the invention can be used to deliver a protein-of-interest into the subject, e.g., into a specific tissue or cell type of the subject.

According to an aspect of some embodiments of the present invention there is provided a method of administering a protein-of-interest into a tissue-of-interest of a subject, the method comprising administering to the subject the Toxoplasma of some embodiments of the invention or the pharmaceutical composition of some embodiments of the invention, thereby administering the protein-of-interest to the tissue-of-interest of the subject.

Examples of tissue-of-interest include, but are not limited to, a central nervous system, muscles, parts of the eye, blood, lymph nodes, spleen, white blood cells, digestive system, and lamina propria.

It should be noted that since the Toxoplasma can cross the blood brain barrier it can deliver the protein-of-interest into the central nervous system of the subject in need thereof.

According to an aspect of some embodiments of the present invention there is provided a method of administering a protein-of-interest into a central nervous system of a subject, the method comprising administering to the subject the Toxoplasma of some embodiments of the invention or the pharmaceutical composition of some embodiments of the invention, thereby administering the protein-of-interest to the central nervous system of the subject.

Thus, the Toxoplasma of some embodiments of the invention can be used to treat a subject in need thereof by delivering a protein-of-interest (e.g., a therapeutic polypeptide) which is capable of treating the subject.

According to an aspect of some embodiments of the present invention there is provided a method of treating a subject in need thereof, comprising administering to the subject the Toxoplasma of some embodiments of the invention or the pharmaceutical composition of some embodiments of the invention, wherein the subject is diagnosed with a pathology treatable by administration of the pharmaceutical polypeptide in a central nervous system of the subject, thereby treating the subject in need thereof.

According to an aspect of some embodiments of the present invention there is provided a method of treating a subject in need thereof, comprising administering to the subject a Toxoplasma comprising a nucleic acid construct which comprises a heterologous polynucleotide comprising a first nucleic acid sequence encoding a Toxoplasma secreted protein in frame fused upstream to a second nucleic acid sequence encoding a pharmaceutical polypeptide, wherein the heterologous polynucleotide is operably linked to a promoter for directing transcription of the heterologous polynucleotide in a Toxoplasma, wherein the subject is diagnosed with a pathology treatable by administration of the pharmaceutical polypeptide in a central nervous system of the subject, thereby treating the subject in need thereof.

The term "treating" refers to inhibiting, preventing or arresting the development of a pathology (disease, disorder or condition) and/or causing the reduction, remission, or regression of a pathology. Those of skill in the art will understand that various methodologies and assays can be used to assess the development of a pathology, and similarly, various methodologies and assays may be used to assess the reduction, remission or regression of a pathology.

As used herein, the term "preventing" refers to keeping a disease, disorder or condition from occurring in a subject who may be at risk for the disease, but has not yet been diagnosed as having the disease.

As used herein, the term "subject" includes mammals, preferably human beings at any age which suffer from the pathology. Preferably, this term encompasses individuals who are at risk to develop the pathology.

According to some embodiments of the invention, the subject is diagnosed with a pathology characterized by a deficient endogenous protein in a central nervous system of a subject.

According to some embodiments of the invention, the deficient endogenous protein comprises a deletion, insertion, and/or substitution of at least one amino acid of the endogenous protein as compared to a wild type amino acid sequence of the endogenous protein.

According to some embodiments of the invention, the deficient endogenous protein comprises a reduced level of the endogenous protein as compared to a level of the endogenous protein in a healthy subject devoid of the pathology.

According to some embodiments of the invention, the deficient endogenous protein is absence of the endogenous protein in the subject diagnosed with the pathology.

According to some embodiments of the invention, the subject is diagnosed with Krabbe disease.

According to some embodiments of the invention, the subject is diagnosed with Rett syndrome.

According to some embodiments of the invention, the subject is diagnosed with Canavan disease.

According to some embodiments of the invention, the subject is diagnosed with Spinal Muscular Atrophy.

According to some embodiments of the invention, the subject is diagnosed with Parkinson's disease.

According to some embodiments of the invention, the subject is diagnosed with hypoxic/ischemic or neuroinflammatory CNS disorder.

According to some embodiments of the invention, the subject is diagnosed with Alzheimer's disease.

According to some embodiments of the invention, the subject is diagnosed with Amyotrophic Lateral Sclerosis.

According to some embodiments of the invention, the subject is diagnosed with Huntington's disease.

According to some embodiments of the invention, the subject is diagnosed with a lysosomal storage disease.

According to some embodiments of the invention, the subject is diagnosed with MECP2-duplication syndrome.

According to some embodiments of the invention the subject does not a have a compromised immune system. Examples of subjects with compromised immune system include, but are not limited to AIDS patients, subjects receiving chemotherapy, subjects receiving immunosuppressant drugs such as for cell, tissue and/or organ transplantation.

According to some embodiments of the invention, the method further comprising administering to the subject a drug capable of inducing the self-destruction element.

According to some embodiments of the invention, the method further comprising administering to the subject a molecule necessary for sustaining the Toxoplasma inside the host cell and/or body.

According to some embodiments of the invention, the molecule necessary for sustaining the Toxoplasma is an antibiotic.

According to some embodiments of the invention, the molecule necessary for sustaining the Toxoplasma is a small-molecule.

According to some embodiments of the invention, the molecule necessary for sustaining the Toxoplasma is a metabolite.

According to some embodiments of the invention, the method further comprises administering to the subject an immunosuppression drug prior to administration of the Toxoplasma and/or subsequent to administration of the Toxoplasma and/or concomitantly with administration of the Toxoplasma to the subject.

According to some embodiments of the invention, the method further comprises administering to the subject an immunosuppression drug prior to administration of the Toxoplasma to the subject.

According to some embodiments of the invention, the method further comprises administering to the subject an immunosuppression drug subsequent (or following) to administration of the Toxoplasma to the subject.

According to some embodiments of the invention, the method further comprises administering to the subject an immunosuppression drug concomitantly with administration of the Toxoplasma to the subject.

According to some embodiments of the invention, administering is performed by peripheral administration.

According to some embodiments of the invention, the peripheral administration comprises intravenous administration.

According to some embodiments of the invention, the peripheral administration comprises oral administration.

According to some embodiments of the invention, administering is performed by intraperitoneal injection.

According to some embodiments of the invention, administering is performed by intramuscular injection.

According to some embodiments of the invention, administering is performed by aerosols.

According to some embodiments of the invention, administering is performed by direct administration to the central nervous system or an adjacent tissue thereof.

According to some embodiments of the invention, the disease which is treated by the methods of some embodiments of the invention, e.g., using the Toxoplasma and/or the pharmaceutical composition comprising same is any of the diseases listed in Table 7 hereinabove.

Table 7 lists non-limiting diseases associated with deficient or abnormal expression or function of the endogenous proteins, which can be treated by administration of the therapeutic polypeptide of some embodiments of the invention.

TABLE 7

| Gene Name/Symbol | Associated disease |
| --- | --- |
| TFEB | Lysosomal storage diseases and neurodegenerative diseases |
| HGSNAT | Mucopolysaccharidosis 3C (Sanfilippo syndrome C) |
| MEF2C | Parkinson's disease |
| NRTN | Parkinson's disease |
| PGF | Traumatic Brain Injury, hypoxic/ischaemic CNS disorders, neuroinflammatory diseases, including stroke and neurodegenerative conditions. |
| RPE65 | Leber congenital amaurosis, retinitis pigmentosa |
| GDNF | Parkinson's disease, Supranuclear Palsy, Multiple sclerosis, Alzheimers disease, Amyotrophic Lateral Sclerosis, Huntington's disease, retinal degenerations, Traumatic Brain Injury, hypoxic/ischaemic CNS disorders, neuroinflammatory diseases, including stroke and neurodegenerative conditions. |
| CNGB3 | Achromatopsia |
| BDNF | Amyotrophic Lateral Sclerosis, Huntington's disease, Alzheimer's disease, Spinal Cord Injury, Obesity, Lysosomal storage disorders. |
| APP | Traumatic Brain Injury, hypoxic/ischaemic CNS disorders, neuroinflammatory diseases, including stroke and neurodegenerative conditions. |
| ASPA | Canavan disease |
| S1PR1 | Multiple sclerosis |
| IDS | Mucopolysaccharidosis type II (Hunter Syndrome, iduronate sulfatase deficiency) |
| HTRA2 | Parkinson's disease, Alzheimer's disease |
| CDNF | Parkinson's Disease, Alzheimers Disease, Amyotrophic Lateral Sclerosis |
| DNAJC5 | neurodegenerative disorders |
| IDUA | Mucopolysaccharidosis type I (Hurler syndrome, Hurler-Scheie syndrome, Scheie syndrome) |
| SPON1 | Alzheimer's disease |
| NMNAT2 | disorders involving axonal degenerations, such as Taxol-induced neuropathy, multiple sclerosis, some viral disorders, Traumatic Brain Injury, hypoxic/ischaemic CNS disorders, neuroinflammatory diseases, including stroke and neurodegenerative conditions. |
| FMR1 | Fragile X syndrome |
| MECP2 | Rett syndrome |
| GNS | Mucopolysaccharidosis 3D (Sanfilippo syndrome D) |
| VEGFB | Traumatic Brain Injury, hypoxic/ischaemic CNS disorders, neuroinflammatory diseases, including stroke and neurodegenerative conditions. |
| HIF1A | Alzheimer's disease |
| SERPINF1 | Parkinson's Disease, Amyotrophic Lateral Sclerosis, Multiple Sclerosis, Traumatic Brain Injury, hypoxic/ischaemic CNS disorders, neuroinflammatory diseases, including stroke and neurodegenerative conditions. |

TABLE 7-continued

| Gene Name/Symbol | Associated disease |
|---|---|
| VEGFA | Traumatic Brain Injury, hypoxic/ischaemic CNS disorders, neuroinflammatory diseases, including stroke and neurodegenerative conditions. |
| STC1 | retinal degeneration, optic nerve diseases, Traumatic Brain Injury, hypoxic/ischaemic CNS disorders, neuroinflammatory diseases, including stroke and neurodegenerative conditions. |
| NGB | optic atrophy, Traumatic Brain Injury, hypoxic/ischaemic CNS disorders, neuroinflammatory diseases, including stroke and neurodegenerative conditions. |
| NFE2L2 | |
| MAPK7 | Alzheimer's disease |
| NMNAT1 | Parkinsons disease, Leber Congenital Amaurosis, Traumatic Brain Injury, hypoxic/ischaemic CNS disorders, neuroinflammatory diseases, including stroke and neurodegenerative conditions. |
| NGF | Amyotrophic Lateral Sclerosis, Alzheimer's disease, down syndrome, sensory neuropathies |
| NAGLU | Mucopolysaccharidosis 3B (Sanfilippo syndrome B) |
| CLU | Alzheimer's disease, Traumatic Brain Injury, hypoxic/ischaemic CNS disorders, neuroinflammatory diseases, including stroke and neurodegenerative conditions. |
| MME | Alzheimer's disease |
| CTSA | Galactosialidosis |
| PPT1 | ceroid lipofuscinosis neuronal type 1 (Batten disease) |
| TIMP2 | Multiple sclerosis, Alzheimer's disease, and Huntington's disease, Parkinson's disease, Traumatic Brain Injury, hypoxic/ischaemic CNS disorders, neuroinflammatory diseases, including stroke and neurodegenerative conditions. |
| MANF | Parkinson's disease, retinitis pigmentosa, retinal artery occlusion, diabetes, Wolfram's syndrome, Alzheimer's disease, Traumatic Brain Injury, hypoxic/ischaemic CNS disorders, neuroinflammatory diseases, including stroke and neurodegenerative conditions. |
| TIMP1 | Traumatic Brain Injury, hypoxic/ischaemic CNS disorders, neuroinflammatory diseases, including stroke and neurodegenerative conditions. |
| GAD2 | Parkinson's disease |
| GALC | Krabbe disease (globoid cell leukodystrophy) |
| GAD1 | Parkinson's disease |
| NTF3 | Charcot-Marie-Tooth disease, multiple sclerosis, Spinal Cord Injury, X-linked adrenoleukodystrophy, diabetic neuropathies, axonal neuropathies, Traumatic Brain Injury, hypoxic/ischaemic CNS disorders, neuroinflammatory diseases, including stroke and neurodegenerative conditions. |
| GUSB | Sly syndrome |
| HGF | amyotrophic lateral sclerosis |
| SERPINI1 | Traumatic Brain Injury, hypoxic/ischaemic CNS disorders, neuroinflammatory diseases, including stroke and neurodegenerative conditions. |
| RGS2 | anxiety disorders |
| NPY | epilepsy, Post-Traumatic Stress Disorder |
| UCP2 | acute and excitotoxic brain injury, Parkinsons disease, |
| SST | epilepsy, alzheimer's disease, |
| SGSH | Mucopolysaccharidosis 3A (Sanfilippo syndrome A) |
| CYP2J2 | Traumatic Brain Injury, hypoxic/ischaemic CNS disorders, neuroinflammatory diseases, including stroke and neurodegenerative conditions. |
| GM2A | GM2 gangliosidoses (Tay-Sachs disease (TSD), Sandhoff-Jatzkewitz disease, GM2 activator deficiency) |
| HEXA | GM2 gangliosidoses (Tay-Sachs disease (TSD), Sandhoff-Jatzkewitz disease, GM2 activator deficiency) |
| UCH11 | Alzheimer's disease |
| HEXB | GM2 gangliosidoses (Tay-Sachs disease (TSD), Sandhoff-Jatzkewitz disease, GM2 activator deficiency) |
| PINK1 | Parkinson's disease |
| PRDX3 | Amyotrophic Lateral Sclerosis, parkinsons disease, alzheimers disease |
| PRDX1 | Traumatic Brain Injury, hypoxic/ischaemic CNS disorders, neuroinflammatory diseases, including stroke and neurodegenerative conditions. |
| GLB1 | GM1 gangliosidosis |
| TPP1 | ceroid lipofuscinosis neuronal type 2 (Batten disease) |
| ANG | Amyotrophic Lateral Sclerosis, Parkinson's disease |
| HMOX1 | Alzheimer's (AD), Parkinson's (PD), Traumatic Brain Injury, hypoxic/ischaemic CNS disorders, neuroinflammatory diseases, including stroke and neurodegenerative conditions. |

TABLE 7-continued

| Gene Name/Symbol | Associated disease |
|---|---|
| NRG1 | Charcot-Marie-Tooth disease, Traumatic Brain Injury, hypoxic/ischaemic CNS disorders, neuroinflammatory diseases, including stroke and neurodegenerative conditions. |
| NFIL3 | Amyotrophic Lateral Sclerosis |
| MAN2B1 | alpha-Mannosidosis |
| DHCR24 | Alzheimer's disease. |
| DDC | Parkinson's disease, Aromatic L-amino-acid decarboxylase deficiency |
| TP53 | Brain tumors (Astrocytic tumours, Oligodendroglial tumours, Oligoastrocytic tumours, Ependymal tumours, Choroid plexus tumours, Other neuroepithelial tumours (Astroblastoma, Chordoid glioma of the third ventricle, Angiocentric glioma), Neuronal and mixed neuronal-glial tumours, Tumours of the pineal region, Embryonal tumours, Tumours of cranial and paraspinal nerves (Schwannoma, Neurofibroma, Perineurioma, Malignant peripheral nerve sheath tumour), Tumours of meningothelial cells, Mesenchymal tumours, Primary melanocytic lesions, Other neoplasms related to the meninges (Haemangioblastoma), Tumors of the haematopoietic system (Malignant Lymphomas, Plasmocytoma, Granulocytic sarcoma), Germ cell tumours (Germinoma, Embryonal carcinoma, Yolk sac tumour, Choriocarcinoma, Teratoma, Mixed germ cell tumours), Tumours of the sellar region (craniopharyngioma, Granular cell tumour, Pituicytoma, Spindle cell oncocytoma of the adenohypophysis), Metastatic Tumours). |
| ADNP | Alzheimer's disease, Amyotrophic Lateral Sclerosis, frontotemporal degeneration/dementia (FTD), Traumatic Brain Injury, hypoxic/ischaemic CNS disorders, neuroinflammatory diseases, including stroke and neurodegenerative conditions. |
| GAN | Giant Axonal Neuropathy |
| GAL | epilepsy, Alzheimer's disease, opiate addiction/withdrawel |
| SMN1 | Spinal muscular atrophy |
| PROC | Amyotrophic Lateral Sclerosis, Alzheimer's disease, multiple sclerosis, Traumatic Brain Injury, hypoxic/ischaemic CNS disorders, neuroinflammatory diseases, including stroke and neurodegenerative conditions. |
| TRAP1 | Parkinson's disease, Traumatic Brain Injury, hypoxic/ischaemic CNS disorders, neuroinflammatory diseases, including stroke and neurodegenerative conditions. |
| I118BP | Traumatic Brain Injury, hypoxic/ischaemic CNS disorders, neuroinflammatory diseases, including stroke and neurodegenerative conditions. |
| PRDX6 | Alzheimer's disease, Parkinson's disease, Traumatic Brain Injury, hypoxic/ischaemic CNS disorders, neuroinflammatory diseases, including stroke and neurodegenerative conditions. |
| TXN | Traumatic Brain Injury, hypoxic/ischaemic CNS disorders, neuroinflammatory diseases, including stroke and neurodegenerative conditions. |
| GAA | Pompe disease |
| GHRL | Alzheimer's disease, Parkinson's disease, Traumatic Brain Injury, hypoxic/ischaemic CNS disorders, neuroinflammatory diseases, including stroke and neurodegenerative conditions. |
| CSF3 | Parkinson's Disease, Amyotrophic Lateral Sclerosis, Cerebral Palsy, Alzheimer's disease, Traumatic Brain Injury, hypoxic/ischaemic CNS disorders, neuroinflammatory diseases, including stroke and neurodegenerative conditions. |
| UBE3A | Angelman syndrome |
| ABCD1 | Adrenoleukodystrophy |
| NDP | Norrie disease, familial exudative vitreoretinopathy (FEVR), inner ear diseases |
| TH | Parkinson's disease |
| GCH1 | Parkinson's disease |
| BCL2 | Amyotrophic lateral sclerosis, Parkinson's disease, Traumatic Brain Injury, hypoxic/ischaemic CNS disorders, neuroinflammatory diseases, including stroke and neurodegenerative conditions. |
| ENO2 | Alzheimers disease |
| EPO | Parkinson's disease, multiple sclerosis, Traumatic Brain Injury, hypoxic/ischaemic CNS disorders, neuroinflammatory diseases, including stroke and neurodegenerative conditions. |
| GBA | Gaucher disease |
| AGA | Aspartylglucosaminuria |
| UPF1 | Amyotrophic Lateral Sclerosis |

TABLE 7-continued

| Gene Name/Symbol | Associated disease |
| --- | --- |
| PSAP | Parkinson's disease, demyelination disorders, Traumatic Brain Injury, hypoxic/ischaemic CNS disorders, neuroinflammatory diseases, including stroke and neurodegenerative conditions. |
| ANXA1 | Traumatic Brain Injury, hypoxic/ischaemic CNS disorders, neuroinflammatory diseases, including stroke and neurodegenerative conditions. |
| IGF1 | Amyotrophic Lateral Sclerosis, Traumatic Brain Injury, hypoxic/ischaemic CNS disorders, neuroinflammatory diseases, including stroke and neurodegenerative conditions. |
| IGF2 | Alzheimer's disease |
| PARK2 | Parkinson's disease, Traumatic Brain Injury, hypoxic/ischaemic CNS disorders, neuroinflammatory diseases, including stroke and neurodegenerative conditions. |
| FUCA1 | Fucosidosis |
| SIRT1 | Huntington's disease, amyotrophic lateral sclerosis, Parkinson's disease, Alzheimer disease, Frontotemporal dementia, Traumatic Brain Injury, hypoxic/ischaemic CNS disorders, neuroinflammatory diseases, including stroke and neurodegenerative conditions. |
| PARK7 | Amyotrophic Lateral Sclerosis, Parkinsons disease |
| ANXA2 | Traumatic Brain Injury, hypoxic/ischaemic CNS disorders, neuroinflammatory diseases, including stroke and neurodegenerative conditions. |
| GCG | Brain insulin resistance in Alzheimer's disease, Parkinson's disease, Amyotrophic Lateral Sclerosis |
| LEP | Alzheimer's disease, Obesity, Traumatic Brain Injury, hypoxic/ischaemic CNS disorders, neuroinflammatory diseases, including stroke and neurodegenerative conditions. |
| SH3BP5 | Alzheimer's disease. |
| CNTF | Parkinson's disease, Supranuclear Palsy, Multiple sclerosis, Alzheimers disease, Amyotrophic Fateral Sclerosis, Huntington's disease, retinal degenerations, Traumatic Brain Injury, hypoxic/ischaemic CNS disorders, neuroinflammatory diseases, including stroke and neurodegenerative conditions. |
| GLA | Fabry disease |
| KCNN3 | Alzheimer's disease |
| ARSA | Metachromatic leukodystrophy, Multiple sulfatase deficiency |
| SUMF1 | Multiple sulfatase deficiency, Mucopolysaccharidosis Type III A (Sanfilippo Disease Type A) |
| CRH | cerebral oedema |
| SMPD1 | Niemann-Pick disease |

Table 7.

According to some embodiments of the invention, the disease (pathology) is not cancer.

The nucleic acid construct, the nucleic acid construct system or the Toxoplasma transformed with the nucleic acid construct or with the nucleic acid construct system of some embodiments of the invention can be administered to an organism per se, or in a pharmaceutical composition where it is mixed with suitable carriers or excipients.

According to an aspect of some embodiments of the present invention there is provided a pharmaceutical composition comprising the Toxoplasma of some embodiments of the invention, and a pharmaceutically acceptable carrier.

According to some embodiments of the invention, the pharmaceutical composition is for treating a subject diagnosed with any of the pathologies described herein.

According to some embodiments of the invention, the pharmaceutical composition is for treating a subject diagnosed with a pathology characterized by a deficient endogenous protein in a central nervous system of a subject.

According to some embodiments of the invention, the pharmaceutical composition is for treating a subject diagnosed with a pathology which is treatable by administration of the pharmaceutical polypeptide in a central nervous system of a subject.

According to some embodiments of the invention, the pharmaceutical composition further comprises an immunosuppression agent.

As used herein a "pharmaceutical composition" refers to a preparation of one or more of the active ingredients described herein with other chemical components such as physiologically suitable carriers and excipients. The purpose of a pharmaceutical composition is to facilitate administration of a compound to an organism.

Herein the term "active ingredient" refers to the nucleic acid construct, the nucleic acid construct system or the toxoplasma transformed with the nucleic acid construct or with the nucleic acid construct system of some embodiments of the invention accountable for the biological effect.

Hereinafter, the phrases "physiologically acceptable carrier" and "pharmaceutically acceptable carrier" which may be interchangeably used refer to a carrier or a diluent that does not cause significant irritation to an organism and does not abrogate the biological activity and properties of the administered compound. An adjuvant is included under these phrases.

Herein the term "excipient" refers to an inert substance added to a pharmaceutical composition to further facilitate administration of an active ingredient. Examples, without limitation, of excipients include calcium carbonate, calcium phosphate, various sugars and types of starch, cellulose derivatives, gelatin, vegetable oils and polyethylene glycols.

Techniques for formulation and administration of drugs may be found in "Remington's Pharmaceutical Sciences,"

Mack Publishing Co., Easton, Pa., latest edition, which is incorporated herein by reference.

Suitable routes of administration may, for example, include oral, rectal, transmucosal, especially transnasal, intestinal or parenteral delivery, including intramuscular, subcutaneous and intramedullary injections as well as intrathecal, direct intraventricular, intracardiac, e.g., into the right or left ventricular cavity, into the common coronary artery, intravenous, intraperitoneal, intranasal, or intraocular injections.

Conventional approaches for drug delivery to the central nervous system (CNS) include: neurosurgical strategies (e.g., intracerebral injection or intracerebroventricular infusion); molecular manipulation of the agent (e.g., production of a chimeric fusion protein that comprises a transport peptide that has an affinity for an endothelial cell surface molecule in combination with an agent that is itself incapable of crossing the BBB) in an attempt to exploit one of the endogenous transport pathways of the BBB; pharmacological strategies designed to increase the lipid solubility of an agent (e.g., conjugation of water-soluble agents to lipid or cholesterol carriers); and the transitory disruption of the integrity of the BBB by hyperosmotic disruption (resulting from the infusion of a mannitol solution into the carotid artery or the use of a biologically active agent such as an angiotensin peptide).

Alternately, one may administer the pharmaceutical composition in a local rather than systemic manner, for example, via injection of the pharmaceutical composition directly into a tissue region of a patient.

The term "tissue" refers to part of an organism consisting of cells designed to perform a function or functions. Examples include, but are not limited to, brain tissue, retina, skin tissue, hepatic tissue, pancreatic tissue, bone, cartilage, connective tissue, blood tissue, muscle tissue, cardiac tissue, vascular tissue, renal tissue, pulmonary tissue, gonadal tissue, hematopoietic tissue.

Pharmaceutical compositions of some embodiments of the invention may be manufactured by processes well known in the art, e.g., by means of conventional mixing, dissolving, culturing, granulating, dragee-making, levigating, emulsifying, encapsulating, entrapping or lyophilizing processes. For example, manufacturing of toxoplasma can be by culturing the toxoplasma in cell cultures.

Pharmaceutical compositions for use in accordance with some embodiments of the invention thus may be formulated in conventional manner using one or more physiologically acceptable carriers comprising excipients and auxiliaries, which facilitate processing of the active ingredients into preparations which, can be used pharmaceutically. Proper formulation is dependent upon the route of administration chosen.

For injection, the active ingredients of the pharmaceutical composition may be formulated in aqueous solutions, preferably in physiologically compatible buffers such as Hank's solution, Ringer's solution, or physiological salt buffer. For transmucosal administration, penetrants appropriate to the barrier to be permeated are used in the formulation. Such penetrants are generally known in the art.

For oral administration, the pharmaceutical composition can be formulated readily by combining the active compounds with pharmaceutically acceptable carriers well known in the art. Such carriers enable the pharmaceutical composition to be formulated as tablets, pills, dragees, capsules, liquids, gels, syrups, foodstuff, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP). If desired, disintegrating agents may be added, such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active ingredients may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the compositions may take the form of tablets or lozenges formulated in conventional manner.

For administration by nasal inhalation, the active ingredients for use according to some embodiments of the invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

The pharmaceutical composition described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain formulatory agents such as suspending, stabilizing and/or dispersing agents.

Pharmaceutical compositions for parenteral administration include aqueous solutions of the active preparation in water-soluble form. Additionally, suspensions of the active ingredients may be prepared as appropriate oily or water based injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran.

Optionally, the suspension may also contain suitable stabilizers or agents which increase the solubility of the active ingredients to allow for the preparation of highly concentrated solutions.

Alternatively, the active ingredient may be in powder form for constitution with a suitable vehicle, e.g., sterile, pyrogen-free water based solution, before use.

The pharmaceutical composition of some embodiments of the invention may also be formulated in rectal compositions such as suppositories or retention enemas, using, e.g., conventional suppository bases such as cocoa butter or other glycerides.

Pharmaceutical compositions suitable for use in context of some embodiments of the invention include compositions wherein the active ingredients are contained in an amount effective to achieve the intended purpose. More specifically, a therapeutically effective amount means an amount of active ingredients (e.g., the nucleic acid construct, the nucleic acid construct system or the toxoplasma transformed with the nucleic acid construct or with the nucleic acid construct system of some embodiments of the invention) effective to prevent, alleviate or ameliorate symptoms of a disorder (e.g., a disorder affecting the central nervous system of the subject) or prolong the survival of the subject being treated.

Determination of a therapeutically effective amount is well within the capability of those skilled in the art, especially in light of the detailed disclosure provided herein.

For any preparation used in the methods of the invention, the therapeutically effective amount or dose can be estimated initially from in-vitro assays, ex-vivo assays, cell culture assays, and/or animal models. For example, a dose can be formulated in animal models to achieve a desired concentration or titer. Such information can be used to more accurately determine useful doses in humans.

Toxicity and therapeutic efficacy of the active ingredients described herein can be determined by standard pharmaceutical procedures in vitro, in cell cultures or experimental animals. The data obtained from these in vitro and cell culture assays and animal studies can be used in formulating a range of dosage for use in human. The dosage may vary depending upon the dosage form employed and the route of administration utilized. The exact formulation, route of administration and dosage can be chosen by the individual physician in view of the patient's condition. (See e.g., Fingl, et al., 1975, in "The Pharmacological Basis of Therapeutics", Ch. 1 p. 1).

Dosage amount and interval may be adjusted individually to provide tissue levels (e.g., brain levels) of the active ingredient which are sufficient to induce or suppress the biological effect (minimal effective concentration, MEC). The MEC may vary for each preparation, but can be estimated from in vitro data. Dosages necessary to achieve the MEC will depend on individual characteristics and route of administration. Detection assays can be used to determine plasma, tissue or CSF (cerebro-spinal fluid) concentrations.

Depending on the severity and responsiveness of the condition to be treated, dosing can be of a single or a plurality of administrations, with course of treatment lasting from several days to several weeks, or e.g., a lifetime in the case of chronic diseases, or until cure is effected or diminution of the disease state is achieved.

For example, for chronic diseases, the dosing can be adjusted until symptoms are managed, stabilized and/or ameliorated.

The amount of a composition to be administered will, of course, be dependent on the subject being treated, the severity of the affliction, the manner of administration, the immune state of the subject, the judgment of the prescribing physician, etc.

Compositions of some embodiments of the invention may, if desired, be presented in a pack or dispenser device, such as an FDA approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the U.S. Food and Drug Administration for prescription drugs or of an approved product insert. Compositions comprising a preparation of the invention formulated in a compatible pharmaceutical carrier may also be prepared, placed in an appropriate container, and labeled for treatment of an indicated condition, as is further detailed above.

As used herein the term "about" refers to ±10%

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof. Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

When reference is made to particular sequence listings, such reference is to be understood to also encompass sequences that substantially correspond to its complementary sequence as including minor sequence variations, resulting from, e.g., allelic variation, sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. *Toxoplasma gondii*: the model apicomplexan—Perspectives and methods. L M Weiss, K Kim, 2011. Other general references are provided throughout this document. The procedures therein are believed to be well known in the art and are provided for the convenience of the reader. All the information contained therein is incorporated herein by reference.

General Materials and Experimental Methods

*Toxoplasma gondii* Culture

Parasites were grown on human foreskin fibroblasts (HFF) in Dulbecco's modified Eagle's medium (DMEM) supplemented with 2 mM L-Glutamine, Penicillin and Streptomycin or Gentamicin antibiotic mix and 10% Fetal Bovine Serum (FBS), thereby referred to as "complete DMEM media". Cultures were monitored daily, and the parasites were passaged by transferring a drop of the supernatant of a lysed dish or a drop of syringe-released intracellular parasites into a fresh dish with HFF.

Generation of *T. gondii* Expression Vectors for Expression of Heterologous Polypeptides Comprised of a Toxoplasma Secreted Protein Fused to a Pharmaceutical Polypeptide-of-Interest In order to generate stable transgenic lines of *T. gondii* that express specific therapeutic proteins, the present inventors first generated *T. gondii* expression constructs by molecular cloning. The constructs include a long open reading frame (ORF), which consists of Toxofilin cDNA [SEQ ID NO: 4481] or GRA16 cDNA [SEQ ID NO: 4472] followed by an HA tag coding sequence (SEQ ID NO: 4474) followed by the therapeutic mammalian cDNA of interest, such as the murine MeCP2 isoform 1 [SEQ ID NO: 4476]; the human ASPA [SEQ ID NO: 4483], the human SMN1 [SEQ ID NO: 4479]; the human PARK2 [SEQ ID NO: 4478]; the human GDNF [SEQ ID NO: 4489]; the human TFEB (Transcription factor EB) isoform 1 [SEQ ID NO: 4600] sequence; the human GALC isoform 1 [SEQ ID NO:4486 or SEQ ID NO:4601 (GALC version 2); the GALC-TAT that includes a Glycine flexible linker (Gly) [SEQ ID NO:4490] followed by a protein transduction domain (TAT) that facilitates nonclassical trafficking across membranes in order to aid the targeting of GALC to the lysosome of the host cell (SEQ ID NO: 4488) or the "mutated GALC-TAT" (GALC-TAT that harbors a deletion) (SEQ ID NO: 4487). The cDNA of interest can also be codon-optimized according to the codon usage of *T. gondii* in order to increase efficiency of expression, stability and localization of the heterologous polypeptide in *T. gondii* (such as with the codon optimized murine MeCP2 isoform 1 [SEQ ID NO: 4477], codon optimized human ASPA [SEQ ID NO: 4602], codon optimized human GALC isoform 1 [SEQ ID NO: 4603] and codon optimized human TFEB isoform 1 [SEQ ID NO: 4604] codon optimized for expression in *T. gondii*). The *T. gondii* expression vector also includes regulatory elements from the same or other Toxoplasma genes that guarantee its correct expression and targeting. Upstream of the ORF is the endogenous 5' regulatory sequence which can be either the endogenous 5' regulatory sequence of the Toxofilin gene, here referred to as the "Toxofilin promoter" or "Toxofilin 5'-UTR" (SEQ ID NO: 4482) or the endogenous 5' regulatory sequence of the GRA16 gene, here referred to as the "GRA16 promoter" or "GRA16 5'-UTR" (SEQ ID NO: 4473). Downstream of the ORF is the 3'-UTR of the abundant dense granule protein GRA2 (SEQ ID NO: 4491; FIG. 3). The expression vector also included a separate ORF containing the selectable markers HXGPRT [SEQ ID NO: 4475] or DHFR-TS [SEQ ID NO: 4484 or 4606] or mCherry [SEQ ID NO: 4608], surrounded by the 5' UTR of DHFR-TS (upstream) [SEQ ID NO:4492] and 3' UTR of DHFR-TS (downstream) [SEQ ID NO: 4493 or 4609].

Generation of Transgenic *T. gondii*

*T. gondii* of the type I strains RH or RHAHX or the type II strains Prugniaud, Prugniaud-GFP-Luciferase or Prugniaud ΔHPT (also known as Prugniaud ΔHX) were used for generating transgenic strains. Extracellular Tachyzoites were collected or mechanically egressed using a 22-26 gauge needle, filtered from cellular debris, pelleted and resuspended in 300 μl cytomix buffer (120 mM KCl, 0.15 mM $CaCl_2$ 10 mM $K_2HPO_4/KH_2PO_4$ pH 7.6, 25 mM HEPES pH 7.6, 2 mM EGTA, 5 mM $MgCl_2$) with freshly added 2 mM ATP and 5 mM GSH in 30 μl each (360 μl total). 20-60 μg plasmid DNA, or DNA linearized with the enzyme ScaI was transfected into the tachyzoites by electroporation with a BTX ECM electroporator. A few drops of the transfected cells were transferred onto IFA wells (immunofluorescence assay wells of a 24-well plate with HFF cells seeded on glass coverslips) and immunofluorescently stained for assessment of transfection efficiency and transient protein expression (expression from plasmid DNA). The rest of the transfected parasites were transferred onto a fresh flask with HFF in complete DMEM. If a drug-resistance selectable marker was used, the next day media was changed to fresh media containing the drug used for selection (1 μM pyrimethamine for DHFR-TS selection or 25 μg/ml mycophenolic acid+50 μg/ml xanthine for HXGPRT selection). Starting from the day the parasites started egressing from the HFF, drops of the supernatant containing extracellular parasites were passed every 1-2 days into a second flask of HFF in selective media containing the selection drug. When the parasites in the second flask started egressing from the HFF, drops of the supernatant were passed every 1-2 days from the second flask into a third flask, and so on. If a fluorescent protein selectable marker was used, when the parasites in the second flask egressed out of about 50%-90% of the HFF cells, the media with extracellular parasites was collected, filtered from cell debris and sorted using a FACS machine. Parasites emitting fluorescence corresponding to the fluorescent protein used for selection were collected and passed into the next flask of HFF in complete DMEM media. After the 3rd-5th flask started lysing (about 2-5 weeks), the parasites were considered a "stable pool" containing parasites that integrated the DNA construct into their genome. A drop of the stable pool was passed onto IFA (immuno fluorescent assay) wells and immunofluorescently stained to assess percentage of construct-positive parasites in the pool, protein expression and protein localization in the genome-integrated ("stable") parasites (genomic expression). Clonal lines were established by manual sorting by limiting dilutions or by FACS sorting one parasite per well in 96 well plates. Plates were kept undisturbed for 5-10 days, after which they were screened by eye using a bright field microscope to detect wells with a single plaque which is assumed to originate from a single parasite. Wells with a single plaque were mixed vigorously with a pipette and 50 μl of the mixture was passed to a new dish and to a PCR tube. Lysates were made by pelleting the collected cells in the PCR tubes, resuspending them in 10 μl lysis buffer consisted of 10% proteinase K in TE buffer and incubation in 60° C. for 60 minutes followed by 95° C. for 10 minutes in a thermocycler. One microliter (1 μl) of the lysates were used as template for PCR screening using primers specific for the genetic construct. PCR-positive clones were passed onto IFA wells, fixed, immunofluorescently stained and analysed using a fluorescent microscope and polarized light microscope for protein expression and protein localization in each clone.

Antibodies

Antibodies and the respective concentrations they were used in, are as follows: anti-HA (Roche, IFA: 1:1000, WB: 1:1000), anti-IMC-1 (gift from Prof. Dominique Soldati-Favre, IFA: 1:1000-1:2000), anti-MeCP2 (Cell Signaling, IFA: 1:200, WB: 1:1000, IP: 1:26), anti-NeuN (Abcam, IFA: 1:500), anti-NCoR1 (Bethyl Laboratories, WB: 1:1000), anti-TBL1 (Abcam, WB: 1:1000), Alexa Fluor anti-rat 488 and 594 (Invitrogen, IFA: 1:1000), Alexa Fluor anti-rabbit 488 and 594 (Invitrogen, IFA: 1:1000), Alexa Fluor anti-mouse 488 and 594 (Invitrogen, IFA: 1:1000).

Example 1

Generation of *T. gondii* Construct which Leads to the Expression, Localization to Parasite's Secretory Organelles and Secretion of a Therapeuic Protein-of-Interest into the Host Cell Experimental Procedures The constructs were transfected into RH (RHhxgprt) or Pru (Pruhxgprt) strain *T. gondii* parasites by electroporation. This is followed by a process of selection for parasites expressing the selection markers (either Pyrimethamine selection for a construct containing DHFR-TS (SEQ ID NO: 4484), which was co-transfected with the construct-of-interest), or using MPA+Xanthine for selection based on expression of HXGPRT (SEQ ID NO:4475), cloning by limiting dilutions or flow cytometry, and PCR-based screening. The positive clones were verified by Western Blot analysis and by immunofluorescence staining to characterize the expression and specific localization of the HA-tagged therapeutic protein in the secretory rhoptry organelles, dense granule organelles, parasitophorous vacuole space, parasitophorous vacuole membrane, or in the host cells. The verified positive lines were further maintained on HFF (human foreskin fibroblast) cells.

Experimental Results

Generation of Constructs and *T. gondii* Strains for Delivery of the Therapeutic Proteins Galactocerebrosidase, Galactocerebrosidase-TAT, GDNF, Aspartoacylase, MeCP2, Survival Motor Neuron Protein and E3 Ubiquitin Protein Ligase Parkin—

The results demonstrate that *T. gondii* can be engineered to express heterologous (mammalian, e.g., human) therapeutic proteins fused to an endogenous protein of the parasite. Using this approach, the present inventors have generated 3 novel stable *T. gondii* transgenic lines expressing the 3 human proteins associated with common neuropathologies, Galactocerebrosidase-TAT (the mutated GALC-TAT SEQ ID NO: 4487), MeCP2 (codon optimized SEQ ID NO: 4477) and GDNF (SEQ ID NO: 4489), and additional 4 mixed-population pools containing stable *T. gondii* transgenic parasites expressing the 3 human proteins associated with common neuropathologies Galactocerebrosidase (GALC, isoform 1, SEQ ID NO:4486), Galactocerebrosidase-TAT (the WT GALC-TAT SEQ ID NO: 4488), Aspartoacylase (ASPA SEQ ID NO:4483) and Survival Motor Neuron Protein (SMN1, SEQ ID NO: 4479).

Improving Secretion and Uptake of the Therapeutic Protein by a Viral Protein Transduction Domain—

In order to improve secretion of the Galactocerebrosidase protein from the host cell to the extracellular space, as well as the uptake of the protein by neighboring cells, the present inventors have fused Galactocerebrosidase to a viral protein transduction domain (PTD). Tat-PTD has been previously shown to significantly increase (by 6 fold) the cross-correction efficiency of Galactocerebrosidase through enhancing both the secretion and uptake of the enzyme in a cell culture model system (Meng, X.-L., et al., 2013).

Localization of the Therapeutic Proteins Galactocerebrosidase-TAT, Aspartoacylase, MeCP2 and Survival Motor Neuron Protein to *T. gondii* Rhoptries Secretory Organelles—

The results demonstrate that *T. gondii* can localize heterologous (mammalian, e.g., human) therapeutic proteins to the parasite's rhoptries secretory organelles (FIG. 4A), from which they could potentially be released into the host cell cytoplasm and localize to target sites within the infected cell. The fusion proteins containing Galactocerebrosidase-TAT, Aspartoacylase, MeCP2 and Survival Motor Neuron Protein localized to the parasite rhoptries as reported for previous Toxofilin fusions that evidently made their way into the host cell. This was proven by immunofluorescence staining (IFAs) (FIGS. 4B-I).

Thus, the present inventors have succeeded in demonstrating that *T. gondii* may be engineered to express heterologous (mammalian, e.g., human) proteins fused to an endogenous protein of the parasite, and that these proteins localize to the parasite's rhoptries secretory organelles. The present inventors have engineered the human proteins to be fused to Toxofilin, an endogenous protein that is naturally secreted into host cells by the parasites, which allows to "ride" on the parasite's protein secretion machinery for the targeting and secretion of proteins of interest (e.g., a therapeutic protein). This is an important milestone on the path to suggesting *T. gondii* as a feasible basis for this technology.

Using this approach, the present inventors have generated a novel stable *T. gondii* transgenic line, expressing and localizing to the rhoptries the human protein associated with Krabbe disease Galactocerebrosidase-TAT (the mutated GALC-TAT SEQ ID NO: 4487), and additional 4 mixed-population pools containing stable *T. gondii* transgenic parasites expressing and localizing to the rhoptries the 3 human proteins associated with common neuropathologies Galactocerebrosidase-TAT (the WT GALC-TAT SEQ ID NO: 4488), Aspartoacylase (ASPA SEQ ID NO:4483), MeCP2 (SEQ ID NO:4477) and Survival Motor Neuron Protein (SMN1, SEQ ID NO: 4479).

Localization of the Therapeutic Proteins Aspartoacylase, MeCP2 and Survival Motor Neuron Protein to *T. gondii* Dense Granules Secretory Organelles and Parasitophorous Vacuolar Space—

The results demonstrate that *T. gondii* can localize the heterologous (mammalian) human therapeutic proteins to the parasite's Dense granules secretory organelles and parasitophorous vacuolar space (FIG. 5A), from which they could be released into the host cell cytoplasm and localize to target sites within the infected cell (FIGS. 5B-I). As this approach of using sequences from dense granule proteins to drive the secretion of a protein of interest from the parasite dense granules is unprecedented, this is the first time mammalian proteins have been found to be secreted into the parasitophorous vacuolar space by fusion to a dense granule protein (GRA16). This was proven by immunofluorescence staining (IFAs) (FIGS. 5B-I). The fusion proteins are then expected to pass through the parasitophorous vacuolar membrane into the host cell, based on the known localization of the native GRA16 protein they are fused to (Bougdour et al. 2013).

Thus, the present inventors have succeeded in demonstrating that *T. gondii* may be engineered to express heterologous (mammalian) proteins fused to an endogenous protein of the parasite, and that these proteins localize to the parasite's Dense granules secretory organelles and parasitophorous vacuolar space. The present inventors have engineered the human proteins to be fused to GRA16, an endogenous protein that is naturally secreted into host cells by the parasites, which allows to "ride" on the parasite's protein secretion machinery for the targeting and secretion of proteins of interest (e.g., a therapeutic protein). This is an important milestone on the path to suggesting *T. gondii* as a feasible basis for this technology.

Using this approach, the present inventors have generated a novel stable *T. gondii* transgenic line, expressing and localizing to the Dense granule secretory organelles and parasitophorous vacuolar space the human protein associated with Rett Syndrome MeCP2, and additional 2 mixed-population pools containing stable *T. gondii* transgenic parasites expressing and localizing to the Dense granule secretory organelles and parasitophorous vacuolar space the two human proteins associated with common neuropathologies Aspartoacylase and Survival Motor Neuron Protein.

Secretion of the Therapeutic Protein MeCP2 from the Transgenic Parasite into the Host Cell, and Localization in the Region of Activity in the Host Cell, the Nucleus—

The results demonstrate that protein fusions consisting of a pharmaceutical polypeptide fused to a *Toxoplasma gondii* secreted polypeptide (and specifically here, the therapeutic protein MeCP2 fused to the *T. gondii* dense granule protein GRA16), can be released from the parasite into the host cell and translocate to the therapeutic protein's target site in the host cell (here, the nucleus). The fusion protein containing MeCP2 localized to the host cell nucleus as shown by immunofluorescence staining (IFAs) (FIGS. 5F-I). This is an important milestone on the path to suggesting *T. gondii* as a feasible basis for this technology.

Using this approach, the present inventors have generated novel stable *T. gondii* transgenic lines, expressing and localizing to the host cell nucleus the human protein associated with Rett Syndrome, MeCP2 (FIGS. 5F-I).

Example 2

Rescue of Galactocerebrosidase Deficiency Through Parasitic Delivery

The Galactocerebrosidase enzymatic activity assay which is based on the enzymatic breakup of a synthetic fluorescent substrate of Galactocerebrosidase named 6-Hexadecanoy-lamino-4-methylumbelliferyl-beta-D-galactoside (6HMU-beta-D-galactoside) is based on the manufacturer's protocol [Otto P. van Diggelen. MOSCERDAM SUBSTRATES, Laboratory protocol for enzyme analysis for Krabbe disease; Galactocerebrosidase]. Using Krabbe patient-derived fibroblasts, the assay is used to evaluate the ability of the GALC- and GALC-TAT-expressing parasite's to rescue Krabbe disease phenotypes in culture. Untreated Krabbe disease cells (Krabbe patient-derived fibroblasts), Krabbe disease cells transfected with sham vector (empty human expression vector) and/or Krabbe disease cells infected with *T. gondii* parasites not expressing GALC are used as negative controls. Positive controls are wild type (WT) cell lines, or the Krabbe disease cells transfected with human expression vectors driving the expression of either the standalone (HA-tagged) GALC or GALC-TAT gene or a Toxofilin/GRA16-fused GALC or GALC-TAT gene, identical to the fusion expressed by the transgenic parasites tested. This allows ruling out the possibility that any negative results could be caused by a lack of sufficient effect of the protein itself, or from disruption of the therapeutic protein's activity by the fusion of Toxofilin or GRA16 to the N-terminus of the therapeutic protein, and thus allows quantifiable and direct inference of the efficiency of the parasitic delivery system.

The assay is used to characterize the Galactocerebrosidase-expressing parasites' ability to rescue the Galactocerebrosidase-deficiency shown in Krabbe disease patient-derived fibroblasts. This experiment demonstrates the transgenic parasites' ability to rescue Krabbe disease by delivering the supplementary protein to cells in culture.

Example 3

Rescue of MECP2 Deficiency Through Parasitic Delivery

Neural and glial cells derived from mouse models of Rett syndrome that harbor a mutation or deletion of the MECP2 gene present an array of abnormal morphological and molecular characteristics. [Percy, A. Rett syndrome: coming to terms with treatment. *Adv. Neurosci*. (2014), [de la Torre-Ubieta et al. Advancing the understanding of autism disease mechanisms through genetics. Nat Med. 2016].

Using a Rett Syndrome cell culture model, the quantitative scoring of the molecular and morphological characteristic phenotypes of Rett syndrome is used to evaluate the ability of the MeCP2-expressing parasite's to rescue Rett Syndrome phenotypes in culture. Untreated Rett Syndrome model cells, Rett Syndrome model cells transfected with sham vector and/or Rett Syndrome model cells infected with *T. gondii* parasites not expressing MeCP2 are used as negative controls. Positive controls are WT cell lines and Rett Syndrome model cells transfected with human expression vectors driving the expression of either the standalone (HA-tagged) MECP2 coding sequence or a Toxofilin/GRA16-fused MECP2 coding sequence identical to the fusion expressed by the transgenic parasites tested. This allows ruling out the possibility that any negative results could be caused by a lack of sufficient effect of the protein itself, or from disruption of the therapeutic protein's activity by the fusion of Toxofilin or GRA16 to the N-terminus of the therapeutic protein, and thus allows quantifiable and direct inference of the efficiency of the parasitic delivery system.

The assay is used to characterize the MeCP2-expressing parasites' ability to rescue the MeCP2-deficiency shown in a Rett Syndrome cell culture model. This experiment demonstrates the transgenic parasites' ability to rescue a Rett Syndrome by delivering the supplementary protein to cells in culture.

Example 4

Testing Therapeutic Potential of the Transgenic Parasite Lines in Animal Models The transgenic lines of the parasite are tested for their ability to affect phenotypes in whole organism. Testing the transgenic parasites in mice allows the assessment of the system in the presence of an immune system and a functional blood brain barrier (BBB). The transgenic *T. gondii* parasites are administered to the respective animal model of the condition being tested intranasally, enterally (such as orally), subcutaneously, intra-muscularly, intravenously, intradermally, intraperitoneally, intracranially or intracerebrally. The transgenic *T. gondii* parasites are administered in the form of tachyzoites, bradyzoite tissue cysts or oocysts.

Following inoculation with the parasites, the animal model are characterized and assessed for the manifestation of phenotypes related to the condition studied (such as pathological phenotypes of the disease). Phenotypes include behavioral, morphological and molecular phenotypes. The effects of the transgenic parasites are revealed by comparison to animals treated with parasites not expressing the therapeutic polypeptide and to sham-treated animals.

For instance, mice model of Rett Syndrome treated with *T. gondii* parasites expressing the therapeutic protein MeCP2 are assessed by known phenotypes of the disease which include impaired social interaction, increased scent marking, hindlimb clasping, reduced lifspan, anxiety, respiratory problem, hypoactivity, impaired motor coordination, miRNA-mediated IGF1 deficit, decreased level of BDNF, impaired cortical plasticity, glial dysfunction, GABAergic neuronal dysfunction, decreased soma size, decreased dendritic spine density, decreased synapse number, decreased activity ($Ca2+$ imaging), decreased sEPSC and sIPSC frequency and amplitude, decreased Tujl+ cell number, decreased PAX6, SCN1A/1B expression, decreased dendrite complexity in cortical neurons, decreased AP frequency in cortical neurons, decreased total transcription in cortical neurons, decreased expression of neuronal, synaptic, highly-expressed genes, immediate early genes and mitochondrial genes in cortical neurons, decreased mRNA translation in cortical neurons, decreased BDNF secretion from cortical neurons, decreased AKT/mTOR pathway activity in cortical neurons and decreased oxygen consumption and maximal respiration in cortical neurons [de la Torre-Ubieta et al. Advancing the understanding of autism disease mechanisms through genetics. Nat Med. 2016.]

Example 5

Generation of Constructs and *T. gondii* Strains for Delivery of Customized Transcription Activator-Like Effectors (Tales)

*T. gondii* are engineered to express and secrete customized Transcription activator-like effectors (TALE). Customized TALEs can be used for a wide variety of genome engineering applications, including transcriptional modulation and genome editing. The DNA recognition and binding region of TALEs are made up of tandem repeats of 34-aa sequences (monomers) which determine the sequence of the recognized DNA sequence. There are 4 types of monomers which differ in their repeat variable diresidues (RVDs) which determines the nucleotide they recognize. The monomer termed "NI" (SEQ ID NO: 4508) is specific for the "A" nucleotide; the monomer termed "HD" (SEQ ID NO: 4495) is specific to the "C" nucleotide"; the monomer termed "NG" (SEQ ID NO: 4509) is specific to the "T" nucleotide and the monomer termed "NN" (SEQ ID NO: 4494) is specific the "G" or "A" nucleotide. More recently, the additional RVD NH (SEQ ID NO:4504) was shown to provide higher G-specificity. The tandem repeat DNA-binding domain always ends with a half-length repeat (0.5 repeat). Customized TALE DNA-binding domains can be used to generate custom TALE transcription factors (TALE-TFs) and modulate the transcription of endogenous genes from the genome, by fusion to the synthetic VP64 transcriptional activator. Customized TALE DNA-binding domains can also be used to generate custom TALE nucleases (TAL-ENs) and can be used to generate site-specific double-strand breaks to facilitate genome editing through nonhomologous repair or homology directed repair, by fusion to the catalytic domain of FokI endonuclease. The TALEs are made by constructing a DNA-binding domain from the monomers (SEQ IDs NO:4508, 4509, 4494, 4495 and 4504), which is inserted into a TALEN backbone or TALE-TF backbone. Because the backbones also include the 0.5 repeat at the end of the DNA binding domain, there are 4 types of TALEN backbones (e.g., SEQ ID NOs:4500, 4501, 4502, and 4503), as well as 4 TALE-TF backbones (e.g., SEQ ID NO:4496, 4497, 4498, and 4499). The backbones also contain cytomegalovirus promoter (CMV), nonrepetitive N terminus from the Hax3 TALE (N-term), nonrepetitive C terminus from the Hax3 TALE (C-term), type IIs restriction sites used for the insertion of custom TALE DNA-binding domains (such as BsaI), negative selection cassette containing the ccdB negative selection gene and chloramphenicol resistance gene (ccdB+CmR), nuclear localization signal (NLS), and either a catalytic domain from the FokI endonuclease (FokI) or synthetic transcriptional activator derived from VP16 protein of herpes simplex virus (VP64) followed by 2A self-cleavage linker (2A) and enhanced green fluorescent protein (EGFP). All are followed by a polyadenylation signal (polyA signal) (Sanjana et al., A transcription activator-like effector toolbox for genome engineering, 2012). The resulting TALE sequences are inserted downstream of the coding sequence of a *T. gondii* endogenous secreted polypeptide as described in the GENERAL MATERIALS AND EXPERIMENTAL METHODS hereinabove, and the resulting constructs are transfected into *T. gondii* to produce transgenic *T. gondii* strains that express and secreted the TALE.

For example, in order to target the TACGTACG (SEQ ID NO: 4505) sequence in a genome of a subject in need thereof, the TALE nuclease construct or the TALE transcription factor construct can be used. In the open reading frame of these constructs the monomers which are specific for targeting the exemplary "target sequence" (SEQ ID NO: 4505) are arranged one after the other, as shown schematically in FIG. 6A (for TALE Nuclease) and FIG. 6B (for TALE transcription factor). Sequence information of these constructs is available in the sequence listing (SEQ ID NOs: 4506 and 4507).

Example 6

Generation of *T. gondii* Parasites that Express Mammalian Therapeutic Proteins and Localize them to their Rhoptry Secretory Organelles In order to generate *T. gondii* parasites that express mammalian proteins and target them to their rhoptry secretory organelles the present inventors transfected type I RHΔRX tachyzoites or RH (co-transfected with the pDHFR selection plasmid) *T. gondii* with plasmids containing sequences coding for the protein of interest fused to the rhoptry protein Toxofilin. The mammalian proteins tested in the Toxofilin fusion system were: glial derived neurotrophic factor (GDNF), parkin (PARK2), galactocerebrosidase (GALC), galactocerebrosidase fused to a TAT protein transduction domain (GALC-TAT; SEQ ID NO: 4487), methyl CpG binding protein (MeCP2), aspartoacylase (ASPA) and Survival of motor neuron (SMN1). In an attempt to improve protein expression and targeting, the present inventors also tested codon-optimized versions of some of the proteins, including GALC, MECP2, ASPA and the additional gene TFEB which was tested in the codon-optimized form (SEQ ID NO: 4604).

ASPA (SEQ ID NO: 4483), ASPA codon optimized (SEQ ID NO: 4602), GALC (SEQ ID NOs: 4486 and 4601), GALC-TAT (SEQ ID NO: 4488), PARK2 (SEQ ID NO: 4478), SMN1 (SEQ ID NO: 4479), GDNF (SEQ ID NO:4489), MeCP2 (SEQ ID NO: 4476) and MeCP2 codon optimized (SEQ ID NO:4477) showed variable targeting of the fusion proteins in the parasites, which included rhoptry targeting as well as other patterns of targeting, resembling endoplasmic reticulum, golgi, nucleus, cytoplasm, apicoplast, microneme and other localizations in the parasites (FIGS. 9A-N).

GALC-TAT mutated form generated primarily rhoptry-like fusion protein localization. From GALC-TAT mutated the present inventors also generated clonal lines that strongly expressed the fusion protein and targeted it to a rhoptries (FIG. 9H).

Example 7

Generation of *T. gondii* Parasites that Express Mammalian Therapeutic Proteins, Localize them to their Dense Granule Secretory Organelles and Secrete them into the Parasitophorous Vacuole In order to generate *T. gondii* parasites that express mammalian proteins and target them to their dense granule secretory organelles type I RHAHX *T. gondii* were transfected with plasmids containing sequences coding for the protein of interest fused to the dense granule protein GRA16. The mammalian proteins-coding genes tested in the GRA16 fusion system were GALC [human forms (SEQ ID NOs: 4486 and 4601) and codon-optimized (SEQ ID NO: 4603), GALC-TAT (human form SEQ ID NO: 4488), MECP2 (codon-optimized, SEQ ID NO:4477), ASPA [human form (SEQ ID NO:4483) and codon-optimized (SEQ ID NO:4602)], SMN1 (human form, SEQ ID NO: 4479) and TFEB (codon-optimized, SEQ ID NO:4604).

GALC, GALC codon optimized and GALC-TAT were expressed in the transfected parasites (FIGS. 10E, 10F and 10H). ASPA, ASPA codon optimized, SMN1, MeCP2 codon optimized and TFEB codon optimized were expressed and secreted by the dense granules to the parasitophorous vacuole (FIGS. 10C, 10G, 10D, 10I, 10J).

Example 8

Delivery of Mammalian Therapeutic Proteins to Human Fibroblasts in Culture Using Transgenic *T. gondii*

The present inventors have engineered six Type I and Type II Toxoplasma clonal lines which in addition to secreting the fusion protein into the parasitophorous vacuole, were also able to release it from the parasitophorous vacuole and target it to the nucleus of the host cell in amounts detectable by immunofluorescence staining. These clonal lines are: RH GRA16-MECP2 codon optimized (RH GRA16-MECP2opt), RH GRA16-TFEB codon optimized (RH GRA16-TFEBopt), Prugniaud-GFP-Luciferase DHFR-TS GRA16-MECP2 codon optimized (Pru-GFP-LUC GRA16-MECP2opt), Prugniaud-GFP-Luciferase DHFR-TS GRA16-TFEB codon optimized (Pru-GFP-LUC GRA16-TFEBopt), Prugniaud GRA16-MECP2 codon optimized (Pru GRA16-MECP2opt), and Prugniaud GRA16-TFEB codon optimized (Pru GRA16-TFEBopt). In addition to the transgenic lines expressing the fusion proteins, the present inventors also generated 2 control lines expressing the carrier protein GRA16 fused to the HA epitope tag alone: RH GRA16-HA (RH GRA16-HAstop) and Prugniaud GRA16-HA (Pru GRA16-HAstop). As MeCP2 and TFEB are both nuclear proteins, host cell nuclear targeting means they were targeted to their site of activity in the cell. Secretion and host cell nuclear targeting of the proteins in all the lines described above was detected in HFF human fibroblasts by infection of HFF cells in complete DMEM with tachyzoites of the respective line, fixation, immunofluorescence staining and analysis by fluorescence and polarized light microscopy (FIGS. 10B, 10I and 10J).

In order to quantify the efficiency and the dynamics of GRA16-mediated protein delivery in vitro, the present inventors quantified delivery over time and multiplicity of infection (MOI) for tachyzoites of the three type I lines RH GRA16-HAstop, RH GRA16-MECP2opt and RH GRA16-TFEBopt, as summarized in FIGS. 11A-C.

Example 9

Delivery of Mammalian Therapeutic Proteins to Human Neurons in Culture Using Transgenic *T. gondii*

Immortalized Human Dopaminergic Neuronal Precursor Cells, also known as Lund Human Mesencephalic (LUHMES) cells, were grown in media containing F12 advanced DMEM media supplemented with L-glutamine, N-2 serum-free supplement and βFGF (beta-fibroblast growth factor). The cells were differentiated in culture into morphologically and biochemically mature dopamine-like neurons using F12 advanced DMEM media supplemented with L-glutamine, N-2 serum-free supplement, tetracycline, GDNF and cAMP (Cyclic adenosine monophosphate). On day 6-9 of differentiation (at which point the cells are mature neurons), tachyzoites of the clonal lines RH GRA16-MECP2opt, RH GRA16-TFEBopt and RH GRA16-HAstop were used to infect the neurons. 16-22 hours post infection the neurons were fixed and immunofluorescently stained and analysed by fluorescence and polarized light microscopy. All lines tested presented clear secretion of the fusion proteins, which were targeted to the nuclei of the human neurons (FIGS. 12A-C).

In addition, human neurons were infected with RH GRA16-MECP2opt tachyzoites and collected 24 hours post infection. Infected neurons were washed with PBS, scraped using a sterile cell scraper and pelleted by centrifugation, residual PBS was removed and the pellets were snap-frozen in liquid nitrogen. Nuclear proteins extracted from the infected neurons were immunoprecipitated using magnetic beads bound to an MeCP2 antibody. Immunoprecipitated proteins were immunoblotted with the same MeCP2 antibody following a standard Western blot protocol. The resulting blot presented 2 strong bands, of approximately 75 kDa and approximately 130 kDa. The ~75 kDa band represents the endogenous untruncated MeCP2 from the human neurons (predicted size: 75 kDa) and the ~130 kDa band represents the parasite-delivered GRA16-MeCP2 fusion protein (GRA16 predicted size: 55 kDa. Fusion protein predicted size: 75+55=130 kDa) (FIG. 14).

Example 10

Delivery of Mammalian MECP2 to Mouse Primary Cortical and Hippocampal Cultures Using Transgenic *T. gondii* and Binding of the Delivered MECP2 to Heterochromatic DNA Neuron-enriched primary cultures from the cortices and hippocampi of P1 (day 1) mice pups were cultured for 5 days and infected with tachyzoites of the transgenic line RH GRA16-MECP2opt. Twelve (12), 24 and 48 hours post infection, the neurons were fixed, immunofluorescently stained and analysed by fluorescence and polarized light microscopy. In all listed time points, the GRA16-MECP2 fusion protein was secreted and targeted to the nuclei of the neurons, and it also appeared in foci corresponding to areas of dense heterochromatic DNA, recognizes by intense DAPI staining (FIGS. 13A-D). This is a classical marker for MeCP2 functionality as it suggests that it successfully binds on the heterochromatin. Notably, in culture systems *T. gondii* can infect both neurons, glial and other cells. Because the primary cultures were not purely neuronal (according to NeuN staining), the present inventors could see that non neuronal cells (presumably mostly glia) infected with the transgenic *T. gondii* also received the MeCP2 fusion protein and presented the same characteristic foci pattern.

Example 11

Expression of GRA16 and GRA16-MECP2 Fusion Protein in *T. gondii* Bradyzoite Cysts During the normal course of infection, after the initial acute phase in which the parasite replicates and disseminates in the body as tachyzoites, immune pressure causes *T. gondii* tachyzoites to differentiate into bradyzoites which resides in the long-lasting quiescent cysts in tissues, and mostly in the brain (Carruthers V B, Suzuki Y, 2007. Schizophr Bull. 33(3):745-51. Effects of *Toxoplasma gondii* infection on the brain). Therefore the present inventors investigated whether the transgenic *T. gondii* continue to express the GRA16-fused therapeutic proteins after they differentiate into the bradyzoite form. An in vitro differentiation of the transgenic *T. gondii* into bradyzoites was induced by stress with alkaline media for 3 to 5 days. Alkaline media contained DMEM medium adjusted to pH 8.1 with 10 mM HEPES and 1% fetal bovine serum supplemented with penicillin-streptomycin (Tomita T, Bzik D J, et al. 2013. PLoS Pathog. 9(12): e1003823. The *Toxoplasma gondii* cyst wall protein CST1 is critical for cyst wall integrity and promotes bradyzoite persistence). The present inventors tested differentiation of the strains Pru GRA16-HAstop and Pru GRA16-MeCP2. Bradyzoite cysts, identified by DBA (Dolichos Biflorus Agglutinin) staining of the cyst wall, continue to express both the GRA16-HAstop (Data not shown) and GRA16-MeCP2 proteins (FIGS. 15A-C). This finding shows that the transgenic parasites can continue to express GRA16 and the GRA16 fusion proteins after differentiation into the bradyzoite stage, which is important for continuous secretion and protein delivery from cysts in chronic infections.

Example 12

Probing the Molecular Interactions Between the Heterologous Polypeptides Delivered by *T. Gondii* and Endogenous Proteins in the Recipient Cell By performing co-immunoprecipitation on cell lysates from infected cultures and from infected animals, the present inventors can decipher molecular interactions between the polypeptides delivered by the transgenic *T. gondii* and endogenous proteins and nucleic acids.

For example, in mammalian cells MeCP2 binds both DNA and proteins from the SMRT/NCoR and SIN3A co-repressor complexes. Binding to DNA can be probed by immunofluorescent stainings and by chromatin-immunoprecipitation, and binding to other proteins can be probed by immunofluorescent stainings and by protein co-immunoprecipitation. The added epitope tags on the delivered fusion proteins can be used to distinguish between copies of the protein produced by the host cell and copies of the protein delivered by the parasites, while antibodies against the protein itself can be used to probe both the endogenous and the parasite-delivered protein (e.g. for comparative assays).

Example 13

Testing the Ability of Transgenic *T. gondii* to Deliver Heterologous Proteins-of-Interest Continuously (/Chronically) in Animal Models The transgenic lines of the parasite are tested for their ability to affect phenotypes in whole organism. Testing the transgenic parasites in animal models allows the assessment of the system in the presence of an immune system and a functional blood brain barrier (BBB). This is done by following the standard infection protocols established in the field to infect mice with the transgenic *T. gondii* (Cabral C M et al., 2016, PLoS Pathog. 12(2):e1005447. Neurons are the Primary Target Cell for the Brain-Tropic Intracellular Parasite *Toxoplasma gondii*; Berenreiterová M et al., 2011. PLoS One. 6(12):e28925. The distribution of *Toxoplasma gondii* cysts in the brain of a mouse with latent toxoplasmosis: implications for the behavioral manipulation hypothesis; Tait E D et al. 2010. J. Immunol. 185(3):1502-12. Virulence of *Toxoplasma gondii* is associated with distinct dendritic cell responses and reduced numbers of activated CD8+ T cells; Koshy A A et al. 2012. PLoS Pathog. 8(7):e1002825. Toxoplasma co-opts host cells it does not invade; Jensen K D et al. 2015. MBio. 6(2):e02280. *Toxoplasma gondii* superinfection and virulence during secondary infection correlate with the exact ROP5/ROP18 allelic combination). The transgenic *T. gondii* parasites are administered to the animal model intranasally, enterally (such as orally), subcutaneously, intra-muscularly, intravenously, intradermally, intraperitoneally, intracranially or intracerebrally. The transgenic *T. gondii* parasites are administered in the form of tachyzoites, bradyzoite tissue cysts or oocysts. Animal models can be wild type animals or model animals bearing a condition treatable or otherwise affected by delivery of the protein of interest expressed in the transgenic parasites. After the initial stage of acute infection, the animal develops chronic bradyzoite tissue cysts, primarily in the brain. This mode of delivery relies on continuous expression and secretion the protein of interest from the transgenic *T. gondii* at the chronic stage of infection.

At different stages during development of the chronic infection (first 3 weeks to 2 months after infection, depending on strain and route of infection), as well as in different time points after the chronic infection has been established and stabilized (time-scale of months to years after infection), brain histological stainings are used to assess the percentage of cells infected, distribution of parasites and the delivered protein in the brain and in other tissues and to quantify the levels of delivered protein. Co-immunoprecipitation and cellular morphologies can be used to confirm molecular interactions between the delivered proteins and endogenous counterparts in the receiving cells and to provide evidence for their function.

The condition of the treated animal model is monitored and characterized at different stages of the chronic infection and at different stages of the disease progression using physiological, behavioural, cellular and molecular measures in order to assess manifestations of disease phenotypes and efficacy of the treatment in alleviating them as well as any potential toxicity arising from the treatment. The effects of the transgenic parasites are assessed by comparison to animals treated with parasites not expressing the pharmaceutical polypeptide and/or to sham-treated animals.

For instance, mice model of Rett Syndrome treated with *T. gondii* parasites expressing the therapeutic protein MeCP2 are assessed by known phenotypes of the disease which include impaired social interaction, increased scent marking, hindlimb clasping, reduced lifspan, anxiety, respiratory problem, hypoactivity, impaired motor coordination, miRNA-mediated IGF1 deficit, decreased level of BDNF, impaired cortical plasticity, glial dysfunction, GABAergic neuronal dysfunction, decreased soma size, decreased dendritic spine density, decreased synapse number, decreased activity (Ca2+ imaging), decreased sEPSC and sIPSC frequency and amplitude, decreased Tujl+ cell number, decreased PAX6, SCN1A/1B expression, decreased dendrite complexity in cortical neurons, decreased AP frequency in cortical neurons, decreased total transcription in cortical neurons, decreased expression of neuronal, synaptic, highly-expressed genes, immediate early genes and mitochondrial genes in cortical neurons, decreased mRNA translation in cortical neurons, decreased BDNF secretion from cortical neurons, decreased AKT/mTOR pathway activity in cortical neurons and decreased oxygen consumption and maximal respiration in cortical neurons (de la Torre-Ubieta et al. Advancing the understanding of autism disease mechanisms through genetics. Nat Med. 2016, 22:345-61).

Example 14

Testing the Ability of Transgenic *T. gondii* to Deliver Heterologous Proteins-of-Interest Transiently (/Acutely) in Animal Models Similarly to Example 13 hereinabove, the transgenic lines of the parasite are tested for their ability to affect phenotypes in whole organism. Testing the transgenic parasites in animal models allows the assessment of the system in the presence of an immune system and a functional blood brain barrier (BBB), and can be conducted by intranasal, enteral (such as oral), subcutaneous, intra-muscular, intravenous, intradermal, intraperitoneal, intracranial or intracerebral administration of the transgenic *T. gondii* in the form of tachyzoites, bradyzoite tissue cysts or oocysts. Animal models can be wild type animals or model animals bearing a condition treatable or otherwise affected by delivery of the protein of interest expressed in the transgenic parasites. This experimental design focuses on assessment of transient delivery that does not rely on differentiation into bradyzoites and establishment of chronic infection and/or chronic cysts. Some examples include: delivery by attenuated parasites that cannot differentiate into bradyzoites and/or cannot replicate and/or cannot persist in vivo longer than a few weeks, or otherwise cannot establish a chronic infection; delivery by local administration to the target tissue or to an area close to the target tissues followed by clearance or inactivation of the parasites. These can also be repeated multiple times for repeated dosing. Immunosupressive agents can be administered before, concomitantly or after infection with the parasites to enhance infection and to aid re-infection of animals that have already been infected with *T. gondii* before. This experimental design also includes delivery by transgenic *T. gondii* capable of establishing chronic infection, but in which the collection of samples or analysis are performed at the acute stage of infection before establishment of chronic infection. This form of delivery relies mostly on secretion of the protein of interest by tachyzoites of the transgenic lines. At different stages during the acute infection (first days to about 2 months after infection, depending on strain and route of infection) brain histological stainings are used to assess the percentage of cells infected, characterize the distribution of parasites and the delivered protein in the brain and in other tissues and quantify the levels of delivered protein. Co-immunoprecipitation and cellular morphologies are used to confirm molecular interactions between the delivered proteins and endogenous counterparts in the receiving cells and to provide evidence for their function.

The condition of the treated animal model is monitored and characterized at different time points after initiation of treatment and at different stages of the disease progression using physiological, behavioural, cellular and molecular measures in order to assess manifestations of disease phenotypes and efficacy of the treatment in alleviating them as well as any potential toxicity arising from the treatment. The effects of the transgenic parasites are assessed by comparison to animals treated with parasites not expressing the therapeutic polypeptide and/or to sham-treated animals.

Example 15

Introduction of Further Modifications that Will Increase the Safety and Controllability of the Transgenic *T. Gondii*

Although the parasite is generally considered harmless in healthy humans, additional modifications to the parasites may be incorporated in the therapeutic strains in order to further attenuate their virulence. As the model organism of its phylum, there is a wide range of highly developed genetic tools for modifying the parasite (Jiménez-Ruiz E, Wong E H, Pall G S, Meissner M. Parasitology. 2014, 141:1390-8. “Advantages and disadvantages of conditional systems for characterization of essential genes in *Toxoplasma gondii*”) which may be used to generate attenuated and exogenously-controllable parasites (Moe-Behrens G H, Davis R, Haynes K A. Front Microbiol. 2013 4:5. “Preparing synthetic biology for the world”). One approach may include engineered auxotrophy. Secondly, attenuated parasites may be developed by targeting and disrupting specific virulence mechanisms of the parasite which are not essential to its ability to deliver the protein drugs. Another approach may include active control through engineered induced lethality such as inducible “suicide switches” (self-destruction element) that eliminate the parasite upon administration of an activating molecule. Some examples may include utilizing the widely-used tetracyclin-inducible promoter for drug-inducible activation of lethal or apoptotic pathways in the parasites in vivo, or the rapamycin-dimerizing diCre system for inducible knock-out of essential genes or for inducible activation of lethal or apoptotic pathways. Such drug-inducible control may also allow differential clearance of the parasite from specific tissues, regions or cell types due to differential permeability of the tissues or cells to the drug and its different distribution in the body.

Analysis and Discussion

The invention is a protein delivery platform that utilizes the machinery of the brain parasite *T. gondii*, which allows it to penetrate the blood-brain barrier and delivery proteins to cells, and especially neurons, within the CNS.

To enable delivery of therapeutic proteins to the CNS, the present inventors reappropriate the parasite *Toxoplasma gondii* for the synthesis and delivery of proteins of interest to cells in the CNS. The present inventors thus establish a versatile platform for specific and controlled delivery of proteins to cells within the CNS. The engineered parasite has the following novel capabilities:

(1) It can be easily modified to synthesize a range of therapeutic heterologous proteins and secrete them with specificity into target cells within the CNS.

(2) It can contain modification that reduce or exclude elements of the parasite that can mediate deleterious effects on the infected host.

(3) It can contain regulatory and/or self-destruction elements that allow control of its distribution and spatiotemporal activity once in the host.

Following is a non-limiting summary of alterations in the parasite’s genome that are described herein:

(i) Fusion of the selected therapeutic protein to a specific endogenous secreted protein of the parasite. Additional accessory elements and modifications may be added to the fusion gene/protein that may increase the effectiveness of the therapeutic fusion protein, such as cleavage sites that may allow detachment of the therapeutic protein from the endogenous parasite protein, after it is no longer needed for its targeting or activity, or mediate detection and assessment of efficiency and distribution of the Toxoplasma and of the delivered protein, such as epitope tags and fluorescent proteins.

(ii) Removal of virulence genes that are not necessary for the therapeutic role of the parasite. These modifications reduce the potential deleterious effects of the parasite on the patient, and makes it relevant for safe clinical use.

(iii) Insertion of regulatory elements that can be induced to cause the parasite to self-destruct in response to an externally administered drug, or to manipulate the parasite’s activity. These elements augment the safety features of the technology, and also provide increased control of its spatiotemporal activity.

The initial strains which were developed with the method of some embodiments of the invention were based on the Galactocerebrosidase and Galactocerebrosidase-TAT proteins for Krabbe disease, GDNF protein for a range of neurodegenerative diseases and other conditions (among them Parkinson’s disease, Supranuclear Palsy, Multiple sclerosis, Alzheimers disease, Amyotrophic Lateral Sclerosis, Huntington’s disease, retinal degenerations, Traumatic Brain Injury and hypoxic/ischaemic CNS disorders), Aspartoacylase protein for Canavan disease, MeCP2 protein for Rett Syndrome, SMN protein for Spinal Mascular Atrophy, E3 ubiquitin-protein ligase parkin for Parkinson's Disease and TFEB for lysosomal storage diseases and neurodegenerative diseases. Though the present inventors have selected a number of therapeutic proteins that are currently being tested clinically and have known supplementary functions, the platform may be adapted to a wide range of proteins.

The possible applications of the technology include, but are not limited to:

1. The treatment of conditions through the delivery of therapeutic proteins;

2. The supply of proteins to the brain in healthy individuals for the purpose of augmenting brain functions or promoting neuro-regeneration;

3. A general solution for highly specific and efficient targeted protein delivery for supplementing protein synthesis.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

REFERENCES

1. Pardridge, W. M. Targeted delivery of protein and gene medicines through the blood-brain barrier. *Clin. Pharmacol. Ther.* 97, 347-61 (2015).

2. Cox, D. B. T., Platt, R. J. & Zhang, F. Therapeutic genome editing: prospects and challenges. *Nat. Med.* 21, 121-131 (2015).

3. Persons, D. A. & Baum, C. Solving the problem of γ-retroviral vectors containing long terminal repeats. *Mol. Ther.* 19, 229-31 (2011).

4. Schambach, A., Zychlinski, D., Ehrnstroem, B. & Baum, C. Biosafety features of lentiviral vectors. *Hum. Gene Ther.* 24, 132-42 (2013).

5. Gray, S. J., Nagabhushan Kalburgi, S., McCown, T. J. & Jude Samulski, R. Global CNS gene delivery and evasion of anti-AAV-neutralizing antibodies by intrathecal AAV administration in non-human primates. *Gene Ther.* 20, 450-9 (2013).

6. Templeton, N. *Gene and cell therapy: therapeutic mechanisms and strategies.* (2008).

7. Dimmeler, S., Ding, S., Rando, T. A. & Trounson, A. Translational strategies and challenges in regenerative medicine. *Nat. Med.* 20, 814-21 (2014).

8. Abbott, N.J. Blood-brain barrier structure and function and the challenges for CNS drug delivery. *J. Inherit. Metab. Dis.* 36, 437-49 (2013).

9. Malhotra, M. & Prakash, S. Targeted Drug Delivery Across Blood-Brain-Barrier Using Cell Penetrating Peptides Tagged Nanoparticles. *Curr. Nanosci.* 7, 81-93 (2011).

10. Bradbury, M. W. B. *Physiology and Pharmacology of the Blood-Brain Barrier.* (Springer Science & Business Media, 2012).

11. Solaro, R., Chiellini, F. & Battisti, A. Targeted Delivery of Protein Drugs by Nanocarriers. *Materials (Basel).* 3, 1928-1980 (2010).

12. Sanecka, A. & Frickel, E.-M. Use and abuse of dendritic cells by *Toxoplasma gondii. Virulence* 3, 678-89 (2012).

13. Carruthers, V. B. & Suzuki, Y. Effects of *Toxoplasma gondii* infection on the brain. *Schizophr. Bull.* 33, 745-51 (2007).

14. Feustel, S. M., Meissner, M. & Liesenfeld, O. *Toxoplasma gondii* and the blood-brain barrier. *Virulence* 3, 182-92

15. Montoya, J. G. & Liesenfeld, O. Toxoplasmosis. *Lancet* 363, 1965-76 (2004).

16. Dlugonska, H. Toxoplasma rhoptries: unique secretory organelles and source of promising vaccine proteins for immunoprevention of toxoplasmosis. *J. Biomed. Biotechnol.* 2008, 632424 (2008).

17. Carruthers, V. B. & Sibley, L. D. Sequential protein secretion from three distinct organelles of *Toxoplasma gondii* accompanies invasion of human fibroblasts. *Eur. J. Cell Biol.* 73, 114-23 (1997).

18. Boothroyd, J. C. & Dubremetz, J.-F. Kiss and spit: the dual roles of Toxoplasma rhoptries. *Nat. Rev. Microbiol.* 6, 79-88 (2008).

19. Koshy, A. A. et al. Toxoplasma secreting Cre recombinase for analysis of host-parasite interactions. *Nat. Methods* 7, 307-9 (2010).

20. Fox, B. A., Sanders, K. L. & Bzik, D. J. Non-replicating *Toxoplasma gondii* reverses tumor-associated immunosuppression. *Oncoimmunology* 2, e26296 (2013).

21. Fox, B. A., Sanders, K. L., Chen, S. & Bzik, D. J. Targeting tumors with nonreplicating *Toxoplasma gondii* uracil auxotroph vaccines. *Trends Parasitol.* 29, 431-7 (2013).

22. Elliott, D. E. & Weinstock, J. V. Helminth-host immunological interactions: prevention and control of immune-mediated diseases. *Ann. N. E Acad. Sci.* 1247, 83-96 (2012).

23. Rothman, J. & Paterson, Y. Live-attenuated *Listeria*-based immunotherapy. *Expert Rev. Vaccines* 12, 493-504 (2013).

24. Reeves, A. Z. et al. Engineering *Escherichia coli* into a protein delivery system for mammalian cells. *ACS Synth. Biol.* 4, 644-54 (2015).

25. Meng, X.-L., Eto, Y., Schiffmann, R. & Shen, J.-S. HIV Tat Domain Improves Cross-correction of Human Galactocerebrosidase in a Gene- and Flanking Sequence-dependent Manner. *Mol. Ther. Nucleic Acids* 2, e130 (2013).

26. Otto P. van Diggelen. MOSCERDAM SUBSTRATES, Laboratory protocol for enzyme analysis fir Krabbe disease; Galactocerebrosidase. MOSCERDAM SUBSTRATES, Laboratory protocol for enzyme analysis fir Krabbe disease; Galactocerebrosidase.

SEQUENCE LISTING (4625 sequences)

SEQ ID NO: 1 - DNA, 2202 bp, Toxoplasma gondii
atggagggtatggggtcgctgcgcaggcggtgcgctgcactaccgctcgtcgcggggttccttgtttttctgggttcgattggcgtaaaagcggatcttcccattcacgccacggtacatgacatcaagggagactggacgttctacttgtctccagctgtacccggagatgttagcaactgcggctccccaagcccaaatacaaacacttcgaatctccgcgaagaactcaaggactacaagtcattcttgagcactcaagggggaatcaagaaggaactacgggtgtcactgactgacattccagtctcgttcgcaactactcgcactgccgccgcactcgagaatccccacaggcgcacctggaaaacgttgggtgttttcgatggccaggataagcggaagcttgttggcagctggacaacggtatacgacgaaggttttgaggtggacgttggtggccgcatgaggctcatggggttcatgaaatacaacccgcagaataactgctcgatcgtcgacggggacttggagaactctcaaggaatcacagactgctacgcaaccgacccgacgcgaacgcagattggttggtacatccagcaggcagaagatggctctcgtttgtcaggatgtttctatgcggagaaacccaaggctgcaagttcaactcccgccgcgttcgtcgcgatcaaggaaaccacgagagttgaacctgcttctggtgccttgattggcaccgacctgaaagactcaacttcgtacatctctcagtcgttcgtggatacacacaacgcgtctcctgcctcaagctggcgcgcgggtgtcaactccgtttttgcgaacatgaaccgtcgagatctttctcgctttgtgaaggattttggcttcaaaaaaatgcgacctgcaggtgacagtgccgatgggctttcgttcatgcagtctagcactgacatttcaactgcagacggagacgccgcctccacacaggtgtatgcatgcccgtgcaagaaaggcgaaaggtccctagacacgcgaaagttggatgagtccgaacagactctggaggtgctgtctcctgtgagcgctctggaagttggacacacaaactttttggccgcaatcaatccccacgttcacgagagcacagccacgaacggactcgacgctcaaggcacgcaagctgtggcaaaagcagcactgtccggcgcgggtgcaacgaacactcaggagcccctgctactccccaaagacttttcgtggtcggatccgttctcgaatcaggcatttgatgagactgtcaccaaccaaggcagctgcgggagctgctatgccgtggcagcaacctacgcgctgcagaagcgtttcgagattgcagcttctcgcatgcttgggcaggaaatccgacttttcagcgccgtccaggacgaggcggacggagcgttgtcctttttggaccttggcagtacgagccaactcggcgagttgtctgcacagtcaatcctgtcttgctccttctacaatcaaggctgcgacggaggcttcccgtacctcgtggggaaacacgcgcgagacattggtgttccgcaagccagatgtatggagtaccaagctgaccacacacaaggctgcccatttcaaaagacggcttcggcctcagagagccaatcgatgttgcaggctgacgcgaatgcaggagcgtgttctgagcacgcaagatggtatgcgaaggactacggctacattggcgggtgctacgagtgcaatcactgctctggtgaaaaacagatcatgttggagatttacaataacggtccagtgccagttgcgttcgatgcaccgccttctctcttttcctacagatccggggtctatgatgcgaactcgaatcacgcgcgcgtgtgtgacaacgatttgccccaccacaccggaattctcaccgggtgggaatacacgaaccacgcagtcacaattgtgggatggggagagacagatggtgagaacggaaaaccgcagaagtattggattgttcggaacacgtggggtcccaactggggtgtcgacggatacgtgaagattgcgcgcgggaagaacttggggggcatcgaaagccaagctactttcatcgacccagatttctccagaggtcaaggcttgaaagtggcgaaagctattgaagctctgaaaagtaaaacaatgtga

SEQ ID NO: 2 - DNA, 2262 bp, Toxoplasma gondii
atgtcggcggctgtggagcctcgcggccgtctttctgatggctgctgcagacgacggctgacgccggcagcggtcctctttctctgccgcgtactcgtcttgttctgggtgaacgaagcagaaccggcgaacggggacttgcctgcccactgtctcgtgaaacatgtcttaggagaatgggagattcaagaaggtctctggctcccctgccaagaagaaggaaacctgacgactgacgcggcccgactgcacgatccgtactgcggatacggcatcccagacagagttgacgcacatggtccgatgacgcctcccaatgtttcggcgagtttccacgcgctgcggacctcgcgcttcactctgtttccggatttccgtatcgaatttgaggacggctcctccggtctctggactctagtgtacgacgagggccttcacttcgaggtttcgactccgcaaaacaggcgtttctttgctttcttcaaataccaactggctccggacggtcagaaccgcgcctggagctactgtcacacgactttggtcggctggtgggaacgccctgctgccccaaacctgtctctccaagacgtcgagaaagctccgccggtctacgacatcccggagcccattgcccccgatactgctgctgacgcgttgctgaagtcggtcaaacgaggctgttggtggggaagaaaagtaggcgaagacctttccgttccgaccaacgaagtccccaaggaacgccgcacccctctggaagtccctctgtggcctacttctcgtccgcctgacgtccgaacggttgctgctgtcgtgaggaagaatctcgccgcggatgccccatgggagcctttggacgaggagtatgtcgaaattcgagggagaaagctgcgcacaatggaggaggtctgggcgcatgcaggacaccagcctctgttgatttccaggcaaaacatagagtcgacgcacttgacactcagtgtcagacctccccttcatttgctcgctgggataaagccttttggaagtcctgcaggatccgatccgccctggcgaaccgttcgcgacttcgactgggctaacgaagaccatgtcgctctcaggatcggacggcgacagtcagttattccagatgccccgaatcaaggaggctgtggttcttgctacgcgatcgcaactggaactgtcctcacttcaagactctggattcgatacgcagcgaacgacgacgttttcggcaaggtcaacgtcagcgctttccagggaacaagctgcaacgtgtacaaccaagggtgcggcggcggctacgtattcctggcgctgaagttcgggcaggaacatggcttccgtacagaagactgcgtcagcgaataccacgccatggctgacaagcacaaaggttcactttcgccgaacttgcagacttgtttcgaccttggcggccagctcgggacctcagcgttcggctgccaggcacctccagctcgagcttctctgccggattcctgcaatttatctgtcaaagtgacttcttggcactatgtcggaggcgtttacggagggtgttcggaggacgacatgctgcgaacgctctgggagcatggtccgatggcagcatccatcgaacctacgattgctttcactgtctacaagaagggcgttttcagagctgcgtacaacagcctcgtcgagcagggggacaactgggtctgggagaaggtcgaccatgccgtggttatttccggctggggctgggcgaagcacggagattcgtggctgccgtactggaaagttcggaattcatggggaacgaaatggggagaaggcggctacgcacgagtgctgcgaggtgtcaacgaaatggcaatcgagcgcgtcgctgttgtcggggaagtttcgctttttcgcgggggggaacacattccacccttgctcgcaaggtctctcgattcacagggaagttcgaacgcttccaaagacagcgaaaggggggagacgctggtcgaatctgtgagtcccgttttccgcggaagcgcgtcgggttccgaaagtggaaacccaagagacgcggcgacgaatgaaagtgcagacatgtcggagtctgcagacgcagacgcagagtcttcgtcggggagtgacgatgacgaagacggggatatggagaaaggtgatgtggagtcgacaacaaaacaaacgactcttttccggcctatccagcgtcacggcgaagtgttggaagaaaagagaacgggtgaatga

SEQ ID NO: 3 - DNA, 2685 bp, Toxoplasma gondii
atgatgctgctgtactaccggctgagcagcgagcacgcggggtcgtaccggcagtgcccgctgtcgtgtagcgcgctgtctctggcagaagtgaagcagctcctcgcggcgcgttgcggattggcgaacgagtatggtcggaagatcgactttcggattttcttggcggggagtcaggtgccaggcggtgctgcggaggctgaggagctcactgagatcgtggacgagaaccagatgatccacgcgtactccaaggtcgtgttgcagcgggtggccatcacatacggcgggagcgggcaaagtgtgttgcacaaagcgcgctcggagctctctcaggaggagtggaaaactgcagaggagcggaagctgagcagccggctgaagcggctgcctcccgagtggctctgtggcctttgtcaccgcgtgatgacgaaccccgtgctggtcagatgcgcgacgaactgtgcgcagtctgcctgccacgcgtgtctcgaggcgcacctcggtccgaatcgcatctgccccttctgcaacagtccctttcgccaggcgattcgcaacaaacgcctgcaagaaataattgctctcgcgaacttgtcggaattcgagtcggcacccggcgccgcatgcgcggtgccgcagctccaggtccaggcgtatcaggcaggcgaccctgcgagcagtgcagtggcgccaggagaaggcagcagatcaacggacctgattcgaagcgcttgccgagagggaccgtctgacgcgagcagactaggttccggagagagccacagtgcaacgggggcgggtgtagcagaccgggtttctggaggaaacgtctgcgaagatagagagactgatgacgacgtgggagcggacgggagcagaggcgacagcgcaggagccagtgacagcttccgcagcgaggcagactgggtccactttgtgtatttggtgcctcaggaaaacctgaaactcatgcgacaatacgacatgatggtcgtcgagagctcctcgaatctggccgtcgcgctggtgagaaaagccacgcagagaggcggaagcgggaaccctgatgccgctgcagagctaggggaacctgcggaaggcgccttgcgtgatggcacagggaactccggacccacaaccgcgacgggagagactgagcagcaggaacaagtgcgtaccacggggagtaaaaacacggatcacgaggtttttgtggtgcccctctgttccgcggggggaggaacgtcgttttcaatagcgggctttgctcgcatcaacagcgcgaggcaggtagaccccgaggccgacagtgccgcggcgactgtcgtgcagcagtggcagagctcctcgggtcgggcttcgaacttgccgggacacggggccggactcgcgttcggcgtgtacaggatatcgtgggacaacaagttcaatccgatgcccatgctaccctcgcgaaagcagcctctgtgcagtctgctgggtgcccacagacggcagtttcacagcaacgcgtctggtgtacctgcagttcctgggcttctgaagcgcgaagtgttcgggggcgcgggcgcaggcatgattgaggccgctgtggaggcggccaagtacgaggaagtcctcgcatgcataaaagactatgctcagtttgggagtcgaccagcggaaccgtggcaacatccagcgtctcagacgtcttctgcagctgctgcaactccaggtctgccgaagaaaggcgtccccgtcggcgggattggccaagaagggtcgcgcgtgcctccgcctccgccgcctccaccgggcagtgtgggggaatcgggcttttcgctttcatctggtaatggtgtttcagttgtcgagaaacgtgatgtatcgtccgaaggaagaggcccgtctgatggtgtgtcgatcagtttcaatgctcggggggcgtctctgccaggatctctcggtgacgagaggaaggctctcgagacaggtgtgtttggcatccccgtgagcctggggccaccgtcgctgggtttgcgtggcgatcctggcgagcctagcaacccgtacttggggtactgtgcgttgcttccccttctcacagaagagcagtttcggcacattcgacggctgcagaagagagccatggtactctgcggttacacacagtctccacctgaatctaggaagaagagacgccgttcaggcaaaaagaaacggggaaagcacagtgtcagcagccacagcacgggtagtggaacccttcctagtgacgagccagtcgacgggtgcgaccgcgtacgtgaggaagcggagaaagagggaacggggtgcatgagtgcagatgcgcctgcggtcgacacaaacacagaagcgttgtcaattcaaaacgcagcaacttcggtcacacgccaaccactgtccgatcccgacagtgccaacgcgactggctcccgcgtgcgtgcgggccgcagagctctcccacgtgtacctcccgtgctcaaaatatcacgcataggcgacaaaaatgacaccgataccacccaaaacaaggacacaggatccatgcagtcgcaaagggccaattctgtcatcgaaacgtgcagcgttgtcgaggaaaacaccatggcaaagattccgggtgccgaggcaaaacctgaaggtgtacccgacaacggaccttgcgaactcccgtag

SEQ ID NO: 4 - DNA, 660 bp, Toxoplasma gondii
atggcagcgcgtgcgggaagcagcggcgtcagccgccgatttctcttcgtgctcttcacggttcttgctggttcctcgttcgtgtccgccgacgacgccttcatagacaatgtgaagaagggtgtcggtgaacatatcggcggaacccctgttgaccttgtcctgaatgacctttaccccctcattgtcaagcaaggcctcggtggcgtgttaggaaagatcatgtacaaggtcaagggtataatgtactaccgcctggccgacggtgtcgccgatgttgtcatgtcggagctggagttctacctgttcggtgagaagggtgcgaatcaatcatccttcaaagagctgcgaaaactttacgaagcctacatgcgcaagttcttcgctgagtctccggaagatcccgttgatgcccttaccacaggtgtctggaaggggctgctgcagcttttcaccgaaaagcttcaagatgctttccgcggcagccccaagggccaaaagatggcggatttgcttttcgactccaacctcacactggtcaagagctggaccgatgccgctcaccttcagatcatgcagctctcctccagttcggctcgcgcgaatgcccttcggctccttcgcgccaagcaaaagaaaccccttgcgcgaaagaactag

SEQ ID NO: 5 - DNA, 573 bp, Toxoplasma gondii
atggtgcgtgtgagcgctattgtcggagctgctgcatcggtgttcgtgtgcctgtctgccggcgcttacgctgccgaaggcggcgacaaccagtcgagcgccgtctcagatcgggcgtctctccttggtttgctgagtggagggacagggcagggattaggaatcggagaatctgtagagctggagatgatggggaacacgtatcgtgtggagagacccacaggcaacccggacttgctcaagatcgccattaaaacttcagatggatcgtacagcgaagtcggcaatgttaacatggaggaggtgattgatactatgaaaagcatgcagagggacgaggagattttctttcgtgcgttgaacaaaggcgaaacagtagaggaagcgatcgaagacgtggctcaagcagaagggcttaattcggagcaaaccctgcaactggaagatgcagtgagcgcggtggcgtctgttgttcaagacgagatgaacgtgatcgacgatgtgcagcagcttgaaaaggacaaacaacagcttaaggatgacatagggttcttaacaggagagagagagtaa

SEQ ID NO: 6 - DNA, 2259 bp, Toxoplasma gondii
atgtcccgccgcatggcatccagatctaggctgctttttgcagctttttgtgcgggcggtgtgctcctcggggccgggccgcctgccgcgcggcagagtgccttcaccgtcgccagcacggtagctggtggagagacgggatataccagcagtttggaagtcgagtctccggaaaatgtgggagttcatgagggcgacgagaactctcaacatgcacatgatgaaatccccgtcgaagctgccgagggcgaggaggtcggctcttcgaggttgagctcctctaaccgcagcagaactactcacgccacgtcggccacgcgcaggggatccagaagccgtcttctgcttcccgcagccctcatttctgctttggctttgagtggattgattggctcctccatgatgaaagagaccgccgaggaaactggcgagcccagagctgccactcccgagaagcaagccgacgcgaaaggcgcaccgccagaagaggcgaaggtcgtagagcaagagggcgcgcaagttgcacatccagagggcgcgcaagtcgcagaagaagactcacgatccaggcagcgtcgcatgcaggccgcagtcttggctgcagttctggtcgcagcggtcatctacggcgtgtacgacaaggcttcattgacgtcgccgaccaccacatcttcagaatcggggacctcgttccgccatccggagctggccctcgaagactcagaggcggacctcggtgggcagctggagatggccctcattgatgcgtcgcacgagacaccagggggagcgccatctgagggcatggctggggctgtttcgtcactcatagctcgtgtggtcgatggagttgtgcaattccttcaagaccccgcttcacagaggaagagcctgggaatggcggcatctgctgtcgccttggcttttctggccgctggtgctctacgggcccggcaagctgcaaaggcattgacacaccgcccagcgccaccccctgctagcaaggaacaaggggaaagcgcgcaggaagctctggaagaacttgagccggctcccgagacacagaccgagcaggtggatcaggcttctatgccactgcccccggcccccgaagactttgacctgcctcctatgccactgcccgaagcacccgaagactttgaccaggctcctatgccactgcccgaggcagccgaagtctttgaccaggctcctatgccactgcccgaagcacccgaagtctttgaccaggctcctatgccactgcccgaagcacccgaagtctttgaccagcctcctatgccactgcccgaggcagccgaagtctttgaccaggctcctatgccactgcccgaagcacccgaagactttgaccaggctcctgagccactgcccgaggcagccgaagaatttgatcaggctcctaagccagtgcccgaggcagccgaagaatttgaccagcctcctgagccactgcgcgaggcagccgaagaatttgaccaggctcctatgccagtgcccgaggcacccgaagactttgaccagattcctaagccagtgcccgaggcacccgaagaatttgaccaggctcctatgccactgcccgaggcacccgaagaatttgaccagattcctaagccagtgcccgaggcacccgaagaatttgaccaggctcctatgccactgcccgaggcacccgaagaatccgagcaggctcctgagccactgcccgaggcacccgaagaatccgagcaggctcctgagccactgcccgaggcacccgaagaatccgagcaggctcctgagccactgcccgaggcacccgaagaatccgagcaggctcctgagccactgcccgaggcacccgaagaatccgagcaggctcctgagccactgcccgaggcacccgaagaacttgaccagcctcccatgccactgcccgaggcacccgaagaatttgaccagcctcccatgccactgcccgaggcacccgaagaatttgaccaggctcctatgccactgcccccggcccccgaagactttgaccagcctgctatgccactgcccccggcccccgaagactttgaccaggctcccatgccactgccgcaggcacccgaagaactcgagcaggctcccgcttcacaccccgaggaggcggagcaggaggtgcctgagagaaaaactgacgcaggaagtgaacctgagaaggatcccgaaacaaacttgttagaggaagaggacgagttgaagccataa

SEQ ID NO: 7 - DNA, 1416 bp, Toxoplasma gondii
atgtcccaccgcatggcatccagatctaggctgctttttgcagctttttgtgcgggcggtgtgctcctcggggccgggccgcctgccgcgcggcagagtgccttcaccgtcgccagcacggtagctggtggagagacgggatataccagcagttcggaagtcgagtctccggaaaatgtgggaggtcatgagggcggcgacagctttcaaagtgcacctaatggcgtcccagttgatggtgtagaggaggatggccgttcgacgttgatctcggctaaccgcagcagaagtactcacgccgtgtcggccgcgcgcaagggatccagaagccgtcttctgcttcccgcagccctcctttctgctttggctttgagtggattgattggctcctccatgatgaaaaagaccgccgaggaaacagacgagacaaaagtggcctctcctgctacaggcacacagcaaattcaaaagaaagtggcacagccagaggacgcgaaagtcgcacagccggacgacgatcaagtcgcacgagacgccttgcgagccaggcggcgtcgccagcaggccgcagtgttgatggcagcactggtagcggctgctgcctacggtatgtactcgtccttgtcaggctatgaggatgcaggctctctctcgtcgccggagtctgcatctccagaactggatacgttgatcatgcagcagggaacgcaattcgctgaacagctggaggcgttgcacgagatgccagtgggagcggcaagtgaaggctccgctgagcaatcgtcactcagtcatctgctcgctgaagttgtggacgcgcttcagcaaccttccctgcagaatatcttgctcgggggagcgtcagctgctggcttggggcttctgggtgctgctgctgctcgacggcgcagaagacaggcacagccagacaccccagcgccaccccctgctagtgaggaacaagtggagagtgcggaggaagccccagaaaaactcgatgaggctctcgagacacaccccgaggacacgcaaaaggcggcgccttttgcactacttggcgcacccgaagaacgagagtcgtctcccgagacgcatcccgcggcatccgaagaatccgagcaggctcctatgccactgcccccggcccccgaagaacttgaccagcctcctatgccactgcccccggcccccgaagactttgaccaggctcctatgccagtgcccgaagcacccgaagaatttgaccaggctcccatgccactgccgcaggcacccgaagaactcgagcaggctcccgcttcacaccccgaggaggcggagcaggaggtgcctgagagaaaaactgacgcaggaagtgaacctgagaaggatcccgaaacaaacttgttagaggaagaggacgagttgaagccataa

SEQ ID NO: 8 - DNA, 1260 bp, Toxoplasma gondii
atggagactggcctaaaggaaaggggcggttctcgccatgctccccggctttggcgtgggccgactcggcacttgctgtcgattcgacttgcggctttcgccggcttgacttttctgctcgcggcgtcgcgagtttctgcagaagtgggggctttcgagggaggcatcggcgaccacgtaacgatgcatttgatagggagaagctgggagatgcacggaggcgcgtgcttcgttggccggccgaagaacttggtggtcgacccggtgttcggtacatatggcagacagccccaagttctcgagacacacaaaaccggtcctcgtctgtgcaaatggctagacgaactttttgagcaacatcaggcgcggcggtctgagtgggaaagggcgcacgaagctgccaagtcgcaagtgtcgatgttcaacgcggtgcggcgcttcaagaacgccgtcacagttttccccgagttccaagtggagatcgagtcgaactacctcagtctcttccacgacgactggtacggcaaccaactgccctggatggccgccacagtcaagtacgttgagccgaaggacggatacggcgtcttccagcacctgaatcgcgtcttcgctgtgccgggagttccccaggcgcaactcgtattctttctgctctaccctgcgccgacgttcaatcagcctgtgaagctggagaaaccggggaagggcagcatcgtctccggcttcatcggcggaacgggactcggggcctcggtgtcgcacatgcgccgaggagacatcggcgacctggttgacctcggccgtgtcatttacgccgcagtgaaaaagaatttcaccatccaagcctctctctcggacttctggctgaacgggggcaactgctacatgggatcacgcttcaaggtaaagggcacgatccagggcgtgactctttgtcagtttctcgcgggtgaggcgagcaaatctgtgtacggagcgtacaaagctgccaagctcaagtccgtccatctgacagtgacaggcgtcgatttgtttaaccgcgcgcagcctgagctgcggtgcctcgtcacggaggggctgttgcttcacgatgtgcacgacttcacggtgagtctggcggtcgatacgaatccgcaactcattcaacactttcagcgcactacgcgtctggccagcatgttcaggtgggtgaagctgataggcaggttcctcgtgaagatcggctcgacgttcatgaaaccttcacaaaagaagtag

SEQ ID NO: 9 - DNA, 1311 bp, Toxoplasma gondii
atgagggcgatcgtggcatcgacgcagcagtttttgcgtccagttggctctcggcccctcgcgggtatttcgatcgttgtggtggtcgcgttggcaatagctttagggactgcagctgacgttgggcgacatgttggcggtttctcggggccgtttcccatgactctgcgaagtggccagtggagactcgatcacggagcatgcttcgttggaaaagcaaagaacctggtagttgaccctcttccccgtgtatcgcctcaggggcctcagccgctcgatgtcacgaccacaggaagcgctctgtgctggtggctggacagtatgtatgcagcgcatatgtccttgaaagcggcgtgggaaaggcggcatcaagaagcgaagaacagaacctcctggttgaatttatggaggcgcttcgccaattggtgggcctcgtttcctgagtttcagatcgacgtttctgtactctacctcgatctgtggaacgacgacttctacggccaccctcttccgtggttcagtgcggaattcagttatacccctccatcaggcagatacgcgtacaacctcttcgacaaactgcagtctcattttgcgtctgctccgggaacggcggttcaggaagttttccttttgttagcccctgcgccgacattcaaccagcctgtagagaaacggtcttccatcgttgcccgcgcagcaactgttgcagccggcaacgaactatttaaggaagcattggggcatcaacgtgttgatgaagttttgtcgatggtccccgccgacccgtttcgtttgatgttgagcaccagtgctttctcatttcaagctaaaatcggggatttctgggagcgcggactggattgcatgctcggcagccgcctgaaccttcgctgggatcaagttggtacaagtgtgtgccgctatatgactgcaaaagccagcgaaaccggctctggtttggccgcatccttcctcaataccgtggaggtccgggtgactggcatggacttcttcaatcatgcagcgccggtcttcaaaacagaattcatcgagggaatcattaccaaaagggctacttacatcccggtgagcatgtatttaagcacggatcctacgctcacgcacgagtacgaagccgcaaaaactgtcaagcgggcggtccaagcaggccgtgttggagcagctcttgctcgaggtttggtgaactttgctagagcgacgaatcaaaaggctgatgagtcacatgaaggtcaaaccaaaacaccaacatcaggagtgcgcggctctgcaggcagcaaacacaactga

SEQ ID NO: 10 - DNA, 1227 bp, Toxoplasma gondii
atgcaggcgatagcgcggggggaccgctcgtcggggtggtcgagttgtagctggcttttctatttttcgtttctgcttctaacgagtgaagcagtggctgcagctgccagtttggagcagacaatttcctattctgtccaacatcaaccgcagcaggaaggcatcctcggcacacagaaaccccagactgccccaactcctcagcagctcattgtgcccgtaagctatctaggagatggtttgtcatacttctctggagttcttaggcgtttacccctcgatgttgcattggaacgtttaactagtgctcgggaaataccaactgtggcaggttttgttcaaaaatatgtgctggcggcccagctatctcgatcccttcagagcacggcgaacggcgtgaagaagattctaatgcgtctcgatgcagccaaaaatgaagaaggatttataacagatctgttgaagtccgctcctgaggttcaagaagttctgagccgtttccttggttctgttgcgtctgcacttgctcttttggacatcaatggtctccatgaggcggttgacgctagtctccccgtgacaaaagcagtggtcatgctgtacttacatctagtgagtgtcgtaccgccgaaacaacgggatcctttctctcctttccttctttatctgcaagatgccgtgggagagttcaagatcatggaggaccatgtcgcctctgttgttgctggtgaggcacaggaggaaaatgttataaacagtcaaccacagggaacggaaacgtcgcacagggcggtagtgagagggggcataagaatgctacaatctgggacctccgaaaccacgaagctgcggaggacgtggtggaggttatttaaagtggctgctctcgccgtcttaacgatggcactgctgaaatatggtacgcctcgtgtgcgcgcttttctcgagagaaggcggatgcgccgaggcggaggtggggacagtggagactttggagaagaggggcgctcaaaaggagacgtgtcaacttctgatgatatgcccagagagccgccgccgccgtacgttccgcccatgtatccgttcgccgaacctgaacacagatgggctggtacgtacggaacgtctcatggaggttatcgagtacaaccgacagctccacccgcccctgcgtctatgctatatccgagtttacacaggctgggctaccagagaccaagcgaatag

SEQ ID NO: 11 - DNA, 1653 bp, Toxoplasma gondii
atggtgacaacaaccacgccaacgccacccggtgcgccggcagtggtgcccatcttcgacgttgtctatcaactgaatccgcacgtgtttagaagtcgcttttccaggaggaatcgcgccaggcgtgttgcgagcagcaagtcacgctcgataattcggtggcttgggtatcttacggtgctcgctgccgtcattttgctaggagcgtatgcagtaaggcgtgtatcgcgcgatctgtccgactcagtgcgggaaacacgacgaggcaggagaattacaggcagcgtacctcccgggactacccgtccccgttcagagtcttgtactggcacacaagtggacggcggctgcggcgctgacacgtcaaccgatggaaagtctgagagtgaacagaccgaaaacggggaggactcacgcttttccacccggacccctattcatgtcactgcatcgacttccccattcgcgacgcgcaaggcggcggaagaacgctcttcgagtccgagagacagaaaagttccggagggtgcccaactccccacgtcgtcgacacctcatgcacaaagaaaggactcaggtagtgatagccggaacccatctacactcataccttcaccaggtaccaacacgtttaacatgaacttttatattatcggagcaggctcttcagcgctcgattttattttcccgcacactccggatgctcaggctacagtcgtctcccccccccgcagcgcggcggccgcaccaactgtcgaaacagttccaagggttcgcacttactcgacaccaacaacattaaccctaccaacggcaccagcgaccgccactagcaaccacatgcatgcctcagcgactccctcgccaccggaacgtcctcaaaacttccgtgggggactcatgcggcaaaacggcatggttgaggggacatcgttaacgactaccgaggctgggatgccagcgccgttacaaagccctcaacacattgagacggaggcgaggttaacgtactcaaatcatctcaagagcccgcatacaccagaaactccaactgtccactcaatagaccccgttgtcggcaccagtggccattccgtagcggtgggatcgcagtctccagccggtggacctcctacagatagccgcaccccagcggcactgacccccacaagttcttctttctcacatgcagattctcttgaaacctctgagcatccgcaaagtggaccgtcgcttcatccattaatctccgggatacaagatgccgtgcaaagccaacttccactatcacaacaggagactctccctgtggtagaaaatgcgactttcttcgggccgcaacagactccaccgtggatggacgaaactgcagctgctgcaattccactcgctccctcacaaccagggtcacgtacacaacccatctcgtctccgcatactctactttcccgtagcggcggtgtgtcagctgtgccaggaccacccagaacagaaaaccctcggcaaccacaagttccaggcgaaaactcttactactctgtaccaactgagcggacgatctctgatccaggtccccaaagggcgggtgcggctcaggctgatggtatcggggctggaggcccacgggacacacaatcagcggtaactccatga

SEQ ID NO: 12 - DNA, 558 bp, Toxoplasma gondii
atgttcgccgtaaaacattgtttgctggttgttgccgttggcgccctggtcaacgtctcggtgagggctgccgagttttccggagttgttaaccagggaccagtcgacgtgcctttcagcggtaaacctcttgatgagagagcagttggaggaaaaggtgaacatacaccaccactcccagacgagaggcaacaagagccagaagaaccggtttcccaacgtgcatccagagtggcagaacaactgtttcgcaagttcttgaagttcgctgaaaacgtcggacagcacagtgagaaggccttcaaaaaagcaaaggtggtggcagaaaaaggcttcaccgcggcaaaaacgcacacggttaggggtttcaaggtggccaaagaagcagctggaaggggcatggtgaccgttggcaagaaactcgcgaatgtggagagtgacagaagcactacgacaacgcaggcccccgacagccctaatggcctggcagaaacccaggctccagtggagccccaacagcgggccgcacacgtgcccgtcccagacttttcgcagtaa

SEQ ID NO: 13 - DNA, 663 bp, Toxoplasma gondii
atggaccgtaccatatgtcccttttttatacagagtttcacaatgtcaactgctttgaagcggctcattccatttctagttccctttgtggttttcctggtcgctgctgccttgggaggccttgcggcggatcagcctggaaatcatcaggctcttgcagaaccagttacgggtgtgggggaagcaggagtgtcccccgtcaacgaagctggtgagtcatacagttctgcaacttcgggtgtccaagaagctaccgccccaggtgcagtgctcctggaagcaatcgatgccgagtcggataaggtggacaatcaggcggagggaggtgagcgtatgaagaaggtcgaagaggagttgtcgttattgaggcgggaattatatgatcgcacagatcgccctggtttgaagcgtgctgtgattttatctcttgggacaagtgcattgatagctgggaggatgttttccagtacgttgcgagccgctgtaccgtggtatgcagttgcgttcaatgcgattgtcgccgcctactacattcgcaaagttcttacctatcgtcgtcgagtgatgacaaagaggcaacccttcatgagttcggtaaagaacttttttcgccgcaggccaaaggatgggggtgctggggtggacaaagcctccaagaaataa

SEQ ID NO: 14 - DNA, 1038 bp, Toxoplasma gondii
atgcagggcacttggttttctttatttgtcgtcgtcatggtgtcgcatcttgcgtttggaggtgagtgcagctttggttcttacctcgcagatatggcgggcctcacggggcgggaagacaaagaacaccatgcggcgaaaaagagatactaccactcgatgtacggaaacaaaactccgtatccctacgcagacggacagcagggctctccacctcctcagggacagctacttattatccaaaaccctgatggatctttcatgatcgtagaccaacaaggcgtcccgcaggcgccccaggcggcgggaggcccgggttctcccatgaatggcggttactatatgcctgcaggtgtctacactgcacaagtcgttccaggaacacctggtcaccccgtacaggcgattccgcagcagcctcttcgcacacaagcaacggccacctattatcacccggcagcagctcctcctcccggtccttcagtttttgtcttcaccccatcctctgttcaaccgggtgcggaggtgactcccggttattctggtctgcagttgagacaacagtctcaatacgattacagctatccaggtactacttctactcccacgcctccacgaccagcgtcgtacggctacccagcgtttccggcatttccacggctgcccgcgttttctgactcagtttcggtttcaactgaagatagtgggcttacagtcgtcagagactcgtcatcctctgaatccacggtcacgccggcagacgaagctgcttcggagtccgaagagggagacaagacaagcaggaaatctaaggtcaagaagggagtcctgacggggttaggggtagcagcaacgctggcagcagcagcggccgccgcaaaggctgtcaagggatttggcggcacccgcacttccacggcgcctgctgaggctggaaaaacggagttggacgacggatatcgcccgcccccattcaacccgcgaccctcaccctacgccgagttattgaaggatttggaaagaatgcgcaaagagtga

SEQ ID NO: 15 - DNA, 363 bp, Toxoplasma gondii
atggcgtctgtaaaacgcgtcgttgtggcggtaatgatcgtgaacgtgctggctttaatttttgtgggcgttgccggttcaacgcgtgacacagggtcaggcggggatgactccgaaggtgcttgggggggtgaacaacaacaggtacaacaacacggacaaagtgaagaccgatcgttattcgaaaggggaagagcagcggtgactggacatccagtgaggactgcagtgggacttgctgcagctgtggtggccgttgtgtcactactgcgattgttgagaaggaggaggagacgcgcgattcaagaagagagcaaggagtctgcaaccgcggaagaggaagaagttgccgaggaagagtaa

SEQ ID NO: 16 - DNA, 675 bp, Toxoplasma gondii
atggcacacggtggcatctatctgaggcagaagcgtaacttctgtcctttaactgtctccacagttgctgtggtctttgtagtcttcatgggtgtactcgtcaattcgttgggtggagtcgctgtcgcagcagacagcggtggtgttaggcagaccccttcggaaaccggttcgagcggtggacagcaagaagcagtggggaccactgaagactatgtcaactcttcggcgatgggcggtggccaaggcgactcgttagctgaagatgatacaacctccgatgcggcggagggcgacgttgacccttttcccgcgctggcgaatgaggggaagtcggaggcgcgtggcccgtcgctcgaggaaagaatcgaagaacagggcacaagacgacgttactcctctgttcaagaaccacaagcgaaggtgcctagcaaacgaacacagaaacgccacagactcattggtgctgtggtgttggcagtatctgtggcaatgcttaccgctttctttcttcgaaggactggacgacgctctccccaagaaccatctgggggtggtggtggaaatgatgcaggcaataatgctgggaacggtgggaatgaaggcagaggtgaaggaggcgaggatgacaggcgcccgttgcacccgggaagtgtgaatgagtttgatttttaa

SEQ ID NO: 17 - DNA, 711 bp, Toxoplasma gondii
atggcccgacacgcaatttttttcgcgctttgtgttttaggcctggtggcggcggctttgccccagttcgctaccgcggccaccgcgtcagatgacgaactgatgagtcgaatccgaaattctgactttttcgatggtcaagcacccgttgacagtctcagaccgacgaacgccggtgtcgactcgaaagggaccgacgatcacctcaccaccagcatggataaggcatctgtagagagtcagcttccgagaagagagccattggagacggagccagatgaacaagaagaagttcatttcaggaagcgaggcgtccgttccgacgctgaagtgactgacgacaacatctacgaggagcacactgatcgtaaagtggttccgaggaagtcggagggcaagcgaagcttcaaagacttgctgaagaagctcgcgctgccggctgttggtatgggtgcatcgtattttgccgctgatagaattctgccggaactaacagagcagcaacagacaggcgaagaacccctaaccaccggccagaatgtgagcactgtgttaggcttcgcagcgcttgctgctgccgcagcgttccttggcatgggtctcacgaggacgtaccgacatttttccccacgcaaaaacagatcacggcagcctgcactcgagcaagaggtgcctgaatcaggcaaagatggggaggatgcccgccagtag

SEQ ID NO: 18 - DNA, 810 bp, Toxoplasma gondii
atggctttaccattgcgtgtttcggccacggtgttcgtggtcttcgctgtctttggtgtagctcgcgccatgaacggtcctttgagttatcatccaagcagttacggagcgtcgtatccgaatccgagtaatcctctgcatggaatgcccaagccagagaacccggtgagaccgcctcctcccggtttccatccaagcgttattcccaatcccccgtacccgctgggcactccagcgggcatgccacagccagaggttccgccacttcagcatcccccgccaacgggttcccctcccgcggcagctccccagcctccatatccagtgggtactccaggaatgccacagccagagataccgcctgttcatcggccgccgcctccgggtttccgtcccgaagtggctcccgtgcccccgtatccagtgggcactccaacgggcatgccccagccggagataccggcagttcaccatccgttcccctacgttacgacaaccacgacagctgctcctcgtgtgctggtttataagattccctatggaggcgctgcgcccccccgtgctcctccagtgccaccccgtatgggcccgagtgatatcagcactcacgtgcggggtgcaatccggcgtcaacccgctaccgccaccacaaccactactacccgcaatgtactactcaggacagcgatactggctgcagcggcagcaaccttgatagccctgttcagacaaagacctttgttcacggagggggtacggatgtttccagatttccaatacagattcaccgtccaaacgacgcagaattaa

SEQ ID NO: 19 - DNA, 957 bp, Toxoplasma gondii
atgcggtcactcaagtcaatcgtcgtgcccctctcggcagcgttggtcgcagcggcggaactcgaccttttcctcggtgaatcgggagtctacttattcgggaaagcgtctgagtccgacgtcgctctgaaggttccagaggatccggttccggaggaaccgcgccgtgaacccgagaagcacgttgacctcttcggcgaagactggaaacagttcggcggttccggattcggagatttctcgaaggtggagttcgagaatcttttttcgcaagtgcatgaaatgatgagacgccttatgggacgaggtgtggatggatttggcccgtctcttctcggcgactctcccggtttccacttcccccgcctcagagcgttgcaaccgaaaacgaagctcgagaaaactggcacgtgccagtacgtggttacttgggcgccggaggtgacggcggagaacgttcgtgtgattctgcacttgcagaggcgccaggttgaggttcagtaccgcgcagctactcgccgtgatgagaagacggagggcggcgagagccacagcatgtcgaaggagcagtcttctcagctgatgtctgtggacccgcaatgcatcatgacacgagaagttgtcgcacagaaacttgctggctggacagacaacactcacaccgcaacagcggggacgccgaaaaagctcctcatttcgtttccgtctccggatcacatcaaggaaatggtcaaggaggggtatctgccagacaacgcgctggaacgcgttcttgcgggcgattttgagggattctcccggacccagatgtgcctggtgtccggcagaaaccgaacggagtgtgcgttcgcagagggccaagaggtcgaactcgaggagaagccgcttccctcggattccagccctgtgacgtccgtcgaactgccccgactctcgcaggaagaccgaggactctga

SEQ ID NO: 20 - DNA, 903 bp, Toxoplasma gondii
atgaaatcgggcagttgccctttcacgttttcgcccactctttctcaccctcttgaaatagcctggcgagctcgtccacttcagtggccggaaatcgaacgccagcccgaaccagctgctccctgtggcgcgttgtatcccgcatctcgcgttctgtccttttcacccacgatgcgagcgattcgttccgttgtcggccttcccgttatgggggctgcagttttcttgggacttctcagcggagaactgcccaactcctccgtgttgcccgtccccgaggtggcgagcacccccttcctcctcagcgtcgccgctgacggcgatggcggcaaaaactatgcggaagtcgccaaggtggaagcgttgacaaatatgatcagcactcccattgagctcttcgtgaaggacgtctggcaacagctgttccataaatctggcaagcccgtgtgggaaaacatgttgttcaaattcggcagtatgatccgacaccgcgccgcacacaaggccactctcgtgattatgtgggaactgaggcacttcctgtatggcactgccaaagtgaacccctcggcgtggaagaagttggagaccaagttcgagacctatttgcgtgagtggtggatgactgtccctgaggacccatgggctgcactgcatgcaggggcgtggaagtcgctcctcaagctgtacaacgaagacctggagccgcttctgagaggcagcccgaagctgaaggacctggagagtatcctgttcgactcgaagctggcgacgatccgcagatggaccgacgaggcccacatcgaagtgatgaagggccggacttctaacatggttcctcggcttgaggccctgagtgcgaagatggccgtgaagcagaaggccatgcagggcaagcagtga

SEQ ID NO: 21 - DNA, 1518 bp, Toxoplasma gondii
atgtatcgaaaccactcagggatacggcttgcctgcaggctcttcgaagttggagctctcgttttagctttagaaaatgtctctggtattcaccggttcgtcgccgggattgagtggaacgaagggaaagaggattttcagtacacgacgtctccttgggtgattccacctgacggattagtcagtcggcgacttgctgaggaacctcctagaaagcgcttgcgaaaaacaaacaaatcagatcgtgactcagattctgctcaaggttccaggacgacttctcctggcagtctgggcggttttggtgcaacaggtgggcgtgttgccgctccgcgaatacggagtggtgttgtggcgtcggaggcgatccgaggtacaatttggaggaggccaggtgaagtcgaaggcaccttgaagcttcgtagaaccaggcctcaatattcacaaacagatggagatggcttgcaggggaacaggctttcatcgacaggggaacgatcaggaatatcgcatggggcgcagtctctggcaatgcgcccaaggacaatgggacaaacaatgaaatctttggagagctcatgggattcggatccactcgaaggaacatcacgggattggctctatgtaacaacgagtgagacaactgcttcgcccggccttaccggctttggagggattggtaaaaagcttgcccctctttacgtacgagataggaaatttgacttacttcaatttgtgaatctgacgaggagcaagaaacaaaaactcttaatgtcatcaaagagcccctcgctcagaaagctcctcatgaacgacatggcccaggaatgggctctaggaattttgcagatcgtgttgcagggacgacaaagagctctgcaggcttcccacaccacgcgaactacagaacccgcaagtggtactgacggcactagtaaatcgtcggaagacgaagcaacacgagccagtgagggcaacgcttccgtcaaccagacatcccccgccgcgtcatatccgcgacggccctcttccgacgaagggcaggacagcggacgtagaaagtgttcaaagcgaagtccgtctcgtctcgtacagaacgctcctctttttctgaaggatgatagtcattcactgaaggacacgctggatttagtaaaaaacaagaaccgggagctgacggagaaggggagggtacatgccacccccctgagggtcgttttgttaaatagtatcatgatgaagaaacttgagaaggtcttgccagtcgtcgaaagcatggacagagcactgatggctcgtcagacgtcttccgaagcagcgactgtggacgactctagcacttcaatttcacatggtatgcagggtagtaccagctcaggtgcagctgctgtacagggtcccagcacttcagttccaggtgcttcgggaggtcttggtccttcgggggggaagcggaaacccgacgacgaagatgattttgactgttcacgcgcgaagcggaaaaatgatcagatgtga

SEQ ID NO: 22 - DNA, 1242 bp, Toxoplasma gondii
atgcatagccggaactgcgtcggaggatcgttttatgacggggccgtgtgttgttcgcctccatcgcgtgctttcggcaatatgcacaacctagtcctggtgttgctggcgtttctgtcttcgtgggaagacaacgaaaccaggcgcggcgatgtggtggaacagcagaatccttttcgcctagcgattcacggcaaaactgagagagaccgtgacgggaattgcacacaacacggcgtgagatcaaatgatttccgtttcgtggatgaaggtgacatgtctgctgaagtaggtcgtggtctggctttacagaaacatgtccgagttccgctgcaggcttcgattgctcggcggctttctgacagggagtcggaaaagaggagccaaggttccgacaacggaaacggcactaccccacctttgccaccacggcggaccccgtctccgcggccttcaggagccagtggagttgtccaacaaggagctgccggtgtgggcacgcctacgatgttggggacaggtggccaacatctctctgaccagggagctacaggttcagtcgcaccatcagtgcaatcttcctcatctagtgctgtcagtgttgagggtgcattgcctctaatccagtttttcggaagccgtagcagttctcctgaagtccctctatgtcatgcgtgccacactgtagaggcagctgtaggcgtgcttcaaagcataagacaccgcagacgggctggcgcgcgtgaggcagctgagcgaatagcggcactggagtcccaacatgctcttcttgtcagttcctccacccagggagagcacagtcaaggtgcacggccaagtgatatccttgtgagtcaccgggcgctacaacgggcgcgccgagaggccacccgacaggaagaaacgctacggggagaagaagcctccctggaagcgtttatacgcgtggcctctgaaaagcgtgaaagagaagggcagaggtctctcgaggtgctccgccagcgcgtggaaaatcagactgcagaacttgctgtgttacgcgtcgaggcagcactagagcggcaacgtgaaatggtggagctcgagaggaggcgcggagacttactggccctggccttagtcgcagaagacgacgaagaatatcttcggctgagtgcagaagaagaagcagtccaacggcaaatcgagcaattggcggaggaaacgaggagaccgcgccgtggccgtagaaagcccgcgtga

SEQ ID NO: 23 - DNA, 1506 bp, Toxoplasma gondii
atggaacgcattgttgtactcgtgtcagcgacatttctctatgccgtcgtgggcagggcatctatggcatcagcagagatggcgtccagaacaaagcgactatatatcctcatttccttccattgtgtgctttctgagattttaagcggccacgccgcggcggaagccacgtcgaagccagcgcgccagcccgaaggtgcgggacggtctgcttccccgtcaccttcactgtcacacgcttcaggtgttgttgtaggggcacgccggcggaggcttgccgaaggcagtcccggggaggagcctgatcccgtccgtgaattgctcgatcttgaggaggagctcgaaaaccttcatgcactgcggttcaaagaacgacttgcgtttaggcaatgtgtgaggcactggggtactttcgacgcctactgtcgagaacactcgagatggaaaagcaagatggcggcggatccagagaggatgagagatgcattcgaaaggaaacaagcaaggaagcagacggcttgcaacgtttgggcggcattgctagatgccgcccgtgagaaaattgaggccatggacagggagaggaaacagatgcaaagtcgactcaccaaggaacaaacctccctgtatcttgccgcaaaagctgcccgcggtcgagctcaaatcgggggtgatagttcgcataccgctgtgggtgaggcagcagttggtgcgagcacgagaccgccggctactggtgaaagtcctacgccaggtgactctggttccctggacgccttggataacgaattagcgcgactaaggcaggtaatttcactggcgttaggcaaatggcatcgttcgcgccgggctctgaaggatcacttagagcgccgtgtaccgtctactccgccgggtgtgccttcacctgaacgagaccgtgccggtgaagcccgagccgtatgggaggcgcaacacctccaactcgaacaagatgctaaacaggcacgcgaggccgttgataaatttcgtgagcggttgcgggaacttaacgcacagaaagctgcacatgagaaggcgcacggtgtctctccgggcaggagaggctgtgaaaatgctcctgtccgcttctcccgtcttggcattaccgttgacgcacgtgaggcggctataccgtggtttcaacgccctaattttttgaccttgagccaccgctggagtggcgcgcctcctgatccagctgcacgaccgcctcctcgctacagatatactgtgtttactgctgaggtacaacacgtatcacgtccaactctgaagccacgcagcaagcattctcgccttcgtgtagctgatccaacccgcgagacaggtgccgaaacgaaggcaagcacgagtacgtctggacttgcaggaccatcagagttccaaaatgaacgagtgcactgcgctctatatgggactgacgaatccgtcctcgacagtagcgagtcgttggcaaaaccgtgttttgtgaaatggcacggctga

SEQ ID NO: 24 - DNA, 1629 bp, Toxoplasma gondii
atgctccagatggcacgatataccgcaaacatttgtgccgtctctatttgtagcctggtattggtggtggcactttctgttggtattcttccaacgccagactggaaggaccgggtgaagatgggcggcactgaaagcgggcctttcgttttacaggtctgcgctagtgatcccctactccatgacccgaaggaacgagagtctggatcagattcgaccagagggtatcacggcggaagctccagcggaggtagcagtagcagacagggtacgacggtaagaagcgacgcgggactttcgtcccagagcagtcagtcttcggcgtccactagcgccaagactagcgaaaatcaccgacaggggccggcgttcctgacatcggtattccgaaaaggtgagacccctgcgctggactgggtaccctacggcactctggaaggcgcaaaatggcacccagggcagcaaaaatcgaagaggcgctcgtctgctaccaccagcagacgacagggagcatcgcattctgggaatcctggacaactgcccgcgccgcgtggaggcctccagccaacaacgacactcagcgggactggtggacaacccaggactgactcgacagacgagggggctgccgcgacgtcggtaatcccaaatcgttcagggtatccccagccagtaccgtatcttatccaccctgttggatttttgagtggagattatagatcactagggatgcttggtctcgtcccatcagtttataccgctacttcggttcagcacatggtaggccaacccggcacaataatccccctcgtgctattgcccggaaagcaagagccggaaggactagtatctacaggaactctgtctgattccttagtctatgagccacttggggttgtgaatcttgggaccgaaatgccgaatcaaggttcgacttcacagtctggcgccgtggctagcaggaaacgaccagcgggtggggccaatggtccggacaagaggcgtcgtgtggaaccagcaggactcacagaatcgcgtctgcggcctgaacccagcttatcctcactcacggaaaaaggttcaacagcgttttccaccaggccgccgtcatcccgcagtgctctggaaggactcacgcaggagacggtagaaatgctgctggacactccatcatatcccatatcgtcagtggtatcatcaccacctccagctagaaagtcatccacctcgtcatcccaacatctggaagctcgactctcacaatcaagaggtcctcccaggacgaggcctcctttcaacccgtggtcaacgaagactggtcttcttgagagacgaggagtgtctgagcttccaccgctatacatccctcgtcctctcgcttcaggctacaggaatcctgcggacagtcgaaagcactccacagtcactcctcaaaccacacctccagctagaaagtcatccacctcgtcatcccagcatctggaagctcgactctcacaatcaagaggtcctcccaggacgaggcctcctttcaacccgtggtcaacgaagactggtcttcttgagagacgaggagtgtctgagcttccgccgctacgcatcgttaaaccacccactaagggtaattaa

SEQ ID NO: 25 - DNA, 948 bp, Toxoplasma gondii
atgaagcgtttctggttgtgcgcgctgctttcgctgctcgagttttcatggggctgcaactctctcggtcccagcctgccgtctttccaggtcgcagaaggggcatttttcggtcgccttcggaactggttcggaaagaacgcggagcagaagccagaggtgccggtcgctcccgtagcggacgatgacgctggaagtgaggaggagagctcctcccactacggcgtcaagactctcacggcatcgactactactactacgacgacaacgacgacgacaaccgtgacttccacgaagcctgagggcgtctgggaggaagagtatgactccatggaggtcccgtacaccccactcccgcctctccgggggattgggctgctggggggtgcgatcttcgtcagtctcgctttcaatttgggcaaactacctctacttatggggggaataggtgtagttcagtatatcaactcggttgtgcaacgaatgcacgcgcgccgcgccgcggacgccgcattgagacgctttgaggatcgccgggagctcgttcgtgcaagaagacgacgacggtggatccagacgttctactcccacaacgcgttgcagcaagaccgcgcgacaaggaagggagagacacaaaacgaggaaagcaatgcaactctagccaacagctcaacgggtaaaggcgacggcgggactgcaggaagcgaggcgccgcctcgcgggatacatgcagacgctgcgtcagaaaggacatggaacactggtggaaaaaagggctcgcttcatgatagtggtcttcacgccgaaggcagcgacaaacgtacaaacccttctgagactcgagaggtcccgaaaacgcggctcaggaaaccaacggaaaggaacaccaaagcacaggtgaagaagaagaccccgagggagaacctcccggaattcgatagaaactga

SEQ ID NO: 26 - DNA, 5715 bp, Toxoplasma gondii
atgaaagtacgttctgtgctctcggttggtttctgggcggctgcatgcgtagcctttcagacaaatcctgatctcgataatctatgtcatgataatagcagaaattatgagttccgcttgttggattccgtgtttctcacgcgtgagggtctatggacatctttgcggatcgtcggcacggaggccgcagcgcactcgccaactagcacaaaggaggaacaggatcccgggtcgtcgaacagtccaggtgaagacaccagcggaacccagttgccacaaggttcgactcagtgtgactggagaaagtgtggcacaagagagcaggtggagaaaacgattaaggaaatagaggaggaatggggagatgagtcggcttttgtgacgcgtaagcttcaacggcgtatgagcaccccttgcaggttaaaaaaacacccctgcccaaaacaacggttgacatgggagcgtgaaattagggaagaattccgacgggtagcgccgcgtcaccttgaacgcgcggccacgctcagaaaagctcttgagcagcgacctccaagtatgtctggcagccttgggacacagagcacgggaggtactttaccgcaggcgactcctgaggacacaagcgtatctaggatgagtgccactccgggtaatgcagtcgaggtagaacttataggtttcgctgttggtaacgatgatactgatatccctgttttccgcacaccggggcctccgggtacaacatcagctccgagcgagccgcaggccggaattccagcgacattaggcggcaagcccgcaatcctcattctgcccaccaccagcgatgcttcaaccggtggacgttctatttcgcagtcgggaactaatctcacgcagcaggcaagcttccagcaaccaggcggtactgcatctgggccgtcaacgtcgtcctctgtttctacgtcacaaacagcgttaccacctgggaacgtaagaggcgccgccggtctgggcacatcaaccccatcaaccacgaatctgcatcaggcatcctcgaaaaattcgactgtcgatccaggagcttccagcagcagtggagtatctggcgtcgcccaggcttttccgggggtactacctggatctgttatgcatcaggcactacagcgaagcggtttgttgtcacaaccgccaccctcagagcgccccgccgcaagtaagagaaggcggaaacgaagaggtggcgaaggtgaccttgccagccagggggtggggcgtacaggagtcaaccagccggtagcagtggatccgtacgacaatacaccttctccaaaattacgattttcccctctgcgaaccgcagagggcgccgcaggtgcaacaaaaccaccacatctgttagccagcttgccaagctccgacccaggcatgttttcgagcacagggtctagccctactggcagctcgcgtctaccttcaccccaaggcagcagttcgtctacttcgttgtctttgggtaccgctcacaggaacagtcagaccacttttcctttgaagcgtgaaccgctgcctccgggcacactagtggaaccagttgtaccgttggtcccttttgcggcaaacaaaaacggacgcctggaaactgtccttatccccagtgctgcggtagttgcaacaggcggatcgtcttttccgcaatcgggaaccgatgccacacagcaggtaggctctcagcaaccacgccgtactgcgtcggggccgccaacgtcgtcctttgtttctgcgtcacaaacagcgttaccacctgggaacgtaagaggcgccgccggtccgggcgcaccgccccctcctgccacgcatccgcatctagcatactctaaacgttcgactgtcgatccagaaccttccctcagcagaagctcacgtggagtcccccaggcgtttccgaaccttcagcagcagccacaagggaatgttgtgcatcaaccactacagcagcagccacaagggaatgttgtgcatcaaccactacagcagcagccacaagggtctcttgtgcatcaaccactacagcagcagccacaagggactgttgtgcatcaaccactacagctgcagccacaagggtctgttgtgcatcaaccactacagcagcagacacaagggtctcttgtgcatcaaccactacagcagcagccacaagggaatgttgcgcatcaaccactacagcagcagccacaagggtctgttgtgcatcaaccactacagcagcagccacaagggtctcttgtgcatcaaccactacagatgcagccacaagggaatgttgtgcatcaaccactacagcagcagcaacaggggtctcttgtgcaccatcgaccacagcatcagccacaagggaatgttgtgcaccaaccactacagcagcagccacaagggtctgttgtgcatcaaccactacagcagcagccacaggggtctcttgtgcaccatcgaccacagcatcagccacaagggaatgttgtgtatcaaccactacagcagcagccacaagggaatgttgtgcatcaaccactacagcagcagccacaagggtctcttgtgcatcaaccactacagcatcaggcacaagggtctgttgtgtatcaaccactacagcagcagccacaagggaatgttgtgcatcaaccactacagcagcagccacaagggtctgttgtgtatcaaccactacagcatcagccacaaggggctcttgtgcaccatcgaccacagcatcagccacaagggaatgttgtgcatcaaccactacagcagcagccacaagggaattttgtgcatcaaccactacagcagcagcaacaggggtctcttgtgcaccatctgcaccgtcgaccacagcatcagccacaagggaatgttgtgtatcaaccactacagcagcagccacaagggtctgttgtgcatcaaccactacagcagcagccacaagggtctcttgtgcatcaaccactacagcagcagccacaagggaatgttgtgtatcaaccactacagctgcagccacaagggtctgttgtgcatcaaccactacagcagcatccacaagggtctcttgtgcatcaaccactacagcagcatctacaagggtctcgtgtgcatcaaccactacagcagcagccacaagggtctgttgtgcatcaaccactacagcatcaggcacaagggtctgttgtgcatcaaccactacagcagcagccacaagggtctcttgtgcatcaaccactacagcagcaggagttgttgccacctggggtgcagccggaaacttcggtgtcgtggaagcctgcgttggcttcagctgacaaaggccaacaacgttcatctggtaaaatgcttatgacgcttgacattcctgggtcgtcaaggcgggcgagtgagcgtgcgtactacgcgccatcacgtgatggcgcgttgctttttgaccagttgtttcccgaatttcctttcgaaggaacatcgatgaatcaccctcagcattatgctggccatgacactgcaaacgtgggtgatagcagtcagcccaagacagcgtactcaacaggagaagtagcgggaccggcgtctagttttgattttctctcacccacgggttggaagcgtacgattcgcagtattgagacgccgcatcctggacatggttcgcaacaacccggggggggaggtacagtccttccgtcttaccctcagttaaaagattttgatctcacgttgttatcgacccctatgccagctcctcaatgggacacttcgacgaacgcaccttctgaaaatgtcgcggcgaagacacaagctgtgccaacacggggcgacgagagtggcagtgtgacatccccatatgaccaactttttagggaagccgctgccttcaacgaaagcatgcgttcagatgaagctcctaaaagttatttgacttccacgtcaatgcactttcaatcagctgccccatcgagccagaatcgaccaggatccctccaaaacaaaccatcggaaagtggaagaaccagcggtgtttctgctgtcggacacaaagcagccgctccgcacgtgaagccttccgacagggaacaaaatccatttcagctttttgttgagccactgcctagtgcaccaaaaccaacatctgcttttgcttggccagaagcagggacctcctttgagccagttacatcagccgagtcgatgactgtctccggggggtctggtaagaaacaggccaaaaggagcacgtctcctgtaacggcttcactggagcagtcaccttttgagaccgtatctgtctccagcgccaccgagcttcaagcgccttcaatttctgaatacggctcaccaaggacacatctgtcctctacgcccgcggtgaaaggtccgtctgcgggcccggtatcttccacgtcaaacgaatttgggagtctccttgcggctgcgttacgggacgcagggtggtcggatggcatgacagaagacgaagcgaccgacttcgttctcgattcaattaaaaacttagaagaactgcaagtggcaaatgaatgggatgctgcatcgacggagacaagacctgctgctgaagggggtacgcaacatgcgtctttcaacttagtgtcgacgctactaggccccgacgccactccgacgccaccaggatcgcgctctacccctcctgggggaccgacgaagaaaccatcagccatgggacgtcagaaaccaagctcacggtccacttcagattcgaaagttgaaggccgaagttcaacgcgcgattcgagtctcgtcgcaccatcgacttccataggagcagcggttcgtgagagaagcaaaacttcttcgcctggtagctcctctccgcaatcaaaacaactcacggaagagtccttctctctgggtaccaaagaggacgatagcgcatctatggttgaaggggatgagtcacaggttcaatcgtccaaggctaccgcttccgccacaagacgccgtgcttggcaagggcagcgtctgaatatatttggaatacagccggaaacaccgggaacacagcctgttctgcagttcatgagggaaagcaatagagggtcagtctcgactgcaaaatccccggatactccagtcacatctgcaccggggggctcacagggtgacagcggcaatgacggagtggggttagtagccggatcaagcgtgctgccttcagcagtgcaaggtaagtcatatgcctccatctccggcatcccttctcacagggagagtctttcgtcttccatccaggatgtgcagccagggggtgttagaggtgcaggccgtcgtacaccaaatgtcaggacgccagtaagtgcctccccaactaccgtgtttccttttgccagtgaaggattgttgaagaaaactagcaaaagacagacccctgggttagaaggctatacaccttcggcgaagactcgtagggagactggtaccgttcttccatcgagtctcggagagtggcaagggctcacgcttagaacaccaatgaagtctacaagtccgggtgcttccgaaatgcagcctttgtccagtttggtggcttctacgtcccgtggtgcactacagcctgccttgcctggttcgatgtctccgagcagtagcgctcgcccccaatctcttcgagcgccgtctcgcggtagctccagttattccgaatag

SEQ ID NO: 27 - DNA, 2598 bp, Toxoplasma gondii
atgcgaccgttacgtgtggccgttgccctgttctgggcaatggttgcggtggtggggttttgggcttcgccggatagccgcttgaccgtgcgaggtccacagtttgcagacgcggcgacacggggagttgtgaaatctttgaaacgagcaatgaaccagggctggcgcaatggagcccacagcatttgcgcgatcctcggctgtgactacgagcatgtcaaagcgcatctaacgcataagcccactttcttccattcattcaaggcagtgtgcgctcagttggacgagttcgaggaggaggttacacacgccaagatgcgagaggaagacttgaccccgagccagagagagtaccgctggctcctcctttcgaagggggccgccttgatcaacgatgctctgggaacgcagttcgaagtgccggcttcctacgttcctcacaacgcgaagaaccgccactacatacctggccagcgcggggagggagacgagaaggagaagttgaagacccgaatgaggggactgcaggtggttgtcccgcttccaaccctcgaggagattcaaaaggacgggatggaccgccttgcggccgtaagggagaaacacatggcccaaatcaaggagctggaggatgctcgtcatcgaaagttcttgctgcttcaggaggaacacgaccgccagacagaccagctggtttctgaacttagactgaagcacaccgaagagatggacacaattcgtcgcgagctggctgaggagaggcgcctcttcgagcagagcgtgaaggtgtgggacgcagtcaaccgcctgctcactgacgctcacgtcggtatcgagacgctgaccgaccgtgtccacacgatgagtcagcatgtgttcaagttgaacgtgttctatgagaagctgcactcgttccaacagacggcgaaggaaaatccgactggcgctgcgccgtactctgccctttcctacgctttccagagtgaagcggctgttgaccaggcgatgcaccagattgtcgcgatctaccaagaagcgtccgcaggcgtcgcccgagttcaggagattttgaatcaggccgatggggtcatggcgacggctccgacaagagacgacgccgcgtggtttcagcaacgccagcgcggctacaaagaccggctggagagcttcgtcaaccttctctccgacctgtcagtgcgactggaggactacatgcagaccgctgaggagcgaaaactcgtgacgctgttcctcggagacgaggtccgcacgcaaatcttggctctgcttcaggagcggaccactgagtggtcgacgcgcctcgcgacattgcgcgaacgcacgcaaggcatcgagactgcggccaacaagttcttcgagagcagcacccagctggatcggacgacaggcgaggttgtgagtgcagttctgcagaaccctgaggcattccttgtccaggtttccacgtacgcgacggagtctggcacccttcgctcggcggccggcgtcatcgaagaagacttgaaggccgtggtcaaggcgttgcaagacttgggaagagagatgactggactgacggaaggcgtagcttctgcgcaactccctcctgctgtcttggacttcctcggactacccgggctcttcaatgccctccaggtcgacatgcaagtgaaggcgaagggccagcaactgttgcaactcatcaagggccgtttgagccaaactggcgagataacgcgaaaactggagatgttgaagagcgaggtgaagaacatcaggagccccgcggtgcgtgaacaggcggaatgggcactcaccgaggcgtcgacaaagctccaagatgtattgcggaccaaggctgaagtggagctggagatccagcagatcaatctccagctgcagcaggtccaaggcaccgttactcaacttgaccagagaatcgctcacgagcgcgtggtggcacagcgagcagcggccggcggctccgccgctgcagggttgcgcggaggttcgcttgcgcttggcggcagcgctaccggttctatggtgggactcggaggctccgtgagcggacttggcacagattctcgagctgctatcgcggatttggagcagaagcgacagaatgagaaggaaaagattcaagagctgcgccacaatctgtcctcgaagcaacgtgaaagcgtcagcctagacaacgaagcccggcgcctggaggtggaagtagcaaacaaacagcgtgaactggcggaggagcaacagagagtactgcgcgtggcgactctggctcaggcgctaacaactggtgcatccccaagtattggaatgtcaatggcaagcatgcgtggagggcttggcttgactggaggcttagcaggcagctctgcggctctcatgacacaagggatcatgggttccagagcggcgggtctgttgggaggaagcacggctggacttgcgggagcaagcatgggtggacttgcaggaggaagcatgggtggactcggaggtgcaggtatgggcggctatggaggcggaagcatgggtggtcttggaggcagaagcacggacggacagttgggaagagggacacgttaa

SEQ ID NO: 28 - DNA, 1914 bp, Toxoplasma gondii
atgcgtcacatttttcctgatgactcggcgactagcatgagggctctcgtttggggtctcggggcccgtgtcctctggtttttcttagcaggtgttctcgctgctaccgtggacatcgctggcgccgatgggattggacagggtatgcctgacagtggtttcaaccatgtggatgcagaggcgcagccgacggtgtttatccgtgaagagcacgatgacagtgcaagctctgaactcgtcgaggacgacggaacatacagtgtggcccggcgctttcgtctgatggttatggccgaccacaaaaaggacggacgtgcatgcgaaagggacatggttctgcaggccgcggatattacaagattgagagtggggggttcgcgaacatctttcagtgctggactcgtccctctcgtcggtctccctttgttggcggcggctggcctgaaagactacatcctcggagtgaacgcccctgttgatgagctgcgcctccccggcgccagggctctgaccccgcatgacgtggtcgacggtgttgtttcggttggtcccggacctccaccacggcccgacggtgaaacacccagaatagtgccttttgggggtacgcaagataagcctttctggaagtcaaagaccttcatcggatcaggagttgccttggtcgctgccattatcgctggactcgcgtcttcgtatagggcttcaaaacaggagcggtctcgacggggtttgctaggcggcgaacagacggcagtgtgggatttgtctgattgcatccttttagtcgacgtgggccaagcgcagtcccgaaagtccatttttggcaccttcgtgccggggtccgcgagactcatcgttgactaccgtcggcagcgtgctcgcttactgtacgaagaacgaccaccgcttgttggaaatcttctattccgtcttcggcggaagagcctcaacaggttcgaggactttcagctgaacacaccgcactgctattttcgaccagacttccaaccgctggcccagaaagagaggacagaagtttctacgaaaaaggaagatagacatgcccccctccctctgacctctggaaatcttttcttccgtgagctgcttgattctaagggcaaaaaaaccgagggcatcgcgatccatttcgtcaaaaaccccgggtgggtggcccctaaagaggctctaccccttgcagcggcagcgcgaagcgccgcgtcagaccttgatttcaccctgttgatgcgccgagcagcagccagaaatctggtgtgttcagaaagcgtaaaaggaggaagtggcggcatatcaatgtgttggaagtcgtctcccccaacaggttcgttgcttttgtggcacgaggaggtcttgcagcatagctgtcgcgtcgtggctgcctttcgaggcagtgttaatcattcggtctgggcgaactttgcaactcagcaactctctataggctccgatgcgccttctacgcgcagtgataatgtccgttccgtgctgagcaagtgcttgctcctcgagcggaatcctcccacgtatggtgttgcgctgaagagagcaacgatctcgtgtccggacccagcaacggtgccatgcggcagtatcctcttcagacagaagactgacgtaggagtactggagggtcactccggcgcttcaacgtcgtcgaggaagcctactgaggtagcttctacggtcttgcaaggaaaggaagagcccggtcttgtaggcgcaggtgccgcgacccaaatggactacagagggaacaaggagacttccaaggtgatacagtcttcagtagagttttttacggtattcatagtcgattttcagcgcaagccctccgattggccagtactgcttgagatgaggaaaaaggatgcggcaagaactagaacctga

SEQ ID NO: 29 - DNA, 1581 bp, Toxoplasma gondii
atggaagtcagacaccgttctgtccagttattctgggtggtcgggttgctggggtttttgatttatgtagtgtcacttcatggttccccggtgaatgccgcggttgttgccgaatcagaaagtgaggctggagacactgcccttgtgcttcatgacactgaagtcatgagctctggcggtacctccagaccccagaaattggtgaaaagagtgcaagggtttcttcggcgctattcggctcctatccgagttaccgtgtcggccattattattttcctcctagggtattacgctttccagtacggcctccggaggcgtcctcaggatggttctcggcgggggcgtcaaccccccgatgaggatagacaaagaggcagctcgccggagactgctcctgagcgaggaacgggggaaagcgattcttcgggtagtcggagtcccgaaagatttcctctgggctcacctcctgcttcaccagaccaagccgacgatggcgatgggtccaagaaatatagggtggacgcatcctctcttttggggaccagaagtgacttgacccgtccatcgggtagtagtgacgaagcaagccaagtacacggccgtcaaggcttggatgtttcggcctccagatcaccaccttctccagcatctggggggaaacccgtagaggggcctttacattccacacctgcaacggggagtccttcagagactgtccttgtaccagcagacacacaaagtccgtgctgcggcgcaaagggctcgcttccaaaggaaacatccccgacaagagacatcggaacacacgttcccggaaaacgttcgccgccatcaccgtccccactgcaaggcccgcgtcttgcttcatttttcgtgggctctgaaagcgggccagagggtgacgtcgtcataatccactcaggtgggccttcttcgtcgtcaggcagcagcggcttgggcgacagctcagtttcaccgtcagatggtgactcaccgacgccaagcgctcctgcacgaggcatgcagcaagagggacctgtggggggcagcagctcaccggagcaaggagggaggcaggcacaggcacccattagtaccactactgcttcctccccacaaacaggggtgcctccagggaaagcagcgccgacatccagaagcgatggcaagccgccgccagggcgaacgggcgtcgataaggtcggagggccttctcgtggaagggggtcgccttcgcgtagcccgggtacccggttgagcctttcaaagaccccacggggaccagttgcctcaccgacaggggggctacgaggaaggggtggcagccatgcagcatcggctggacgagggccgttaccaggtcctcccgggaaaccggagcagcgtccaggagttcttggcccacggacgaagcccttcacaccaaaaccttcgtgggtgccaccatacggaacaccatcatcccggcgtgtaggaagtcgtactcgggaaccgccacaaagtcaagaacagcatccgcaggccccgtctggcgaggggacgcgtgacttagacggtagagaccaagacgacagcaggtga

SEQ ID NO: 30 - DNA, 2052 bp, Toxoplasma gondii
atgtctgcccagggtcagcagggtgtccggtcaacagtagcggctggcaagaaccgcttctggcaaccggcacctatcaccgttctgcttgttctttcatcatcatttctcttcgcgttcgcggctaataccccacagaacagttcgacgacggggcagagcacgcctagtgatgaccatggcgtgtcaacagaacatatccacgatgccgtcacggtagatgcggctgaacacgctggagaggatgagatgacagcttgttcaccggaggcggctcgcgtaatcgaagcacgcgtggcgacgctgaaggcggagactgaggctgcggtcgcggaagtgcgcagaacagaagccatgcaaagagagttgttcggtcgtctcaacgcgaaagtgcgcgcaatgaatgaccgcctcgatgagctttctgacgcgcagaaaagcctagcgaagcgcctggaaaccacaggtcagctgcttattgcggatcgtgaagaacaagcaaaacggttcacaaccgatgtcgaaacgtacattatcgagtcggggctgaagaaggccgtctttcagcaacgtgaaattgccgccaaactacagactcttgccgagtcaaaccagaaaagtaagcaggctttagatgctttgcttcagcatgtggacgacgaaaaggagcaaacgaagcagtggatatcaacggtcgttcgcgacctggagaagtatgtcgaggcacgcactcaaaccacgctcgagagtctccagagggacgcgcaggagcacgcgaactttatgcagcagcagctgaatgacatgaaactggatcacttgcttctactgcaagctgtcagcagcgcagagacgcagctgaatgaacgcgggattgccggggtagacatttcccagctggacgagtcagcgtccttcgagaggatgatgacgacgttcgagaaggtcctgaaggaacagctcaaggggaaatttgtgttgccgatcttcgtcgtgacgcagtgcccggactccatggagagagtggcgttcatgaatacctacctggtgccatcgaaacgcaactttcgcgccgtgtttcaagctttgggacatacacctcaagcctctgctgttgtcatccggattgagtcagttatggttgaggcttggatggaggtgaatggaaaagtgacaggcatgcagtacctcacgcctcctgctcacgaggcgttgaccgtgaccaccaaggatcggttcggcttcgaatttctcaggcgcgtgagagagcttgaaacaggggattttaaggctgatccacacggacgcagcgtcgttattgcgtttgtggggaatcggaaggggcgtattggaggactgccgctgacagatgtaaccgagttcaacaagttccaagccctgcgtaccctggcaaccatgcattcctctccgataaaggaaacaaataatctttggcaaatcatgaagacggaggtggatatagtagccaccttcgcagccatgccacgagttgaagttggcgggagttcactacgcatttaccaaggaatcgcgccggagccgaggctgcccgcatctccgttttgcagaaacgcgttcacgctcatccgaatagaggtcgcaaaatccccccgtgggaagcaagaatacgtctatcctaaggcgtcactgctgaagaaggtgttcgacatccttgtatctacgaacacatcgcaggattcaggcggtgatggtagctttgccgtcatcagggcaaacgttagcaatgctggttggctgcagtctaagctctatgctacggcagaccgaatggcagtcgaaatccatcgtcccgtccctgggacagctcctccctcgttctccagtgaggatgttgcgggggaacaccgtgccaatagtatggctgcggttgtagaccaaatacgaaaacaaatgaccgatgtcgtccttcccaatattgatcctgaggacagcacctctcgtaggcaggtgcttgtacacatttgcgaaatcggcgttacctgcaactcggatcgccacccggaggcctga

SEQ ID NO: 31 - DNA, 1137 bp, Toxoplasma gondii
atgcggcatcaagaacggttcgacctgcgaacgggtgtgttgttgtgtattggactcgtcgggtggagtggttttgtggtgcaacattgtgcctgctccgacggagttttttctgtgcagtctccaagcgcaccccagcatgacatcttgtgggatgctaggaaaacacaggacgagttacgtgcgttcaacggggaatcttcgggagaactggcaaagggtgctggaattcgagctacagaaggtgaagtattcgctggaggtagggctgcagcaggcgtaatatcagctgaaattccagctgaagagggtggagaagcagccgcaaatccaacttcagagcgtgaaatagaagctccagctgcagaggatgaagcagaagctgaaatctcggacgcgagtggtggcgttgcagtcacaagtccagctgcagaagaggagcgactgtctgcacgcagtgccagtcgtccgagtggcaggcgcacgggacccgacggagttcctagcacccggggacttgtattcactgctggtgggagtattctagcggcggctgtcatgatgttgttaagtcgtctttcaaggcaaagatctatacaagtttggactgtctggcgcgaagagcgacagtccttgggattgtccgttgcatcagacgccttagttgtcgccagcgccctcgttgctctactaggtggtaaacgcgtagtcaaaggcgtaatgcggaagcgagaggctactaggcgaagacgtagagacgaaattcctggagttgaaatgccagccaagcgcaaacgacggagaagtgaagctgagggtgcacgggccactgaaggtgtcaaagtttcggagcttgttgaagatgaaactccgtctcacgtctcagccccaacggaaccaggacggacagcaatcgctgcaacagctgtgacaggggcagcggccctggcaggaagtgtagcactggtgttgggttctcgtcgatggttcaggtactatcaccaagtcgaggaagagtcccgaaggctagtggccgccggtgctttattcactggtgctttgtttgctgcatacaagctatttaagcaagtcagggcaaaattagctgcaaggaggaagaagagcacgaaggcgtga

SEQ ID NO: 32 - DNA, 1137 bp, Toxoplasma gondii
atgtatcccctgactgtttactcgattcttgctgtggttggcctcagccttgtctgccgagggattgcgacagagcaagtggtcgcagctgccgccaaatcaaactccgaagaaaccgtttccacaggaatcggcgaatctgcagaagcaagccccgttaatcgccccaggccgaaaccgccttcaggtgatgcgaaacgtgctaattccgtggcagtcgcgaataccatcatcccccgatacggggaagcctccgtcgatgacacacagcgacggggtctcgcgcgggtaacaccgagacctcgactccgcaagtctcagagacggtccagctcactgtccagacgacagcgactgttatataaagttggcgcggttataattgcagttgtaggggcggcaatagccttcaaaacctggtattcgaagcgtcaatatgagcttcgtgaacgagcgttctgttacacgcgtggtcgcgctgatgtagcacaagcattagttgatggacttctgacggagaggcacaaggtgaatattctcatcaatcgtgcccggcaagaagagtctgaggccaagggtactgctgaacaccgggaacttgtgaaagtacgggaagctttggaagattttgacgtgctactggaaaaacagcggcaaaatgcagaagcacagtggagcgagttatctgccgcagcagctgaaattggcaacaaaattgacgttagaacccttgtcagaactgacccggacaaagcccaggcgtcagaggaaggacgcttatatcaagcaaaacatttctggcagcagctccagccggaggaggaggcactccgaggccagctattaccagacgtagtcaggttggagggtgaagtcagggaagctcgcgacagagaccttccttcattgagcatgctttatcaacagttggagcaagcgaaccgtcggagggtagtaagcactgtggacgaccagctggaaagactcaatcgacaactgccgcacatggtgggtatggatccagactacgccgaggagcacatcctgtacacgcagcttcctctcagaggccccgcctacgttcggatgtcagaggacgtactgcgacaagtacaggcggaaccgaaacagacttga

SEQ ID NO: 33 - DNA, 1359 bp, Toxoplasma gondii
atgcattcgatagtgtatgtggtggtctccgttctggctgttctgggccgcgtagacgggcagcccctggggtcccggaaggcgaagccgggtgccggaagcgcgccgggaccttccgtgctgccttccagcttgccacacatcatcatgcagagtccaacgaagaacccacgtaaacaacgaaaacactccatggcttccggagacgctggcgcaaaaacagcaacagtagcagaggaagccgcaaaggcggtcggcgtcagaggggacactcctggggaccaggcctcggcacgaggtccagatgagaaggaaaagcgcgagactgcggcacggacgaagcaaaacaaaagcacagcaactgcgaacaaaccaggggaaaccaaggacccctccactccattagccggggcagagggcaggaagcctgaattctcgaacggacaagaaaatgtggttgacgaaagcgacacacgagggtggcgcgatggttcacgctcgctgattggcacggagaatcctgggaaggcgaaaaccaggcgcctgactcggccggcgtgcaggcgactgcggtatgctattggtctcgctatagggactgttcttgccttgttgtcattctacggttatcggcgctatcgtgatgctgagatacgtgcggagagaaacaggaatgcttcagcgtatttctatcttactgggcgaaggaatgccgctgtcagtctggctcagcagctccgacatgagatggacagggtttcagaagcaatcaggttccacgaacacgaacaggaaagatatgaaagggcaagattcgacgaggacgcgaaggcagcgatggagacgacggcagccttggaggatgtacttgagtattttactgaaaaacggaaggaagtggaaacactttccgtccggttagctgccgcagcagatatggtgggtgcagatatcaccaggcaagacatgaggagactcacgccggagcaacagcttcagattgtgcggcaaggacgtttcgatgaagctcgatcactgttggaatcgacctcacgtgaagctaaccttctgagagaactatatgtgcctggtatagtggaagcggaagaggaggtggagagagcagaacctggctccgaggagctattcagacgacggcgagacctcagagaaaagaaggaaacccggcttggcagtgcagtcgatcaccacttggctcgtgtagtccgagagataccattcagcgtcggcattcctgaagaacaggctgctcagctacgtgcacctcccggtatagagccggtacccgagcatgttctggtagccatgcaggcaattgaaagggcacagcgtacgtag

SEQ ID NO: 34 - DNA, 657 bp, Toxoplasma gondii
atgtataccgaaagatcttcgctctcagctgcagttgtgatggaaaaagaaggggtgacgccgagccagtgttacgcaattccccctgaacgggaagacgccatgacgctcgtgactcagatgttctggcggtggacaatcgcctttctcgccctaatatacgttgttgcaactcaagcgaatgcttcacggccagccacagtgaggaaacaatcgaatgacgcagacggagaaggagaggttgacactggtgtcgcaggtcgccagacatcaatgcctaccactcacatcgggggcctcgctggacgtggacatcggggaaaacaaactagaaaacagtacattcatctagacgcgttgaatgaggatgtggaaccggaaatcaaggaaccgtcactgcggcccctctcccagaaagcgactcgaagagccaaatggtcgagacttcttttggagttgcttcccgcagctgttttcgttagccttctgataaccatgatgtcccgggcacgaccagtgaccagggtacacgagacggtaactaattttctctatcgtcaaggcgtcgatgtttccaggcaactacaggagttaagggatgaacgacagcgtgagatagaggcagaattcgtcgatattcccccagacttggaatag

SEQ ID NO: 35 - DNA, 3261 bp, Toxoplasma gondii
atggcgatcctccgtctttccttcgtgttctctctctcgttgctcatcgctctgtattcggtgtggcagcatatgctgcatgcacgggcgtccaagccagccgtgttgaggaagctgcctggcgcgagtgagctcctccgatctctttcgggttcgagtatctctgcgtggaggcgcgtccgcgctgtgtttcacgaaacgctcgttttgacagatgtcgacgacacactgtggtcctcgggggcctggcggttgggggggaagactctcgggggagttgacgaggacctctctaggggtcaaacgtaccccggtataggggctctctacttccttctttctgcaggaccgcacgtgacagcagctcctgtcaacaagttcctgccgacttgtccggtgcccctcgtctccccgctgttcgagacctgccaagtgggagacgcgcggaggtcgctggccggagcaaccggccgagtcacagacacttgggtgtttggaggcggggaaagagcgaaggaattgcaggactctcggaggaagcctgcagagaagagaccgctgctcccgcctcgcgttgggctactgacagcccgggcgtccagtgcagccatgagatctttcacgcgatccccgtcgttctacgcggccgtcaccgccgcactcattcatggagcaagacagatctacggccccggagtcgacgactggggacgcgtgcgttttgagaataacatggaacttcttcgagatgtgattggcggccaacactcgcgaggccgggggaaagtcagtggcttcaaggaggccctcgaaaggtttcctaaacaaacgccagtctttgtcggagactctggcgaacgagacgtcgaagcggcagcggggatggctctctttgcacaggagaaactcgcagccgtcttcgtccatgtcgtcttcagtaattgggaaaatgaaaatccggatgagatcgagcaagcaatcgcggctccgagagctactcctttcaacctcagattcaacaatcggcggattccagccctgcagctggcatacgacgtccaggcgaacttgcatcccagcgatccgaaaccagaaagtttcgcggcgctttcagacacacatttatattctgcaggcatgcgcgtggcgagtgtcatgaagccgctcatgattgcgtacggccaccagagccggcggcaaagggcgaagcctacggagagacacgacaggaggacgaacaaggatgaggaaggcattggagacattgtggcgcttcctatctttttcctcaaatttcgggatttgactgtgaaacgaagtatgtcggttaggcggcaaacgacttcaaacccgttcaggaagctgtactcccacctctccacggggttgaaaaacagtgtctccaaggtggtcgacctatgggctgaggaagaacaactccgcagctatacggaccttcgcacagttcccgctgacgagttaggcgtcagtagcgatccaggcgttccgttcatcccgtacagaacggcattgggggctggtatatcggcgttcattctcgaaatgattacgttccaagatttaatcaacttggcggtgtcttcgatccgagacttccggtccctaggcccgcctcagtcgtgcgcccagcagcagggtttggaggatttgtattttgacctgaggtacatgctggaggtcaccggggaggccttgcagtcggtacatgtggagaatcgagcgattttcgaagacggggtcgcggcgatgcgaacctttcacaccaaagctgtcgacgcatgcatcccatcgggtccggccgagccctggactgtgggcgaagaaatcggcgcctgtctcgcgctgttccgaactccgcgggcagctgcgagcccccccagggaccccacagacagcctcccagaggcggcaggcttaggcgacatcccgcatgcggttctgccgcttgcgcgagtggtgtgcactttcgtggatcaactgaagcactggcgaagcgcgggtgctgacgagactgaggtattgagtttggaattctcagtcgcgttgaatgaagcggtggacatgagcaacagaccgttcggcatcggcggacagccagtgacgagtctagccaacctctctggagacagcacctcccgcgaagttccaaggccctctggaactttgcgtatggaatcacttcccatgtctccgctacgcgacgcggacgtcgcgtctgtgtttcctcgatcgctgcgttctcgcccaacgtctggcaccgtgaatctttcgttgccaataccacctggctcgccgggaaactcttcgtttcctcaggtctccctcacgggtcagcctggtgatgaggcagatgcaaggccatctggacgaggcaacgagtccaacttcgtttcttcgtcgggattctcgccgctgtccgccacctctcccgcctcagaccccgcaccgatgtccccggatcgggcgcatctctattggacaaaagaggcagaacgtcaaaacgtcgaacgccgaagttccggagctatcgcgacatcaactcaagccccggctgcatctcgggatctaccggactcactgcagatagaaggaacggtagattctccttcgtcgttccagagtcgaggcgcctccgcagatcgtcagaggcctcagggtcggatcgaggacggcgcctttgcttctccgttcttgcctggcctgtcgactacggcagggccatcgggacagggacgaacctcggtggatctcgtgcgaagcggagcgcttagctcgcgtcttaacgcggcctctggggcagctcttggcgatgttatcagcgccgcgccgagcgactgtccattcggggggctcaggaagttgctggctacaatgcgcccaatctgcgagcaccaaaagaagcttcttggagatgcctcgccgtgtgcattgatgtcacaccttctctacgaagagggtctgatgcacatcttcgccacagtcacggcgtggtacgaagacggcgctcgcgagcctctttacatcacgaaaatgcacctcactctggatccggcggaagccaaattagagacgctgaggaagagagaaagcgacaatttcgcgcatttgggtatgggcgtcttgaaacgcggcagggggcacagcacctacgatattgaccggctgcaggcgaaccatcgcgagttcgctcggtcctaccctgggttcaagaatctttcgtgcaaccccttcgaggcgtga

SEQ ID NO: 36 - DNA, 2766 bp, Toxoplasma gondii
atggagtcgaatcggcgaagagcaccctgcccccccgcctctggggtctctcccggcagtatcctgtgcttgtttctcttgtctcttcttccttgcgctctcggagcatcacagaagaactcagccgagctcctggactctctggcgtgtgtcggctctcctccggagacggcggagaacgcgaccgcgtcgctggggtcctgggagcaggttccctgcctcgatgcggcatctgtcagtgtgttcacttcgagaaaagaagtgcaggccggaaacattttactttttctcgacatcgacgacaccgtcatcgcctccggaggctggaacgaggtcatgggcaatagcctcggtggcgtcgatgaccgatatcccaggggatcggagtaccccggcttcagcgccgttctgttcctcctcgctctcggaccgcatgcgcggaacttgaagagcggacaactgacggagttcgcgcctccgtcgaaagccatggtcgttacagctcgacccaacttgccggtctttagacctccaaacctcatgcgacatctcacttccatcctcactcgaggtgccagacaaatcatgggcgacaatgcccctgagtggggcgtcggctctcagaacgtcatgaaacctgctagcgttttaagaggcacatacggccgaggagaaaataaactttccttcatgaccaaggtgctgacggaggggcgccccgtcaacgagtctcggatcgacgagaatacgaaggtcatgttcgtcggagattcggccgaaagggacctggaagtggcgattggcctctcggcgatggttccagacaaggtggcggcgcaccttctgcacgtcgtgtacagacacaacagtggcgatccgacgcagatgcatgcctctcacacagtccagacgggagagaagttcgacgaagacggcgtcttgagcaaagccgctgtgacactccaggaaatcatttcgggagcagcgcgcacggtcgcagccgccacgcgcgcgttgacggagaaggacgagcgcgagaagcaccgacaaactccaagagccttcacagagagtcagccgacaaacaagaaaatcagtttccaggaggctctcggcaacaccacgcgcttcggcatcagagtgggtcacgcgctggttgacgcgattgccttggtgtacgacgtgtacgtcacgagcgacgacgaagaaggcccgaggagctgcgccgagttgagtgcatctcaggcgttcgaggtgggcgtcttgaccgcacggaagatccgcttgattctggatctctaccgtcatcgctggcttcacacctactcgacctttcgcacccgggaggagcaggaggctgccggggcgtctgtgtcttcgcgaatgcttccgatcttcttcgtcaaatgcggaactgtcaagctgcgcgtagcccacgaggcgccccgacaggcgcctctcgacgtccttttgtcggaaatgaccggtgctcgagaccgcgtcaccgtgcgcttccgaagcgtcgatacactccacgcgggctccgaactggacgcagagaccgtgagaagcaacatgcttgacactctgggaatccccgtcgtcccctacgtcaccagcatctccgcggtcgcacaagcctacgtcctcggaatcgtcgacctcaccgatgtgctcgtcgtcgtcagaaagacttacgagatgctccgagcgcaaggccccctggcgcagccggcgcgtttgctgtctcttctggaccacttccacgacctggaggccctccgcgccatgctgttcccaggcgggaagggggcgttgcctgcgagtgcgccggtgcgcgtgcgggcgactgtcgactatctcgatgagcttggaaaggtccagaaggcgttcatcaagcgcgcggcttatcttcgggcagtcccgacccgcacagagatgtgcattcgcgagatggagcgaaatgctgagagccactacgaccgcagcctgaagcgtcaacgaggcgcggctgggaagagtgcgcccttcacgcggtcgcagttctccgccttcgtctctgcgtttgccgagctggtctgcaagtttgacgtcgagctgtcgagcgtccagtttgcgggaggcgccgaggtccacggcttgtccgtctacctcagccgcttggtgcgccaggccgtcgctgcgacagaaacgacgcctttttcaagcgcgcagaagaagaaggcgccgccggagagccctgtcagcaaggctgtggcagagctagcggccacgaacgcgggaacggagaaagaaaagaaagacccgaagaacatgggccgcggcaaaaccgcatgcaccctgtctgacgatgtgcgagtgacatttgccaccatgtacaaagccttctgcgcagacgtcgctcgagacgtctgtcaccttctagagacgcgattggttaccagcggcgttctctcagatttcatcttcctcgctcaggaacgtggaagaaagtatcaaggcccgcttcgcctccctcacctcggacgcgtcgttttcatcgacgaacatggcctcgatgattttgaagtgtctcaccagaagcctctgacggatgtgattgggtccatgggggcaaagctggacgaagcgatcatggagcaagcgtcggcgggattccgcttcgcaaagtggcctggcttggattcgtggaaccagtggacacaggttgcagcgtccctgcaattaattgtcgactgtggcttgttgaaccgcgggacgcagtag

SEQ ID NO: 37 - DNA, 2901 bp, Toxoplasma gondii
atgcgttttcctccagcaagctgtcattctgcatcccgaaaagaagagaagccctcgcgagacgccgagatgcagccccggctgatccggaccgtcctggcgaccccgggatcggcgccaaatagcgcgccactgcgtccgcgaatccgcagaccctcgttttcttttttccctcgtttctccaactcgttcgcctccgcccgctgtctcctcttcttttcgctccttctctttgtcgctctgccccccgctttcgctgctgtgcgcagcaacacaggcacctcgcgtgaagctggcgaagtcgacaacgcgcagccggcggctgaccccgaagtctctcgagcaccgcccgccttggcgcagccgaaagtttccttcagaggctggaagcacggtttgtcgaaccgcatcacccccattgtgcaggtcgaggatgttttggtttcctcgggcggcatcaggcgccatggagatgccgtgtatggcgaggacgctcgcctgcgtctaggcgagccgtaccccggcacagccgcgctcgtgaatctgctttccaggggaccgttccccgccgggaagacgccgcggagcagcatgacgcgaccgatggtgactgcccccctcttcgtcaccctgcccttcctcctgtctgccttcgtgccggcttgccgccccggcgagtgcaggcgaaaccacgcgcagcgtcgccgcgtcgagggcgaaggcgccgaggccgcagaggcagaggacaaaacggaggaccaggctcgggaggccgaagtcgcgcgaacgcgggaagtcgaactcgaactcgtccaactcatcgtcaaaaaagacctcaacgacgcagtcaacaagaccactcgagaagccagttccacgtggcaagccggtgcttggtggtcagacctcccacccagtgtcgacccgtccaaaacgacgcctcagcaggctgccactcacgtcgttcaactcttgcaaggtgctgcccacgctctgggaccctcgaactcttttgtctactttttctctaccagcacacctcggggtctcttggatgcctgcgcatccacgtttctcgaccgtaatatcggcgtgttcttgcatgtgccatcgctgtccgcggaagacacggtgtctcttccccacgaagccttcgtcttccctctggcgaccctgggacgatcgaggcccacgcctattccagctgtcgtgttgacctacgacgtgaccgctcgccagaccgtgacggtcgaccggccgacgccttctttgggagatgtgtcgcctgagctcttggggaaactcgcgacgcagttgcagccgcggcttttgcgagttctgaagttctttgggcaggaaccacgcgcacatggccctctgccggtcatctttgtcaggttcagaaatgtagaaattcagcagatcgtcgatccgtggcacggccacccgtcgaggtatctgcagctgcagagagaggggaaagctcccgcttccaacaacttcgcccgactcacgcccgtccctcctgaagaagcttctggaaagggccatgcgttcgaccccgagaaacacctgcaacacgcagtgcccatcatgacctaccgaacgacggtctctgctgccgcccaagcgcatgtgatgaatcttatcagcagcgctgactttgcagaacttgcgatcttgacagtaaaagacttgcgtggtcgcgggccactgttccagccggcgacgcacgagtacgtgtcggctctgaagagcgactggaaggtttatgtgactctggcgaagactccgaacctgattgaggacaagcagctcgccgagacccacgagttgatcttgcgggcgaacgaggacttttccgccgagcgcatgcactgcatcaagaagtacgtcctgacgatgagtcaggaggaccccttgttcgacttcaccaagacgttctgctacaacttccccgaggttcggtacccgtcgagcgccggtggcagcgagttcgtcgcgaatgcggtgacggcaggtctcgcgctccgggagctgtttaacttcacagtctggcccagtcggtcgagacaggagaacgaggacgaggcgcaggcctccggtttgtccgccgcctcgcagcacgttcgaggggtgcggctgccctcgccgcaccctcccatgcgcaaagaagacaggcccgcgagtcgcgctgaggaggcccgacgtgccgtcctcgagaggcctttgagtggctcgctgctgcaagcttcccaactcgaaggccagacctcaggggatgcagatgagaacgctgagagccgtctagctaagaaccaggaggtcgtggaagaaggagcaagaagtgtcgacagtgaaaaggaaggtcagggtctagaagccggtagccacggacagagcgagcacgcagaggtcggtgggcgtgaggaaacgcatagcgaagaagggaagggagctgcgaaagcagtgagggaggaagagaatctgaacaagcaccaacatgcaggcactgtggcgactttccacggcaccattcccgaggcgttcgcacaaaaaatgcaggaaaacttcggtccccgatggatctcactgctccaactcctaggaagtgtcagcctcactaacgactacctcagggtcctctcctggctagcgtctgaagctgattccgacgcgatgacacttcctgcgagacgattacttgtccgccgtgatgcggaggtctctctctcgctgtcggcggccctacggcatcacgttgctgtcttctacgaaaaccaagtcgaaggaaacttgtctcacccagttgtgcacaagcatgaacgacagtacaaggtggctgaggagggcctaaggcgctttcttagggatcttgtttcctattcttcaaagaagtga

SEQ ID NO: 38 - DNA, 561 bp, Toxoplasma gondii
atgatgctcattgcgctcgtatgcatgctggttcatcgcttggatttgggggcggcagtgtcgcaagatggacgagatctttttgtgggacttcctaaaggagcgccgctgggtcccaccttcattgggcttactacacctcgaccccctttgagttcgttgtcagcattacagacttttggagctgaccagcgtctagatagaccaggtgactctcctggctactacgttgaggctaagcagttttaccgtgtgccgcctacccggtcatcagcaacgagaaataaggggacaagtgcactgaaggtcgcagctgctcttgctctgttagccgttttggggactgaggttgccgattacgttgatagacaacatgaaggcgaagtgacagatttggagtatgaccggaggatgcagacaactaggactgctttaggtgtcacccgcttagcctctcttgtgttagcaaccttcggtggtgtacgttttatgttggacaaggcaagcaaatggatgaaggcaagaaaagttgaggactcagagaaatccgagcgtcgatag

SEQ ID NO: 39 - DNA, 993 bp, Toxoplasma gondii
atgaacactggttgtctgtttctcccggctacgagacacgcagcgatccagactatttgcgtcgttgcccttgcacgccaagtcgccgacccagacgcacttgtcttcgaacgtgactttctcgagtttatccgcattctttcgtccacacaaacagttttttcgtcgttcgggtgcccgcgatcgcacgtggcgttgcttgcccagagcgtggaacgtgttcgtgaggcaaacgcggttggtctgttcagcgagttcgcgcgtcgtctcgggtttccgacttcgggagacgacgcaggatgctcctgtgcttttttcgtttttacgggtagagcaatggtgtggagagtttcgatagggtgtgctgtacttgccactgtgctcgtggcaggccatgagccagttgcttcggcgccgtacaaagcgtacggaattccagcggagtcgacagacacgacctcgggagacgatgtcgaagaagcgttcaggaaacgaagcaggggaaacgtgctgaaggatgctgccaaggaagaaaaaaaacttcctcttttctttatcgacgtggaagataacaaggggcaaggccgaaattcggagaagggagctacagacgacgacgtcgccgtcgacaagacgaagcgcagttcaccttctgcaccgtgcactcgcctcgcagggaaagagaagaaatacccctgcgatcgatacgtcgtcaaaggcaagatgtctttcctagaggcgatcggcgcgttttttctcgcctcagttattcatgccgcagtctccgagcagcttcgagcccgatctaccggtggtgacatctggcggccgcgtctcgcaggttcagttatgcaggccgctctcgcggcgacaactctctggatggctctaaggcgcagactcccgactttctacttgttgcagcggcgggagtcttcggaagaaaaaaagaaagccaaagagaactcgacacgggccgcgtctgccgtgtga

SEQ ID NO: 40 - DNA, 660 bp, Toxoplasma gondii
atgactcgcgggtttgctttctgtcttctttttctcgcccttttcgggctcttctccgtcgcacctcactcgatcgaagcgggagaaacgcctgaagaaacagaggccgtcgttgctgcgaccgaacagggggccgcggaagtggatgaagccaccgacgaacacgaagaagacgatgacgatgatcatagagccgactttgaatctttgctccagatgatgagcaaagacatgcacatggatttggcgaacaacaatatggccggtgtcgccaaagttctcaaggagctgacagaccacatcgacgccgctcataagcacgacccggaagcccatgagcacaagcatccgcttctgaagaagatcttgacgaagcgcacccacgacaagatggtgacaacactgcagaaaatctactccaatgtgccgcgagaggagatcaatgatcagctccaagctgtcatgtccctacttgaacatgtgaaacaggacccgaacatgtcgccgaagcaattgctggagaagacagctcatcaactggggatgcctctcacccctgacatgtacgaggacatgcagaaacacatggggtgggcagcgaagctgttccagtacatcgctcccggagggctagatgaagagaaggcggaggagctgtaa

SEQ ID NO: 41 - DNA, 610 bp, Toxoplasma gondii
atgtggttgccggtgtatgtgcctctcttgctggtgtttggagttagtttgtccctcccacaaggaagccttggcacagactcatcgtcactccggggagtggacgctgacactgaaaagcggattaatgtcgggaagaaacacctgcagaccctccgaaatctggaaactcggtgccacgattccttgcaagcacttgttgtaatcgatgcaggcagtagttcgacgaggacgaatgttttcttggcgaaaacccggtcatgcccaaataaaggccgtagcattgacccagacagtattcaactcatcggcgctggcaagcggttcgcaggacttcgtgtagttttagaagagtggctggacacttacgctggaaaggactgggagtcgaggcccgttgatgccagacttctcttccagtacgtccctcagatgcacgagggggcgaagaaactcatgcaactcttggaagaagacacggttgccattttggactcacagctcaatgagaaacaaaaggtccaggtcaaggcgttgggcattcccagtatgctttgcagcacagcaggagttcgcgacttccacgaatggtaccgcgacgccctctttg

SEQ ID NO: 42 - DNA, 1000 bp, Toxoplasma gondii
atgtggttgccggtgcatgtgcctctcttgctggtgtttggagttagtttgtccctcccacatggaagccttggcacagactcatcgtcactccggggagtggacgctgacactgaaaagcggattaatgtcgggaagacacacctgcagaccctccgaaatctggaaactcggtgccacgattccttgcaagcacttgttgtaatcgatgcaggcagtagttcgacgaggacgaatgttttcttggcgaaaacccggtcatgtccaaatagaggccgtagcattgacccagacagtattcgactcatccgcgagggtaaacggttcacaggacttcgtgtagttttagaagagtggctggacacttacgctggaaaggactgggagtcgaggcccgttgatgccagacttctcttccagtacgtccctcagatgcacgagggggcgaagaaactcatgcaactcttggaagaagacacggttgccattttggactcacagctcaatgaggaacaaaaggtccaggtcaaggcgttgggcattccagtaatgctttgcagcacagcaggagttcgcgacttccacgaatggtaccgcgacgccctctttgtccttttgcgtcacctcatcaacaatccgtcgcctgcacacggatacaaattcttcaccaatcctttctggacacgaccgatcacaggagctgaggaaggcctcttcgcgtttatcacgctcaaccacctgtccagacggctaggcgaagacccagctaggtgcatgattgatgaatacggggtgaagcattgccgcaatgaccttgctggcgtggtcgaggttgggggtgcttctgctcaaattgtctttccactacaggaaggtaccgtcctgccctcttcggtccgtgccgtcaacctgcagcgcgaacgccttctcccagaacgttatccaagtgccgacgtcgtgtcagtttcgtttatgcagctgggtaggccagtccgcagga

SEQ ID NO: 43 - DNA, 1320 bp, Toxoplasma gondii
atgactgcaacgccagcaggcactctagtgagactatactcttcgttggtctctgggcagcacaagagtgcagatggcgactgcaattttgcattttcgccatacgccgtcagcgctgtcctcgctggcctgtatttcggggcgagaggaactagtcgggagcaattggaaaaccactatttcgacggccggtcagcagctgacgcagcagcatgcctgaatgaggcaatccctgctgtctcgcaaaaggaggaaggcgtagatccggatattcaatcttcggtagtacttcaagctgcaaatcgtctgtatgcgtcgaaagagctgatggaggcgtttctgccgcaattcagggaattcagagaaacgcttgaaaaggcacttcacacagaggctttgttggcgaatttcaagacaaacagcaacggggaacgagaaaaaatcaatgaatgggtatgctctgtaacgaagcgtaagatcgtcgatctccttccaccggcagccgtcactccggaaacgacccttctcctggtcggaacactatatttcaagggaccatggctgaagccgtttgtcccgtgtgaatgcagcagtctgtcgaagttctacagacagggtccatctggagccactatttcccaagagggaatcagattcatggaatcaactcaggtatgcagcggggctctgcgctatggattcaaacacactgaccgccctggatttggtctcacgcttcttgaggtcccctacattgacatccagtcatcgatggtgttttttatgccggacaagcccacggacttggctgagctcgagatgatgtggcgtgagcaaccagatcttctaaatgatttggtgcaaggcatggcagactcttccggcaccgagctccaggacgtagaacttactatcagactcccatatttgaaagtgagcggcgacacgatatctctgacgtcggcactcgagtctctgggagttacagatgttttcggttcgagcgcagatctatctggtattaatggaggaagaaacctgttcgtcagcgacgtatttcatcggtgcttagttgagattgatgaggagggaacggatgcggcagccggtgcagcggcgggtgttgcgtgcgtgtcccttcccttcgttcgggagcataaagtgattaatattgatcgttcgtttctttttcagacgcgaaaactcaagtgcgtacaggggctgagggcagggaactcgccggcaatgcgcaaggatgatgacattttattcgtgggccgtgtcgtcgatgtgggtgtgttacagagtggtggcgaatga

SEQ ID NO: 44 - DNA, 957 bp, Toxoplasma gondii
atgggaaagaatcctcttttgtttcttgccggagttctggtttgttcgttcagcgtagctgtgtttgcttcgcccgaaacgaaagtttgttcttgtccgcgcaatctcgaattaaactgcggtggggatcacgtgacctacgcaaaccactgcatccgggagtgccacggcgtcggcctgttacacgacgggccttgcgctgaccaagaagaccaaggttcgtctgtcaacgaaccatccgaagtagccgatacaacggaacagcccagcataacgccatcgggagaggaggatcgtccgccaaaggacgccccaaaggaacggaagaggctgcgaggatgcgcttgcactcgcgaattgcgactcaactgcggtgtggacggcgtcacgtattcaaaccattgtgtccgcaaatgcgaaagagtcaagctgctacacgaaggtccttgcaggggaggtcccggacgcacactgttttcgcagcaggatgacgaatctgagaacgatgctctggaagaggaggaacaaagattacagagaacacagtcttcacaccagcatgatgatgctgagaatggtgctcgggcagagcatgaacaacgtttgaagggctgcccatgccctcttaacctgatgcttaactgcggcgtcgacggcgtcacgtatgacaaccactgccttcgacggtgcaggagagttgaactgaagcacgagggtccatgtgaagccgacgaacagaaacagcttcccgtgcagcacggtgacaatgagatcgacgtgccagaacggagaattgaagatcttaaagactgcgcttgccccttgatcctaacgccaaactgcgggacggaccggaagacttaccccaacaactgtgtgcgtgagtgtgctggagtcaaactgcttcacgagggcccctgcgaaggggacaccgaagagatctgggatgaccaataa

SEQ ID NO: 45 - DNA, 264 bp, Toxoplasma gondii
atgccactgccgcaggcacccgaagaactcgagcaggctcccgcttcacaccccgaggaggcggagcaggaggtgcctgagagaaaaactgacgcaggaagtgaacctgagaaggatcccgaaacaaacttgcaggcttccgagacacagccgcaggagcaggtgcgctctcagcctggtcggagcgacggaaagtgtacggacaagagggacgaagttgacctcgatgtgctcgaggccgagatgttggagaaagcgccataa

SEQ ID NO: 46 - DNA, 1152 bp, Toxoplasma gondii
atggatgttcggtatcagacacgcggagcggttgccgcggtgtacgttctcttccgcactgtagtaggcgcagtactcggactccattgtctgaagattgtttcggcagaggtcggtcttacgcatgggatcatgtctaccgaatttgaggtagagcttagaggccacaactgggtcatcgactcgggtgcctgcctgttggggcagccgaggaatcttgtcgtggatcccgttctcgacagcgagttcatgacgccacagaagctgctcacagaccggacgggcccggagctctgcagctggctggagaaaatccatcggcagcacatggaacagaagccagcgtggttggcagcgtaccaaaagttcgagaaacgcttctttcttctccgccttctgggaatggtggggaagcccatcacgtttttccccgagttcacagtgaggataatcgtgaaacacttcagtttgtggggggacgatagatgggggaatgcgcagccttggattgccgcgacattcgagtacgctcatcctgaaggcgccggaggcgagctctttctccacatagaaaaggttttctcgatggagtttagcggccgggtggcgaagcttgtgcacatcctcttgaatccgtcggcgaccttcaaccaatacgtggaactccatagaagaaaaagcagtggggttcccggggactccggtgtctcagggatacgtcggacgctctacgagagggacttgaatattagccactttccgaccgcagacaccagtcagatcagtcacagcttggcccccgatatactcacgctgagatttgccaaacaggacttctggatggaagacggcagctgctacattctctcgagattcgttgcaacgtcttcgatacgagggaagactctgtgcaagattgtctctgactatggtcacagagaatcgtggatgcctttcgtggggagcaggaaaaaaacggttgctctggctgtgacagctgccgattttttcaatactcggcggccctctttggtagcacatatcaaggaaggagtgaagctggaagcgctcgacaaaactcctgtcgtgctggagcttgtcacagatcctgtaatactgcgctcctacgttgaagctgctaggaaagcataa

SEQ ID NO: 47 - DNA, 675 bp, Toxoplasma gondii
atggcgaccacacacctcaacaagtccgtcatcgcgggcggaagtatcaagaccattaaagctctcaaaaagtattggaactcgccggtgtctgatatcgacgacaactcgagcgaggccaagtataccatgctgcagatggctatccttttgaacaagaaaaacgtcgtagagtatctgatctcgcaaaaagacgtggatttgactacccgagccacagacggaaccacggcgctcatgacagctgtcgggaaaaatgttcctgtagattggatacgagcgatgctcgaacgtggtgcggccgacaatatcaacgtagaagacaacgagggccataccgctcttgacagatgtgaaaaggacagcgaggtatacaaactgctcgtccaacacggagcgcagccaagaccttcccctccccctacgccgccgccggagcctgacgtggctggtggtgcgggttctacggacaccaatgctgcaggtcaaaacggtgcttccaaaccggtggacggaataacaggagttggtggcatgtctccaggcctggacgagcacccaggcatatgggctacaatgtgcggctgcgggggacggcaaggaaaaaacggaaccgaggttgtagaagtagtcgacgcgggtaaagcggagctgaaccctgctcaagcttcttag

SEQ ID NO: 48 - DNA, 1662 bp, Toxoplasma gondii
atgacgacgcaaacaaccacgaaagggtcgtcgcggatctcgcggtgcaccgttgccctcgtttttgctttgtcggcatgcgccactgacgcattgaatatcggcaaccacgctcaccaaacaagactggcgtccggaaaaacttcggcgaagggtgacgccaatccgtgggccaagatccttgaaagatacaacgtgcctctcgtgcacggttctggcgtctatgtcgacttggggaacacaaagattctcagcaagaaaaagtaccgcgagcctggcgggaagtgtcccaactatggcaagtacatcaagacgtaccagcccaccacgaacccggaaatttggcctaacgattttttgaagccagtgccgtacgcaaatacaccccaggacacgatgccgctcggaggcggcttcgccatgcccatgcatcagatcagcccggtgtcgctgaaagacctgaaggacgaggcggaggggctgaaaaccgccactggggtctcgtcgtatgccgttgagcatgccaagaacatcagagatgacttggggcattgcatatggtgggctcgcatgacgtccgcgcacgacacgtcgtcgagcgcgactaactcgaaagaagactactaccggtacgctttcgtctgggacccgaagaaggaaatgtgccacatcatgtacttgaacatgcaggagatgacgggagcaggaacgtactgcaagaggggggactcaggccccaacctgacgtggtactgcttccacccggagaagtccatcgagaaaaacctcgtctggggcagcgcatacgcgcgcctcgaccacgcttctgcgtgtccggaacacggcttaaaaaacgttcactgggggcagtggaacgggagaagttgccagaaaatggccgtccggaaacgcatctctgtaggcagtgctaccgaatgtgccatggagctgtttaacaacagtccgagcgacaacccgacgcagtacgtcggcgacgagggccgtgggtgggataaaatcctcgacgacgtggttggagtcctcatccccgcaggatccaccaagaaagaccagccgcacacgcgcggagttggcatcaactgggcgaacttctacaaaaagcccagcggttcctactgcgaaatgtacgatggcgtcccgaactgcctcacgtctgcgcctgagcagtacgcgttcgtgagtctcggcgatccaaacccagacaacgcacaacttccgccttgctcatccgccacagaaggcgttgtcattccctcccactgctcttgccctgaaggagagacaagcggaagcagctctggtgtaaagtgcgaagacggcaaatgggtggagggccatgtctcctgcacctgctcactcgatgaggacaccagcgtcaacatctggcttattgcgggaccgtgcattgccgctggagtgctgttgctcggaggactgatatactggatggcacaaaggaacaagcgcgaaccggctgttgaaaagcctcaaatcgtggacgagacaagggagcacgccgttcgaacccgccagaaccaagcagacctgctgcaggaagcggaaccttcattctggggagaagctgacaactatggcacaagcgtcattctcgactccgccaacattgacaaggacttttga

SEQ ID NO: 49 - DNA, 1710 bp, Toxoplasma gondii
atgatctgttcaatcatgggaggcttgcggagcctgagggcagcgcggccatacagtcatcaatcgaacactgagacgaagcacatggggctcgtgggcgtagcaagtttgctggttcttgtggcggattgcaccatattcgcatcgggactcagctcaagcacaaggtctcgcgagtcgcagacgctgagtgctagcacgtcggggaatccctttcaggcaaatgtagagatgaaaaccttcatggaaagattcaacctaactcatcatcatcagtctggtatttacgtcgaccttggacaagacaaggaagttgatggcacattataccgggagcctgcggggttgtgtcccatttggggaaagcacatcgaactccagcagccggaccggcctccgtaccgtaacaacttcttggaagatgttccgactgaaaaagaatacaaacagtcagggaatcctttgcccggaggcttcaacttgaatttcgtgacgcctagcgggcagcgaatttcaccatttccgatggaacttcttgaaaaaaatagcaacatcaaggcgagtacggatcttgggaggtgcgccgagtttgcctttaagacggtcgctatggataaaaacaataaggcgacgaagtaccgttacccatttgtttatgactccaagaagcgactgtgccacatcctctacgtatcgatgcagctgatggagggtaaaaagtactgttcagtcaagggcgaacctccagatctcacatggtattgcttcaagccccgaaagagtgttacggagaatcatcatctcatctacggatcggcctatgttggagagaacccagatgcgttcatcagtaaatgcccaaatcaagctcttcgcgggtacaggttcggtgtttggaagaaaggccgttgcctcgactacactgaattgaccgacactgtgatagaacgtgttgagtcaaaggcacagtgctgggtgaaaacctttgaaaacgacggggtcgcgagtgaccaaccccatacgtatccactgacgtcgcaagcatcatggaacgattggtggcctctccaccagagtgaccaacctcactcaggtggcgttgggcgtaattacggtttctactacgtggacacgactggagagggcaagtgtgcactctctgaccaggtacccgactgcctggtgtcggattctgccgccgtgtcgtatacagcagcggggagtttgtctgaagagacgccgaatttcataattccgtcaaatccctctgttactccgccaacgcccgagacggcacttcagtgcacggccgacaagttccccgactctttcggtgcctgcgacgttcaagcctgtaaaagacagaagacgtcctgcgttggcggacagattcaaagtactagcgtcgactgcaccgcggacgaacaaaatgaatgtggctctaacactgcgttgatcgctggactcgccgtaggaggggttctgctgttggctcttctaggaggaggctgctacttcgcgaagaggttggacagaaacaaaggcgtccaggcggctcatcatgaacatgagtttcagtcagacagaggtgctcgaaaaaagaggccaagcgatctcatgcaagaggctgaaccgtcgttttgggatgaggcagaggagaacattgaacaagatggggaaacacatgttatggtcgagggggattactag

SEQ ID NO: 50 - DNA, 2145 bp, Toxoplasma gondii
atgtgcccccgagtgtctgtagacgcagtaacggttctcgggaccgctttactgctgtgtttggaggggacacgcttgtcttccatcgttcctccttctagcgttccgttcgccttgcctgcacaatgtctgaacgcaaatcaaaggctgcagcagggagtgatggctagagcttggagcgcgactcaaagtgatgatgatgagagtccggctcccatcttccctgagagcgactgcacttatccagcagacaacaatttcgaaaagatcatcacaacggctcacctcacaacctttctagaaaacgcctcacagggcttttcgtacaaaggcatgacgcactcgagcgaggccgcggcgcagatccacaaagacctttcgtgcgcaattcaggcggacagcagattcgcgagtttctgcaactccagtgacaaatactcttacgaagagaacgcgtttgtcaacgtctccgagtgcgcggcgttcttggcccacgtctttgtgcacacgaactcttttacgcaatttgaggaaacgtcaaacaacagggagtgccgagagtcggaaaaatacccttgcgggccgtctactgcatcttatcacggccgaggacctctcatgatccgtggcaatgatgactacggacggctcggtgaatatttgttcgacgacgccgaaaaactccttttgcacccacgcctcattgagccccaaggtatcagcggctgggttgccgctttgtggaagtggatggaacaacgcccctacgggctgaactgtccggaaacgttcgtgggatcgggcaaggcgtcgtgccacgatgccattctgaatcaagacgtgtctccagaggtaactatggaggctctgacggataacgatagggagaagttgacgaagggcgtgagcggcttcggtctcacaatcaacatcctggcaggagaggccgtcgcatgctgtccgtctgctctcaaagatgcactcgcagccgttcccaagccggttcttcttccttctgctgcagtgccgggagtgataggagtggcagagtccgaagcagctactcgcgccagagctgatcttttgttgaagctcgccgagcgaggcgggttgggtgcaggcgcactgacaccagaggagttgaagaagatccttgctcccaacggagcgcgacaaggcggtgccgctcagacgctcgagccgtcagaggagttggagtcgccggattcgggtgatgcggatgaggaaagcagaccaggggaacaaaaacctaatcctcacgcggcgcttggggctgagcaacgtcagcagcaactgtttgaccaaattatgagtgcccctccgccgcctgccgacggaattcccgtgcaaccaaggggcgacggtttcctgcagacgcaagcactcgcgcttccttcaactcttactcgctttgtcgtgccttccaagggcatttttcccagcggtagttccgcatcgcagaacccgctgtcttcggcggctgccacgtcggcctttctctccttccttgcccaccttctgtatccgcatccgacaccaagtggcacagagaacacggttcctctgcctagcggcactgtccccccaacgccttttcctttaccaggagacgcgaatcgactctgcactacccgaggtgtcttgtcggccagagctgcagagtctaatgcagcaaatactgacgctgcgggtgcggctacagcagctgacacgttttgcctgtcggttgttcgtgggtgtcccgtaatgttcccaccgagtgccgtagaaataaatgcagaccaaggtgatgaagacacggtgaatttagtcaaggccgctgcttcgggaaatgcagctgcagtgataggtccagacggcgaaaagtgcaactttgtctgtgtagatgcatccaacaattctgcccagagtgcgaccaacggagctgtgagcactgacgcgcatgcggcggaagacgatgcgttggctgcaaagagtcacgcagaggctgttgcaaatttgaagacggaggaatttgaattgaaaagcttcgagtatcttcccaaatcgggtgttgtatgtggttacacctgtgtttcccatcacgacgagaccgaggggggaaccgttttcgaaggcgcgtga

SEQ ID NO: 51 - DNA, 2634 bp, Toxoplasma gondii
atgaagccctcatcgcttcgcattttgctcgtggcctggacgatcatctcagatgcagagttgaatcacttcagtagtcaagctccacttagctggccaaggtgtgtcgtcgtgtccgctgctgacgacgcccaacgtgacagaggcgacacaacggcagcttcctctagtagagatgaagaactggaggcagcaggacctgccgacgaagcgaaaaaagcagctggagagaacgctagagaatgtgctgggacttgcaacgagccgccggacggatctgtacatgtgcggtccagtgacggcagcgaatatttggatgagcaaccgggtgacggggccgggcaaatagtagagcagccacgttctgatgaagctgaaggcagcgaatcgcaggcctctgttggtgggcgatactacgaacaggaggcttctgacggcaagcgccacgacgaagaggagcctcctgacagacgtggatacgttgaaaaggcagctgtttcagatgatggggatgcagtgcgtcctacagtggtagaaggtgaggaccaagagctccttctgaagcccataggaaaagggaaagcttgtgagcgtgttattgtctctaggatccgcgatgggggagtgaagcgcggcaagaagatgggttttaatgccgttgggataaacatgccaatgtggagctgttacgggatgagcgtatccgaagctggaagtggattccccagggactggatggcctctctttcaagaagaaacatcctgaacgtcgttaacgaagaagctctacttcgaaaggcgaagaatcgaatcgggattgagctggcttgggagagtggggaaggtggcgaaaaaccgtatatgaagtgtgaagaaggtgggctgtacgtgccggtgattgtgaccaacgtagaggatcaggaaccctacagggtcgaactttctccgaccaagttctggtccgcggcctcatcaagaacgggtcgtttatatgtgataccagagcaggaggcaagtgtcacagagggtgacaaggaggacgagaagtctgtgtacattattccaatggaggcattggaaggtcacgtgtttttgcctcatgggtatctgaaaggacattactcggagatgccaaatgaactgaaccacgcccgcgagtttgaggttaacaaactttccgtagacgatttcctcacgcgtgggcagcgggtaacgctcgtctgtactgcacctggggagccggcacggattgttccgacagttgacgccgcaccacgaaccctgcaggtttccagacgaaaagacaagcgggagggagagatccgcggtcaaactccgccgaaggaaaatgctgcggccgacgccgctatacaagaggcagatggcaataagctctcacgagaccgtgtcacaccacaggggctcacagaacaagagtccagaacggttggaaaaaccgaggaaactgatactgctgcctcccgtagtgcagaactgacgggtgcaacacgaggactggtattgatgtttctcactgaggaggatggcctgggcttcgaactacccttaccggtgctcgtggacagagttcttttcatggtgaaacagactcaagaagcggcacctctacaccttcttgcatatctcactgtgcgtccgtgtaaacgaccgatacacgacccgatatttggacaaagctacgaacccgtacaagaaactactgtgaagaacaggatgggtggcggtggggaaggtagtggtaaggagagcggtggttttttcggcttcttcaagcaacagactcagaagccgaaggactttgaggctcaagagtctcgtgaagacatgagcaagcggtgcaggcctaagcgggtcctacctgtcgaattgataggcacagaggctcttcagtcaccgaccctgctaaacgcaatgttggaacaaatagagagtcgcctgaagtcggacacccagtgcattgttgccgcggcgccggctacaccaaaatccgactctccaaatcgaccacgtcttcgtgcgcggttggtctgcccctcacttgagcacctctttatcctgttaagagagaaggacgcatcagatcgcgaatacaacgcattcaagagaaccaaaaacaggcagatgataaagggtgctgtggtgggacttttcggcttgttcttagcttatcgggggttagttggtctcacacggaatccgatgatggcgagagaattatttgcccacgtaataggcagagaacatgttggaaatcaaccgtatcacttctttccgtcagaacgacagctgtacagattcgttggattgcgtagtttgggacgggctttgcaatttcggcggtacaatgaggcgatggggaacgctggtgtgagggcacaagtcggaatcagtttgtggacagtctctttgctggcgttgacagcccttctcgcgatacggttgggtagaggtaccagacactttgttagaaatcggaaacgggtgtccaacataaagggggaattacaacgacgtccaattattcatgaagagcaagctcccgtgcccgagctggaggaagcggaagacgagtgttccaccgtggacgtaacttatctcagttttttgtattga

SEQ ID NO: 52 - DNA, 873 bp, Toxoplasma gondii
atgtcgagccacgacctgcggctgtgtcgtccacggcggcagtcaaagggtagccgacaaagccccgctttttctgctggacgactctgttcttcgtggggatctctttgtgtttgtcggagagtcccccgtacgaaactggggggttcgcctgctccccggactgcggggatccaccgagactcaaagtgctgtgcgactgcgatgatgccttttccaaaacgcagtttatctcttgtttgtctccttttctgcgtggtcacggctgccgggactcttcctcgacaacctgtagctgatgcgtttcgcctggagaaccagggagtacaggactcacacgcaaactcggacgccatgcagccctcgctaggaagcgcgacgaatcacaaggcgacaggaaccacgagctttgtctcagtgaatgaaaatgaggagggcatgtcccaaaaagcgatcatcgtgtttgttgtggctatttcggcgatggtcatttgtatcggcgtcgttttggtcatgtggtggatgtcatcggaacgcgagaagaagagacgccacgttgctcgagatgcggagcgagctccgggacttttttttagtgaagacgaaggcccaatgtctagcgatgaaaagtcggcaccgaaaaagccagcgggaggaaactctccaaatacgcgtgatgccggcgagtccatctctcgcgaaaggcagataattgaagaggacctaggaaaagttctcgttgtggatcctgtttctggagtgatgcggagtaggcaaaagtggcagcggaacgggaactcggtgccggacaaacgaatgcttgccggcacggagcgaacttgtcggacggggcaacaaaagttcaaaaagtag

SEQ ID NO: 53 - DNA, 2097 bp, Toxoplasma gondii
atgtctttcactcacgcgcccttgctcgacacggatgcgtgtctggagttcctaaacgctctagaatacgggaaagcgcatcccgtccacgagctgcaagactgcgcgactgccgagtatgtctggggcgcgctccacgaaatttaccctgcctggtttgacgagtctcttcacccgtcaaagttccccaatgcccaggaggcgctgtctcagatcctctattacctcgatgaatttcacgaaaataaatactctggagatttcagtgtcatcacaggacatctcgacgctttcctcaaaggcgatccctcactcattttgaaaacgcacgaattcatcttgctcgcggcagtgaatggagactcccagcaaatcatcgcaaaaatcatggctatgtcccagcctactcaagaaatcattcaggcgataatccaacaatatgcagatgcagataacggatcgtcgaacgatactcctacgaactttagccgcatggcctctgaggcggcagcggcgagacgggagccttcgattgcagacgacctcgggctcggtcggtcctcaagcgcggttggaggccacttggccccggttctccaaaaggttcaggatgagctttcgcagataaaggcggaacttcgcaagacgaagaacgcgctcacggaaagcgaaagccagagagaaacgctgtcggacaaactccagttggccgagaaggaacgagaagaagaaaaaacaaaacgcatggttttagagcagcagctctcggcgaagaaggatgtcctggtgaaagacttcacagagcagatcgaggattcggacaaacagagagcgaagctgaaggaggaactggagaatgaaaaaaaagagaggaagaaggcggatgagaagaaccgcgccgttgttgcagaactcaaagaagaaatggatctcttgaagcaggaggctcgtcgcgtgtccacgctagaagttcaggtgcaaaactacaagacgaaactgaccgaaatggcggccctgaaggagaaaatgactcaactcgaacttcagaacaaggcttacatggaccgaattgttgagggcgaggccgacagcgtcggagctttgggattgaggaagcagatcgattcgtacaaggagcgtgtcgcagatgtggaggagcgactcagttcgatgactgcggagaaggaggcgctttcgaatctcaaagaagaagtcgagaaacaactttctgcagcagaaaagaagctggaggtgaaggagctggaggtcgcacagttggaggcgaaaatcgaggcgaaggactttgaaatttcctcactcaacgacaaaatcaaggaactcgacaagaacaagggccgggatatcgcagaggagttggcgaacatggccaaaaagaacaaggcagatggtgtagacactgcagctcgaatcgctgagctgtccaatgaagtcgatgacttgaaacgcgtgaagcaacgtctggagaagaacgctgcggcttatgtagcacagatcgcctttttgcagaaggaattgacagttgggtgtgcgagtgcggccgatgcccagaagctgcaagacctggtggagaagactgcgaagcaggaagaggaaatcaagcaactcagagagagcaaagatgacatggcgaagcaaatgatggaggctttgagcaaacacgagaaaggctccggtggcgacgagacatcggcggcgaaggtcgcgatgctggagacgcagctcgagtttgagaagaagcaggcctctatgcgggaagatatcgtccgagccaaggtcgagaaggaaatggagaatgtccactcgactttgaagaatcaactgcaactccgagagcgcgagagcaatttctacagaaaggctgtagaggagaatgcggagagtagcaaaaaggaaatgaagctgctttcctctgtcctctacgaccttggactgcggtttcaccgtctgcaggcgtactgcgaccaactgaaaaacgaaaacgaagccatccagctcagagttcgactacaccagcagagcaacgcgtcgatggccgactcgattgcgacagattctgtcacacctcgggaggcgtga

SEQ ID NO: 54 - DNA, 1056 bp, Toxoplasma gondii
atgtttggtgaactttgcgttgagttggcgtttccatttttgcgtcaagcggtttctgtcatgttttcaagggcttcgcttggacggccgggtgtaccccgcctgccaggtcgccccgtatgcctcttgctatttgcaagcctgtgcagttgcctggttcagaaatgtacttttttgccagtctcagcttttcgacgctccgagggtaacttgtcccgcggactttcggctgaacagcatattcgcaacaaatcaggtaggcgacaactgtcagaaatcgatggaggaaatcattttgacgtcgaacccgccagcttcttgggcctcctcggagaaagccctgaagacgcagacagttcctccacaaaagcagaggactctgattcggaaggcggaacttcgccagcggcaactgaagaccagaacgggaacgaaagcgactctcaacagtcagaatcatctggagctgtagagaaacggacggcagcaaaggaggcgccagaggcgcagccagagaaacaggaggaaccaagcaagaatgaagctcaagaagcgaagggtactgcggcagctgcttcccgacaggatgacactgtgattggagaaggaaagaacccggaagagctaactgacgatgatttcaaacaaatgagcacgagtcaaggtctttctatcttgttcagccaaggaaagggcatgatgcaagaagttcagcacacgctggacggtgtcaatgccgtcgttagtattactgaactaatggggaaggtgcgcgaggatattaggaaagatgttgaagccctgaatcacactgtcactgaagagtaccaaaacatcgaacagctcaggcaactgcaagatgctcaaacggctgtccttcggtcgcagctgaactaccttattccattgaatcgtcaagaagccgctgccttacctgagatgcccggggaagtgttacagtctgggtcgtcttcactcagtttctacagccttttcgggtcagtgtgcgctgctgtggtttccgttctcttgtcggcagctcatgtatcctcgtga

SEQ ID NO: 55 - DNA, 993 bp, Toxoplasma gondii
atgaaactcgctgccgtgtccagtgctgccttcgcggctgctttttttccagcagttgtcaatgcaaggaaagttggaaatccggcggcgcagcccagtgtccttgtcaacgaaccggtggccctagctcagctcagcacattcctcgagctcgtcgaggtgccatgtaactctgttcatgttcagggggtgatgaccccgaatcaaatggtcaaagtgactggtgcaggatgggataatggcgttctcgagttctatgtcacgaggccaacgaagacaggcggggacacaagccgaagccatcttgcgtcgatcatgtgttattccaaggacattgacggcgtgccgtcagacaaagcgggaaagtgctttctgaagaacttttctggtgaagactcgtcggaaatagacgaaaaagaagtatctctgcccatcaagagccacaacgatgcgttcatgttcgtttgttcttcaaatgatggatccgcactccagtgtgatgttttcgcccttgataacaccaactctagcgacgggtggaaagtgaataccgtggatcttggcgtcagcgttagtccggatttggcattcggactcactgcagatggggtcaaggtgaagaagttgtacgcaagcagcggcctgacagcgatcaacgacgatccttccttggggtgcaaggctcctccccattctccgccggccggagaggaaccgagtttgccgtcgcctgaaaacagcgggtctgcaacaccagcggaagaaagtccgtctgagtctgaatctgtcccgtctttgcctttgtctcaaattccctcagaagtgcccctgtcccaagagtcgccagtaccgcctcaggatggtgagaacccagattcgccacaaaatgaagacaattcgatgcaggaagtcgagaatagcgcttcgcagtcggatatcgaggctcagcggcaggccgagaacggccgtctgccgagtgacgatgaggcgtaa

SEQ ID NO: 56 - DNA, 1131 bp, Toxoplasma gondii
atgcacaccaaaatgacggacggagcaaaattatatcgtcgctcaatgacgacagccacaaccacaggcttttttctgttggcatgctggttcttgccatcgagctgtatccagggcagtgaggcattatccacgacagccactacgcagccgatatcaaatgtgactcgctatcctgagcaacatactgtcgccagaagtgccgccgacgtggctaaggcactggcggagaaggtagcccgcgaagcaatgaagaatgcgtataacgatgttttcaggaattggacaggtatcgctcatcccgatttccacaacggtgacgctgaaacctgcaagattgttctgagcttcgacgtagcgaagaagaaaaatgccatgggcagcgtcacgaagatcctgtcggtaactgtgaacaatgcaagggggcagctgacagtcaaataccttgaacgaccgaatgtccggaatgcaactaacgttagacgtgcctcttcttgggtgaggaggaagctcgctctagaaactgcagatgaggttgtctcagtgacggagaccattgatgtgccacaagcatgtatcgctgacaatcactcgcgctatttcgtcgtcacgcgacggaaaaatgtgatagacacccgtgttttcgctgtcgttatcgaactagagctacatcccggaccctatctcgttccacgagacatctcgaggatagcggagctcgaccggatcctcaaagagcacgaacgcgaaactttcacggaaggaaaatgggttactctcccgggttgcatgatgttaatcagggttagagagacattaaaaagggcaccgcgtctcacaattgacgcttaccgtgggtctgttcagtttcgagaagacgagctgaagagcttaggctcccaggcgctaccccaagggtgcacttgggatggccccagtgctgtaggcgttgtgacccgccacgacagatctgcggatgctaacctgtgggacgttctgttgttcatggccgatgccccctcgcatgttcagttcgaatacacacttcctaaagaggctgacgtcgaacggaacagtgacctgagttccgggttcgcttcaggtcctggcgagcaagatgacaatatatag

SEQ ID NO: 57 - DNA, 1371 bp, Toxoplasma gondii
atgggccaggcgttgtttctcaccgttctattgccggtgttatttggcgttgggccagaagcatatggagaagcgtcgcattctcattcgccggcatcgggacgttatatacaacagatgcttgaccaacgctgccaagagattgctgcagaactctgccaaggcggacttcgtaaaatgtgtgtgccctctagccggatagtagctcgaaacgccgtgggcattactcatcaaaatacacttgaatggagatgctttgatacagcctctttgctggagagcaatcaagaaaacaacggtgttaattgcgtggacgactgtggccacacgataccgtgtcctggcggcgtacaccggcaaaacagtaatcacgcaacgcgccatgagatactgtccaaattggtcgaagaaggagtacaacggttctgcagtccttatcaagcatctgccaacaagtactgtaacgacaaatttccagggaccattgcgaggaggtcgaagggcttcggaaacaatgtcgaggttgcgtggaggtgttacgagaaggccagcttgctgtactcggtttatgctgagtgtgcgagcaactgcggaacaacgtggtactgccctggaggacgacgagggacgtcgacagaactagacaagcggcattatacagaagaggaaggaattcgccaggcaatcggatccgtcgacagcccatgttctgaagttgaagtctgcctaccgaaggatgagaatcccccggtgtgtttagatgaaagtggccagatttcacgaactggtggtgggccaccgtcacaaccgcctgagatgcaacagcccgccgatcgttcggacgagagaggtggcggtaaggaacagtcgcctggaggagaagctcagccggaccatccaacgaagggtggtaacatagacctgcctgagaaatcaacatctcccgagaagacgccgaaaaccgagatccatggtgacagcacgaaagcgacgctcgaagaggggcagcaactaacgctcacgtttatctccactaaactggatgttgctgtaggctcgtgtcattcactcgtcgcgaatttccttgatggatttttgaagtttcagacgggctcaaattcggcgttcgatgtggtagaagtggaagagccagcaggacccgcagtgcttacgataggtctgggacacaaaggccgtctcgctgttgtcctcgactacaccaggctcaatgctgctttaggatcagctgcttacgtggtcgaagattctggatgcagctcaagtgaagaggttagtttccaaggagtgggtagtggagcgacgctcgtggtgacgacgcttggcgagagtcctacggccgtctctgcttga

SEQ ID NO: 58 - DNA, 597 bp, Toxoplasma gondii
atggcgctttcttctttgaacaatatcaggccttttagcgggttgctgggttgcggcctgctgtttggcgcccttgtggtcgtggtggcatgtgttttcagcgttcctgtggaagcaggcgttcttcgtaaggtagcaggtgcaggaagtctccaggcgtctattggagagcacgatttttttaacgattacgatcaggacgaggaatacaggaagcgccagcaagaactgcagaatcagagtccagaagaagtcgaggaagcgaaacgcaaataccacgaagagctgagacggaaagcagaagaagatgcagagacgaaacgtaagcaagaagcagtcattcaagaactgaaagaggtggcaaagaaaagaggacttcgtgaagccgctgagcgtgaggagaagcgcattgatgagcagcaggctaattacgagcaacgacaacaagaactgagagacatggattcagcaatggaggagaggcttatgcagcagagaaaaaaagaccaggaagagagagaacttgcaagaaaaaacagcgataaggtcatggaggagctcaaagagaaactcgcaagacgcaggaaatcaatgtag

SEQ ID NO: 59 - DNA, 615 bp, Toxoplasma gondii
atgcagctcaagaagctttcagtcgtctctatcacccttttggggctttttaagttcgttaatggagtctccgagggcgtggtcgtcccagtaagattcggatcggagacggcccgtgctgacctgttgaaccaagtgtcagagacagtattctccttagtagaaactactgaagatgacaaaagcgccgcatctatcgtgagaggcgccttcaggagtgccttgaaggaaatacttgttgcagtgaaaggagaggttcaacaaacatgcgaggagcttgcggatcttgcagcgcgaaaaatccacgaggccgaagaacgtggcgagggtcgtctcgacaaggaagaggccgttgacgatgagtcagatttcagcttcttggattccccgaagacgagtgaagcttctatcaggcctcacggttttcttcaagagagaaagttcgtagatacgttgaagactcttgcgaagggagcgctcaagacctttgttgaacctatgaaagctgcacttgtcgacggaataaggccaatgctgccgaaaattaaggaggtagctatagacgtctttagacaggcgtgtgaacacgcagaggagaagctccaggacgcgtaa

SEQ ID NO: 60 - DNA, 6549 bp, Toxoplasma gondii
atggcgattctgcggtcagggatcgccgtggcgacactctgtgtcgccctgggtttcacttcccaaagaggcgttgtagcagaaacatgccctgccaggttcactgcctggacgtactgcggcggccaaaacgccatgcaggaacgccacaacgtcgcttgcgcgaacatcgttgagtctcgcgaatgcgaaaagccacagtcatgcggtgacttcaccgaatgggtcccgagcgtcgcgaactgccgtgaaggccagatgcaacagcgccaccgtgagggttgcgaaaaccacgtcgaacgccgcatgtgcaccagcccagaatgcgtcggcaagtggaccgaatggacatactgcaactccaagggcattcagcaacgccacaacgcgagctgccatgttgtcgaaatccgcgggtgtggcgatgtcccagaaggctgcggcgagttcgggccgtggtctccgccactcgacgatttcaacaactgcaagcacggcgtggtgtaccgccgcaagcgtgaagggtgcgaccttgaagaagttcgcatgtgccccaagttcgactgcagcgcatgctcaccgaatgcagactgcaacaaggccgactcggtgtgcacatgccgcgagggctacgagggcgacggtctgacctgcgagcctgtgaacccatgcaagaaccacaactgctcagagcatgcagtctgcttcgccgacggtctccaggcgaagtgcagatgcgagaaggggtacgacggcaaggaaggtgcaggcacccaggacgacccctgcatcgaccgcgacgaatgcgccaccaacacgcaccagtgcccagctcactcgacatgtcgcaacaccgagggtagctacgactgcgactgcaagacaggctacgccatgtccgagactggcagctgcgaagacgtcaacgagtgcgccaccgaaaactcctgccccgagaactcgtcttgcgtcaacaccgccggttcgttcgagtgcgtctgtaacgagggcttccgcatgaatgccgaaacgcagcagtgtgaagacatcgacgagtgcgcagaggaaggcggctgcagtgccaacgccacctgcaccaacagcgtgggcagctacagctgctcctgccccgagggttacaagggtgagggaactcgagattccccttgcaacaagatcgactactgtggcgagggtctgcacgactgcggtgagcacgcgacctgccggaatgaggctgtcggcttcacctgcatctgcgacgccggctacacgggacttggcaaggtcagcagcccgtgtgtagacattgacgagtgcgacagggaacaccctacgcacgattgcgacagcaacgccacctgcaccaacaccgagggctccttcacctgcgcttgcaacaccgggtacacgggcgaaggccgcggcgccgacacctgcacagagatcgacgagtgcgccgatggcactgccaactgcgccgccgaagccacatgcacgaacacacctggctcgttcaagtgtacctgtctggagggctactccggcgacggcttcacgtgctccgacaacgacgagtgccagcaagaacctgcgccgtgccaccagtctgcaacttgccagaacacccccggcagcttcacttgcgcgtgcaacgccggcttccgcggcgacggccatacctgcggcgacatcgacgagtgcgcggaagacccaaatgcatgcggtgcacacgcagtgtgtcgcaacaccgtcggcagcttctcttgcaactgcgaggaggggtacggcaacctcgacgaacaccgcgcttgccacgatatcaatgaatgtgaggccgagcccgagaggatcccgccgaacgcgacatgcgtgaacaccgacggttccttcgagtggtcttgcaacgccggctacgaacatgtcggctcccagtgccagaaaatcaacttctgcgctcgcggcttctgctcgccgcacgccagctgccaggaagtgagtaacggcaccagctacgagtgtacctgccagcccggctacgtcggcgacggtgtcggccctgagggttgcgcggaccgggacgagtgtcagacggagaaccactgctcgacggacgagaacggtggcatctgcaccaacactgaagggagctacacatgcagctgcaaggaagggtacagacaactcgcggacggcacctgcgaggacatcgacgaatgcgccagcggccacgaatgccacgaaagcgcaacatgccacaacactgccgggtcatacacgtgctcctgcaaccccggcttcagcggcgacggccacgagtgcgcggacatcaacgagtgcgagacgaacgcgcatgactgcgggagccacacgacctgcgagaacacagttggcagctttgtgtgcaactgcaaagagggcttcgtccactccgacgagaagacctgccgtgacgtcgacgagtgcgcggagaacaagcacgactgctcagtccacgcgacgtgcaacaacaccgagggctcgttcgagtgcagctgcaaggcaggcttcgagggcaacggcaaggagtgcagcgacatccagttctgctccgccggtcgcagtgactgcgcggcgaacgctgactgtgccgagaacgaggccggcaccgactacgcttgctcttgccacgctggatacagaggcagcggtcacacgagcaagggcgcagccgacgggtgcgttgacatcgacgagtgtaccgagggcgtcgacacctgcccccgccaaggaggccgatgcgtaaacaccccggggtcctacagatgcgaatgtgaagagggatacacctacaccacgaaagaggacggtactgttgagtgcgtggatatcaacgagtgtggcgtatcagagatgaacacctgcgcctcgaaggcgaatggcggcgtctgcaccaacaccatggggtcgtacacctgctcttgcctcccgggctacacaccgtctgatgacgggcgcgtctgcacagacatcgacgaatgcgcgactgagaacggcggctgctcagagcactcgcaatgtcgcaacctccccggcagctacgaatgcgtctgcgacgctggctacgagaaggtcgagggctcggagcacctctgccaagacatcgacgagtgcgctgccggaactgcaaccatccccaacaacagcaactgtgtgaacactgcagggagctacgagtttgcatgcaagcccggcttcgagcacaaggataacgcctgctcgaagatcgactactgcggccggggcggctgcaactctctggcgacttgcgaggaaaccgctgatggcaccgactacgtctgcacatgtcccaagggattcgtcactcaaaatgaaggccgtggggctgacggatgcacagacgtcgatgagtgcgcggagaacggatgcgcagcctatggcagcgagggggtcatttgtgagaacactcccggcagcttcaactgctcttgcgccaacggctacctcctgaacaacggcgtctgcgaagaaatcgacgaatgcgcgggctccagctcgaacacctgcgctgacgaaggaggcatttgcaccaacacccccggatcgtacacttgcagctgcaagcctggatacgaccagcagggccacgactgtgtggacatcaacgaatgcaccacccaagagccttgcggcgacaacgcggattgcgagaatacctctggctcgtacatctgcaaatgcaaggccggtttcgagatgagggacaaccaatgcgttgacatcgacgagtgtgcgaccaacaccaacgagtgccacaaccacagaggccgttgcatcaacacccacggatcgtacacctgcgagtgcattgccggattcattggtgatggcaagatttgcatcaacaagaacgagtgccagagcggcgacttcgagtgcgggccaaactctcactgcgtcgacaccgaaggttcgtacaagtgcgactgcaacagtggctacaagcaggatccggagaacccagacagctgcatcgacagggacgaatgcgagatcgagggtgcctgcgacgagaatgcggactgcaccaacttgccgggaagcttcagctgcacttgccgcgctggctaccgccaggaaggagagctttgcgtgaagatgaacctctgcgcagacgatgagaacggcggctgctcaccccacgcggactgcgagcacctcgacaagatcgtctgcacttgcagacctggctacgaaggcgacggcatcacctgcacggacatcgacgagtgcgccctgaataccgacaactgcgactcgcacgccacttgcgagaacaccgacggcagctaccactgcgcctgcggctcgggcttcaccggcgacggcttcacctgcgaggacatcaatgaatgcgagaccggcgagcacgagtgcgactcgaacgcgacctgtgagaacatcgtcggctcctacagctgccactgccccacgggcttcgccggcgacggcaggagttgctcgcccgttgaagtcgtgcctggccaggaatcttgcaaccactggagtgcattcactcgctgcgatcccgagactcacctcagcagccgctactgtgtggacctcccagacaaggttgagtcgatcacctgcgaagtcggctccctgccccagcccccgactgtcgcccccggcgagggtggtgaggaagacggcaacgcatgcggaccgtggggtccgtggagcccgtgtcccggcgaaggaaacaacatgagcacccgccggagagaagacaccgagagcgaggcgtgcgtcaaccaagtcgaaaccatggagtgcccaactcaggctgggcaagcatgcggcaactatggtgccttctccgactgtggagtgcctcttcgcggcttcgccatggccttccccgagaactgcccagagctcgtggccttcgccgcctgcgatgctcccgcgcctccccaagaggaccgctgccattctttctcggcctggtccaagtgcacacacatacccggcactactctgtacgagcagacgcgctcctgcgatggcatggatttgaccgagtcccgcttctgcactcccgacgatgaggtcggctcggacgtttccactgacgtcgcttccgaatgcggttccctcggcgagttcggcgagtgtgtgaacggccttcaggagagaagctactcggactgccccgatcataaagaagtccgtcagtgctctgacgaatcctgctctgccttcggcgagtggtcaccctgcggggaaccccagcaaggcctgcgtatccgcaagagacgtgcatgcgacaacgtgcactgcgcctgtgtcgaggccgaggtctgcggcgatgccaccccagagattgaggaggaagaaggcgaacatttcccccctgaagaaggcgaggtcttgcctccatatgaagagggtcctggtgagggtgagcttcttcctcccgaggaggagatccctgaaggagaacatgttcctgaggaggaaatccctgaaggagaacatgttcctgaggaggaaatccctgaaggagaacatattcctgaagagctcccagaaggcgagcatgttcctgaggaggaaatccctgaaggagaacatgttcctgaggaggaaatccctgaaggagaacatattcctgaagagctcccagaaggcgagcatgttcctgaggaggaaatccctgaaggagaacatgttcctgaagaggaaatccctgaaggagagcatattcctgaggagctccctgaaggagagcatgttcctgaagaattccctgaaggagagcatattcctgaggagctccctgaaggcgagcatattcctgaagagttccctgaaggagagcatattcctgaggagctccctgaaggcgagcatgttcctgaggaggagatccctgaaggagagcatattcctgaagagttcccagaaggcgagcatgttcctgaggaggaaatccctgaaggagaacatattcctgaggaggagttccctgaaggagagcatgttcctgaggaggagatccctgaaggagagcatgttcctgaggaggagctccctggaggagaacttattcctgaggaggaaatccctgaaggagagcatattcctgaagagctccctgaaggagagcatgttcctgaggaggagatccctgaaggagaacatgttcctgaagaggaaatcccagaaggcgagcatgttcctgaggaggagatccctgaaggagaacatgctccagaggaagagactcctgcacctgaggagaccgaaaaggaggaggaagaaggcgttccagtcgcagcgattgccggtggtgtcgtcggaggtgtgttgctcattgctggtggtgcaggtgctgccgtgtacgcatcccaaggtggcgttgaagcagctgaagacgaagtgatgtttgagagcgaagaagacggaacccaggctggcgagaaccgcgagagcgagacggtcattgagatcgaagatgacgcatgggcagacatggactaa

SEQ ID NO: 61 - DNA, 1407 bp, Toxoplasma gondii
atggtgggtgttttccagctgtgcctcctaacgtgcctgctttgcttgttgaagggcagtgacgccatccagcttcgccagcatcgaaatggattgggtgtcgagcagagctttgtatctgaagaaactgatatcgtcggaggacgcatttcttccctgcaagccgagttggactcctactgccacaatcggtacaagcaactctgcgacggcggcaacaaaaaattctgtgacaaaactggtgtcgctcgctacggcacggggatccagagccagcagactgccgaatggagatgctactttgcggaggttttgaaaccctcaggccgcaaggtgcagtgtgtcgatgactgcgggaattatttcccctgtttgggagttgtggatccgaacgacactttccacgcgactgcacataatcagattttgaatttcatcaaggatggagttgaaaagcactgcagtccattccaaatggctggcaacaattattgccagggcgttcttgcggacacagtcgcccgcaaagacacgggcaccgcatctcaaaaggcgaaagcgtggcgctgctataagaaagacagtctcacgtacgaggctagatccatttgcgtggacaactgcggcggtgaaatagaatgccctggcggacgttcagaaacctctggagaactactcagtcagcattatactagggaaaaagagctgcagaaagtgatcgagtcacaaagtgccccctgccatgacgcatgcgttgcgacacccatcaacccaccaatttgcgccgacactgagagtctcctgcaaagtaccaaacgcagcagagcacagagattcatcgatgacgcgtgccagaaactgttcaactgccactgcaaaaaagacaagaaattctgcacgactgtagtcgcccgcaaggatcgaggtcgcgcaggcagtcaaaatgatgctgagtggcgctgctattctttagaagagttggactttcaaaaaacaaacccgtcgtgcattgatgagtgcggaaatgaactgccgtgccaaggcgcagtaccagaagagtctactcaccacataacgtggaccaagttgccgtctaaaattgacgaagctacgcaaaagttctgcactgaacgacaaagagctgcgaatgactattgcgcgtcagagttcgcagacagtctggcgcgatatggacccggcgcgggggaccaaaccagtcaatttcggtgtattaaaaaggcggcaatgcgtgcagatgccgaagggcaatgtgccgattcctgcaaaggaacggaaacgtgcggaggcggtcgaagcagacttgatggccctctctcagttgatgacgttttgaatgctcacgagggtatttcagaggctatgaaaagcgcctcgacagagtgctag

SEQ ID NO: 62 - DNA, 2907 bp, Toxoplasma gondii
atgagtgaggcagcatactcggcggaaagaggctgggaccctgaaacaatgacttgcaagtgccccaatgatgcacccgcgtgctcagcagaacaggctacatataatctgatcaaccatagttcggttgctctcggccaaggtgccatctgtgcagcagccacagggaccgtatctggtattgcccgccatttcaagagatcgactttagatttgtgcggcgacttgtcgaaattgtcacctttgagttgggaacagctgcccttacccccttatatggcggatgacgtcattctggatgatgaggtcatacggagcggccactatttgtgcaccaaatcataccatcatgtgttctgccgtagctccctgattaccacatcaacgactacacctgaaccgaaatgggactggcctgccagacaagactgtgtgccgggtgaatggacgagctggagcaagtgctcaatggactgttatgtaggaagtggtgcgctgccggtaaagtcgaggtcccgatctgtactaattgatcgacgtgggacaggaaacgtgtgtgtcctcgaggaccacaccctgtgtaaagtcggttctgaggtaccgtactgcgaagacttatgctggatcactgactggggtgactggagcggctgcgaacagaaggtgctgcagatcggacaagcggcagttcgagctcgcacgaagcttcggcacatctttatgggcacagggggcgtgtgtagttccgaccacatccagtacgattactccggttgcaagagtggtatggattctagcggggggcgggaggatgactcagcacattcgatggtggaacagaaatcacgggtaacagacgccggctgcaagaagtcttctggctggtccgcctgctctctgccgtgccagcagccaggcgcgaacgccgtgacacaacaattccagcttggactgccagaaacggtgacagcctctaccacctcgtactgtgcctctaggtcgcgcgcctgtgtggagaagaagccgccatgtgtgctggacgtcgcacccgattgctcccttgtgaagcccagatacgattcccccgaggaggctctgtactgccacgagctgtgtaataatgctctaacacgctgcagggaacaagcagcactgcaatttcagacacaatgggagtgcattatggcattcatcaactcgtcaggcgttactgggcggtgccagattcagaaaggcgcagttagcaaaacaaccctgcggccacctgtctgcttcttgagtcggacgcgtcaagtggatgcctcaaagagtctttcttttctgactaccgacaagactagtggccgcggttcctgcatgtgtgcagttacaaacagcgtaccgtgctctcctgaagaagtagcattatcgtttgatgactgggctaagcagctaggttcgaccgtttgtccgttcggtcagctgggagcgttctttaattcacctaactcgaagggctccgccgattctttcgtctacttcggcgcttccgacctgggacgtgtacactgccccatttccaagagttcagacttaggcagtcgctttcctactttcacagagtttgaaagcccggaaagcatgaacaacttctgcgaaaacggcctacctttctggcaagagaagcgggaacctctagtagattgccggcaggtgataccgaagaatgcctcaacaacggactgcccggggcgttgccacaaggcagtggtcaactgcatggtgagcaatgattcattagacaactgcattaacgaggccctatcagccggtgacttcgccgaaaattgcgaacttcagtcctcggtgaagctcggcaagggcttgatgttctgcaagcgtattcgcacggactgcgagtactccgaatggtcagaatggagcgaatgcagccgtacctgcagaagtggagatgatgaggagagtgttcgggtcaggggtcgcaagctgctcgtcgctgccgaacacggaggcagctgcgacgccgacatcgaggattctcatggtgggagcctgagcgacgtccagctgtgcgactggcttcctccttgcgacgcgctggcagatacagagacctacgttatcatgccaaagccggaaccaaaactggcagactggagtgcgacacggacaacgacaacgacagtgattccgggtcttcagaatgagaacaagatcttgtgcaccatcgtggacatggccgacttctccaaatctcaccgaggctatgacacggagacggagtcgtgtaaatgcccgtacaatgcgagagtatgcagtcgaacggaagcggtcaactcccgcgacaactgggacgaactcatgcagacagtttgcgagagcaatggccaaggccagatacttgcacagggcatggagacgttcagttgcagcgaccgcgtatttcggtcattcaggggcactttaggtcagacgcctgaagcgcactgcaaaagtgaagacgcaacgtatatcttctgtgaagatggtgcgatcgataacgacctcatattcacagaggtgatgatgtcgattattaccggcgtcgtcatgggaatagccgttgtctactgggcgattcagtacagtggggatgtccagaaagtgcttggtttggccggccgatacgtggagctgacgaacctcctgcatgaagtgtctcaagagccgcaggcgcacgaagaagagaaggcggaagaaggcgagggaccagatgaagacgcagaacctgaagcggcagtcgagggaaataatgaatttgactgcaacccacgggcgaaggaagagaatggagaagaatcggaacaggatgcctcggacagtgaatccggttccgatgacgacgatgatattgtatcggaagagtag

SEQ ID NO: 63 - DNA, 8775 bp, Toxoplasma gondii
atgggggttctgcgagttcggtcattcccgcttcaacagaggaccatggtctttcgggcgacgagggagccgtttcggcttcccttggtaccagcgtttattgctttgttcttgttaaagggtgtaacttgtcaactgcagttgggtacgagcaccttgcagaagaatatgtggactacggtgaagtttgacgagcccatgatagacccagtcgttttcgtgtcaccacctgaggttccgacgaacagttttgctttggtactgattggaggagtcacggcgtcaggctttcgcgcgcgtgtctacttcccgtcatgtgaatattcgcccagcggcgggacactgtacgccgtgcgatggcttgccgtggaagcgacgtcagccggatactatgacagctccaacagacaaacaattgactggacagcacacgcagtgaccctcgcttcatcaggcacaatccccgccggctacgtatggtcgcagtcgttttctgcatgggaggatagaccgggtactccaggcgtcctgattggcgtgcagaaccacagggaaatgatttcagcaatgtactcgtcgtcggaatacctgaacccattagtcatcaacagcaacagcggagggaccttgacgttttctttcctacgtcagattagtcatcggataggcttcacgttaaaagttggcatattccagtatgatgcgaggcgaggagcagttatcaatggagtcaatctcgtggcccagagatatgatttgaaagtgaatgaagtattgccggttgcagacgtggtagctggcggtacgacccctgcaacgtttgcagtccagtgggtaacgccgaccgaggcgcccttggccctggtggttaaaccaaaactcttaccagacggcagttactccgagagtctggtcgccgttgaagactgcagaaaaggagcaacctacgaacctcacgcattcgacgtcacacacgcgtttacaggcaatccggcttccaccgctcatcgaatcaacgggggtccaaactgcttcaggccatcggcgagcgttcccacttggcttaccgaaccgtgcaaattggcttgcgagagcttgtggactgccaactctgatgactactggaactgtgacgacgtaaacgcttgctttgagactgatttccggtcggcggagacgctgatggcccttccacaaattgacgagagcattgcagaagtgcttgtaacgtcgtgcaacttcgcgacaaggaccgcagatctgataaagcaatacgagtatgcggtgaacctgaaagttgacgatattgctattggcaccatgtggagtacgtcgtctcactgcggaggcgacaagatggaggttgagattgtcggcgctttctacgagaagctgggtgtctcgattttaacgggctccacatgcgaagttcaagatgttagcagggaggtagaggcgctgtgcaaagctgaaggaggaattggatgttctataagtggtgcacaaatctatgaactcataatgaattatccgggcgtctgcttcgctctggaggatgcagaattgcaaatcttcttcaactgcacctttgcttcaacttcgccttttgactgcgagctgtacgaatccaagggatttgatcaagaaaacggtgactgcatgtgtccgaacgccttggccgcgtgcacgcgggaggaggccacattcaagagcggctggttacagaaccttaataaatcatatcagtatatgctgcacggccagatccgctacgtggccaaaagctcagtcttccaagctttctatgaagcgccagaaacgtcaagtgccggggacaatacgctgtgtgctcggatgaacaccattgttgtttgcaagaatcccacgccagtgtccgcagtcgtgggcaaccgcggtcctaactgctacgtaatagagcatggctcccaatactgccatctgccgtgtttgacggcgtgggacgcgtttcttgctgccaaggacttgccacaacaatcggactaccaagcagagtttgaacgcttctggctcagcttcgatttccctgccattcctcctcacaccagccaaagcttgttggagcagttacagcgttgccgctttgctacacggccagctacagctcctctgcaacaatatgaggatgagatcgacgtgcaactcccggactacggagcggtgattattccgctcggctgtgacaagctgcaccatcgagaggtggttcaggcattggtcggatcagcttcgtccatcatgttgggcgttcatgagccaggttgccgctatgaagacgccacagagacagttcagagagagtgtaaagctgccgtgtctgcgcgcaaaaccacatgtgaaattgatagctccctgttcacttccaaagacatcctgtgcaacacgtcaaccatcaagctcatcattagagggacttgtattccagggccctacttgccaacagactacacatgtgcactgtaccccaccacgggggtagtcagccgtgacggcagatcttgcacatgtccaaatagtgcatatccctgcacatatgaagaaggccaactaacagcttcgagatggaagaatgaagtcaatactggagcaactgtcagtttggccaacagcgttgtctggacggcgcctcctgggacctcagagtatacgtacacgcatacagatgcttatgactatgtctgctccaccgacgagcatcactttgttctttgcaaagatttgacgccgagtgcacttccacttactgaaagagaaccacactgcctcaacagcttttctgtgaagccggatgcctcgacagttgacgaccgggattgccaagatcagtgcgcgagtctgtttgccaccagatgcaggcagtcgttctataagtggttgtgcgtggcccaggggctaccggaatgctacattccgaacacggattctttcacatgtcaaatcgacaccaatccctctgcgtacaactattcgtacggctcgtgcggctgctccggggcgtacccgccgtgttcgcgcaacgaagccaatgccaccaggcttgactggattacggccttcagagctctaagccacaagaagggcgttgtggtggccagagggaagcaggcgctttggactgaaaacccagacagatggcgatacgaaaatggcatgctccagggaggtggctgcttgaacaattcttggtttgttggagtgttctgtggagcgcatttgtcggtcacgccacccgcgagaggagatgttctaccaatttgttcgagcgctgcgaaggtcgaaaaccctgacactccgcatcctgcctgtcgagtcctctgcgcacaagtattgaacgaatgcaaaaaggttttctctaccaccgaaggagcatccgcctatgcgtcagtattcgactgtttcaaggcccgcggaaaaggaacaactctcgacaactgcacttacgaactagggccagagaaccgcgcaacaggagttgctgagttgcacactggctggacagtcgcctcggcgtcgtggtcgcgagttcttttcgatgtagagttcgctgacccgcctgttgtctttttgggaatccccagagacacccaaccgttttacacgccatctgtgcgattagtgacgaaaacaagctttgaggtgaagctgtacagaaacaactgcggactcgatgatacacgaagctcctccgcaccagtatcctggatggcgattcccgaaggtgcctatttgacggatttcgtcgagaatcctgttcgagtaatgaaacttccgatgacaacgcgtaccccgacggttctgacgttttcccttcccggcttgaaagaacctgaggagatggtagctcttgctcaagtccaagacttgactccgaccagtgtttctacagatcgcgtcgcagttgtgatttcaaaccttaagacaaactccctggaactgtcgcttgtggtggacgagtccgtgaatttttcgactgttgctgtcgggatcctcatctcgggcaagcaaaacccggacctcgctgctggattgtccccccttctcaatcgataccacctgcagacgtttcgcattccagcagcggcgtattcagcgacaagcattttaggtgaaggtctctacttgtccgggggtatcatgcctcacgttttcgccgcggcgatccagacgagaagcaggactaaagagttggacgaaagcgatcgcgttgttatttccagaagagcaacgacaacgccttccacgtggtcagccctgttgtggaagaagacctgcgacgcaaaggacatgtttgaagcggttgagaatccctctgatcttatcatcgctggtatttatgttgaagctcgcaaagacgaacccagtgcgattctcggaaaccggcacgacctgtgcctctccttcataggtcaaagtttcgagagtggagttgtggcgacatgcatgggagcttgtcggagtgcactcccggcctccgtgcagctgcactgccaggatgaatgtgccttgaacatctttgctccttcggttcacacgaagtgtatgtcggactgcgaaagtctgctggtggcgcagtatgaagaatgtgctggtcagtgcaccgccaccggcaccgcttcttgtcaaaggaagtgcaagcagttcctcggaaataaatgtgacagtactgcttcatcggacgtggcggcttgcttggagttcgtcacccccccgtctgtttttgagcaatgcacgctgctcgtcgagtactctgtcagcgagggcggggcgtccgacggactcgaaatcgaggaagagacaacaccatcccaaacgtatgagaactgtatcatcgtggacatgcgggatgggagattcacagcctttacagggtgggactcccgggtggcgtcctgcaaatgtcccaacgacttccgcgcgtgcacctcagagacagtcaacactcaaaaccactggcggaccgagttgctcgcttctgcaggcttgtgtaaagagcaaccagacgggaggttcaacgctgtcacgcaacagttgtggtcgactacaggcgatctctgtgccttggcagctgacgaacagcaacctccaatctcctggaccagcaacatgttgcctgcttatgttgaccaagacgtcgttctcgacaactccaccattcgcagtggcgactaccagtgcagagaaatctggcactacgttgtctgtccagctgctgccacgtcaaccacaactcaggagccgccggtaccaccctttacagcaactctgaaaacggcaattgtcggggagtggggtgaatggtccgcgtgcacgggaacatgcttttcccagtggtggacgcctaaaaggacgagaacgcgcttggttttggcggaactttcccactcgcaaattccaagtgtatcggaaacagcgacatgcctcgaccttccgccttgcgggacagtctgttgggaacgagagtggacggagtggagtgaatgcaagttgttcactattgtcatgggccagggcctggaatattttcgacaacaaatcaaaccgattttcgactttgtcgaggaagcatgtggattggatgagcacgagcgatacgaaagatgcggcgaggagcaaaacaacggggagacaccggcgacctccacactgcaaacagattcgctgctagagaccaggtccttgactgtctctcgcgggacggctgcgcgcgcattgtcgcgggtgtcgatggatccggcccttgagcctccctcttttgcctctctccatggaactcgttcgcatgttccagcttccatagatgccaaaataatagagagacgaaagggaatcatgagccgccgacgctctgtccctccgtcggggtatttggaggaaactgccgaacaagtggcgcgtgggggcgaaagtgaacaaagcgagaaggcgagccaaaacgggagtaggaggcaccgagcatccaggaaacagaagcgaggcttggagtccatatactcggatgcgagtgtccgcggcagtggagagtcgacactgcatggaacaggaacgaacgcgtacagagaccagatagaatggacaagcaaaagttcttcgcgttcggcaatactcgacagcggggcgagaggtgcagaggcgggcactagcttactgcagaaagcgcgacgcgcacggagaggagctgggagatttcggaagagtcgaagccaagcacggaaccagacccccgacaaatcgtgttcggtcgtatctgagtggtcaggctgcgattcaccctgtctgcctcacaagggctcgacacctcgccggtatcggctcgccgttcctggacagaatgaggcaaactactgcacggtaccgttgagtggcaaagagcacctctgtaccgatttgccgcagtgtgctcacccaaacttcgactgtgcgaaggttaccgcttcgcggttgacagacgaggacatagcagcctgtaaagcggtgtgtgtggaggtcgtcaaaacgtgcgagacgatgatgagcgcagtgttctctctctacacctctctggaacaatgcgcactggttcagtttcaagaatacgagcaattcccgggacagtgccacataccggaagagtatacctcgacgcgaagacccaccaagtgtttcccctcgcgcacgaggaggcgcgtcgcgagcggagagttgccgttcatctttcaggtctcaacggcttcgggaacttcgccgtcagccacttcagatgctgcgtcttctgtcgctgagtccttcgtctcaacgggaacggcctcagctcccagctcgcgggttatgaatgcactcgcgtttgaggcctctgcttcacagacttccatcgactcctgcgaatgctatgatcccgcagacgaaccgtgcactgctcaagaagctcgagactctctgttcgattctctgtacttgttcctaacgcatccgctgtgtgcagagtcccccgcagcagaaggcgctttgtttaccatgtcggagcctaaccagacggcagatgccgcctcgtactttgcgttaagaggcctcggccgcatgcactgtcccgtgcctatgtacaagtcttcgactgaggtgaaaggcgttctgacaccgaaacgcgtcactttctccgaattcaagacaaaggaagacctcaacgagttttgccacaaaggcctgagcaactggagacaaaatgtgccacctgagatcatcgggagtgccagtttccccaactgtatgctggtgacgccgcgcgaaggtgcggagccacaagactgcgctttgctgtgttccgagacaatgagctcctgttcagccgcgagcttgtctttcgtcgaattgtcacagtgtgtccaggacaagctgaccgaaagcgacttctactcaaaatgttccgctccggaagtcttggctccaggagagggaatcattctttgcaaaaaaaaggtatctacctgcgactacactgaatggtcagaatggtcaacgtgcaccgcaacctgctttaactgggacgaaggagtgattccactgcgtgtccggtctcgcgattttgcctcgagttcagcagagagcagggtgttgtgccggctcgagagtcaaaacgacgccattcagactgagaaatgcgactggatgcctgtttgtcctgaggctgaaagtgaagaggaagacgatgcgacgggtggcgtcgaacctagaggggagcccattgtcccgccttggtcgccggagaggccgaccgacgaaaacaatcaggccatgggcagtgaagatattgtgccaggcacagttgaatgctacgttaccaatatgggcacaatcatgacttcgtactaccgaggttacaatcaagagtaccacgggtgcaattgtcccggcggccggcggccatgcacccgcgcagaggctgtggcctctctcgatttgtgggcaaaggactcaggaggtctttgcgaccaagacatggcaacaatgatttccgccgcagagggtgaagcgtttttctgtgcgaccggaagcttcggaaaaatcgatacctctttgtcggagtcatcctgcgcctcgtcggaatatcaatacgttttatgtgaaggtcacccgtacgagggcatagcgaacctgacgacgtgggtgatttgcctgcttctgggtgtcggcggaggcatctgtttcgtcctttcctgtgtgcagtacagcagcgacatccagaaactgttggggttggcggggagctaccctgtcctggttcagaatgtcacagagctacaagagcgtgaaagccataaacttcggcgtcaggggaatatttcagcaacttcggaacactcggacgctcatgcaccgtctctctcagactctggctgggacatggacggcaaccaatcagcaggctctgcattcccagaggaggaaccgtggcaatttgaagatcacgatgaagaaccattgctcagtacgaggaaatactcaaggaattcgggctcggctgagattcctgaaccctcagagatagggcagacgtcccccacgcaacaaagagtcccgcgagcctctttggctgcacagcgaagcacatgccagctgtcgtcgagactgggacaggcgaattcgcctgagcaaagcttagagcgaagaagcttgaagttacgggattcccacgccgacgtcgaactgcaacgcacacttcggaaagaaatgaagggaaaccaggtgtgggacaagacggtatga

SEQ ID NO: 64 - DNA, 2007 bp, Toxoplasma gondii
atggttgtttcctgtctctgtaccgcgatgtcaagtgccctctctcaacggaactgtatcctgatatcgtgtcgactcggtcgtcagaggtcaagaccacctgacgcaatgaaagtctatgcccccgtcttcacatgccgtcgccaatttctgtacgaaaaatatacacgtcgccgttgtactacgcttggaggcctggtagctttatgtgtcattttcactgctgaagctatttcacggtcacaacatccctacggaacgtcgaggagtgatttgagtccaccagcaactgtggatagcacaagctatggaatgtcaatcctggaggctggcggcccatccgacgaagtggcgattccctccgatagattgcagacttttagaaatgcgtctctcgattttgatagggctattcgcttccctaatcaggcgagtgtggctgaatcaaggcaactacgtttaatgcagatgggcgagtgccaaaacgtctattggggaaaaaaagagctcattagcaggatcacagggaaatggaaaagtgcgctgcacccatcctgtcacgagagctggttcacatacacttcctggtcgagaacaaaaacatggcgagagtgtgcccaggccctggacaactcctacttgtatttttcttgggtgagacgtcacaacgaagccgatggagcgtgcatatgggtcaagccctcccgcagagacgttagcaagagcgacgtggaggactgtctggtcgatgtgaatccacaaaaagaagttgccgtaactggaattgtcggcagccaccacggatgcacaacgtgcgaagtgggcgagtggtctgagaccacctgtgacagttggtgtaatgatggagtaaagggtcgttttcgcgaactaacaggtcacacgaattcggctcactgcagtacgtcggctgatgccaactgcgatgtatgtccgaatctgtgggaagttcaacgctgcagcactgccgtagaatgcgctcaaggaatcaaaccaagagtccgtttctgtcccaacgaaggcagagagtacacggctgaaggctggcgcgcctgtgccgaacggtgccaacgcaagttcaatgccacgaacggagacacggcgaaccgtgataccttctacaaggccgaatgtttcagatactcattcaacaatgacacctccgcttgtattcttaatccgcttcatgcgtgccccgatgccgagtcagctagtgacgtgttgtggatttctggagacgttctgagcatgccctcggccgactacacaaccgtaacgtggcaggagtggcaatcatggagcagctgcagcgaggtcgacccggcaaccggttggaaaaaaaggacacgacgacctaaaacatgggggtatcgtccggacaacgtcttatcaccgttgcagtggatatccgtcaccccttgcgcttccaacgtaacactaacacgaagtgaactcgatctggcgatgaatcccagtgcgatgtgctgggtgtacagtgacttcgcggattggtcgacagtttcttgtgaaccccgatgcggggcagacaggaaaaagacgagggccagggcagttcggcagatgcctgtggtacagccagatggccggatctcggagtcgtgtgcatccactgaagtttcactggaggcacgccagcagacgaaggactgtcccggttttgtatcctgtggcaccggctgcgtcttcggagagtggacggcatggagcgattgccggtgcacagcggaagggtcaacagcgcgaacgattcgcgcgcgagaactcgtctctggctctaaagaatcctgcactggtctcgaggaggaaaggaaatgtgaaaaagtttgcgaagaaagcattttctccaatggagtcacttacgcagttgccggaggcattgggctggtagttgtcattggcttaggttttataggacgcaagttttatcgagctctgcccgccgaacggacacgggacaactacctctaa

SEQ ID NO: 65 - DNA, 1056 bp, Toxoplasma gondii
atggacgcgctgaagactgtgttcaaccggagaatcgctctccccgttgttgttgcagcggcgttgctccataatagtgccgaggccctgcaatctccagggctccggagacagctagtcaactcccactctttcgctgaggtggagacgacaggatatagctgctttgaaaaaggcaaggagtacgttggtttcagcctgactgagttcgccaaagtgggcgacgctgctttgtgccagcagaggtgcaatcaacacccgcagtgtggcttcttcacattctattccaatgagaaccgatgcgtgctccagtcccgcaagccttctcaggagaacaacaatgccaatgccgtttctggcccgaaacggtgcccgctttgcctcgttgataactatgatttcagaggcgagacaaacatgcataaatcaggtgctcccggtctcaatacactcctggcgtgtcaacagggatgtgcagcggagcccaaatgcaaggccttcctcttcgagaagcgtccccgcacgtgtcacttcaagacaagtgataactatttgaaatcgttccatccggatacttcatatatcgcaggtccgaaaacgtgtacggatgaacactggtgcatcatgaaggatattggctacaagggcacagactcgaaggcgacaaaagcaaactcagcggcagagtgccagcagatgtgcctcaacgacgagagatgtgactttttcacgtggcaacaggcgggcaagcattgttggtttaaggctggggcgtccactgcctcaacaaaatacaatcgggctggcgactattctgcaccaaaacactgcggcctgccgaccacatgtgtcaaggagcggacgaagtacgcaggcgaaaccgttgcgacgttccccaagagcgaggtggggaccttcgagtcctgccaaatgaagtgctggaagaccagcaagtgtgtgtttatgcacttcaacaatgatggctgcacgctctctgggatcaatgcaaccgctcaaactgatgcgaactccaaagcaggcgatatcacatgctga

SEQ ID NO: 66 - DNA, 1056 bp, Toxoplasma gondii
atggagactgtgacgactctgttcaaccggaaaattgctctctcctttgttgttgcggccgcgttgctccataatagtgccgaggccctgcaatctccagggctccggagacagctagtcaacgtccactctttcgctgaggtggagacgacaggatatagctgccttgaaaaagacaaggagtacgttggtttcagcctgactgagttcaccgaagtgggcgacgctggcttgtgccagcagaggtgcaatcaacacccgcactgcagcttcttcacattctattccaatgggaaccgatgcgtgctccagtcccgcaagccttctcaggagaagaacaatgccgatgccgtttctggcccgaaacggtgcccgctttgcctcgttgattcctttgatttcagaggcgaggcaaacctgcatcataaaggtgctcccggtctcaatacactcctggcgtgtcaacaggggtgtgcagcagagcccagatgcaaaggcttcctcttcgagaagcgtccccgcacgtgtcacttcaaaacaaatgataactatttgaaagcgctcgatccggatacttcatatatcgcaggtccgaaaacgtgtacggatgaacactggtgcatcatgaaggatattggctacaggggcacagactcgaaggagacaagagcaaactcagcggcagagtgccagcagatgtgcctcaacgacgagagatgtgactttttcacgtggcaacaggcgggcaagtattgttggtttaaggctggggcgtccactgcctcaacaaaatacaatcgggctggcgactattctgcaccaaaacactgcggcctgccgaccacatgtgtcaaggagcggaccaagtacgcgggcgaaaccgttgcgacgttccccaagagcgaggtggggaccttcgagtcctgccaaatgaagtgctggaagaccagcaagtgtgtgtttatgcacttcaacaatgatggctgcacgctctctgggatcaatgcaaccgctcaaactgatgcgaactccaaagcaggcgatatcacatgctga

SEQ ID NO: 67 - DNA, 1812 bp, Toxoplasma gondii
  misc_feature (949)..(1678): n is a, c, g, or t
atggacgcgttgaaaactttattgaacaagggaatcacactcgccgtcgttgttgcagcggtgttgctgcagattcgtgccgtggcgcttcaatatccagggctccgaaaccaggtagtcaacgcccactctttcgctgaggtggagacgacaggatatagctgccttgaaaaagacaaggaatacgttggtttcagcctgactgagttcaccgaagtgggcgacgctggcttgtgccagcagaggtgcaatcaacacccgcactgcagcttcttcacattctattccaatgggaaccgatgcgtgctccagtcccgcaagccttctcaggagaagaacaatgccgatgccgtttctggcccgaaacggtgcccgctttgcctcgttgattcctttgatttcagaggcgaggcaaacctgcatcataaaggtgctcccggtctcaatacactcctggcgtgtcaacagggatgtgcagcagagcccagatgcaaaggcttcctcttcgagaagcgtccccgcacgtgtcacttcaaaacaaatgataactatttgaaagcgctcgatccggatacttcatatatcgcaggtccgaaaacgtgtacggatgaacactggtgcatcatgaaggatattggctacaggggcacagactcgaaggagacaagagcaaactcagcggcagagtgccagcagatgtgcctcaacgacgagagatgtgactttttcacgtggcaacaggcgggcaagtattgttggtttaaggctggggcgtccactgcctcaacaaaatacaatcgggctggcgactattctgcaccaaaacactgcggcctgccgaccacatgtgtcaaggagcggaccaagtacgcgggcgaaaccgttgcgacgttccccaagagcgaggtggggaccttcgagtcctgccaaatgaagtgctggaagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaggaagccggtggccagtatatgtcacagcccacgaacgaaaaaaggagaccagacagtttctcacgaaatcgtgaggcccgtgaacacgtgtagacgagtgactcctgagcgtggcgatagtgaatga

SEQ ID NO: 68 - DNA, 2310 bp, Toxoplasma gondii
atgagactccaacgcgaggccgttttcggtctgatgttcgcttgcggtatgtggatgtggccgagcgaagtggcaggtggagggtggagtattgtggatgccttacgaaaaaggtacgacacgagtcgaggaggcgacgcaaacggtgtcgatacttcaggcgttgaagatgtgattcaatctgagagtgccatcggagccgcagaggggtgcaccaaccagctggacatttgctttcttatcgattcgtctggaagcataggaatacagaatttccgtctagtaaaacagttcctccacacctttttaatggtgttgcccattggcccagaagaagttaacaatgcagttgttacttactcgacggacgttcacctgcaatgggatctacagagtccgaacgcggttgacaagcagctcgcggcgcatgcggtgctagacatgccgtataaaaagggcagtaccaacaccagtgatggactgaaggcctgcaaacaaattctgtttacaggttcgcgcccaggacgcgaacatgtgccgaagctagtgattggaatgacagatggcgaatcggattctgattttcgcaccgtgagagcggcaaaggagattcgtgagcttggaggcatcgtcacagtccttgcagtcggtcattacgtcaaacatagtgagtgccgaagcatgtgtgggtgcagtggtacgagcgatgatgacagtccgtgtcccctgtatcttcgggctgactgggggcagctcgcgacggcgattaaaccgatgcttaaagaggtttgtaagacactcccccaggatgccatttgctcggattggtccgcatggagcccctgcagtgtatcctgcggtgacggaagccaaatcaggacgcgaactgaggtttctgctccgcaacctggaacaccaacatgtccggactgccctgcgcccatgggaaggacttgcgtggaacaaggcggacttgaagaaattcgtgaatgcagtgcgggggtatgtgctgttgacgctggatgtggcgtctggggagagtggtccgcctggagcgcgtcttgcggaaatgccacaaggaagcgagagcgaacgcgttacaatgacccaccaccccagggggcaggccgtcggtgtgaaaatcaggatccgccggtgttacaggagcagacagaagaagcaactcttgctccttgcataactataccgccaactcccccagaatgggctgcatggagcgactgcactgtcacgtgtggcggtggcaatcggcatcgagtgagaaacgcactgccaccaggactggggtcgcagaacggagaaagtgacgaatcgctcgtgtccaaactgtggcctgggacagatctacgacaggaggaagcatgtaatacctcaccgtgtccaattaatgcaacttgcggtcagtttgaagaatggagtacatgctcggtctcatgtggtggtggactgaaaacgaggtcgaggaacccttggaatgaagaccaacaacatggaggactatcctgcgagcagcagcatcctggtgggcggacggaaacgataacttgcaatcctcaagcgtgtcctgtggatgaacgaccgggggagtgggcagagtggggggaatgtagtgtcacgtgcggcgacggagtgcgagagcgcaggcgcgggaaaagtctagttgaggctaaattcggcggacgcaccattgatcagcagaatgaggctcttccggaagacttaaaaatcaaaaacgtcgagtatgagccgtgttcgtatcctgcttgtggagcttcctgcacgtacgtctggagtgactggaacaagtgcgtgtgcccgatgggctaccaggctagacatgcagcagtcaagttcgattatcgtaacaagccttgcgacctcccaacgtttgaaacgaaagcatgcagctgcggcgagacaaatccggtgccttcggagggaacgactcctggtgcgcctggcgccaccggtccggaacagccaaaccagcgcccacttcctgaaggttctgatgaaaacgagacgccgacgaacgaagagggagaacagtccaagaaagagtcaggcagtggcatagctggggctattgcgggtggcgtcatcggcggtctgatactgcttggcgcagctggaggagccagttaccactactatttgagctccagtgtcggatccccatccgcggagatagagtacgaagcggacgatggggcgaccaaagtggtcatggaagaggagaaggaaacgctggtgcccgtggatgacgatagtgatatgtggatggagtag

SEQ ID NO: 69 - DNA, 1152 bp, Toxoplasma gondii
atgcgaggcgggacgtccgcgctgttgcacgcgctcaccttcagtggggccgtgtggatgtgcaccccagcggaggctttgccgattcagaagtctgtgcagctgggcagctttgacaaagttgtgccgagccgcgaagtcgtctctgagagtcttgctccgtctttcgcggtgactgagactcactcgtctgtgcaatcccccagcaagcaggagacgcaactctgtgctatctcgagtgaaggcaagccatgtcgaaaccgtcagttgcacactgacaacgggtacttcatcggggccagttgccccaagagcgcttgctgcagcaagaccatgtgcggccccggcggctgcggagaattctgctccagcaactggattttttgcagcagttcgctcatctaccatcctgacaaaagctatggaggagactgcagctgtgaaaagcagggccatcggtgcgacaaaaacgcagaatgcgtcgaaaacttggacgcgggtgggggtgtgcactgcaagtgcaaagacggcttcgtcggcactgggttgacttgctccgaggatccttgttcaaaaagagggaacgcgaagtgcggacccaacgggacgtgcatcgtcgtcgattcagtcagctacacatgcacctgcggcgacggcgaaactctagtgaacctcccggaagggggacaaggatgcaagaggactggatgtcatgccttcagggagaactgcagccctggtagatgtattgatgacgcctcgcatgagaatggctacacctgcgagtgccccacagggtactcacgtgaggtgacttccaaggcggaggagtcgtgtgtggaaggagtcgaagtcacgctggctgagaaatgcgagaaggaattcggcatcagcgcgtcatcctgcaaatgcgataacggatactccggatctgcttccgcaacctcccaccatgggaaaggagaatcgggatccgaggggagcttgagtgaaaaaatgaatattgtcttcaagtgccccagtggctaccatccaagataccatgcccacaccgtgacgtgtgagaaaattaagcactttgcccttgacggggccggcaaccacgacacgactacgtatgtcgcaagacgaaggtacccagcgagtctctga

SEQ ID NO: 70 - DNA, 1743 bp, Toxoplasma gondii
atgagagcgtcgctcccggttcacctcgttgtgtgcacgcagctaagtgccgtttggtttggagtggctaaagcccatggtggacaccgactggaaccgcatgttcccggattcctgcaaggcttcactgatatcacgcctgcaggtgatgacgttagtgccaacgtaacaagttcggagcctgcaaaacttgatctctcttgtgtgcactctgacaataagggatcaagggctcccacaataggcgagccagtgccagatgtgtccctggaacaatgtgctgcgcaatgcaaggctgttgatggctgcacacatttcacttataatgacgattcgaagatgtgccatgtgaaggagggaaaacccgatttatacgatctcacaggaggcaaaacagcatcgcgcagttgcgatagatcatgcttcgaacaacacgtatcgtatgagggagctcctgacgtgatgacagcgatggtcacgagccagtcagcggactgtcaggctgcgtgtgcggctgacccgagctgcgagatcttcacttataacgaacacgaccagaaatgtactttcaaaggaagggggttttctgcgtttaaggaacgaggggtgttgggtgtgacttccgggccgaaacagttctgcgatgaaggcggtaaattaactcaagaggagatggaagatcagatcagtggctgcattcaattgagtgacgttggatcaatgactgctgacctggaggagcctatggaggctgattctgttggcgcttgtatggaacggtgccgctgtgatggaagatgcacgcacttcacgttcaacgataatactcggatgtgctacctcaaaggtgacaagatgcagttgtactcatctccaggtgacagaaccggcccaaagagctgcgattcaagctgcttctcgaacggggtttcttacgtcgatgatccggcgacagatgttgagaccgtattcgaaatttcacacccaatttattgtcaagtaatctgcgccgcaaatccgttgtgtacagtgtttcagtggtatgcctccgaggcaaagtgcgtcgtcaagagaaaggggttttacaaacacagaaaaacaggtgtcacgggagtcacagtgggccctcgggagttctgcgattttggcggtagcatccgcgaccgagaagaggcagacgccgttggatcagacgatggcctcaacgcggaagcaactatggcaaattctcctgattttcacgacgaagtagaatgcgtccacacgggcaacattgggtcaaaagcacaaaccattggagaagtgaaacgcgcaagtagtttgagtgagtgcagagccagatgccaagcggagaaagaatgcagccactacacttacaatgtaaaatccggtttgtgttatccaaaaagaggaaagcctcaattttataagtatcttggcgacatgacgggatccagaacatgtgatacaagttgccttaggaggggagtcgattactcacagggccctgaagtaggaaagccttggtattctacgctgccgacagactgccaagttgcatgcgacgctgaggatgcttgcctggtgttcacctgggattcggcgacgtcacgatgctacctcatcggctcaggtttctcggcacatcgacggaacgacgtggatggcgtggtatctggaccctatactttctgtgacaatggcgaaaaccttcaggtgcttgaagcgaaagacacagaatga

SEQ ID NO: 71 - DNA, 546 bp, Toxoplasma gondii
atgctgcgacctactgttcgtagctcgttactgtccctggggctgacagtgatcctctatctggctcttaccggctctgctgatgcgttagcctcgcatttacgctccagacacatggaagccggaagacgaaccatggatacccaaaacgatgtagaaagtgctggtcgtcaatctgaaccaatggaggcagcagatcgacaggcagaacatcccggtgcacccactcaatctgaaatgaaagaattccaagaggaaatcaaagaaggggtagaggaaacaaagcatgaaggcgatcctgagatgacgcggctcatggtgaccgagaagcaagagagcaaaaatttcagcaagatggcgaaatcccagagttttagcacgcgaatcgaagagctcgggggatccatttcgtttctaactgaaacgggggtcacaatgatagagttgcccaaaactgtcagtgaacatgacatggaccaactactccacgatattctcgccgcaggtggagtcgttgggctcgactccgaggtgaaactcgcatag

SEQ ID NO: 72 - DNA, 1050 bp, Toxoplasma gondii
atgaggctcttccggtgctgtgctgcggccgttgtggcggccgaatcgttactgtggctgaagaacggctccccgttttttgcctttcttcctgggaatggagagattgcagacaactgctctgggaatccatgcggtggcaccgcagctggtacgtgcataaacacaccatctggatatgattgcaggtgcgaaccaggctacgttctgggcgttgaaaatgaccaggtcacgtgcatgatgccctcaggtgtacccatggctaattttgtacagctgtcggaaaagcctgcagcttgcagctcaaacccttgtggacctgaggcagccggcacctgcaacgagacaaacagtggttacatttgccgctgtaatcaaggctacagaatatctctcgacgggacaggaaacgtgacatgtattgtaagacaggaaagcggctgtgaggaaaacgggtgtgggccgccagatgcagtacagagttgccgccgactaacagggacggcaggtcgactatgtgtatgcaaggaaaactttatagcgacaatcgacgccagtgcccatatcacctgcaagcgtgtgcctccccattataggaagcctcccttcgaatttggcaagggaggtcatcctgtggactcagaaccatcgaaacgccagagggaagatgaaggtgaaagtcgtgagcctgaaagcgactcaacagaaccggggagagatcaggaaagaagaacaccacttgaggaaagccaggaaccggaaggaagcaccccggacagtcagcagagccgaggtggttctggtagcgacagtaccgagagcgaggaacaaggaaaggagagagaggaaggaagtggacatgctggtgcgatcgctgggggagttattggaggcctgttacttctgagcgctgccggagcgggtgttgcatacatgagaaagagtgggagcggtggaggggaggagatagaatacgagaggggtatcgaggctgcagaggccagtgaagtcgaagtcctcgttgatttggatagcaaaacatgggattaa

SEQ ID NO: 73 - DNA, 1023 bp, Toxoplasma gondii
atgggaggctgggagtcaaaagatgcgtgtgagtcgggagggacagcgttttgcgggacagtcgcaaattctgctggctgcattgcgctctctaaagagttctactgtacctgcctaccgggtttccagcctgagggccggaggatgaattcgtcgtgcgttgatatcgacgaatgcgccagaggaatagggctgtgcttcagcaaaatcgagaattccgagtgtgtgaacacgccaggaagcttcgagtgcagatgtaatgaataccggacgttgaagaataatgtttgtgaagatataaacgagtgcttggacaaccgaggaggctgcgcagaacacactgattgcatcaacaacgacggagcggcagtaacctgcaggtgcttaccgggctacacggggaatgacggcaaacctggacgagcgtgcaaggatatcaacgaatgtgaagaaccggatcactgccccgagaactcggtctgcgtcaacacccctgggtcctaccggtgcgaatgcaagacgggatttgcaaaagatgctgaagggatgtgcacaggcaaagacttttgcgtcacaggagagaacggatgcgatcccaacttcgccacatgtactccggttgtgggctcctacgcctgtgcgtgcaaggatggttttcaaggcagcggcaggaagggagaatgcaaaccgcttcctggctccgaatacaaggcctgcgagctattagggctacactgtgggcggtaccaaggatgtgcatcagacaacgcaggaagctacagatgcgcagcactgactaaagtgcagcaggtgaaagttcttctgtccgagggacctggaacggaaactcccctttggctgtggtgctgtgtcgccctagctgccgtcatttttgttggcgctgttgtctacggtgttcgttattttctgaagaaatggaagaagacgaatgagtcagaagatgacgctctattgagtggatacgggtatgactacggcgcggcgcattcgttcagagggtag

SEQ ID NO: 74 - DNA, 2055 bp, Toxoplasma gondii
atgaaggccaatcgaatatggtgtttttttgcgtggcgtatggttgtgcgggcctcatttctgaaagagatggacagcattttcgtttctgctatccgacagaatgtacagcatactcattctgcccttctcgccaaactgaaggaacccccagatccagatgatgagaactcttggctttgtcgaatatcaaaaaaatatgacgcatgcggtagcagggaatattccgataagggcctcaaatggacgttctgtcccgaggatttttgctgtagcaagacggcatgtttttacggttcatgtgggagttggtgccacgacaactgggctctgtgcagctcatctataatctaccacgacgagtacagttacgggaaatgcaactgtaaacggtttcaagaaaactgtgatgtgaatgcaatttgtgtgcatgcgaacagagaggatggcggtgcgtattgtcagtgcaaggaaggatattggggtgatggtaaatcgtgcaagattgacttctgccaactgcagccgtgtggtgcagggacctgcaccaggacggatgaaggatacaagtgtgattgcccagaaactcacaagcttattgtcgttgaagacaaagagacgtgcaaggcaaaaccggacttttgcgcggaagagccttgcggaccaccctctatggttgaaaattgcgtgaacaccgatgacagctacgaatgtgtttgcaaacaggggtatgaagtgaggaacggccggtgcgaagaaattgacttatgcgcggacaagccatgtgggccagatgagggtgtgcatgagtgtgtaacagagaggcaaccgaaattaaggtacagatgcacgtgcaaggcaggattcgatttgaccaccttgcctgatggtgtttcccagaagtgcctgaagaacttttgttacgaggagccctgcggcacccgggacctagttgaaagctgtaagtcaaaggcatatggatactcgtgtttgtgtgcggcaggtgccatggttcaagtgattaacggaaaagaaaagtgcatcaaggcggacttgtgccgcaatgatccgtgtggtccagagacagcagtgattcaatgttactctcatggcaccagctataggtgtttgtgcaaagcaggctacactgaagtttttgttaacgggaagagttcatgtcaaaagggcgacccctgcactctgaacatgtgtggcggtaacgaagcggtccaggagtgcacaactgatggcacggcgtacgggtgtacctgcaagccaggctattcgatagccattaagcatggtcagaagttttgcaaccctgaagaggagtgtgcttctcattgtggctcggcagctgcagtgaaaagctgtgaaatacttgactctggcggataccagtgtacatgcaatccaggatacgtcatgagatacagcgactatgtaaaaggatgcgtcgagggaaatcagtgttctctcaatccttgtggggagcaggaagccgtgcaaaggtgcattcctgaaggtgacacgtatgattgcgagtgcaatccggggttcgtcaaaagagtcttgccggatgggaatttcatttgcgccgatccagcgagctgtgtagggaatccctgtggtagctcagatgcggtcgatgcgtgcattgccgggactagcacgtatacatgcaggtgtaaggacggatacacacctcagtcaattgggtcaaagttgcagtgtttaccagaaagcactgatcagacagatttcgattccaaacacaaaccagaggacaacaaaggtcgatattcgaaaggaacaattgcattggtggttgtggggtgtgtagccttgttgggtattatagccggaggaatttcttacgccagaaacagaggaggtgagcgcgatgatgaagacttggcaccaccacctcgttccacacgagaacggaggctctcatcaatgggcgaaggttttgagaatgcctcatgggcatcttctgtaagtatgattcctagtgcacctgctccgccaccttcgggcggtatctggtcctaa

SEQ ID NO: 75 - DNA, 903 bp, Toxoplasma gondii
atgagggtttcgtttaacgtaccgcttcatcgaactggtttcgtccttgtctgcgtcattggctccctgtgctggtgtatagcacccgctcctgagtgtgtgtttccagccacgggtctcggacccgccgcttggaatcacccgggatctctcgctcagatgagggcagaatcgaagggtgtcctttctgttactggaatatgcgatagaaacccgtgtggaccccatggcaattgcatcccaaaccttagtacgtacacgtatacttgttcgtgtgaaggaggctacgtggaagcagcagtctccggtaagccaacctgccaaaggaaagatccttgtgacaccagcccctgtggaacgaaggaggcggtgaaagaatgcagacctaacgggcagtattacgcatgcatttgtcaggcaggataccaggtggtctccacgaataccggttcgaggtgccagcgaatcaaatcaacaactacaccatgttcctctcaaccgtgtggtgggccagaggcggtagaagcttgcctcgtgacgggaccgacaacatactcatgcacatgtgcatcaggctatgaaacgataacaacggagcagggagaaaggtgcgagaaaacggatccttgcttgagcaatccttgtggagcatcgaaatatgtgcagtcatgtactgctacgaataccggctacacttgcgagtgtgtaaagggagcaaagaaaacaggttccgactcagcgccgatgtgtgtcgctggcgagtcagacatgacccagtggtacgtggcggggggcatcggtggatgcctttgcctgttcgctgtggtgtatttgacctcttccaggcaatccccaaattctaacgacgctctgtatgcacacgattttgaaggaatgtattga

SEQ ID NO: 76 - DNA, 3000 bp, Toxoplasma gondii
atggtgcccttgtcgagaatggcaatggtgtcggttgcgtattttatattaggagccctggtatatgggtctgcgaatgtgtttggggagatgcaaccgcgtcaactggccaaatcatccacggatgaccctacaatccacgatgaaggccacggtgccgcagcccctagtacaccgagagctggtacggaattgatgacaccacaccctctggcttcccgtgcgaaggccgtgacgtcagcaattatacaagaatctaaaagtacacttttcaacacgggtcatgtgaccacaactgaacatgcgccaaagaatccaggtctactaggaaagcctgtgaagcaaacagaggcgcttcagcttgcgtcaccagagaagggagtgacgacaatggaacctaaggcggcctctcagcatgctgatcgtagtggaaacccagcggtgaagaagagcacatcaggtgcacagcaagctgcagcacaaagtggaaaggtcctcacgaagctgacaccaatcgagaagaaccccgcacctctacatagacagccgatgacaagggcaacacccgtcggtccaaagcctgcggatccagctggcaaggcagtaaagaaggcagccacagggataccaaagcctgcagctccaggtggcaaggcagtcaaggtgactcctgtcgcgcgaaaacctgttgcaccaaaggcagcagctccagacggcaaggcagtcaagaaggcaaccgtagtcgtgccaaagcctgcagctcccagtggcaaggcagtgaagaagccggttgtcagcgtgccaaagcctgcaacactcggtggcaaggcagtgaagaagccagctgccggcgtgccaaagcccgcagctcccgatggcaaggcggtgagaaagccagttgtcggcgtgccaaagcccgcagctcccgatggtaaggcggcgaaaaagccagcgtccggcgtgccaaagcctgcggatccagctggcaaggcagtaaagaaggcagccacagggataccaaagcctgcagctccaggtggcaaggcagtcaaggtgactcctgtcgcgcgaaaacctgttgcaccaaaggcagcagctccagacggcaaggcagtcaagaaggcaaccgtagtcgtgccaaagcctgcagctcccagtggcaaggcagtgaagaagccagttgtcagcgtgccaaagcctgcaacgctcgatggcaaggcggtgagaaagccagttgtcggcgtgccaaagcccgcagctcccgatggtaaggcggtgaaaaagccagttgtcggcgtgccaaagcctgcagctccagatgacacgggaatcaacaaggcgacccttgtcacgcggaaacctgaggctccagacgtgaaggtagtcaagaaggcaaccgtagtcgtgccaaaacctgaagcgccagatataaaggtaatgacggatcagaccccaacgacgcctccctctccgcctgtacgagcaagggcagcgtcggcgacgacaatagtaacagctcctgctccagtgccaacccggcctgtgctgacaacaacatccacggcagcaacagttaccacaattaaaacagagactccacgagcagcctcgaggctccagcaagatctgaacgctttctgcaccacgcagttccaaaagctgtgctcggagactatcgatgggggccggtattgcggagtcagcggcgctgtagcaaggttcggtccaggagggcatgattccgactcccaatggaggtgttacgaagagtctatcatgaacacgactaccaagggcgtccagtgcatggacgattgtgggaaccagatgcagtgcgttggcgctgtttccgtgaagacagttgccacaccgccccttagagctctctccgccttcatcagtcagcggcgatggatatactgcagttctttccagcgatctgcagatgcactgtgcaacttcaagcgtacaggaaacgttgcgcggtatgaccctggcaggactcggtggatgtgttttaatccggtcgacatatctcttgaaggccagtcctactgtgcaaacaattgcggaggcttcacgccgtgtgctgggggcctatcgcctggagaaatcccaactcgcaccgtatacatcattcagcagtcggacacagctgaggcgttcgcggctcttcatccgtgcagacatgatgaaatttgcattccgtcgacggtgtacccccccgcttgcgtgaaggcacacaaaataattgccattcaacaactgagcaagcagcaagaagccatggataattactgccagactgaaatggatcagatgtgccgagtagggaaatggacgacatactgctaccagctttggttgtcgcggatggtctccactgaagaggatgaagaaccaaagtggcggtgttatccgttcgcgcttctcaatttctcggacctctctacctgtatcgatggatgcagcaacagggtcccgtgtcacggagctccgtcaccaacatctacgttgactacagagttctcgaagttgaagacaattgccgagaacattgcgttttgttcgccgtttcagaaggctgccaatgaccactgcaataagagatacggcgaaggatgggtggccagacaagacgtgacaacggatgattgggcgtgctttcagacgacaaagcttcccacgtatcggtggacaggatgcgtcgacaactgtggcaacacctctttgtgtgctgccggcgtgccagagcaacttcattcagctgctgcagaagcttttgtccacccagatcctgcattggagcgggtggttgagtcagtgccatccccgtgtctgacaggggagtcgtgtacaccgacagcgatgaatcctccttactgctctgaaaccaggccgaacccgcaaccggctcctctacgagaccacacaattcgcaacgcgctagactgcagtaaaggagcacctctggcccggcgaaatcctaccagtaaatag

SEQ ID NO: 77 - DNA, 1827 bp, Toxoplasma gondii
atgtatcctatagcaccatctttcgcgatggtgggttcggtgggttccattcggcgcacaagccgatgccccagtaagacggccagctgtttcagattgtatgtcttccccctggtgcctcctaccaatatggcgaaagccaaaacagtaggagtgcgcctgattggcgtgaccacatgtgtcgcttttgcggcgtccctgcaagttgctgttactggtgcactcggggctggtccggcgtaccgggtggcacaacgcccgggttccttacacttcgctcggatgcatgatcgttttgtcaacaaggaccgagaagccgaagagcacaaggttgcagctctggagcgtaacacaactcctgaaaatatatcttctcaaatggatagtaacaagacaacggcaccgtctccagagccaggaacatcgaagcgggcacaactcaaaacgactagcgcggcatcggcgaccagacccctcgtctcccaactccaaaaggatgtggattactactgcgctaaaagatttgagcagcagtgcgccaagggagtgttggggaagacgtactgtacagatggtctagtggttgggcggtatgtttcacaaggaagcaaattagaagcgggctggcactgctttaaaggggcggaaattgcccacagtcaaagacaggtgaagtgtgtggacaactgcgggaacctgatgaaatgctttggggacgtgaattcatcacagaccgcgaaggttgccatgcccgggatggatgaatggattgacaaacggaagtggacgtactgttcaccatatcaacaagcagcagatgccctctgcaacctgaagcatcatggagacgtcgccagatacgaccatgtccggcagaggtggatgtgccttgacctgaacgatgtcgctttggatgggattagctactgtgccgacaactgtggcggaccaacgtcgtgtgtaggaggcttgttgccaggggaacttccacagcggagtgtgcgcattgtccggcatcgggacatggagtcagcatttgaagctatacagccgtgtccaaatgctggtgacatctgcgtggccagcacggtgaatcctcccgcgtgcctaccacaggtgcagacattagtacttcagagacttccagcgcagcaacgggctctggacacaatgtgccaagatgctatggacgaggaatgcagaaaaggcaagcaaacggaagactgctttggattgtggttggctcgttacgaactcgagagcagcccgggaggagcaggagcgtggaggtgttacccggagtcccgactagacttcacccaattgtccagttgcatcgatgggtgcggcaatccaatatcttgtcgtggacagccagcagaagtgtcgccagcattcatcgacctccctgcgctcgacaaggtggctggcgacatgagttattgttccgcgtaccagagggcagggaatgcctactgtgcgcagaaacacggtccccgctgggtagcaaggcaaaattgcaacacgtacaagtgggcctgcttcaatttggacaacttacctccgaatggctgggtagggtgcgcgggtcactgcggagaattcatttggtgccccagcgctggaacaggggatgcagtgagcgactctgtacaagatgaagatctggaaagcgtgatcctcgccgtgccagatccgtgtttagctggggagaagtgtgagccgaccgcacaagagccagcttactgttcagtatcaagaccaaatcctcatgcgaaggtgaagaagttatcggtattcgaggatcgaaggctacggggatactga

SEQ ID NO: 78 - DNA, 1965 bp, Toxoplasma gondii
atgaagctcgaatgcttcggtctcgctgctctgtcggcagcgctttttgctggcaaggcagaagccgtcgctgcgaattgcttcaaggccgacacagattacttcgggtacgacgtggataagattttcgtgggcgctgcaactgagtctgcagagaagtgccaagaagcatgcagaaaccgcgaagactgtttctacttcacatacattccagagcggaagcagtgctacttgaaggacaaccaggctcctaacgggactgtcacaaacccgctggcgatctctggaccgaagttttgctatccgactgggacctgctttgagtacatgaccgactacgtggggtacgacgtgcagaagatcgaggatcagtcggtgtctcaggcagacgactgtcagcgactgtgtgcatcgaacgaccagtgtttcttctggacgttcattccctctaaacacaactgctacctgaagcacaatggcgcaactgtcggccgcaccccgcacagcgaagctatttcgggtccaaagtcttgcactggaggatcgccaaacgaccaaggcgtgccttgctacgagcctgacacggattacttcggctacgacatcaaaattttcgataacaaccttgtgggcaccgcagccgagtgctacggcctctgcctctcgttcgccgaatgcaagttctggacgtgggtgcctgcgctgcggaactgctacttgaagagtgagtatgcgccgctcggtcgcgtccatgcccctggcaccatcagtggcccccgcgactgcaacggatcgaatctcccccccttcgtaccccctcctccgatctatccgcctactcatccccacccgccaccctctccgtacccaccgtaccctggccacacaagcactacgacgcctgctacacctcctgcagagtcctgctacaaagctcacgtcgacttccccaccggaacgctgaaacaaatcgtcacggacgacgcctacgcctgccagaaactctgccaggccgaagccgcgtgcttcttcttcacctacaaggcagacatcttggagtgcgctctgaagggcagtttcgccgcgaacgcccctatccccaggagacacgccctgtccgggtcgaagtactgcgctgacaagatgccccctgagttccagccgctgcacaaccacgttccaacccctccgctgccgccccatcacgctattcctccagcttatccgggacctaacccaatgccggttcccccgacccccggcttcgagccgtcgtgcgccgagctgaacgtggagtatgtcagtgacattctgagcgttcttggagcagactcgccaaaggaatgccaaaccctctgcaagctgacagcgtcctgcaacttctttacctaccgctcggatctgtacaggtgctacttgagcaagagcaagggcactccctccagtcgcctgaacgcggtggctggaccgaaggagtgcccaggcgagggctctgccgtgccgccgactgcgtcgacgtgtttcctgcaaaacaagatgtttgtcgggacccctctgagctccatagaggccaagagcgcagagcagtgccaggcgaaatgcgcaggcgatccgcagtgctactacttctccttccaggtcatgtcctcgaactgccaccttttccgacaggtcaacggcgccaaggaagaagggacctgcgtgtcggggccgaagacctgcgccgacaaacccacggacccgtgcttcaaggaggggttctactttggacaggttctcaagagacataacgccgtcgccagcgccaaggagtgtcagacgctgtgcgcgacctttccacactcgtgcgtcggcttcacctacgagtccgcttcccagaaatgcttcttgatgtcccaaaccgacggcctggaactcagcgacgggttcgtctctggcttgaggcagtgccccgcgactccgtaa

SEQ ID NO: 79 - DNA, 1413 bp, Toxoplasma gondii
atgagccacgaaaacgccttccatccttcgagaatgcagagcttctctttgcgatgccgcccgtcgtcactctaccacgcggccgggtctgacgaggaacccgctgcagtgtcaacgccagctgcaggtcggacctccggagttgtccaagcagtccaacgccgtgaagggaaggcattcgcggctgggcagcctgtcagatgccgagctctgctgactcggcgaagttcgcgtttacttttggctggacggttgcatttacgcagtcatcatgccttgacttcgattgccgcagtcttcctcatgttcgccgcgtactgtccgtctcacattgacgacttgggtaagtcagggatgttttctgcgaaatgggcagatgcgttcaaacttcactcctccaatacagagagtgcacttcttcagacgcactcgcacttgatgaaaaccgaccctatcttgccttcggggtcggagtggatttgccgagaagcgtacaacgacgaaggctgcggtacgggccacaacgcctcgctcggcactacggaagcgtactgtcaggaagaggactgctgtctggcttccacagaaaagtgcacacggattccggggttgtgcgccgttgacagcttcctcctgtctcagtacagctggggaaagtgcaactcgtctcagtgtgcgcgctgcggtccgaacgcgacttgcggctacatcgcgagcacgacaaccgttcgaggaggtgtctactgcacctgcaagtctcccttcgtggggacgggcgcctcatgtgtggtcgaggcatgcaaggtgcgcaacccgtgtggccagggaacttgcgtcccgacctcggaggcgggcaagagctacaagtgcgactgcaagccagggtacaccgaagtgtcgactggcacttccttctcgacatgcgtggacatctgcaagcaatacggctgcgggtcagaaggcgtccagacgtgcatcgggggcatcgactcgcacaagtgcgtctgcaaacagggctaccgcttgagcgaagatactgcgcgccagcggtgcgtgaaaaacgacccgtgcaccatcaatccttgtggcccttcctcggcagtggaaaagtgcgagtctcaagaaaacgggatcgagtacaagtgcacctgcaaggtcggtcacgtcgtccggtacgtcaacggcacacaagtctgtcttgaagaggggaaaccgtgcagccctccagcctgctctgtggatccgcctgccaccactgctacctcgacttcgaaacccacgaaccagagcagcggaaatgacggcgaaggggtaaacgccggcgcaattgctggcggggtcattgggggcgtcgtcggcatcgggatctgtggcgctggggcgtttttcttcatgaaaaagtcgcaacactga

SEQ ID NO: 80 - DNA, 2154 bp, Toxoplasma gondii
atgtgtctcctttcctccctcttctccccttcttccgtctctgcctcccttgtttctgtctctccgttcctccgtagtctcttgccgcagtctttcgtctgtctcctctcttaccccgctctggacctcatccactccgtctctgcttctgaactggacaccgctctggtctccgtcccgacatcgaaggctgtgtccttcacagagtttgacatccagcagccgccgtccgacaactcctggctctgccgcttctccttctgggatggaccctgcgtcgatcgacaacacaacggcataggtccctggcgcttctgtcccagtgggagttgctgcagcaaggtcaagtgcgcgtacggttcctgtggaggttcctggtgtgcggcctggaacagcgggctctgtgtgttccataacggggactacgagagcgacaggtgcacatgcgagaagtacggcgggcagtgctcgaagaacggcagctgcaagcgtttggacactccggagggaggcgccttctgctactgcaatccggggtacgttggtgacggtcgcacatgcgagagcgacccttgctacgggtctccttgcgccccagggacctgttcgcgcatgggcaactcctacgtttgtggctgtccaccaggctacacgcaagatacgtcgcgcggtcacgcccggtgcgttgagaaggccgacagctgccgcgcgcagccgtgtgggtccgacaccgttgcgtacgactgcgtcagcttcgactccggcgcctatgaatgcatctgcaaggacggatatgcgtcgaacgggaccaagtgcgaaaagcaggactggtgcaaggacaacccatgtggagacgcgaacgcggtgtatgactgcatctcacacgagacgggatacacgtgtcagtgccaaaagggatacatccaggtggtgacggacgagggccagcagaaatgcgccaaaaatccgtgctcgtacgacccctgcggcacctcagacctggtgaaggagtgcatcaacaaaagcgacggaacgtacggctgcgtctgtgcagacatcgcggagatcaccacacacgaggaaagcaaccaaatcacgtgcgctcggaaggatccctgcttggggaatccttgcggcgccgcggaggccgtccagcagtgcttcgtcgacggaccaacgtacggatgtgtctgtgcgtcggggtacacggtggtgcctgacgcaactggagcgaaaaagtgcgttttcggggatccgtgccagctgggaagttgcgggccggacgaggcagtcgacagttgctcaacgaatggccaggcgtacacatgtcagtgcacgccagaggcgattctgtcgacgagtgcgaacggcatccagagctgcgtgatgcgcgacgagtgcgaagagaactgcggggcgacggaaggcgtcacgcgctgtgaaaagatatcggaaaacaagtgggattgcctgtgcaaggcggggtacatgctcaagtacgtgaaggggaagaaaatgtgtcacaaagcagatgcctgttcggtgaatccgtgtggaacggcgcaagccgtcgcggattgccaggtggacgtcggcggcgacggctacacctgcgtctgcaactcgggctacgaactgcggactcagtctgacaacacacagctctgtgcgccgcccaacagctgcattggtgacccctgcggcaaggccgaagcggtgtcgatgtgccttccaaccaaagacgggtacacatgcaaatgcaacgcaaactacactctccagacaatgtacgggaaaccccggtgcgtccccggtccgtccagctacgacagcgatgaggaggaaacgagctcttcgagcagcacgacctcggaagaggaagggacgtccaccgtcatgattgccggctgcgttgtcggcggcgtcgtgctcttgggcgctgttgcctacatgggccgaaggggaaacgacgaggaggaagacgaacagccgcgaccgcctgcgggcggaccgcagggaccttacatgggccagcaagggtacggccagggacaaaacttgatgcctccaggcatggatccggccatgggtcgcaacagcatgatggctcgacagcagtatgccatggacactcgcaactcgttctggggttaa

SEQ ID NO: 81 - DNA, 2280 bp, Toxoplasma gondii
atggcgggtccgtaccgatattctgggctagatcgcttttccctgccgtgtctctctccagcgtcagcgcttcgcgtggtgggaagcagcgagacgaaggctcatttggtcaagatgcgcggcgcaagagacgctttgctgagcttgagccgaatttcccttctggccgcactggctggcctagcttgctgtcgcgccatggtcgttctgtcctcggcgtttgcgacgaccgtcgtggaaaaacaccctggtagccttcatccggaatccggggaagcccctgctacagcctcttcactggttcaaatcgaggcagcgcagcacaccagtctggtctccagtgccgctgcccgtactgtttttcagcctccgtcagaggagtcgtggctgtgtcgtctctcgacaaacaatgggccctgttcgaaaaactcatcagatcccgagatcgggcagtggcggttctgcccgccagggcgctgctgtagcatgtcaaagtgtgggcctgcaggctgttccataggctggtgtgaggggtggggcaacccattgtgctggatcaaggacgacacctacagcgacggcaagtgcacctgcgaaaagtacagagaccggtgctctcccaacgccgactgcctcgaatataacgtcgaacgagggggcgcgtactgcgtctgcaaagacggatactacggagatgggaaagtatgtgagtttgacccatgcagcggcaacccctgcaatccgggtagttgccggcgacatggaacgtcatactcgtgcgcgtgcccggacacatatgcggttaccagcacaagcagtggagagcgctgtgaagtcaagaggaatttctgtctcggcgaaccctgtggctcgtcagaagttgccgctgattgcgtcagcttcgacagcggggaatacgaatgcatctgcaagagttcctacgtttcagacggcaagggctgcgtgaagttcgatccgtgtgagtacaatccctgtggcacctccgaggccgttaaatcgtgcacccacgtgaacggcgatgaatacaagtgtgagtgtcatgaagggtacaatctaacgaacgactcggacgggaacatggtctgtgcaaaagacccgtgttacgggaacccttgcggtctcccccacttggttgcctcctgcgctcgacggacgccggattcaaccagttccgcgacctacacgtgcctgtgtacggctgctggccacctgcaagtcgatccggtcaccggggcccaatcgtgtactcaaggagatccgtgtgcttcgaatccatgtggctcggatgccgtagttgatttctgtatcagcgaagacgatacctacaggtgtgtatgcaaaacgggctacgcatccgtggagattaacggtagaaaacagtgcaaacgcggagacccttgtgagctgaaggtctgcggtgaagatcacctggtggaaagctgctccacaaacaacaaattgtattcgtgtgattgtacgtcccttgctatcaaggggctcaacgatgaaaaaaagcctgtttgtatcagtcgagaagaatgcgagagtgtctgcgggcctctgaaaggcgtcaagcagtgcaaccagaagatgggggtgctggagtgcgtgtgtgacatgggctacatcctgtccacacagaacggaaaaaaacagtgtgttcagggggatgcatgtctgaatcagccgtgtggaacaccagagtcgacgttagcatgcacagcgaacggcagtcattactcatgttcgtgcaatgaaggctatgaacttcgaatgcggccagatggcactcaagtttgtgctagtgcaggtgattgcactggatccccttgtggagccagcacgagcatcggcgtttgcaccccgggggtggacagctacacatgtacgtgtgtctccccattcgagttacagcagacagcagatggaaagcccacgtgcggtgaagctttcacgacaacaacaactcaagccgtaaaagatgatagcgggagcgacaactcatcttacactggactggcaacgggagccgtgatcatggttcttgcccttggtgctgcattgtggttctcgaattctcaagaagaacaaactatggggtccggtgggatgggaggaatggatgacccaatgcaaggcccaatgggcccgatgggaatggggggcccgatgggacctggaggccccatgggtccaatgggccctcctggtcctcgtcagtcgtatgcggcgtacccgtcaggctcaatgtggtcataa

SEQ ID NO: 82 - DNA, 1056 bp, Toxoplasma gondii
atggacgcgctgaagactgtgttcaaccggagaatcgctctccccgttgttgttgcagcggcgttgctccataatagtgccgaggccctgcaatctccagggctccggagacagctagtcaacgcccactctttcgctgaggtggagtcgacaggatacagctgcctcgaaaaaggcaaggagtacgttggtttcagcctgactgagttcaccgaagtgggtgacgctgctttgtgccagcagaggtgcaatcaacacccgcagtgtggcttcttcacattctattccaatgggaaccgatgcgtgctccagtcccgcaagccttctcaggagaagaacaatgccaatgccgtttctggcccgaaacggtgcccgctttgcctcgttgattcctttgatttcagaggcgagaaaaacatgcacgataatggggttcccggtatcaaaacagtcgtcgagtgtcaaatggggtgcgcagcggagcccaaatgcaaaggcttccttttccaacacaagaccaagcagtgtcacttcaaaacaagtgataactatttgaaatcgctccatccggacaatgagtatgtcgcaggtccgaaaacgtgtacgggtgaacactggtgcatcatgaaggatattggctacgaagccatgtacacgagacggtcccaaacaaactcagcggaagagtgccaaaataagtgcctcaacgacgagcagtgccagtatttcacctggcaagtgtcgaacaagcattgttggttgaaacatggacctaccattgccaactccaaatacaaccgtcaaggcgaccattcagcaccaaaacactgcggcctgccgaccacatgtgtcaaggagcggaccaagtacgcgggcgaaaccgttgcgacgttccccaagagcgaggtggggaccttcgagtcctgccaaatgaagtgctggaagaccagcaagtgtgtgtttatgcacttcaacaatgatggctgcacgctctctgggatcaatgcaaccgctcaaactgatgcgaactccaaagcaggcgatatcacatgctga

SEQ ID NO: 83 - DNA, 1224 bp, Toxoplasma gondii
atgaagacgcgctctttcaaccaggctgaactgaaacgtgaaagagttgacgtgagaaaatgcgaaaaaaacgacacagtatcctgcgctggtgtgtcgttttgcagcgagggcctagaactccgacggcaggatatggacatgacgccatttgttgaagacaacgccgaggctcatgtctgttatgagccagacgtggagtatgtggaccacaccaacttggcaatcgaaggaggtcacgttcactctccgtcatcatgccaagatttatgccagcgctaccaagactgctacttttggacgtggaactcagttaagaaggactgctacttaaagaactccacagcgcttttcagccggcagaagaattacgacacacgaaataaaattagcggaccaaaatggtgtatgatgccgcatcctctgcggtgctacgaagtcgacgtctcttatgaaggatacgacatcatcaaaaatcccctaacgaacatccggagtgttcttgactgccaccgagcctgcgttgaattggaagactgccgctactggacatggactgcggattcgatggagtgtcaactgaagagtgcgaacgctctccgggcctggcgccgatcgttcgacaccatcgggaaaatctcaggaatgaagaactgcggcgtctgcacggaactcggtacggactactacgggcatgacgtacgacgcgtggagacgaagagcattgtcagttcagagcagtgccgggacttgtgtatcaaggacgccaattgcttcttttggacatgggcgtcggactggaaaaactgctacctgaaagggcccgacgcgttggaagcgtggcgccgggataattcgacgcgatctcttgtctccgggtcgaagttctgccccatggaccgtgaccttcgtcttgcttctctatcgcaaagcccgttcatgtatcctgccttctatattcataacccccctccatgctatgagatcggagtcgattacgctggacacgacctcgagacagtcgatgatgagaaagtgctctctgtccaggactgccagcagcaatgccaaacacgggagggctgcgtctactttactttcgacacagttagcaaagtttgctacctgaagggtgggggggcgctccacgactggacgaagaacgagactacggagaagttgatctcggggccgaaggactgctcctgctccgggcttcattag

SEQ ID NO: 84 - DNA, 3486 bp, Toxoplasma gondii
atgtttgtcgttgatttgagcctgtcaggcaacatgaggtcactcacacatggcaagagcatccatcgctctagcatcgttgttgtgacgcactgtagtcacagactctccctatcccctttaaatcgtcccgcgttatttccatcacattctgacaggtacactgttccctggcgttgtcggccttcgtcttggcgtttatggatcacgttcgtttgtctgtcaacattgcacatgttcggtctctccagcgctgtcaaaagggatggggaagttcctactgcaaatctgagagcctctctcagtcccgatagcagcaaagagaacgcgatgctgcttagtgctataggaggcatagggcctactgaatcaagacttcagcatataccgttcagcacgacacgttatcttcctatccgtagccatgttttgcagtctactgttgagagaattgaatcccccgaggctctcaatgaggttccgacaaaggtagaaagaaatgagttcactgaaaaaggagacaagacagagcaggtcctcaccgcccaagccgaccataaatctctgctggagggcagatcggaatcaacttcgactgcgccagatgacgatttcgattttttatttgaagatgacacacctaagaaacccaagagcagagtgaataaagggacgtcctccgatgaaacgagtccaggagacagaagttctggggaaggtagttccgactcagacagtctactgtctgttgtgcacagaacaaagggcaacgcaacgcaggcgaacaagaatcaaacgcgtattactcatccgaagagcaaagcacagcatcagaagaaggtcacaaagaaacaaggtataccaggatcagacagtttgggaacctcttcagccgattttgattttgacatcgacagttcctcaaacacgcaggctgacgactcacagcggcagtcgttaggggattcatccgctttggatcttttcggcagtgacacgggagacacgggagatatctttggcttctcgaattcttctagtgatggtggaaacgctgctgccaacgatggaggcctattctcgtcctcgggcatgggacctaccggcgcctcagatgagacctcggcaaaccctctaggctcgatactgggtggcgtgttaaacccatttgcgcaacagcagtcgattactcccatgacggataaggctgacgaatggtcaaaggaaaatatgaaggctttcgaagagaaaatgccaaagaaaatgcgagacgatggcagtccagatagttggtacaagcaagccgttccacaagagagtgtggcagatctcaacaggatgcgagaaaaccgtcgcatcgccgaagaaaaccgggcggcggcgccgctctcagctgtatacactaaggcaacgaagacggttcctgctattaactacctcggcgcgggttatgaccacgtcagaggcaatccggtcggcgacccgagttctatgggagaccccgggatccggcccccggtgcttcgttttacttacgcccaaaacgaagatggtgtctcgaatgacttgactgttttgcagcctcttgggggttatgttaggcaatacgttgcgtgcaggcaaagcgagaccatcagcgaactgtcaaacctcagtgactaccaaaatgagctttctgtggatgcatcacttcaagggggagacccgataggcttaaacagtttttctgcctcaactggatacagggattttgccaaagaagtctcaaagaaggacaccaggacgtatatgctgaaaaactactgcatgcgatacgaagctggtgtcgcacaaagcaaccacttcaagtggaacgtaacaatagcgttcgcggcgggcgtcagccagttaccagatgtctttgatgcgcataacccggaatgtgcctgctcagcagagcagtggcgtcaggatcaaaatgcggaggcatgtacaaaaacgaacgttcccatctggataagtttcatcgaacagttcggcactcacttcctcgttcgcttgtttgccggtggaaaaatgacgtatcaagtgacagcgaagcggtcggaagtggagaaaatgaggaacatgggaatcgacgtgaagacgcagttaaagatgcaactgggtggcgtcagcggaggggcgggtcagggaacctcaagcaagaaaaatcaaagttcgtcagagtatcagatgaatgtgcagaaagagacacttgtgattggcgggcgcccgcctgggaatgtgtctgatcccgctgccttggcggcttgggctgataccgttgaagaacttccaatgcccgtcaagttcgaagttcagccactgtaccacctgctccctgttgagaagcaggaagcattcaagcaagctgtcacattctattcgaagtctgtggggttgacaccgcaggatctcagtgctctcacgggtgtaacccgcaatctcccaaaacagctaacccaagcgacccaggtggcatggtcggggccacctccaggatttgccaagtgcccagagggccaagttgtcatacttggctttgccatgcacctaaactttaaggaacctggaaccgacaactttcgcatcatttcgtgccctcccggaagagagaaatgtgatggagttggtactgctagtagcgagactgacgagggccgtatttacattctctgcggagaggagccgattaacgaaatccaacaagttgtggccgagtcgcctgctcacgccggcgcgtctgtcctcgaagcctcttgtcctgatgagaccgtcgtcgtgggtggctttggaatatctgttcgaggtggcagtgatgggctggacagcttctctatagagtcttgcacaacaggtcaaaccatttgcacgaaggcgccaacacgtgggtcggagaagaattttctgtggatgatgtgcgtcgataaacagtatcctggacttcgagaattggttaacgtggcggagcttggttcacatgggaacgcgaacaaacgcgctgtgaattcagatggaaatgtggacgtgaagtgcccggcaaattcttccattgtccttggttatgttatggaagcgcacacgaacctgcagtttgtacgcgacaaattcctacaatgtcccgaaaacgccagtgagtgcaagatgaccggaaaaggtgtggaccatggaatgctgtggctgtttgatcggcacgccctctttggctggattatctgcaaaacggtgaacgagccggctatgcatgtagcaacggacgtgggcaaggcgaaggggaacggcaaaaagagaaagggaaagaagggtaagaataagactaatgcgcctaacgaagtcgaggaagggcagcagctgggcgcggattcaccgagccaagtctctgtaccagccgatgctgattcagggccgacgtccaagactatgtcgagtctcaagcttgcgcccgtcaagctgttagacctgtaa

SEQ ID NO: 85 - DNA, 1056 bp, Toxoplasma gondii
atggacgcgttgaaaactttattgaacaagggaatcacactcgccgtcgttgttgcagcggtgttgctgcagattcgtgcggtggcgcttcaatctccagggctccgaaaccaggtagtcaacgcccactctttcgctgaggtggagacgacaggatatagctgccttgaaaaagacaaggaatacgttggtttcagcctgactgagttcaccgaagtgggcgacgctggcttgtgccagcagaggtgcaatcaacacccgcactgcagcttcttcacattctattccaatgggaaccgatgcgtgctccagtcccgcaagccttctcaggagaagaacaatgccgatgccgtttctggcccgaaacggtgcccgctttgcctcgttgataactatgatttcagaggcgaggcaaacgtgcatcataaaggtgctcccggtctcaatacactcctggagtgtcaacagggatgtgcagcagagcccagatgcaaaggcttcctcttcgagaagcgtccccgcacgtgtcacttcaaaacaaatgataactatttgaaagcgctcgatccggatacttcatatatcgcaggtccgaaaacgtgtacggatgaacactggtgcatcatgaaggatattggctacaggggcacagactcgaaggagacaagagcaaactcagcggcagagtgccagcagatgtgcctcaacgacgagagatgtgactttttcacgtggcaacaggcgggcaagtattgttggtttaaggctggggcgtccactgcctcaacaaaatacaatcgggctggcgactattctgcaccaaaacactgcggcctgccgaccacatgtgtcaaggagcggaccaagtacgcgggcgaaaccgttgcgacgttccccaagagcgaggtggggaccttcgagtcctgccaaatgaagtgctggaagaccagcaagtgtgtgtttatgcacttcaacaatgatggctgcacgctctctgggatcaatgcaaccgctcaaactgatgcgaactccaaagcaggcgatatcacatgctga

SEQ ID NO: 86 - DNA, 882 bp, Toxoplasma gondii
atggcgcgggtccgaacactcgcagacctccgcacagaggacgaggcggacgagcacacgcccctctataacgctgaaacaggcagtcgggactccgattcaacgagcagtgggggtgcagcgccccggtcgatgcctattcgctttctcgagctcctcttccctcatttctccctcagaagcgtcgttcttgcaatcagcattgtcgactggattttctacattgttactgtgtgcttagatacagagctaccgctgatcccagccgcaaatattttggtgcactttggggccaactatccgcctctgataaagcagggtcaggtatggcgcctgctccttcccgtctttctgcacgcaaattttttccacgttttcttcaatgtcttctttcaactccgcatggggttcaccatcgagcgacgctacggcctgctcaagtttactggtctctatttcgcatcggcaatctacgggaatctgctctcggccaccgcgttcttctgcaactctctcaaagttggagccagtacggcaggcttcggtttgatcgggattcaaatttgcgagatggcgctgacgtggcatcgcatgcgacatcgcgaccgcatgctgacgaacatggtgtcctttgtgctcctgatggtacttctcatgttcactctcaatggaggtagcatcgaccagatgggccatcttggaggtcttctctgtggcttctctatcggcatgttgtataacaaggaattgaacgataagcctgtgtggtacccctgggcgtctgcagccgcgatcggcattttacttgccttgccagcagcgtgcttcccaattctctatgctgttgatcgccattgccacagggatttgtcctacatttag

SEQ ID NO: 87 - DNA, 1605 bp, Toxoplasma gondii
atggaggtttcaagaagtcaccggtggcctcttggctcttcaccacactcttcatctcccgctctctgttggtcgtgcgtttcgcgtttctcgcgctccatctgcaggagaggcggccggtttccccctctctatttctcccgttcttccttccttcttcgcgttcttccccttgtattatactccctggtctcaggtccgtcccctgtttctctctctttctctccatctgccttttcctgtttctcgcctccgttccctctcactgtcgccgctgagagcccctcggatgccgctggcgacgcttcgtcttcgttgcccgacggcgagcctcttgactcaacgagtgagactgcggcgagcgagtcggaaaaacgttcagaggacaaaacgcagctcacggaagagcagatgaaggagaaagcaagaaaagcggccgaagcggctgcagctgctaccgcgaaggcgctggaactcggcgtctctgtgccgcctctggtcacggcgtcggcgggcggatctgatattctttcgacgcactcggcagcatccgacgccgctgacgcagctgaccgcacagcatctggttttgctgcggatcctgacaaatccgcagtcgtgagagcggacgacatgcgttatcagagcaatccagaaaactcaacggacggagagcacgcaagctccgaagaggaggaaaaaccgattcctgtcgatgggggagactgcatcatctttgctgcggaagaaggcgacagagacagctgctcttgcccagaggggttcgttctgtgcaactggcaagatgtccagatgattcagaggcgcctcgcacgcatcgagagggcagccagagctgcggcagttcgtgtgcttcttctgcatctggacaaattgccagcagaggaactggaaacggctccagcctccaggtccccttccgcaaaggagagcaactctgcgtctgaagccgacgccaaagtgggcggcgaactacggggaagctcgagcgcttctggagaccaagcgacggacgactcgcgaaaagaggaaggcgcgacagacgaggcggagacgcgtctcgaggcgatgctgccgacggacttggccgagttcgtgaaacagactgcaaaggcagccatgagcctccatgcgccgggctgggtaaaaactttgtgtgacgacgacgcgagaacaggattcaaatcctacggagtccagatcgattacgaagtcgaagcgatctgcaaggatgaaggaacgaaggatgcgcctgctgtcgacttcatctacgagctcaacacctacgtgcctctttctcgtcttcgcaagctccaggagaaggacagcagctggacgcctcggcactgcttagttgcagacttctacttgtgcaagcggctccctcacaagaggaagaaagtgaactgcgagatgtccggctggagtgagtggtcgccggagtgcgtcaacgggacgcaaatgcggaaaaaccgaattactcggagcggacagcatggcggccgcgcgtgcgtctgggacgggaagcaacctgtccacgcggaggtgacggagctccgatcttgcaatcagccttcgtcttaa

SEQ ID NO: 88 - DNA, 2286 bp, Toxoplasma gondii
atggggtcatctcatgccattgtcgcgtgtgctgccttgatcgtgttgttatccaccaacgcgagaggactcagggtgcggaaagacaaagacgtactgttggcaacgagttttctttcccaccatggagaatatcagaatcccactggcacatataaccttatcaaggagattcggagggtggaagcggaaatcgaagatgaggttgaaacactaaacagagacagaaggctgcatcgtgggcacaacaaatatgccgatgacgacatccgacaggggctaaagggcgagcaagatatgggcgcttcagaaaatattcccgttgcggagctcgaaccacaggatttagatcgggaggcgaagtatcctgtgcggatgttgattgtggacaagcgttctgatgatgatgatgaagagaccaaaacctcgtttgtggagacggcgctacattcggatcttgcgcaacgcgttgtaaaggagctgaacgggcatgtggacgtccttagagaaagtggcgtggttttagtggatcttccagcacaaaccaccgacaaacaactgcaggaattgatcgaaaccgccagggcacaaggcaccatagtagagccggatcacttggttcaaagtgtcaatacatcgtcgaaaggatcaaatgacccacttctggatcgtctctggggaatggatgcgttgaacgtgaaagaggcttgggacatcatcactaccggcgagcctaatatggggggtcggaggccactagtttgtgtgttagatactggcatcgattataatcatccagacttacgggacaacatggaagtgaaccaggcagagagggacggcacgcttggagttgacgacgacaataacggtgaggttgacgacatctacggggccaacatgctcagcaaggaaaacgaccctgcggatgatcactctcacggcactcatgttgccggaaccatcggtgctcacggaaacaacggtataggagttgctggtgttgcatgggcgccccgtctgcttccgtgcaaattcctcgcctatacaggaagaggatacagctcggatgcagtccgctgcatcgactactgcgtcaaaaggggtgctgatattgttaaccatagctggggaggttcatggccaagtgaagcgcttcgtgaagcggtggtgcggacggcgaacaacggtctcattcacatcttcgcagcaggaaatgacggagtagatatcgaccagacggccttttatccagccgcattctcgactgaagcggacgggctgatcacagttgctaatgtgaaaggagatccagaccatggagggaaacgtataattgaactggatcgttctagtaactatggaatacagcgcgtccaggtcgcctgtccagggatgtggattttatctactgtccctaccagcggttcttcgcaagagccctatgcggagaagagcgggacatcaatggctgctcccgctctcagcggcatcgttgctttaatgctcgcggtgaatcctggactgagtacgcgacaggtcagagagggtttacgacagtgctccgtccagcagccccttttgcaaggcaaagtagaatggggcagtatgcctgatgctaaacgctgcgtcgagtatgcgctgacaactcacgcagaaggtcggcacaagtctttcataagggaaccctcaaccgagacttcgacacccccacctcctccaccagcacagcctacaccccagccgcagccacatcctcctcctcaacccgagactccaccatgcgcgccttcaccaccgccgccgaccccaccatgcgcgccttcaccatcgccgccgaccccacccccggggtcaccacacaaacctgaaccgcagacgcctgtttaccctgaggttccacgatccacgcggtcaccgccgccgtcgcctcccccaacggaatctgcacccgaagctcctccttccgatactccctcatgtcgtgtgcctccttgcagcagttctccacgaagcggctctcaaccaaagccacctcaagataacactactacaccgaagatgccctcactctcctctccaccgaccgaacattctacagcccagccacctaaacacgaaaatgacgcacgtgaacaggagccaccaaccgacgaggatgacttctcatccgttaagggtaaaaagttaggtgcctacgaatcggacggttcgcctcgggcctcctcctgtgccggagcaggagttctcggtgtttttttcatggttgttggactgaccgtgtaa

SEQ ID NO: 89 - DNA, 7023 bp, Toxoplasma gondii
atggtgtccgcgaggaaatttctgacgtctttcaatcgagaacaggggggcgaaaattccctctgcttctctcctttcttttctccccttttccgctcgtcagttgcggaggcggagacgcgacccgacagcagctccgatcctgtcaacgatggagactcgacgtccggtggagagacgccggatccgctgccgacgcttgcggaagttcgcgcagcgcttgcgtcgaccgtcgcgcagtcgagaacctttccgcggcgtctcgctgcgaagaacggcgagcaagtggaggacggagacgaagagctggcggagcggaagcgcgtgcgaaagccgcctagagacacgagcgcgtactcggtgttttcagtgcctgcgctgaagctcgaaggcgtcgccattgcagaccaggaagaggccgtcggatcctttgcggtgtctgtcggctgcggatttttccacgaccctccagcgattcctggagtcgctcaccagctcgaacatttgattttcctgggagcagagggtgaagaagccgcaacgtcctgggatgagttcgtcagtcagcgcggcggaacgcacaacgcccacaccacagctgagctcacgacgttcttcgttgcggcgccgactgacaccttgcctgaacttcttgacagacttctcctgcatctcttccaccctctcctcgcagccgaacaattcgcctccgaggtcatggcagtgcaatttgaacacgaaaaaaaccaaccagatgtcgcgcgagttctcctcgagctcgcgatggctgtcacaccatcgctcgcgtctccagcttcctcagcaactcaggacgaggtcccgacctccttttaccgtccggaagtagcgcgaaaattcggcacaggcgacttcgacactctctgcaagacgccgctcgagcagggcctggacgtcctcaaagccttgcgagagttccacggcaagtgctacaaaccggaaaacatgacaatcgctgttcggatgggccgccgctccgttccgatcattgttgaaggcgccgtagacgcgtccggccagtccctgcggatccctgcggaggtcgaagcggcggcagagcgcgaggcagagaaacgctccgtgtatactccgaaggaaattggagaaatggttgtgcgaattctttcaaagtatgttcaagccaattcaccggaaacagaagcacacgctgacaagacgaagacgccgcacaacaagggaaactctttttctgcgtcctcgtcaagtgacctcaccccacaacgaactccttctgatgcgtcctcttctgcatccccttctgtgtcctctgcgcccgcgtcttcacaagccaagaggagaaacgaggtgttgaagacagttcgactgcatgcaggcgaaaggcagaaagaggcgtctcaggttgcttctctcttggaagccgctgtcggcgaagatgcttaccgatcgcgtccgaacgctacagctgaagactctagtcctacagatggagagtccgacgcaagcgggaagctctatcgagtcttccgtcagcatggttgggggaaacgtctgctggttgtctgggagagaagaacgaactggactgttcgagggtacgacgaagtttttcagcccactgctcttctcgagtatctcctggagtaccctggcgaggcggcgcttctcaatcggttgaaggctcagggactgatcgccgacgcggagtacgtggactacaccacgagtcagaaggcgttcgtcgccttgctgttcgagttgacggacgaaggagaggagaagtttgaggacgttgtttcggcgacgctcgcgtacgcagagcagctccggacgtcggtgacggagacgtacattttggattttttcgacgagtttgcgcgcgtggcgaatcgctcatggacgtacaaggatcccgaagacgccgtgagcgccgtgatcgctgcagccgagaagctcgctgtccttcctcagcgtccagacatggtgattgccggcggagagtttgtgtctctccccggagaccgcactctccttgtcgacgttctcaaggaagagctggagagcttcggccgcgctcgcgcctcggcgatcgtcgtgctgccggaagatacggcgcgcgggagcgcagaagtcgtccatgcgttccggccgtacggcgtccaattcagcgtttctgcactgccttctctcgctcaggcagagaaagtcggagagcggataagccgcacagacgccgcggagaagatggaactgctgcatgcagaactggcttccgaggacctgatttcgcactcgatgatcgaatcatcggcgtttcctctgcccccggtcctcgcctgcaacgtcgccgcgacagtagctctcacgccgcgtcgtgtaccggagatctgccagtccttgtcgccggttcagttcccgatcaagggtggacgaagcgacagcgaactgcgagagtcgagcgagcttcctctcgggccgcgttcagaaagtctggaagacgctgaggtcgaggaagaacggaagaagctggaagcgtcgggaccgccctgcgtactggtcacggaagagagtttctcggtgttttggaagaatgcagagccgttcaacaagccaattgtccggggctacttcaagttgagagtctctgcagaagacgcaacggcacaaaacactctctacgggaagatcttcgcgactctcgccggcgaacgcgctcgcactgctctcgcctccttccaaggctgcggcgtcgacctcctcatgtccttcaccaacggcgctctcgttctcgaaattcaagctttctccgagcttttcgccccggttctcgcgcgcctaattgaggtgttgaaagagtcacaagataacgtgaagcagtcggacttcaacaagattttcaacactctgaaagtccagctttcagatttctccactgtcacgcccttcgagctggcgcttgacgtcgcactcagtgtggttcgtcggaacagattttcgcagttggacttgcgaagcgctgtaaccgacgcttcgtctcaattcgaggactttaaagtcttcctggagaaagtcttgacgaagaatgcgctggacgttttcatcatgggcgacatcgactacgaagaggcgcgaaaactcgcagaagacttcagagctgctctctccaagcagcctctcccgttctcggagagcgcgggcagcgagattctcaatctcgcggatgacatcgagattcggttctcaaatccgattccggaagacgccaccaacgcgtatgtgtctctttatgtgacgcatccgcctcctgacatgatggaaatggtggtttactctctcattggagaggtgatcagttctccttttttcgacacaattcgcactcactggatggacggctacgtcgcggcagcagccgttcgagaggtcccccccgccatgactctcgccaccatcgtgcagggctcgcagcggaaaccggacgaactggagaggcacgtctgcgccttcttggcagagatggaagaaaacatcgggtcctccatgaccacagaagctttcctcgagcgcctccggtggcttagcagcagcaaatttcacaggagtgccaccagcttcagcgactactttggcgaggtgacttctcaaattgcgtcccggaacttttgctttattcgagaacagctagctcgtctggcgactgagaagttcctcagctgtcctgcaattctcaaatcctacatgaactctttggtggaccgcgccaatcgcaaacgtatcactgtgaagatcgaagggaactcgtcttccagcgagacagcgtcgcatcagcgcgagattcgagcgccttcgtcgacactgccgaaccgttgtggacttccgggactgtctccttcagcgtctccgtcagcggaagtccgacaggctccttctctctctacacagacgtctgcgttgcggccgcggccgttgtcggagaagcgcgagaccacgcagagcagcgaacctgaggctccagagacgtcttctcaagacggccagcggagtgtcaaagccaactcgccaaagccgctgaatgcggctgggtctgtgggaacagcagggaaggtcgaaggcaaatcgcgcaaggtcgcgtctcgggtggacaccccaggaaacgagcgtcgaacgtacgcctctctgtttgggacgcagaatgtgcttagaagcagccgaatccagtccgacttctcctcgccgatcttctctcttggcgacgacgcagacgcgctctccctcattcaggttgaggctcgcgtctcgacttcgaactccaagccgaaggctgtgctcggcgcgcgccgaggagacggccagtccccaacggtcgcttcgccctctggcgccgcacccaagcgaccggcgccgcccgcagggccgcgcgacaagtctggcgaggcctcagagacgacagggacggaaggcatggaagtcacagaaatcgcctccgatgttgaaggccaagccgaagaaggagatgtccccatcgagttcctgccgctcgcgagacaaatcacgccgcacatcctcgagcgctgtgcggcagaccaaaacgctgcaggcgcaaaacggattgtggtggacaatttcttcacggatccggtcgaggctcgtcgaagcatcctcgaaaacctggaagcgaaactcagctcgacgtcttctctcttttctctgtcgccttcttcccacccatctcctcctctctggctagcgtacagccgctcggagtcctgcagtattcgcaccagcacaatttcgcgagccgaggaagtttgtggggcgtggcgcgagagcgcaccggaggctgtcttgatcgtttcgcctgagcagccgcccgcagggatgccgagcttgccgcctactttgggagacgcggagccgccggccgcggcagtccctctgtctccttcgggcgcagagacaggtgtccccttggtgccggagagccccggctcccctgcggctgcggggcgacaggcggcgacgaaggccccgacagaaagcgaggcttccgcggcaaccgagggtgaccatccgcgtgtgggcacctctgcggaggcgagaactcgtcagcttccgaccgcagaacagcagacactggaacagcggaaagcgcttctcgaggcccgtttgagacgcctagaaatgcagaccatcgcgcagcgagcgcagctcttgaagcagcgcctagacgcaatgaagcagtacggaacaagaccaacaacgatcttcaacacttggctaggaccgcacaaacgaggctttctacagagtgtcggaggcggcacaggcgccagctctggggccttccccgtctctgcagtctcgggccgcagttccacggcgacgcgcacccaggccgcctcagatttgcacggaagccgtcggttgccttccgctcttcatcaggcggcagatcctctggcgttcaagcgaacgctcgaaactctgaaatggagagagcagggccttcttcagcggcaagccgaactgaggacgcagctgcgaaaagtgaatgcctttggcagtacagctggagactcaactgcaccgaacctgggtctagctgaagacaaaaacctccgactcgtagaaaatgtcactgtggcttcgggggcgtctctcggctccagggatcaaaccgccatcgcccatcagacggatgtcctgccgccgcctcgggcttcaattcccacggtccccaccctgacgccggcgccttcgcctgtcgcctttgcggccctgccgcagatccaccagcaacttcctggagtcgacgttggtgccgagataccccgtccggtgacgcctgtttccacggacatttctgcatctgcttctgcgttcgtcccagggtctgtgcaagcgtctctctcccaatctcccgcggcatctgtcaaaggcgcaggcgcacctcccttgcctctcgctcaccaaccattcgcttctcttcctccagctcctcagctccctcaagagccccgtgtgcaagaagcaaacgtagggtctcctagtccgccgactgtggttcctggtgtacccactgtcggagcgactgcacctactgtgggagaaggtgcgactactctgggggctggtgccccggcggtggcttctccggcgcctactgtcggagctgctccgcaagcagtgacatacactgcgcctactatgggagctggtgccccgacggtggcctctctggcgcctactgtcggagctgctccgcaagcggtgacatacactgcgcctactacgggagctggtgcgcctgcggtggcctctctggcgcctactgtcggagctgctccgcaagcggtgacatacactgcgcctactatcggagctggtgcgcctgcggtggcttctccggcgcctactgtcggagctgctccgcaagcggtgacttacactgcgcctactatcggagctggtgcgcctgcggtggcctctctggcgcctactgtcggagctgctccgcaagcagtgacatacactgcgcctactatcggagctggtgcgcctgcggtggcttctccggcgcctactgtcggagctgctccgcaagcggtgacatacactgcgcctactatcggagctggtgcgcctgcggtggcctctctggcgcctgctgtcggagctgctccgcaagcggtgacatacactgcgcctactatcggagctggtgcgcctgcggtggcttctccggcgcctactgtcggagctgctccgcaagcggtgacatacactgcgcccactatgggagctggtgccccggcggcggtggcttctctggcgcgtgggccgagttttgattatcaggcgggtgtagtatcgcgtgcagttggaggtgcgtctcagcctcaggctgaacaggcggcttcttacgtcagcgacccggcgtccgtcgctagggtgagctcagcgtcgatcttgccgcatgcagctgttccagtggtgcatgcctga

SEQ ID NO: 90 - DNA, 1131 bp, Toxoplasma gondii
atggcggatgaagaagtgcaagccttggtggtggacaacgggtccggaaacgtgaaggctggcgtggccggcgatgatgcgccacgtgccgtcttcccgtctatcgtcggaaagcccaagaacccgggtatcatggtcggaatggaggagaaggactgctacgtcggtgacgaagcccaaagcaagagaggtattttgactctgaaataccctattgagcacggtatcgtcaccaactgggacgacatggagaaaatctggcatcacaccttctacaacgaactgcgtgtggcgcctgaggagcaccctgtgctgctcacggaagccccactcaaccccaaggcgaaccgtgagagaatgacccagattatgttcgaaacctttaacgtccctgccatgtatgtcgctatccaggccgttctttctctgtactcctccggtcgtaccaccggtattgtgctcgacagtggtgatggcgtctctcacactgtgcccatctacgaggggtacgccctgcctcacgccatcatgcgtttggatcttgctggacgcgaccttaccgagtacatgatgaagattctccacgagagaggatacggcttcaccacctccgccgagaaggaaatcgtgcgcgacatcaaggagaagctttgctacatcgccctcgacttcgacgaggaaatgaaggcggctgaggactctagcgacatcgagaagtcctatgaattgcccgatggcaacatcatcaccgttggcaacgagcgattccgctgcccggaggccctcttccagccctccttcttgggcaaggaagctgcaggtgtccaccgcaccaccttcgactcgattatgaagtgcgacgtggatatccgtaaggatctgtacggcaacgtcgtcctttctggaggtaccactatgtacgagggcattggcgagaggctgaccaaggaacttacctccttggctccttccaccatgaagatcaaggtcgttgctcctcctgagcgtaagtactccgtctggatcggagggtccattctgtcctctctctccaccttccagcagatgtggatcaccaaggaggagtacgacgagtctggcccgagcatcgtccaccgcaagtgcttctaa

SEQ ID NO: 91 - DNA, 771 bp, Toxoplasma gondii
atgtctccgctaggcttcggagcgtttctttcccctctgcttctcttttgtgtgtctcctcacttgcggacgggagtttcccgatctttctcttctttcttgaagccacaaaagctccagcgttttgtttctcgcgagtatccccgtcgccgttgtctgccgtctctccatttcacgtctcggtgtttttccacgcgtctttcctcgagaaaaatggcagtcaaagtgcttgttcccgtcgctcacgatagcgaggaaattgaggcagtctccatcattgatacccttcgacgagccggcgccgaggtggtggttgcgagtgtagaggacaccgaaatcgttcgcatgtcacgcggcgtttgcgtgaaagccgacaagctcatctcagcggtggaaaatgaaacgtatgactgcatcgcgattccgggtggcatgccaggggccgaaaggtgccgagactctgcagctctgacggccatgctcaagactcacaaggcacagggcaagctcattgccgcgatctgcgccagccccgctgtcgtgctccagactcacggtcttcttcaaggagaaaaggcggttgcgtatccctgcttcatggaccaattccccgccgatatgcgtggcgaaggccgagtctgcgtcagcaacaaaatcgtgacttccgttggaccctcgagcgctatcgaattcgcactgaaactcatcgaagttctgtacaacaaagagcaggcgaagaagatcgcggcacagctcctttacgcgtactaa

SEQ ID NO: 92 - DNA, 1428 bp, Toxoplasma gondii
atgttccgtcttttggttccaacatattattcctactccgtcccattacgttttcctttttgcaagatctaccgttactcaacttccaacaaaatggtggccatcaaggacatcactgctcgtcagatcctcgactcccgaggaaacccgaccgtcgaggttgacttgttgaccgatggcggctgcttccgtgccgctgtccccagcggcgcatccactggcatctacgaggcgcttgagctccgtgacaaggaccaaactaagttcatgggcaagggtgtgatgaaggccgtggagaacatccacaagattatcaagccggcgcttattggcaaggacccgtgcgaccagaagggtattgacaagctgatggtcgaggagctcgatggaactaagaacgagtggggctggtgcaagtcgaagctcggcgcgaacgcgatcctggccgtctcgatggcttgctgccgcgccggcgctgctgccaagggcatgcccctgtacaagtacattgccactttggctggaaacccgacagacaagatggtaatgcccgtcccgttcttcaacgtcatcaacggcggctcccacgcaggcaacaaggtcgcgatgcaggagttcatgatcgcccccgtcggcgcctccacaatccaagaggcgatccagatcggcgcggaagtgtaccagcacctgaaggtcgtcattaagaagaagtatggcctcgacgccacgaacgtcggcgacgagggtggcttcgcccccaacatcagcggcgccacggaggccctcgacttgctgatggaggccatcaaggtgtctggtcacgaaggcaaggtcaagattgccgccgacgtcgccgcttccgagttcttcctccaggacgacaaagtctatgacctagacttcaagactccgaacaacgacaagtcgcaacgcaagactggcgaagagcttcgcaacctgtacaaggacctgtgccagaagtatcccttcgtgtccatcgaggacccgttcgaccaggacgacttccacagctacgctcagctcaccaacgaggttggcgagaaggtccaaatcgtcggcgacgacctcctggtcaccaacccgacgcgcattgagaaggccgttcaggagaaagcgtgcaacggcctgcttctcaaggtgaaccagattggcacagtcagcgagtctatcgaggcctgccagcttgcccagaagaacaagtggggcgttatggtttctcaccgctccggtgagactgaggactccttcatcgctgacctcgtcgtcggtctccgcaccgggcaaatcaagactggcgccccgtgcagatccgagcgtctctgcaagtacaaccagctgatgcgtatcgaagagtcgctcggctccgactgtcagtacgccggcgctggcttccgccatcccaactaa

SEQ ID NO: 93 - DNA, 1302 bp, Toxoplasma gondii
atgctttgcattgtagagcgaattgcaatgccaacgcgtggtgtcaacccctcggcggcaaacggcaagctcccgccgcggacccggtccgcaacgggatgcagagtgtacatacacccgatggtaaagttcatatccttactttttgccgttttttacgcacgattctttctgcttttttgtgtacgcattcaatccacatttcccaccatgtcgggatacggtcttcccatttcccaggaggtggccaaggagctggccgagaacgcccggaagattgcagcgccgggcaagggtattcttgcagccgatgaatccactggcaccatcaagaagcgcttcgacagcatcggagttgagaacaccgaggcgaaccgcgcgttctaccgtgacttgcttttcagcactaagggtctcggccagtacattagcggcgcgatccttttcgaagagactctgtaccagaagagcccgtcgggcgtgccgatggtagacctgttgaaggccgaggggatcatcccgggcatcaaggtcgacaagggcctggagactcttccgctgacggacgacgagaaggcgactatgggtttggacggcctctctgagcgctgcaagaagtactacgaggcaggcgctcgtttcgccaagtggcgtgcggtgctcagcatcgacccggcaaagggaaagcctacaaatttgtctatcactgaggtggcccacggcctcgcgcgctacgcggcaatctgccaagcgaatcgactcgtccctatcgtcgaacccgagattctcacagacggcagccacgacatcaccgtgtgcgccgaagtcaccgagcgtgtgctagcggcggtcttcaaggctctgaacgaccaccacgttctgctggagggagcgctactgaagccaaacatggtgacccacggctcggactgcccgaagccggcgtctcacgaggagattgctttctacaccgtccgcagcctgaagcgcacggtcccgcctgcgctccccggcgtcatgtttctctccggaggccagtccgaggaagacgcttcgctgaacctgaacgagatgaacaagatgggaccccacccgttccagctctccttctcttacggccgcgctctccaggcttcctgcctgaaggcctggaagggtgtccccgaaaacaaagccaaggcacagcaagtgctgatggagcgcgcgcgcgccaatggcgaggcacagctcggcaaatacggcggcggtgcaggcggggccgctgcggcttcatccctcttcgagaaacgctacgtgtactaa

SEQ ID NO: 94 - DNA, 1470 bp, Toxoplasma gondii
atggccttgctaacgacagtccgtgacagttgcttttactttccacagaaaacagcctcaagacatgtgttcttagcgtgtgtgactgccctactgcagcgcagcgatccgacttttttttgcgaacagtcgacgagcatgcaacctgaagctgattccgcgtggcaacccgatgctggtactgtttcgctgctcacgcgagtgaaggatctaagggtcgctattgcgccggtactgtggaagtctgcggaagcgcacgagcatcgccaccacccatccgcctgttgtgggccagtggaacggaatctgctccaatacacggcgcgtcccgcacctccacccttccccgacttggctccttcgcttctttggccgagggcgcgtctgcgaaccaaaaagattgcgggacgcagttacacgaccccggactgcagacactttgccaagatggtgtgcaagctgggtattaacggttttggccgtattggccgtctggtgttccgtgctgcgatggaacgcggcgacgtggaggttttggcgatcaacgacccgttcatgtccctggactacatggtgtaccttctgagatacgactcggtccacggccactaccccggcgaagtcagccacaaggacggcaagctcattgtcggcggaaaggccgtgactgtcttcaacgagaaggagccaactgccatcccttggggccaggctggcgtccactacatctgcgagtccaccggtattttcctcaccaaagagaaggctcaggctcacttgaccaacggcgcgaagaaggtcatcatgtccgccccccccaaggacgacaccccgatgttcgtcatgggtgtcaacaatgaccagtacaagtccagcgatgtcattgtgtcgaacgcctcttgcacgaccaactgcttggctcctctcgccaaaattgtccacgataagttcggcatcgttgagggtctcatgaccaccgtccatgcgatgacggcgaaccagctgacggttgatggaccctccaagggtggcaaagattggcgcgctggccggtcggcaggcgtcaacatcatccctgcctccactggtgccgccaaggctgtgggcaagattattccttccctgaacggcaagctgaccggtatggctttccgtgtgcccgtccccgacgtgtctgtggttgatctgacctgcaagctggccaagcccgcgaagtacgaggacatcgtggcagctgtgaaggaggctgccacctccggccccatgaagggaatcatcagctacaccgacgaagaggtcgtctcctctgacttcgtccactgcaagttctcctccgtgtttgacatcaacgccggcatcatgcttaacgacaccttcgttaagctcgtgtcttggtacgacaacgagtggggatactccaaccgccttgttgagctggctcactacatgtccgtccaggacggcgcgtaa

SEQ ID NO: 95 - DNA, 351 bp, Toxoplasma gondii
atgcccaagtgcatgatcttttgccccgtcgcggcgacgccggcgcagcaggacgccctcttgaaggacgccgaaaaagccgtcgcagacgctctggggaagcctctgagctacgtcatggtgggatactcgcagaccgggcagatgcgtttcggcgggagcagcgacccgtgtgcgttcattcgcgttgcttccattggaggcatcaccagttccacgaactgcaaaatcgccgctgctctctccgctgcatgcgaacgccacctgggcgtccccaagaaccgcatctacacgacattcacaaacaagagcccctctgagtgggccatgggcgaccgaactttcggctga

SEQ ID NO: 96 - DNA, 1416 bp, Toxoplasma gondii
atgcgagccgggttttcgtttgctctgttggcagtcggccttttggccactgccgtggtgtactccgcagcggaggaggaagctgtgactgtattgactgcctctaacttcgatgacactctgaagaacaacgagattgtcctggtcaaattctacgcgccttggtgtggccactgcaagaggatggcgcccgagtacgagaaggctgccaaaacactgaaggagaaggggtctaagattgtgttggctaaggtcgatgccaccagcgagacggacatcgccgacaaacagggtgttcgcgaatacccaactctcaccctcttccgcaaggagaagccagagaagtacactggcggccgcacggcggaagcaattgttgagtggatcgagaagatgaccggccccgcggtgactgaagtggaaggcagcgctgaggacaaggttacgaaggaggcaccgattgccttcgttgctgagctcgcgtctaaagacagtgatatggcgaagctgttcgaggaagtcgccaacgagtcccgccagctgggaaggttcttggctaagtacggcgcctcggacgagaagatctactcccttcgctacgaggagggcactgaagccttcacaggcaagaccaaggacgagctgaagaagttcgttgacactgagtcctttcctcttcttgggcccatcaacgcggagaacttccgcaagtacatcgaccgcgatttggaccttgtgtggctctgcggtaccgagaaggacttcgatgaggccaaaaccgctgtccgcgaagctgccaagaaactccgtgacacccgctccttcgtctggcttgacactgaccagttcaagggccacgctgagaacgccctgggcatcaccgaattccctggccttgttttccagtccaagaagggacgcttcgtgctccctgaggcaacaacctccctgaaggacgctgctaagatcagtcagttctttgatgatgtcgaagccggcaagatcgaccgatccctgaagtctgagcctgtcccggagaagcaagacgaagccgtcaaggttgtcgtcggaaagaacttcgaagagatggtcatccagaaggacaaggatgtgatgctggagatctacgccccgtggtgcggctactgcaagagcttcgagcccatctacaaggagttcgcagagaagtacaaggatgtcgaccaccttgttgttgccaagatggacggcactgccaatgaaacgcctctggaggaattcagctggtccagcttccccagcatcttcttcgtgaaggctggcgagaagacccccatgaagttcgagggctccagaaccgtcgaaggcttgactgagttcgtcaacaagcacggttccaagccgctcaagaaggacgacaagggtgaagaactgtaa

SEQ ID NO: 97 - DNA, 1938 bp, Toxoplasma gondii
atggcggagaaagcactgacgagagcgacaacgccgacgggcagctggcggcgtcccgagcctgtggacagagcagatccggagaacaggagagacagcctgcatgcgggagcgccctacgcgtccgagggacaaggaggaaggaagaccgagagcggcagaagcccagaatccctgagcttgttctcccggcagttccttgcggagagccgtacaccacaatcgtcctggtcccggtctcgtccatcctcttcggctcctgcctcttcgctgcgcccctctccttcttcagatccctctcctcgtgcctcctcttcctctagctgtccagcttgctcttgtgggttgtcttcttgtctgtccaccgactcccccggttctcgcacgtctgcttcgggggttcccgataagttcaagagatcctgtgcatattccggaaagcctccaccatccaaaaaacgacgactgctgcctgcagcacagctggcctctccaacgtgtaccctcaaaggacacgtgtatcgctgccctttagagcggaaacactcgcttcccacgccgtccgtttttttagagaaagacggctctctctcgtcctcagcgcttcggattttatcgcgtctccacgtaaagtatgtcccctctgaggatccccacaaagtgactagcgggtcctcgggctttgtacgcactgcatccttctctgcgtctgtcaagtctgggcaactcggaggccgtgcgtcaccgcctcagacaaagacaggccttaacccgctcatctctcttctctgttgtctgcctctcctcgagccttcctcgcggccttcctgcttcttcttcctctcgccgtctgcacttctgacaccttcttcttctcgcgcgtcctcctcctcttcttctaagcctccgtacccgtcggatcgcgtgaggcctggaggcctgacaggagacgcgttcaagttatctaggcttcagctgctgtacgattcgcttcccttgtgttgtcagcctctcgcgtgctcgtcatcgttggtgtctcgtttttcgtctttggatcagtcattcggcgtcccctctgcgtcgcctgcctttgtccccatcaacacgtgggctttctttctctcgctgcttgccaccgtcacatctagtcctctgccttgtgtctcaccttcttccgtttccccctcctcctcttctttcgaatcgtctgatggcttctcgtctctctctcgatcggcgtcgccgcgcttcaagcgggctctggtcttcgtctttgagtttattcctacgctctgttgctctgcatgctgtgaggcggaccacgcggagagcctccggagacgcggtgcagagccgacagcgaacgcagttgagtgtaggggaagccagggcagtagcgagaccagccgaatcgaaaacgtgcagcgggaagacgatgcaggaggttgccgccatggggctggtgagggagagagacgcaccgaagagaaggagggagaacaccgcctcgaggcaggcagcacggaacagacgcgacagcaagggcgagaaccggaaagcaatgatgacgcgggaatgccggtttcagatgaacagagaggagatccgcagcgaccgacaggaagggtagagagagaagagagacgggcagcgaacgagaacgacggtttttgggcgcgaatctgcggcgttgaaaacagccaattcattcgtgtgtgtcgagagagattctcccgcgtcgtcatgctcctgccgccgatccctgaggcttctcacatcatgggatgtgaagagatcaaaggagaacagagtgggagagaggagacacattcacaagagaacatcgaggcagatgccgagctcgcctggacaacatggattgaacaaggggggcgtgtcgctgagcttaccaatccggcattcgatcggccattttag

SEQ ID NO: 98 - DNA, 549 bp, Toxoplasma gondii
atgaaaatacagtccattgtcacgaaaacgacaaaagccgctctaactgccgcgattgatacacttttggcgaagggtgccgacgctccagctgtctcatccttccatgaaaaaggaggagctgtgccggttctgtgtgtttttattgtgcgtgcttattttgttggttcttacctcgttattgttcctctgctgtgcttccctaactttccgctactcgaacgtctagcccagcactgcagttctggaacgttgctgaaaggggaagacaccttgtgtcgggatccaaaagcttctagttgtcatctgcatctgagactgagattccttgaagttgtcgctgtttgtttcgttctgccgcgcaaacaggccgatcttcggctgcctctgtacagatttcaagcgggtgttcgcagaccctgcctgcatgcccctcgcgcgttgaatgaggcgccgttaaagttcgatgttgccttatttgttcaatttgttcttcatataaaggctttctgctgcgagtctcatgattcttgttgccgtcccacttag

SEQ ID NO: 99 - DNA, 648 bp, Toxoplasma gondii
atgaaggttgccagcggttccgccatcgtaggactcctgctcggagccgcagtcccagttgtgtacgccggacctcatggcggtcacagaccccagaagaaaggaggatacaccacaactaccacactccctcccaatccaatggacgtacgaacagaatgcttccaggtgccgtacagtgtcgaaaagacatgctacaaggacgagcacatttcccggccatacacgtgtccgtcgtcatattctgaagaagtgtgcagcacgcagttggcggaatctcgcgatgtgtgcactcaactggtgaagaaggaggtccagtaccagtgtccgaaggcaacgaagcaaacgctgtgctcccagatcccggtgacgttgaacaagacatgcaagaagcaagtcacaaacaaggtcccgagcagttgccccaagattttgacggtccccgagtgtgaaatccagtcgaggccttctcaagacgtgtgctacgagtctgaggcgtacacgcaggagtacgattgctggggctccgagcttcatcgcgaatgcgaagtggacatgcgcgtcgttgacacccagtgcaaccgcattgttgactcgccggtgctatacgagtacgaagataccgttgtggagagagtctgctccacg

SEQ ID NO: 100 - DNA, 2859 bp, Toxoplasma gondii
atgcacccctcgggtgggcaattcgttcccaccccccagagacacggtcccgacctcacaaagagttgggggctgataaatcgcgacttcgcgttgcgaacgagggaatgggccgtctcgcagaggagtctggtttttcctgttgccgttgccgccgtgaggggggaaacggcaccaattgctggtcgggcgtcccagtgtcctcgtctgcttgtgccgttttcgtgggttcttttcctggagcagcgtccggagctctctctcacaaaggttgttttccttctttggaatctgtattttgtttctttgtctccccttcgtccgtttaccggttcccttcacccccgccccgtcgtcaaaatggtgaacttttcagtggagcagatgcgtgagattatgggcaatccgaagaacattcggaacatgtccgtcattgcccacgtcgaccacggaaagtcgacgctgacagactccttggtctcgaaggccggtattatttccgctaaggcggccggtgacgcacgtttcacagacacccgtgcggacgagcaggaacgctgcattaccatcaagtcgactggtatttccatgtacttcgagcacgacatggaagacggcaagggtgcgcagccgtaccttatcaaccttatcgactctccgggacatgtcgacttctcctctgaggtcacagctgccctccgtgtcactgacggtgcgctcgtggtcgtcgacaccatcgaaggtgtgtgcgtccagaccgagactgtgttgcgtcaagctctggctgagcgtattcgccctgttctccacgtgaacaaggtcgaccgcgctctcctcgagttgcagatggacggtgaagaaatctaccagaccttctcccgaacgatcgagaacgtgaacgtcatcatatccacctacaacgacgagctgatgggagacgtccaggtctaccctgagaaaggaactgtctccttcggtagcggtctccacggctgggccttcaccgtcgagcgcttctccaagatctacgcgaagaagttcgacgtccccaaggagaaaatgatggagcgtttgtggggcaacaacttctacaacgccaaggagaagaagtggaccaagactcagagcgagaacactcgccgtgctttctgccagttcatcatggacccgatctgcactctcttcacctccatcatgaacgacgagaaggagaagtacaccaagatgcttggcagcttgggcattgagctcaagggtgacgacagggacctgactggcaaggcgctcctgaagcgtgtgatgcagctttggcttccggccggtgacactcttctggagatggttgtgcgccacttgccttctccgttcgcggctcagaagtacagagtcgagaacttgtacgagggtccgatggacgacgaggctgctcagggtatccgcaactgtgaccccaacgcgcctctgatgatgtacgtcagcaaaatggtgccgacctccgacaaaggtcgtttctacgccttcggtcgtgtgttctctggcactgtcgcgactggccagaaggtccgcatccaaggcccgcgctacgtgcctggcgagaagaccgacttgtacatcaagagcattcagcgcaccgtcatcatgatggggaagtacgtcgagcatgtccaggatgtgccttgtggaaacacctgctgcctggtcggtgttgaccagtacctgctcaagtccgggacgctgacgactctggacaccgctcacaacattgcggacatgaagtactccgtgtcgcccgtcgtgcgtgtggccgtgaagccgaaggacaacaaggagctgccgaagctcgtggaaggtttgaagaagctgtccaagtctgacccgctggtcgtttgcacaaccgaggagtctggtgagcacatcattgccgggtgcggtgagctgcacgtcgaaatctgcctgaaggatctccgcgacgagtacgcacagatcgacttcaccgtctccgaccccgtcgtctcttaccgtgagaccgtctctgctccttctcacatgacttgcctgtccaagtcgccgaacaagcacaacaggctgtacatggttgccgagccgttccccgacggactggcggacgccatcgaggccggccaggtcaacgctcgcgacgacccgaaggagcgcgcgaatgccttggctgagaagttcgacttcgacaagaacgcagccctcaagatttggtgcttcggtcccgagacgactggcgccaacatgctcattgataccactcagggagtgcagtacctgaacgaaattaaggagcactgcaactcggccttccagtgggccagcaaggaaggtgtgctctgcgaagagaacatgcgtggcatccgcttcaaccttaccgacgtcaccatgcacgctgacgctattcaccgtggcgctggccagatcatgcccacttgccgtcgtgtcctgtacgcctgccagttggcgtctgctccccgtctccaggagcccatgttcttggttgacatcacctgtccccaggacgccgtcggtggtatctattccaccctcaacacccgcagagggcacgttttccacgaggaacagcgctccggtactccgcttgtcgaaatcaaggcgtacctgcccgtcgccgagtccttcggtttcaccaccgccctccgtgccgccacttccggacaggccttcccgcagtgtgtgttcgaccactggagcaccctcaacggcgaccctctggagaagggctccaagatggaggagctcgtccacaacatccgtacccgcaagaacctgaagcctgaaattccgcccttcgaaaactactacgacaagctgtaa

SEQ ID NO: 101 - DNA, 2070 bp, Toxoplasma gondii
atgttttttttgtcgacctccgtaattcccggtgccgccgttttcagcgtgcgttttgcgcggaaccccacgccttgtcttttaccccgcaacagcttacctgtgcatctccggcacacggctttaacgccccgattcctcgaacactcgaacttagccttcggttttttccgccggtcgatttcgacaggctgctcgcgaacgcttcgaatcaagtccactccggttggtgtgcttttctctgccaaaatggcgtcaagaaccccgttccaggacgcagccctctcgatcgtgaagggagcggcttgcattgccctcagtctgaagactgcccgcacgacgcagaacgtcaaattttctaaagacaaccgatgctccatcacccttggccccatcgaggttgagccgactgctgccgaggaggctctcctgaaaacactgaccaagcaaaagattgaggaaaactgccccttccgcgtgttcaccatccctcgcgatctggcgactcgcatgtaccaggagtcttacctcgacgagttcggaattcccgccaatgtgaaggaagtccgcctcgtcgtcctgccggaatggaatatcaacgcgaacatgtaccccgtcctgaagtctacaggacaaatcgcggacatccagtttgagtcagtgaagttcaatgaggagaagaaacagctttgcctgtcgcttcacgtcgtcccaggacccgatgaacagtccccggctctcgctgaggaggagaagctcggtcctgaggagatcccctctcgcgctcaggtgcttccgccgtctggcgttgaaggcgacgactttggcgagggcgatgacgaccagaccatcaccccgtgggacgtgcaggcggccgagggaggcatcgactacaacaagcttctgaggaagtttggctgctcttccatcacacccgagctcatttctcgcattgaggctttgaccgggaagcgcgctcatcacctcctccgtcgtggaatcttcttctcgcatcgagacttgaacttgctcttggattccctggaaaagagacaggcgaggctcgcaagcggcaaacgcgaggacggcccaggttcggaaggcctgtccggcccaggcttctacctgtacactggacgaggtccttcttccgaggctctccacattggacatctcgttccgttcatgttcaccaaatacctgcaggacgtattcgatgttcctctcgtcatccagttgaccgatgatgagaagttcctcttcaaggactccttgactttggaggagactcaccgtcttgcgttcgagaacgcgaaggacatcattgcttgcggcttcgaccctgacaagaccttcatcttctccgatctgtcgtacatccagcacttgtaccccgtcatcttggagattcagaagaaggttacgtacaaccaggtccgtggtctctttgggttcgtcgagagcgacaacgtcggcaagtctgcgttccctgcagttcaggctgcgccgtcgttcccgacagccttcccgatgatctttggcggcaagaaggacgtccgttgcctcatccctcaggcaatcgaccaggatccgtacttccgtatgacccgcgatgtcgcgccgcgtttgggtctgttgaaacctgcgcttattcactcgcgtttcatccccgcgctgcagggattcaagacgaagatgtccggatccgtcgagacctcgtccatttacgtttccgacacccctgaacagatcaagaacaagatcaacaagtatgccttctctggcggccagccaactgaggcggagcagagagtgaagggtgcggacctcgacatcgatattccgttccagtacctcaccttcattctcaatgacgacgatcaactcaaggaaatcggtgaaaaataccaaaagggcgaaatgcttaccggcgaggtcaaggccatcttgatcaaggagttgcaggctctcgtcctcggtcaccaggaacgccgcgcgaaggtcactgatgacatggtccgccaattcatggatcccttccgtccgtgcttcaagaagtatgcacaatag

SEQ ID NO: 102 - DNA, 1428 bp, Toxoplasma gondii
atggagagaggtcagatgctagagcctaaggagactgcgaaggcgctcagcgcaaccagcagtggatactactccgaccatgtcgaccagaacgagcaagttcgcctcctcaaccgactcgccaacgcggagggaagctcgcaggtcaaacaagatgcagtgttggccaatccgccagactggaagaccctggagaaagcgggcgtcctgcctgcaggcctctcggctgttttgtcgaaaatcaatcctctctgtctcgacgaattcgcagaaatgctcgcggctgatccggacctcgttcgcgccctcgtcgctctcgtgcggctggaaggaaacctccacacggtgcagtacgtcttgacagtcctctgcgaggtagtcagagacgacagcagcaagtacgaggcgttgtgctcagctgtggcagacagcgaagttttcgaggcgtttcgtcagctgctggaagtcgcaaacctggactcttatacagccgaccgagcagcctttctcctctctggactcatgtgtcgagctcgctcggggactttttccgacagtcaggtggagtacttggttcaaggtcttctccacggtcgcgcggccaacaagtttctcctcagcgaaggtggtcgcctggacgcgtttgtcaatctgctgaaaatcgatggctaccgaccgatgatttgggattgtcgcggatttcctgagctcgtcctgcggaacttgtcgctgacgcttcccgcgagcgtcctctacaaagcgatgttctgcgtgtggctcctcaccttccacgacgcgtttctgcctcagctgaacgagaagggcattgttgtcgccgtgtgcgtagtgttgaaagagtcccgcgtcgagaaggtgattcgcgtcggactcggtgtgctgcacaacttgctgaagtgcgacgcgtcggtggaaacagtcattgaacagaacgtcgcgcaggttttggcactgctggaattcgagaaatggcgcgacggggacatgtacgacgacatccgcctcgcgacctcgcacctggaacagaaaattcgtcagttcaacaacttcgatcgctactgccacgaactcgacaagggacagcttacgttctctgtcctccactctgaaaaattctggagagagaatgtcatggcatttgagaacgatgagtttcgagccatcaagaagctcgtgaagctgctggatacgtcaactgacaaaacgactctcgccgtcgcgtgctacgatcttggcgagttcgcccgtcttcacccggcaggaaaaaaggtgtgtcagcagctgaaggtgaaagaccgcgtgatgctaatgataagcgacaaggaccgcgaagtagccggcgaggcactgctgtgcattcagaaattgatgttgaacaactggcaggacgtcgccgagctcggaaagtag

SEQ ID NO: 103 - DNA, 1851 bp, Toxoplasma gondii
atggcgccccgaggcgaagcagcagccccagagggggacgcggaaatgggaatcatctacaaagtctctggcccgctggttctggccgagcaaatgagtggaacgaaaatgtatgaactcgtgcgtgtcggctggcagcgacttgtcggagaaatcattcgtcttgagggcgacaaagcctttatccaagtttacgaggagaccgctggtctttgcgtaggcgatcctgtgctgaagaccgggaaacctctttccgtcgagctgggacctggtcttcttgacaacattttcgacggaattcagcgccctctcgagcgcatcgcacaagtcgcccagagcgtcttcgtccccaagggggtcgatgtgcctgctctggaccacaagaaactttgggagtacaatccagtcgccaacgttcaagtcggcgatatcctgaccggtggagatattatcggaaccgtacacgagaacaatctgtttctggagcaccgcatcatgattccccccaagattcaaggcaaggtctcctggatcgcccctgcaggctcgtacacagtcaaggacacgatcatgactctggagtatcgcggcgagcaaattccgattcagatggctcacgactggccagtccgagagcctcgtccctgtctcgaaaaactctcgggaaacacaccgcttctcactgggcagcgtgtgctcgactctctcttccccacggttcagggaggaacttgcgccattcctggagccttcgggtgcgggaaaacatgcatttcccaggcgctgtcaaagtacagcaacagccaggtgatcatttacgtcggctgcggcgaacgggggaacgaaatggcagaagttctaacggagtttccagagctcacgacggtggttaacggccaggaagagggcatcatgcagcgcacctgtctcgtcgcaaacaccagcaacatgcctgtcgctgcccgtgaagcctccatctacaccgggatcaccttgggagagtatttccgcgatatgggttaccatgtggctatgatggctgacagcacaagtcgctgggctgaggcgcttcgtgaaatcagtggacggcttgctgaaatgccagctgacagtggctatcccgcctaccttggcgcgcgtctggcgtctttctacgagcgtgcgagccgtgtacgctgtgtggggtctccggaacgcgaaggcagcgtgacgattgtcggcgctgtctcgccaccaggaggagacttctctgaccctgtcaccacgtccacgatgtccatcgtacaagttttttggggtctcgacaagaaacttgcccaaagaaaacacttcccctccgtgaactggacaacttcgttctccaagtacattcgtgcgctggagccgttcttcgattcctacgacgctgagtttagcagtcttcgacagaaaatctctgacattcttcagcaagaagccgagttgacggacatcgtccagcttgtcggcaaagactcgctctccgaggatcaaaaactgattctggaagtcgcacgaattattcgagaagatttcctccagcagaacgcgttctcggactacgactacatgtgccctctgtataagaccgtcggcatgatgcgcaccatctgtcacttctacgatcagtgtctgcgcgtcatgcaagaaacaagcggcagcgagcacaaaatcgggtggggtacaatttacaacacgatgcggccgaccatcagcagaatcaccagcatgaaattcttgccgccgacgactacggaggcgcaggcgaagcagcatttcaagcagctgagtgacgagatcacctctggcctccggggtctcgttgagaaataa

SEQ ID NO: 104 - DNA, 1518 bp, Toxoplasma gondii
atggcggctcaggcagccaaggccgacgctgcgctcgcgcatgcagcggcagcttctcgcgactaccgagtggctcctcgcctcgactatcgaacggtcgcaggtgtggaaggcccgcttgtcattctcgatgatgtcaagttccccatgtacaatgaaatcgtcaacatccaccttggagatggatccgtcagagaggggcaggttctggaagtccgagggaagcgagcagtggtgcaagtgtttgaggggacgtccggcatcgatacgcgccagtgccatgcggagttcacgggagacgtattgaagatgccgatcagcgaagagatgctggggcgggcgttcaacgggagtgggaagccgatcgaccgcgggcctcgcgtactggccgaggagtttctggacatcaacggatgcccgatcaaccctcagtgtcgtgtgtaccccaaagagatgattcagacagggatttcggcgatcgacgtgatgaacagcgtggttcgcggccagaagattccgctcttctcggccgcgggtctgccgcacaacgagatcggcgcgcagatctgccgacaggcgagtctggtcgcggggaaggatgtgaaggatcactcgaacgagaacttcgccgtcgtctttggagcgatgggtgtgaacatggagaccgcgcgcttcttccgacaagacttcgaggaaaacgggagcatggaacgcgttgcgctgtttctgaatctggcgaatgacccaaccatcgaacgcattatcacaccgcgcctcgctctgaccactgcggagtacctcgcgtacgagcgcgagatgcacgtctttgtcattctgaccgacatgacggcgtatgccgacgcgctcagagaggtctcagctgccagagaggaagtccctggacgtcgaggctatcctggctacatgtacacggacttgtcgaccatctacgagcgcgcaggtcgcgtcgagggccgcaacggatccatcacccagttcccgattctcacgatgcccaacgacgacatcacgcacccggtccccgatctcactgggtacatcactgagggacaagtcttcgtggacagaggccttcacaaccgacagatctatccgcccatcaacgtgctgccttctctcagccgtctcatgaagtccggaatcggacgaggcatgacgcgcgaagaccacccccaagtctccgaccagttgtacgcgaactacgcgatcgggcaagatactcgcgcgatgaaggccgtggtgggcgaggaggcgctctcgcctgacgacttgttgtacctggagttcaccgacaaattcgagaaccggcttctgagtcaagggccgtacgagaaccgaacgatcttccagtcactggacattgcatgggagctgctgcgtattttccccgaggacatgctgaagaagatcaaggaagaagaactgcgaaagtactaccccagagacaagtacctcgaggaacaggaacggaacgacaagcgcgtccccccctcatga

SEQ ID NO: 105 - DNA, 1215 bp, Toxoplasma gondii
atgttggggtcgtcggagggcggcgcgcgcgggtgtccgtactggatcgttgcatgcaatacggacgagacgcacagcgccgagcagattttcagttccctgaagcacgcggtcttgggctctcgcaacgcgctgtgcgacgaggcctgtctgttggacattcctcatttgaagttcgggacttttgacgacttgattcgctccgtcgacattctgcagaagcaggacgcctacgtggagagtgtgattcggcgcatcgagcgccaggccgtggagatcgaccccgactgcgagttgaaagtcgtttggcagcggcactcgctcacggtcgaccagtacattcggcgttttcagtgggatgacgccaagtttccgcggctccgcgccatcccagaaaacctcgacgcgctcgtgcagtccgtgaccaagaccgacgacgaagtgcgagcgaaagtagcagtctggcaggaggtgaggcagcagatggcgaactcggcatcgggcaagaagacaggtcctgcgacttacttccagcgagacttgatcgacgtcttgtctccagacacggtccgcgacgacgacttcttggtgacagaacacttgacaacggcggtggtcgtcgtccccaggggtcaggagcgagagtgggaacagagctacgagagtctggacgcgttcgtcgtaccgcgtagctcgcgaaagttcaacgtcgcggaggacgcagacggaaacgcgctctggagagtgattctcttcacctctcacctccaggcgttccgacaggcggcgcaggcgaagaaattcgtcgtccgggacttccactacagcccgcaggcgtacaaggagacggtgctcgcgcggtcacgcgtcgaggcggagaagacgaagcaagaaaccttcctcagtcgtgtctgcttcgcggccttctcagacatcttcgtcgcctggatgcacctcaaagtcatgcggaccttctgcgaagcggtgctcagattcggagtccctcccgagtacgccgccttcgtcctccgtcctgtgagcgaagcgaaggaaaagaaacttcgacacgaactggacaaactgttctcgcccaaaggaggcttcgggaacagctacttctcaggcaaagacgaccctggaagcgacgacgaagacttctatccctacatctggctcgcgcttcagcctttcggcagtcaccgcgcatccgcttga

SEQ ID NO: 106 - DNA, 1191 bp, Toxoplasma gondii
atggagctctcgttcttcaacgtcgacgacggctacctggaaggcatctgccgagggttgcgctcggccttcttgacggaggaagattataaaaagttgtccgccgcggattcgctcgaggatctgcggtcggccctcgaggagacggattacggtccgttcatgcaggacgagcctctgcccctggcggtaccgactttatcccagaagtgtcgagagaagatggcttccgagttccggtacatgcggtcacaggcttcagggcctcttggcaagttcatggacttcatcgcaacggagaagatgattgacaacgtcgtcggtctgattcagggcgccctgaacagaaagtcttctcacgagcttctggcgcgcgtcgacccaatggggtacttccaggaaatggctgcgattgcgaacatggatttgacgacgagctacgaggaactgtatcgcgcactgttgatcgacacaccggtggggaaatatttccaagcttttctcacagagtctggatcgcaagccgcggctcactccgctgaacacggtggccgcagcctcgcagaagtcgccagcatcgtctccgaaacagatatcgagctgatgaggaacagcctcaagaaaggctggctggaggatttctacgccttcgtccagtctcttggaggcacaaccaaggaagttatgacgcacattctcaagagggaagcggactaccgtgtcctccgcttggtcgtcaactcgctctcttcgaatcagcaacagcaaatggatcgccaggctctgtatccgtcattcggttatctctatcccgaaggaacggatggcctgcgaaaggcgtggaatgacacgactgtccgcgcagctctggcgcctttctctagctacctgaacctttatgagcaatgcaaatcgttctacgttggacaggagggccagggcaatgaggccgcaatcaacatggcgagcacgagcaaattcaaatccctggaagacttgctctacagcgaaacggcgacaatgtgcgaacttgcgtttgagcagcagttccactacggaatttactatgcgtgggtgaagctgaaagaacaggaaatccgcaacatcgtttggattgccgacatgattttgatgaagagaaaggagtacatttccgaccagattgttcctctcttccctcctcgggtgtga

SEQ ID NO: 107 - DNA, 1038 bp, Toxoplasma gondii
atgctttccttcgagtttagttctggcgtgtatatgcgaaacaattcgtcagcagcgctgcaggaaactggcgtgtggcacaacgcgtggcgcgctcgcagtaaattgccgacggctttcttcatcgacatttcttcatttagtgtaggttcgttcttttcttcgcattctctggcgaataacacaagttcgacaccaccttttgtgtgcaaaaagcgatttgtgacggcgccgatataccttcgtttcccccgctaccacgaagaagaattcgcaatcttttttccgaccctgtcaagttcaccagcacccgcccccctcggcaaaatggcgatggacgacgcagaggcccagcggcaaatccagcagatggtcaagttcattctgaacgaggcccgcgacaaggcacaggagatcgaagctcggtctctcgaggacttcaacattgagaagctgaagttggtgcaacagatgaaggacaagattcgccaggagtacgagaagaaggcgaagaaactcgaaacccagagagccatcgaccgatcgactgcggtcaacaaagctcgcctgcgccgaatctctgctcaggaccaagtcctatccgaggtgtacagccaggccatgacgcagctttccgctgttagccgcgaccgagcgaaataccagaagcttcttgaagacttgattgtccagggtcttttgcgccttctcgagagcgaagttatcgttcgctgccgcgagatggacaaggcactggtggaagctgtgcttccgaacgcggtgaagagatacagtgaaatcatgcgcacagaggcgggcctgcacaagacagttacagctactctcgataaatcgggtcgatacctcccgcctccgccatcggccgacaatgatggaatgtcgtgctgcggtggcgtagtgctgatgactcgtgatggccgcatcacctgcgataacaccttcgacgctcgcttgcgcatggtcatcgttgaatgtgcaccggcgattcgccataccttattcccgagccatcaatga

SEQ ID NO: 108 - DNA, 588 bp, Toxoplasma gondii
atgcaccaatttcgctgtctggcgcgaataaaaaagcattactgtggcggggatacagtagaaaatcattctgacaagaacaaagaattgcagttggaacaaatcttcgctccagcgaccgtttgcggccttagtcgcttgcggccagccgcgggctgctcgaaggtggttttagtttcaaagattcttctcgttctcgcaaaaatggctccggtactggggcgcgtccagggaactgacctaaaggttgcggttattggtgatgaggatactgtcgctggcttcctcatggccggcattggcatgagagatggacttggcaggacaaatttcttcatcgtggattccaaaacgaaacgacaagatgttgaagacgcttttcgcacgatgacagagagaccagacatcggcatcgtgctcatcaaccagcacgtcgctgacgacatccggtacatggtcgatctccacacgaaaattatcccgacaatcttggagatccccagcaaagacaaaccctatgacccgagcaaggactccgttatgcagcgcatcaaattcttctttggaggagaacttcccacgtcgtga

SEQ ID NO: 109 - DNA, 396 bp, Toxoplasma gondii
atggcggcagcgaagggctccaatgcactcattcagcagctcctcgaggcagaggaggaggccgacaccatcgtcaacaaagcgaaggaaaaccgggtgaagatgctcaaggatgcccgcttcagtgctgaggaagagctgaaggtatttcgcgccaaagaggaggagcgattcaaggcggaatacgaacagaccgcaggccaagaagattctctggtgtcgagcctggaggcgaagacaaagggcgagattgagggcatcaagaaagactacatggagaacaaagacaaactcatcgagttcattcacagaaaagtcatggatgtcgatctttcgttggacacggaaacgattgctgttctacgcacttgcgacaaacgaggcgtcgcaccgtaa

SEQ ID NO: 110 - DNA, 474 bp, Toxoplasma gondii
atgttctggtctgcatttctccagtgtgacccgaactcgactttcttcgggttcatgggtatcacggcggccatggttttctccaacttgggagcagcctatggtacggccaagagtggtgttggaatcagcagcatgggtgtcatgcgtccggatctggtaatgaggtctatcattccagtcgttatggctggtatcttgggtatctacggcctcattatctccatcgtcatcaacggctcaatggacacccctgacacctactcgagctatgccggctatggccacctcgcagcaggactgactgtcggtctcagtgcaatggcggctggactcgcgatcggcatcgttggtgatgctggtgttcgcgctaacgcgcagcagcctaagcttttgcggcatgatgcttatcctcattttcgccgaggctcttggactttacggtcttatcattggacttgtcgtcgctactaa

SEQ ID NO: 111 - DNA, 489 bp, Toxoplasma gondii
atggagcgagctagcgccgctgcggcaacacgttcgcctatcttcgcgtctgcactgaccaagagaaaacccctcctattgctgcttggattcgcggtcgtcttgacgtttttcacttgcggggttccaactacctctctgcggctgaggggccccaaattcactctgcaggatatgaagaaagccatcaaagacgcgaaagacggtgtgaaaggtgttgaggacgctaagaaaaaacatcagaaggctgaggattccgccaagaaggcatcaggatcaaagaaagacaagctacagaaggaggcagacgaaaagaaagaaacgttgcagagcaagattaaggatatgaagcaaaaatgcgaggagttgcgtcaggtgaaagaaggcaccaagaataacaagggactcagtgataaagaaaaaaaggatttctcgaaggaaggagagaaagccgacgaggttctcaaaagatgcgggacggttgtgtag

SEQ ID NO: 112 - DNA, 1716 bp, Toxoplasma gondii
atgaggacgtctgttgcccttttttttgcggcggcaggcggcatcagcctggtctgcgcaccccaggtctctctggctgcgccagtgcaagggactttgggcccggacgtcgcagatactgcgggtgaacctgttgttcttcaagtcgctcgaggtgcggattctctgccagattcaagaggcaacatcgatgaagaaggcatcactgaggtagccacgacaggggttcctccacaaacacaatcgtccgggcgatcgtttggtcaacgtgtgatgtcctggtttacatctgctcggaacgcaatccggcgtccacgaaccgatgaacagggggccgtcccaggaccctcacagcccatccctagtgggacagattctactcctgaaggatgggagacggttcagtcaggcgatgtcccgcctggggagccggagccgaaagcacccactagatccccgagacaacgagccagagacatgtttggtcgcgtgggccgcttcttcggaggtgcccgacggtttgttggacgcggttggaggcggttcaccacgggtatggcgggagtcactgaccgtgttagaggacgacttgctctacgaagcagcttcgaattccgcaacgaggaggcggtcggacaatcagaactcgcatcgcttgcctcgtccatgacagttacggcccccgaaggcgaagcgttggaggttgcgcgtgaggcggggctgcggtctggggcctctatcaaccttgtgtccgctacaactggtgaacaagtgacggtatctctcagagcaccactcggaattggagagtatacggcagttttcagcggattcatctctggcattgattctgaactcgctgtgaaggcgtttctcgggaagactacagagtcgatgtcagttgccgagacagaggctagaatcctgaaaatcgtgtcgctgaaggacccggtggacgcaatgcatcgacttcgtctcttggctcccatcgagacactggtttaccgaggagatggtgattctgccgatcagagcgaaggcaggccggttgtcctggttcccaaggcctcgtcctcgctggtggatgtcatcaattttctgcgctcaggtgatgcctcagcattcgatgatcgagcgaagaaaattgtcctcctgggcgcgactgtgcagctgatccaacttctggcagcactgcacacgcgaaaagtagtgcacggaaagctggaacccaaaagcgttctgctcttcagtcatggccttctctacctctccgacctcggcagagcacgtcgccacggggagaggttcacgacatcccgtccgagtaggtacggtgcgcctgaggttttggagcaccccgagacaccgtacacgtattcccgggacgggtattctctcggaattatccttttcgagttatggtgcggaaggctgccgttcgatctggggacacccggagtcgattcttcagagaaactcgagaactcacaccctgcgaccttgtatcaaaccgttcgcaacttggatcagcgtctgtccttcgatgtctgcccgagtgacatgccggaatctgtgaaaaccctcattcgcaagttcctgactcgaagacgttggacccgcctggtgccacaagctgctctgcgcgatgccaatttccgccgcaccatgcagttgcttcaggagaccgttcaagggaatggtgaaacccaattgtaa

SEQ ID NO: 113 - DNA, 1719 bp, Toxoplasma gondii
atggaaaaaatggaggggcgaaagtcttttcgcgttctgggcaccccgctgcccgtcgccgcgctcgcggcaatccttcttctcgggtgtatgtacacacgagccgcaggcaccccggacgactcgttgtttccgctttctgaagacacatccgtggatcctcgcgagtccttcagcgcggaggacgtcctgaacgcgtttgtttctccagagtccgtggagtcgttgtttgccagcatcgttgcagagcaggtagtcgctacctccggcaacctgacagaaagcgcgccgcgggaccgcgattccgcgccagagcgacgatccgacggaggcactttgcgtggtcacccagaagatgcaggggaactgctccgcctcctgctggctgacagcgaagacatggagctgtggaaggcgaatttctttcggcacctcacccacagcatgcgtcacatcgtgcgagattcggttctcgtctccgagaaagcttttccgtcagagcaggcggacgaagcgggccgggaccccggcgacctgaagaaggcgctgaaagagactggcgaagacgtcttctgggaaagtcgccccgccagctcgaatgcggccgtcgcactcatcaaaagaaagatggaaaaacaagcaggaaaaacaggagaaggtgctggacacacatgggagccggaggtctcccttcgcttcaggtacttgagtttgaaggacgcgaagaaactcatggggaccttcctcgtcaacaccaaagtcgaggggttcccgactcccaaaggcatgccgcttcccgcgaaagagttcgaaaacgcaacagagccggtacctgctcacttcgatgcccggaccgccttccctgcatgcaaagacgtcgtcggacatgtcagagaccagggcgactgcggatcctgctgggccttcgccagcacagaagccttcaacgaccgcctctgcattcgcagccaaggcaaaggactcatgcccctgtctgctcaacatacgacgtcgtgttgcaacgcgattcactgcgcttccttcggttgcaacggcgggcagccgggcatggcgtggagatggttcgaacgcaaaggcgtcgtcactggaggcgatttcgacgctctcggcaaaggaacgacttgctggccatacgaagtacccttctgtgctcatcatgcgaaagcacccttccccgactgtgacgcgaccctcgtacctcgaaagactcccaagtgtcgaaaagactgcgaagaacaagcctatgcagacaacgtccatccctttgatcaggacacacacaaagcgacctctgcgtattcactccggtctcgcgacgacgtcaagagagatatgatgactcatggacctgtgtcgggggccttcatggtctacgaagattttctcagctacaaatccggtgtttacaagcacgtctctggcctccctgttggtggacacgcaatcaaaatcatcgggtggggcactgaaaacggcgaggagtactggcatgccgtgaacagctggaatacgtactggggagacggtggccagttcaaaattgcgatggggcagtgtggcatcgacggcgagatggtggctggcgaggctgcgtggcaggagaccgaaggcgtggtgaacggcgaggaggagctcccgggccagcatgcatctggcgcgagggtcggcgcgcatgcagaggaggagagagaaatgtag

SEQ ID NO: 114 - DNA, 1614 bp, Toxoplasma gondii
atgatcccccggacctgtgacgatccccgcagggactcgtgctgcccgctcttttctgtggattgttgccctccacatccttccccttcctctgtttttcagtctgatggcaagcatgaacttcccgcttccgaaatcccccactcttttcgggctgtccctgaggggacatttgccgccaggtcgccacggagccatggtgcaggccaaccgcagggagaatgcccatcagatgctacgacgtcagctgcatccgatacatcctcgcaggctccgcatgatgttccagtcttcactgattctctcctctcttccagcacatcggaatggccccatcaagggccacgaagtgatgctgtggagtcactggaacatgcatatatctctgggaccgtatcgagcgacgaacccgtttccgaagaacccctcagcagcgacgaggaatacttaccttcagttgatttcacaaaaaatgcaagttgcgaaatgtcacctggcgaccttcccgagtcactaaattccgtcagtgaacctgtctctaagttgcacagtggtccctcaagacatgctacggtcatacggcgagctccccagagcgcaagggacggtttctcagtaatgaggaaagacgcatcgcttcgacagcctgccattcctcccatggcaccggttcggcttcttccgtcaaggcggtgtcagtggctccgagcgctgccggtcgtcttccttatggtgttaatcgcctatattcttgctgtttttgtaatgtaccatgctctccccttgctgcagctgaacatccctcagtcgatgaaatttgcttctacttacaacagaggtctgtttgagcttttgggcgttggtatcctgactttcctcttcctcgtctcgtactggctagctgtcgtcaccccgccaggcagcatcccaaatactgacgaatggtcttactcggcgcccgaaattttcgacatagaagggctaccttcggttgtggaaacaaaaaagacgggggcacgtcgtcactgcaaatggtgtcgccggatgaaaccggatcgggcccaccactgtcgggtttgtcgtcagtgtgtactcaaaatggatcaccactgcccatggatctacaattgcgtcggctggagaaatcacaagtacttcatgctctcgctcatctatgggtcccttgattcccttctcattgcaatctgcatgttcgaaactgtcaagcgagtagtggcgtcggacaaggaccagttcgaaaaaatgtttatggtcctgttcgccgagacgctcgatattttcctctgcactctcatcactgggttcttcttttttcacacgcacttggtttgcaacggcatgacaacaattgagttctgcgagaagcaattcatgcgtccgcgcacgcccatgcaagaaagtctgtggaacaaaggctgttggagaaatttcacagacgcattcggatcaaatccattaatctggttgttgcccatagataatcgaccaggagacggtgttcacttcatcaccgaggacacacggctacttcacaccccggttctgcgacgtattcggacctttgagccaataattgaatcatcagtggactga

SEQ ID NO: 115 - DNA, 1200 bp, Toxoplasma gondii
atgaggacgtctgttgccctgtttttcgcggcgctaggcagtatcagcctgccctgcacgctccatgtctccctagctgcgccaatgcaaggaacgttgggcccggatgtgccagaaaacaccggtgagcctcctgttctttcgtcctcttccagtgatgttccactgcgaggggccgaaggcgggagcactcaggagggcgccgtggagggacccctgccacaggaatggagacaaccgcccccaaagcctccccgtcgacgtctagtcgagtcgatgcccagccattcgagttcgtctatccgcagaggaggagagagtatcgtcacagggcctgaaaacgttgccaatgacgagggtggttctccatctgacgatttgaagatcgtacagcccgaggatgtgccgcctgggggcccggggccgaaagctcccggagttggtaccaggatgagaaactgggccactagatccccgagacaacaagcacaacgagccagagacatgtttggtcgcatgggccgcttcgttggaggtgcccgacgggctgttggacgcggttggcggcggttcaccacgggtatggcgggagtcactgaccgtgttagaggacgacttgctctacgaagcagcttcgaattccgcaacgaggaggcggtcggacaatcagaactcgcatcgcttgcctcgtccatgacagttacggcccccgaaggcgaagcgttggaggttgcgcgtgaggcggggctgcggtctggggcctctatcaaccttgtgtccgctacaactggtgaacaagtgacggtatctctcagcgcaccactcggaattggagagtatacggcagttttcagcggattcatctctggcattgattctgaactcgctgtgaaggcgtttctcgggaagactacagagtcgatgtcagttgccgagacagaggccagtatcctgaaaatcgtgtcgctgaaggacccggtggacgcaatgcgtcgacttcgtctcttggctcccatcgagacactggcttaccgaagagatggtgattctgccgatcagagcgaaggcaggccggtgtcctggttcccaaggcctcgtcctcgctggtggatgtcatcaattttctgcgctcaggtgatgcctcagcattcgatgatcgagcgaagaaaattgtccgcctgggcgcgactgtgcagctga

SEQ ID NO: 116 - DNA, 291 bp, Toxoplasma gondii
atggtttctgaagcgacagacaaagtgacgggagagaagattgccgtgctagttgaccatacttcaaccaagggctctcgaaaggacatggataagcagtggcactatgtgccatgtgctgtcttgtttggaaaggtgaagaactcaattacagcttgcaaccttcagaggtttctggttccattctattttgcgaggatcccggagagaccaataactcaggaggcgcgtcaaggagcaagaaaggctgggtccttaatgccctgccgctgctgccttgactcaggttga

SEQ ID NO: 117 - DNA, 1560 bp, Toxoplasma gondii
atgacagactgtcctttcgcggcgatccggggatcgagtgggcggatctcccggtcgcatgtcgcttttttggtcatcctggctgtctcagtcacgtcgaatccaacgctagcctttcatcgagggtctctgcaagggacagcaactcgtgacgacctcccgacacaagcgcaatatctgagtgccatcggtgctcacgagacgctggtccgtgcccaacgtagggctgcgttccagaaaactcccggaaagaatagcggccgcccccattccttgcttcaggatgtggctgaggagcgagaaaactccagtacggcggttggctccatccctcacttctccgcgttgccagagtcggaatgggactacaagcaacatggcaaggattggggcggcatgtgcgctacaggcatgcagcagtcgccagtcgatttacacattgaggggctacaggagccggagtaccgtaatctgacaaatgtttatatgaacgcgttcgccgggacgcaaccatctcgaacgcttaagccttggaagcgcggggatttcttctacacctaccctcaccagttcacgaaagtcgaagtgtacaagacgtcgaaggtgtttcaggtccgcgttccagaggaccaaatgacgcctctcggagcactatttagcacagacacgacggagatgtacactgctcaacacatcttctttcactccccctctgaacacacctttcaaggcgaggcgaatcggcgtgaaattgaaatgcagatttggcactattcgaacgacttgctgtcgtacgaatcgtccacaagcttgaaccatacgtctctccctttcctcgcgctcttcgctcaaagctctctcaaccttcccgacgtcgaggaggctctgaagcgagaccactcctctggctccgaccctagtcttccttcatcccactggcgtgtaatctccttgacattcatgagcgaagagcttgatcagacgagtctggcagaactcaagagcctcccgtccgagaggatgctcagcactcttcttagcgccgaaaggatcagcagccaagcgggtcaatccgagaaggtagaactggcgcatccgctaaatttgcagtcggtaatgatgatgcttcagctgaccaacacggagttctttgcctacgacggaagcacaaccatgcctgattgcaaggagaatgtacgctggtacgtagctcgtcaaccactccccgtcgcaaccgaaacaatgctgcggttctacaagatgttgaatcctcatcaactgaggagtcgggacgagaacgacgggaacttccggatgctgcagaatgtggaagacaacatgcgcaacgaagggaacgttttcttggtgcagggattccccctccaagttcttattgccaacagtcttggctttgataccatggcgaaaatgtcaaaggaaggcgcacaaatgttccaaggctggttcagcgctgcgggcgaacataccttcggccatagtggaagtgcgcttgccttcgccactgctgccctcgttttcttgaatactgttggcatataa

SEQ ID NO: 118 - DNA, 531 bp, Toxoplasma gondii
atgtgggctgactacttgtcggagttcgcctcccttcacgaggacgccgagcgcatcctcgcaggcggcgacccgtcggagggtgtcgaagtcaggcagcagaaacttgatgcgttgatgaagaaaatgaagcgatgtttctcatctcttgagatgaacgttcgctccctgcagccccgcgagcgccagcctctcgaagcttcgctgatgaactgtcgccggcaattcaccgacattgaaagaaggactcttctcttgcgagaaggcagcagaggttccgggcaaccgagtgcgtcgaagagtcgtcaaaacactttggaaaagctgaaaaaaggaagcagtcagctagaggagagcctgcggctagcagcggaggccgagggcgtcggagagtccgctctttgttcgctgtacgtacagcgggaaacgctttcgcggacaatgacgcgaactaaggacgttcagcgaaacatggacgaggcagacacaatcgtcaccaagatgtctaagtggtggaatggtatctggtag

SEQ ID NO: 119 - DNA, 834 bp, Toxoplasma gondii
atgaggacgtctgttgccctgtttttcgcggcgctaggcagtatcagcctgccctgcacgctccatgtctccctagctgcgccaatgcaaggaacgttgggcccggatgtgccagaaaacatcggtgagcctcctgttcttccgtcctcttccagtgatgttccactgcgaggggccgaaggcgggagcactcaggagggcgccgtggagggacccctgccacaggaatggagacaaccgcccccaaagcctccccgtcgacgtctggtcgagtcgatgcccagccattcgagttcgtctatccgcagaggaggagagagtatcgtcacagggcctgaaaacgttgccaatgacgagggtggttctccatctgacgatttgaagatcgtacagcccgaggatgtgccgcctgggggcccggggccgaaagctcccggagttggtaccaggatgagaaactgggtcatgagagtgccaaatatagaactgcaaccacccaggcaggtggttggtcgcatgggccgcttcgtcggaggtgcccgacgggctgttggacgcggttggcggcggttcaccacgggtgatgcctcagcattcgatgatcaagcgaagaaaattgtccgcctgggcgcgactgtgcagctgatccaacttctggcagcactgcacacgcgaaaagtagtgcacagaatgctggaacccaaaagcgttctgctcttcagtcatggccttctctacctctccgacctcggcagagcacgtcgccacggggagaggttcacgacatcccgtccgagtaggattcctggtacgctcttggagcaggtggattga

SEQ ID NO: 120 - DNA, 999 bp, Toxoplasma gondii
atgaggacgtctgttgccctgtttttcgcggcgctaggcagtatcagcctgccctgcacgctccatgtctccctagctgcgccaatgcaaggaacgttgggcccggatgtgccagaaaacatcggtgagcctcctgttcttccgtcctcttccagtgatgttccactgcgaggggccgaaggcgggagcactcaggagggcgccgtggagggacccctgccacaggaatggagacaaccgcccccaaagcctccccgtcgacgtctagtcgagtcgatgcccagccattcgagttcgtctatccgccgaggaggcgacagtaatgttctactgcctgaggccgaaggcgggagcactcaggagggcgccgtggagggacccctgccacaggaatggagacaaccgcccccaaagcctccccgtcgacgtctggtcgaggcgatgcgcagcaattcgagttcgtctatccgcagaggaggagagagtatcgtcccagggcctgaaaacgttgccaatgacgagggtggttctccatctgacgatttgaagatcgtacagcccgaggatgtgccgcctgggggcccggggccgaaagctcccggagttggtaccaggatgagaaactgggtcatgagagtgccaaatatagaactgcaaccacccaggcaggtggttggtcgcatgggccgcttcgtcggaggtgcccgacgggctgttggacgcggttggcggcggttcaccacgggtgatgcctcagcattcgatgatcgagcgaagaaaattgtccgcctgggcgcgactgtgcagctgatccaacttctggcagcactgcacacgcgaaaagtagtgcacggaaagctggaacccaaaagcgttctgctcttcagtcatggccttctctacctctccgacctcggcagagcacgtcgccacggggagaggttcacgacattccgtccgagtaggattcctggtacgctcttggagcaggtggattga

SEQ ID NO: 121 - DNA, 795 bp, Toxoplasma gondii
atgtttccccgtgtcgctttattccctgtccccacttgcgatctttttcttgtcggtaggagccgtctatcacgtgctgcgaagttgcatcttacgcgacagctggtggtgtctgttgcgtggctgcatcgtcacggcgtcgctcacaatgacttgaagcttgagaatgtctttcccagtgaagaagggaaggctgtcattggcgatttgggtttcggagtgcaaattggaacgtcggcgagactgaaatacacagcggcctatttagaccctcatgctgcggaggaatgccttaataatcaagtagaaacagttgcaaatgaagggacaggtgcgtgggcactgggaactctcgtctttgtgatatggtgtagatcctacccagtcgtttcgcgtgagcaagcctgcctttccactcgtgatttgcgggaccgcctggtgacaatggcaaagacaactaaacccacgccatcatctcaccactgccaggaactcccctctccggtgaaagacctaatagccggatttctacagtggagccgtgaagcgcgacgtctcccaggtgatgatgttgacgaattccttgctgctaccttgctgctacagtctcagaagcagcgacctcctcagcgagtgtgtgacacggataattgccacattcagatcacggcgacagtgatcccaaaaacgaaccattggttcaccattctgacaaccggcaagtcgggccgcccaatcgactttctcatctacgaaatcggcagaggacttactggcatccgtggccaggagtga

SEQ ID NO: 122 - DNA, 369 bp, Toxoplasma gondii
atgtttacatggacgcaagaatcgcagcagcaagcattggtcgacgagaaatcgtcatgcttacacagaaggatgcatgagcattatgaaatcttctctttaaggttgtggcgtcaaacgtatccattcagattagattccgtctccgccgcgacggcgcaagaggtgaagcagttcaccattacgtgtgcacagaagactacgccgcaacccgacatccactcgtgcacaggagtccccgttgaggtccggaaaatcttcacgggatttttacataggttcgtcgaagatcgacgtctccccggtgaggttgcagaggagttccttgccgctacacacgctggtggtatcgaggggcctgatcagtaa

SEQ ID NO: 123 - DNA, 747 bp, Toxoplasma gondii
agcactcagaagggcgccgtggagggacccctgccacaggaatggagacaaccgcccccaaagcctccccgtcgacatctggtcgagtcgatgcgcagcaattcgagttcgtctatcggcagaggaggagagagtatcgtcccagggcctgaaaacgttgccaatgacgggggtggttctccatctgacgatttgaagatcgtacagcccgaggatgtgccgcctggggggccggggccgaaagcacccggagttggtaccaggatgagaaactgggccactatatccccgagacaacaagcacaacgagccagagacatgtttggtcgcatgggccgcttcgttggaggtgcccgacgggctgttggacgcggttggcggcggttcaccacgggtatggcgggagtcactgaccgtagcgaaggcaggccggttgtcctggttcccaaggcctcgtcctcgctggtggatgtcatcaattttctgcgctcaggtgatgcctcagcattcgatgatcgagcgaagaaaattgtccgcctgggcgcgactgtgcagctgatccaacttctggcagcactgcacacgcgaaaagtagtgcacggaaagctggaacccaaaagcgttctgctcttcagtcatggccttctctacctctccgacctcggcagagcacgtcgccaaggggagaggttcacgacatcccgtccgagtaggattcctggtacgctcttggagcaggtggattga

SEQ ID NO: 124 - DNA, 1470 bp, Toxoplasma gondii
atgagcatcttgggaaagcatacggcgaccgtcggagaccgatacaaggtacgactcacaccagaatatggcccagggggcggttatgggcattgtcgcgattacctgctgcagagcgagagttgttggaggggggaccttacgtcgggggtcagaggagttctgacaaagaaaggaacgagagcgagaacgacaaaacgccacgatctcgtcgctgtgacgtcgggagaacattactggaaccaagggcttgtctaccacgaggaacagacagcgcctcctgttgcagcttctagcagtttcatgcagagcaccacttctcttgctacgcctgctgacctgaacgctccggttgacacccagggacagctcgatatcaacagcgtcctgaagaatcgacctcccgcagaggcacagctctcgcctcgcgagattgcagccaaaacccatttcgaagcaatgtttgccaaaggcctgcaactgacggttgaatccatattcaccggagaaacctttaccctgacaaaaccggcccgtttcttaggatggggatcaacggcgattgtttttggtttgcaccgcgtgaaagtgggcggagcaagtgctccacaacaattggcagctaagataaacgtcaggagtttgcaagaactgcaacatctttcctcgtctcagaaaaaaacggctcttgaggatatacaagaacgttttctccgggaagagagctcagcgaggaatgcgctgcaacatgtgaccccagaaacggctctggagcacggtgtcctcttcccagttgatgtttgccgtatttctaaattgttctccggattttgtgcaggcatttcctacgtaatacttcctgttctagcattgtttcctgtttttacttgcgacctccagcaggtcgttaagagtggcctatcacgtgcggcgaagttgtatatcacccggctgctgctgcaggctgttgcgtggctacatgccaatggcgtggctcacaacgacttgaagctagagaatgtccttctcagtgcagaaggaaaggctgtcattgcggattttggtttcgcagtgaagcttggaaccgcatcagccattcagttcactgctccctatttggatccgcaaaccgcagaggcagtgcctcaagagaaaacgaaaacgaccgcgagtgaggaaagagatgcatgggcgttagcaactctcctgtttttgctttggtgtggatcgtttccatacgtatcggatgagcaggccgacctccccaccagcgacttgctgaaattgctggtgacactgggaaagacagaaaagccagcgccgaacttccatctgtgtaaagacctcccacctgcggtgggacatctcgtaaccgcatttctacagtggaacagcgacaatcggtctcgccccggggatgttcttgacgatttccttgctgctacagtgtccgaaggagcgagcgcctaa

SEQ ID NO: 125 - DNA, 615 bp, Toxoplasma gondii
atgagcatcttgggaaagcatacggcgaccgtcggagaccgatacaaggtcgttaagagtggcctatcacgtgcggcgaagttgtatatcacccggcagctgctgcaggctgttgcgtggctacatgccaatggcgtggctcacaacgacttgaagctagagaatgtccttctcagtgcagaaggaaaggctgtcattgcggattttggtttcgcagtgaagcttggaaccgcatcagccattcagttcactgctccctatttggatccgcaaaccgcagaggcagtgcttcaaaagaaaacgaaaacgaccgcgagtgaggaaagagatgcatgggcgttagcaactctcctgtttttgctttggtgtggatcgtttccatacgtatcggatgagcaggccgacctccccaccagcgacttgctgaaattgctggtgacattgggaaagacagaaaagccagcgccgaacttccatctgtgtaaagacctcccacctgcggtgggacatctcgtaaccgcatttctacagtggaacagcgacaatcggtctcgccccggggatgttcttgacgatttccttgctgctacagtgtccgaaggagcgagcgcctaa

SEQ ID NO: 126 - DNA, 1707 bp, Toxoplasma gondii
atgagaaggctgctgctttcacctgttggtttcgtcattgtcctggctacactgttagaatgtcacccgcccgatcggtgtgttgctcatcatggcagcagcactgatgaatcgaacgtgtggtctcctcgaggggcccaatttgtacccggggcgtcagaggccgctgtaaaaaatcaggttggtattcctgacagtgcccttctgtggccgtcgcaagatgctacggaaaccgggctgcggcctacggagcaagtagaggcacgatcgtcatttcctgctgcaaagcaatatttatcagaggcggcacctgcgcgtggcgaccttccaccgcgcgccacaggccttctgagacgtcgaggagctagagtgcgaacggtgaaagctcacgagatcggtgtggagactccaaaaacgtatggctgggatcacagggttgtcgacagtgagaagcagaccacggcgcccgttgcagattcaagtggcttcattcaaatcccctcttcgcgcgccacgcctaccaccctgaacgctccgattgacctccagggacggcgcgatatcagaaacatcgtcaggaatcgacctcccgctgactcagatttatcgcgtagcgagattgcagccaaaaacggattcgagcgaagatttgtccggggtttacaactgaaggttgagtcattattcagcggaggtgttttcacgttgacaggaccggcgcagttcctgggaattgggtcaacggcaattgtgtatagtttgaataaggtgcaagcggacacagcaagtgcgccagaacgggtggcggttaagataagcatcaacaatctacaacgcctaagaagcctttctgtttttgacaggcaagagttgctagataagacgccagaacgctttgtctcaagcgaaggcgcagtgaggaaccttctgccaggtgtgacaccagaaacggctctggaacacggaattctgctaccgctggatatttgccgcgttactaacttgccgtccggttttcgtgctggcccggactacaagatgtttccccgtgtcgctttattccctgtcctcacttgcgatctttttcttgtcggtaggagccgtctatcacgtgctgcgaagttgcatcttacgcgacagctggtggtgtctgttgcgtggctgcatcgtcacggcgtcgctcacaatgacttgaagcttgagaatgtctttctcagtgaagaagggaaggctgttattggcgactttggtttcgcagcggaagttggaacctcaacaaaactccggtcaacccctgcctttctagacccgcaaaccgcggaagaatatcttcaacggaaaacggaaacggtcgtgactgaggaaagagatgcatgggctctgggaactatcatatttgtgatttggtgcggatcttacccgttcttttcatttgaagaggctgtccttcctcctgcagtgttgtggcaaaatgtggtgtttatgtcaaagaccactagacctgcacctccacttcagcattgtaaggggatgccatctccagtgaaagccctcataaccggctttctccagtggaactctgacgatcgacgccgccctcgtgatgtcgttgaaggattcctcgccgctacagcctcggaaccagcgacctcttcggcgactgcggcagaaggaagcgtcaggccgcgcgcatccagatctcagtga

SEQ ID NO: 127 - DNA, 1626 bp, Toxoplasma gondii
atgaaaaatactctgttgtcacctgttggtttctttaccgctctcgctgtacttatagaatgccacctgtgtgaccggtgtgttgctcatcatggcagcagcactgatggatcaggcttacggccccctcaagaggtcgactcggcaccacgaacgccgtcgatcgctgttaaagagcttgccacgtttcctggagatgacattcagacgtcatctcaagaattgcccggctatgaactttggaccagggaacaatcaggggcatctgtgcgtgttgggtttccgcagaacgccgaaagttttctgacacaaagagaagcgagagacgaaatcgcgaatgctcacgagctcgtcgctgtaactccagaaggcgatgcgtggaatcacagtggtgttgtccccgaggagcagactgtcacgcctgcttcaggtagcttcattcagaggcaagccgcgcatgcaccgccttcgactcgattgacgcccgtggaccgccgtggcaggtcacacacagtgtcagctgtcagacggcgggtgaccgtggaagacgttatgcgaccggaccaatcggcagccatgcatgcagtgttgtcagcatttggaggaggcctggttctgaaggctaagaacaaatggggtagaacacgttacacgctacagggacccgcaacattcttaggaatgggagccgagggcattgttgtacgtctaaatcaggtgaaaagcgaccgggaaagatcggtgacaccggtggcagtcaagctgtgcctcattcgtgcagcagtgttctcggggctgacatggtggagaaaacgaaggaccagaacagaactaatgaaactgtttctgtcgaacgagaattctgtgaagcgtgctctaccagatttggacccggccgaaatgctagagcacggtctcgtcgttccacatcatgctgagcttgtttccggtatgcccacgtggtttgccgcgggcgactcattttttgtattacccgttgtttctgtgtctcctctttttacttgcgacctcgaaacggtcgtgcaaaacccgttgaccttttgggcgaagatgtacattacccgccagttgctaaagagtattgcgtggatgcatcaaaaaggcatttctcataatgacttgaagcttgagaatgtcctgctcagtgcagacggaagggttgccatcggcgattttggtttttcaagccccttcggggcttcgttgcccatcaggggcactcatctatacatggaccccgacagctcagaagcattttttgaacaacgagagaacgaaatcactccccacagagatgcatgggcgactggagtccttcttttctatctgtggtgtggcgtgtttccattcgggttacagaatgtcgctaacgcgagtccgccacaggtgatgagggtcacagtcatgcatgcaaggactaccaggccgccgcccaacttccggctgtgtcggcgcatcccgcgtgaggttcggaacctcgttaccggatttctgcagtggaacgaggaagctcggcgtcttcccagcgatgttgccgacgcgttccttgccgctacggacgacggtggtagagaggcgcgtcggataagaacgcatcaattttga

SEQ ID NO: 128 - DNA, 600 bp, Toxoplasma gondii
cacgtgctgcgaaagttgcatcttacgcgacagctggtggtgtctgttgcgtggctgcatcgtcacggcgtcgctcacaatgacttgaagcttgagaatgtctttctcagtgaagaagggaaggctgttattggcgactttggtttcgcagcggaagttggaacctcaacaaaactccggtcaacccctgcctttctagacccgcaaaccgcggaagaatatcttcaacggaaaacggaaacggtcgtgactgaggaaagagatgcatgggctctgggaactatcatatttgtgatttggtgcggatcttacccgttcttttcatttgaagaggctgtccttcctcctgcagtgttgtggcaaaatgtggtgtttatgtcaaagaccactagacctgcacctccacttcagcattgtaaggggatgccatctccagtgaaagccctcataaccggctttctccagtggaactctgacgatcgacgccgccctcgtgatgtcgttgaaggattcctcgccgctacagcctcggaaccagcgacctcttcggcgactgcggcagaaggaagcgtcaggccgcgcgcatccagatctcagtga

SEQ ID NO: 129 - DNA, 2094 bp, Toxoplasma gondii
atgaggcgttcgaggtcaaaataccatgtcggtacttttgtcactgggtcagctgttcagcgactgacgctagttggaatgtattctgcagtgtgggtcacttcagcacatagctcgcctgtcaattctgcaactgtgtccccttcgttctttttcctgcattccaagccgcctcatggctcccccccaaatgagaggaccactggagagtccagtggctccaacgcctccatagagttgatggaaatgcagcctacgcaaccagagtccctttccccgaccgcgatggccgcacgtcgcccgaatgtaccaccacttcccgaagcaagcgggctgccgtcgcgcttgcctccatggcaggaaacgcccttttcgcctggaaagggtgacacacaggactctgcacaagtgagcactccttcaggcactccacgcgtgcagccgataagttccccgaagcgagaagctctttttcggatgtcccctcccccggtaccaaagcgttctctgcgcaggactctttcgcaatatttccgtgcacggaaacattctggtgtcccaaatccccgcgcctctgcacaactgccaacagccgatcgggagcaagcagtgaaccggccgcacagagcttcccggctgatgaagagttctccgtcttctgcaagtcaccaggcgcatggagcagcgcctcatcggcggcgcgctgctacctcaccccagcctcgcacacgcagagacccagcaggtccagttggtcggacgctgaggaattggattagcgaccgattatcccgcgcatacagacatgtcaggagcaggctgcgcacgggatatgccagactgctccggcaacttcattccatgacagagaaaattcccacaccaccagtacagctgcccggtcaggagtgcgtaaacgttttgggggctcatgtcgctcgacaggtggccgactggaggcaacaaatgggacgcacctcgctcgagtttgcagtggatgcagcttttcctcgcgataaagatatttcgttcaagtcatacatctcaaggaaaagtgtcactttacgcatggggaaggttttaggagggggtgcaaggagcattgttgtggaggtaacgcgagttgataccggcgacagatgggctttgaaagctttcctggttccacgggatgtcattggctcccctggaaccccaccgccttgggacgcaatcagcgaggaagcccatgcgataaaattactaccgcatacagttccagctgtagtttatcgaaacctgcggtttctagtccccgccgacgtgttgatatacgagggagacggaatggagaagctttggaacagacgcggaacgggctcaaacttctacacaacctatcttcttttcccaatagctcaaggttctctgttggacgctgtcagagcaatgttccgagatgcgagacggggcaatgctgaggtgtctgatggtgaggcagcacgcaccctggccgcgaatgtgagtttttcgattcagattatccgcctcacggcactgcttcacagccacggggttgtgcatggggacttccaaacgaagagcttttttttgtgtcaagacggctctctgttcctcggtagagtccgcagtctgacgcgagtaggagccccatatcgaagccccagttccgcgacagacagtcctcgctgcactcccccagaggtgctatcccccccagaaaatgcggcttttacattttcgctgaatgcctgggaacttggttgcattctctaccagctctggtgtgagggtcttccgtttggtctgtccccgacacccgagacacctgggaaaatcgtgctgcctcctgtcataacatcgccttatttgcagacaaagaaacgatctggcttagcgggcacatcaacacgtccagtcaagcatctggtgttcactggctgcgttaaaaacatgcccgttgaaatgcgacaattgattcgtcgcctgctccaggaagacccacacaaaaggttactcccgactgagattcttcgggatcctgttttccagaaactcgaagagcaatcgaggccaccggacgcccaggcttag

SEQ ID NO: 130 - DNA, 345 bp, Toxoplasma gondii
atgtggttatggtttccttgctgtcagtttatacatgtagccgcacaacacgaggaaaaacaatgcagtggaagtgcggtgcattcgggtcgaacgcgcgtagcggcacattttgttcgtctgaagacaacgcgcacgtgctgcaagacagaggatggtctttccgcagtcattccgctggtcactcaatgcgcatatcagccgggcaagccaagcaactcaggtggatatttcctggttctagaaattctgcctgatcgttgcttgtttttttctttgaccacatcaaatactctgacgggaaattcatctagtgtattggaaattaatgaattattgaattga

SEQ ID NO: 131 - DNA, 1485 bp, Toxoplasma gondii
atgacggtggcggtgaacgccatggtaacgtacggggagctcgagcgaatcttctgcacgtgcacatcacactatttctgctctaccgtgccacaatccggcgcagtaacttctgaaggagagctgcagaacgaaacaggacctgagggtgctcaggaagggcgaggaatggaaggtgatgatcccaccgtcctatcagatacggcgcgtgcgcctggtgacaggtcaaatgcgcagaatcgaggtgaaaagagcgacgtgaacctgcatgcgtctgttgtggtaccgcgggagacggacaatcacggggagttttcagtaacgctctacccaccacggccggcggaagaagacaagcagagtatggagcagagtgaaaggcccgagtcagaagccgtcctccaggcgaaggatgacgatgaggtatcagaggacaatgctgtgctgagcgaacggcaagagtggcaacgcatcgaaacagtgggtagggagtggttgaaatctcaggttgctgcatttgtgccgccagacgtcacaccttggcctgatccagattcgtcggtggatcggctgtttgcaaagaagtttccctccgggaaacttttaattctggaacctgatgagcccggcggaacgtatgaggtactttatcgaggtcccgtccttgggcgaggcacccgtgggattgccttcaagggaacaatggtggccaccggagaacactttgcagtgaagttgcaatttgtgcgcaagtctttattccgaaggcgtagttccttactacgggaccttgtcaaatatctacagcaagagtttgcagtccgcaatatgctggttgcggcatacggcgaagaaaacgtacaaaaaaagggtatggtgctgcctctaactgttcgccgacggcatgcgttcggcgactttattacaacgccctttagcttcacgatgttttggaatttccttgttttctatccattaatgaaatgcaccctaggaaatctcttggtaggcccacattggccgagagaagcgagattgttcgtagcgaaacgcctcatcgagattgctgcagcgcttcagcgtgcaggcgtattgcatcgagatatctttgagtcgaaaatccttcttcaagaaggttcaggtgatatttttttcgcggatttcggagacgcttcgggaaagcacatgcagagtggtatcgcttggatagagctacagcttgcagagtcctccaggctcggtcacttggtatactacgtttatacaggaaaaacgtttactaaattctggaagttcaggtgcactgataacgtgctttttcataacgatgtgaacgtgaaggacgtgccccttgctgataaactcatccggaatgcaatcaaagcattaataacctgcaataaggataagaggattctcccacaggaaattactgcatctattccgtttttccgggatgaacctgaattctatgagagcaaatga

SEQ ID NO: 132 - DNA, 1041 bp, Toxoplasma gondii
atgaggttcccggtggcttcgctctttgcggcaggttggctcggcctagccgtttctgctgaagaacccacgtgggagagtcttgaagagcgaggccgtgaactcgtcaagcaacatgtatccgcagtttcgggatatacgcacctttttgagcgcgagctgcacatggtgaatgctgcgactgcggtcctccctttgggcagcgttcttgaggtatgggggggcaagcgtctggttcgcggcagaaacgttgctgtgaccgaaggcgcggtcctgtttgacgtgacggacaacgaatcaaaacacgagtacacagccaagcttttttcagtggcgaacaaaagcgtggtcaaagccttgtcagctgtgtggaagtccttcaaggagaaaaacgtcgagaacgtgctggtcgagcgcttcgggtcggacgaaaatgtgctgaaaagcggctttctcgtgccggtaggcggaggcagcatagtgaacgttccccccgttcttcagccggcagggaagtggtcggatacttctttccttggtgcgctgattttgtacccccgggtggcacaaactctggacgccctactctggtctggcgctacgttggaaaaggctgcgaaattcttcctcattcgccgactcatcagaagtgtcggagacttgcatcgcagcgagctttgccacggcaatctccacccaacgaacattgtgattttagccgagtcgggggacattgcgctcacttctttcggtgacagctgcttccagtctttgtttgtgctttccgacgccatgggcgtgggcggtgccaagcaagacacagtgcgccttggcaatattgctcacgcgatctacactgggaaatacccttctgacgacctggacaaatgcaacgacaaccccgatttccctaaggctgatgacacggatgtgaacgacgtggtcattcgcgctgccatcatgcggctgctctgctgtggcgagtgccctatgcaaaagcctgccgacatggtggtcgcgagtccgcttttctcctcgtaa

SEQ ID NO: 133 - DNA, 5346 bp, Toxoplasma gondii
atgacgggcggcgcggctgcgccccgctcctcttcgggggcctctcgcacacctctctctctgcgtttctctctgacgcttctctgctctctcgtagccctcctcactctctctgtctctctctccactcccgcttctcacacctatgtcttcgccgtcgtcgccgccgacaccggcgtatcctctgtccctggacacgagcgtggagcttccaaggccgggccagacgcgaccgtgaaatctaagaggcgtcgtgagagatccaagaaaagcgatggaaacgtctccgcgaaaggcggtccagaagagtcagagatgcaggaccaatcgaccaccgacgtcgacttcgagacaacgcctcccgtggcacgtgatgcaaagactcaaagcaaacgtgatgcaacgacaagagggaagaagggcaagaggagcagaaggaagcgtggtgagaagtccaagaaaggcaatcgggaggcgggtgcgaaaggcgattcagaggcgtcactgacggaaggcgaatcgaaggccgacatcggaggggagacgacagcccaggtggaacgcgatgcgacaacaaaagggaagaagagtaagaggagaaggagcaggagcagaaggaagcgtggtgagaagtccaagaaaggcaatcgggaggcaggagcgaaaggcgattcagaggcgtcactgacggaaggcgaatcgaaggccgacatcggaggggagacgacagcccaggtggaacgcgatgcaacaagaaaagggaagaagagtaagaggagcaggagcaggagcaggaggaagcgtggtgagaagtccaagaaaggcaatcgggaggcggaagcgaaaggcgattctgaggcgtcactgacggaaggcgaatcgaaggccgacatcggaggggagacgacagcccaggtggaacgcgaggcaacaagaaaagggaagaagagtaagaggagaaggagcaggagcagaaggaagcgtggtgagaagtccaagaaaggcaatcgggaggcggaagcgaaaggcgattctgaggcgtcactgacggaaggcgaatcgaaggccgacatcggaggggagacgacagcccaggtggaacgcgatgcaacaagaaaagggaagaagagtaagaggagaaggagcaggagcagaaggaagcgtggtgagaagtccaagaaaggcaatcgggaggcggaagcgaaaggcgattctgaggcgtcactgacggaaggcgaatcgaaggccgacatcggaggggagacgacagcccaggtggaacgcgatgcaacaagaaaagggaagaagagtaagaggagaaggagcaggagcagaaggaagcgtggtgagaagtccaagaaaggcaatcgggaggcaggagcgaaaggcgattcagaggcgtcactgacggaaggcgaatcgaaggccgacatcggaggggagacgacagcccaggtggaacgcgatccaacaagaaaagggaagaagagtaagaggagcaggagcaggagcaggaggaagcgtggtgagaagtccaagaaaggcaatcgggaggcggaagcgaaaggcgattcagaggcgtcactgacggaaggcgaatcgaaggccgacatcggaggggagacgacagcccaggtggaacgcgatgcaacaacaaaagggaagaagagtaagaggagcaggagcaaggggaagcgtggtgagaagtctaaggaagccgatcttcaggagggtgcgaaaggcgattcagaggcgtcactgacggaaggcgaatcgaaggccgacatcggaggggagacgacagcccaggtggaacgcgatgcaacaacaaaagggaagaagagtaagaggagcaggagcaaggggaagcgtggtgagaagaccatgaaacgcgatacgcagttggctgggaaaggcgagccgcagacggccgcgattgtcgatgcgttgctccagatggagagcgggtcgttgaccgaaagggaagccgtggcaaaagatccgaaagaaggtaatgcagatgcgattgtcgggaccgactcgatcgaagcaagagtcgctgtcagcgcggagagaacggaagaaggcggcaagccagctgaggcggtttctgccgccgatgcttccaaatcggccgaacagggccggcagaagtccacgaagagggggaagaagcgccaccgcagaaaccgcaagaggagcaagtcgaagaagtctcacacaggctccagcgcgccgaccaccgctggtgtttccgcaccgacaggctcgctccccctgtcttccgagactccgacctctgcagaaaaggaggcgacagagtttctgctcagcagcggtttccccgccatctcagcggttctcgcgagtcgcgggtcgaagcttgacgccgcgaaaaagtcgaagggggcccccgggtcgacctcggtggtcgattcggagtcagtcgtttcaggacgcgagcgacagacgcacgatgagtttctgcctcccgtcgacgtcgcttccgtactcaggagggcgaacacaggggacgagtctctcttcgacccagacgaggcggataacaccagcgctgcgaccaaggcttttgaggtgacagatgacgaacccaaggctgaaaagccgagtgagactgaaacgcagttacaggagttgatggcgactgttcctcagcttgacgagctgttgcagaagttacctaagcttgaagagctcgcgacgagggttcctcagcttgaaaggctgtccgagagtgaggctcagcgtgaagcgtcaaacgagcatggtcgtcattctgccgagctgagagcgactggtccttcgctggatgagccaatgcgtgggcctcggtttggcgcgctgcaagcgaccgagtcgaagccagtcccgacgtctctcgcgaacgttctaatctcgtctcttgtcttccctcctcgcttgtcgttgctcttcgcccagcctgccagcggggcgacgcagaagaaggcgaccgttggagaacaaacttctccggcagactccccgcagacgaaaggagcgctgccgccgactgcagagttgccgaaggagcgggcagcggctaactcgaatgtcgagacaacagctaagtctcagggcgacagcgaagcggagaagctgttgaaagagttgagggagctcgagaaggggatgcagtcgcagacggtcggagacatcagttcgacgcggggtgagacagagtctgacaattcgcggactcggcccgagagcgatatcaagtaccggggtatgtcgggctcgttttccggttccggcccggcatcttcgcggcatatgaagcaccgcgtgagtattcgtggttcgtttggtgaagcggatgttgtccttctgcaccaaaagccacaacgcggcgacgagaccgccgagcgcaccagcagcttctcggcaaccgccgacaacagcgtctctgggcctcggcgccgcggcttcggccctgtcccgcgctccatcttcggttccgcgttcagcgacttggaagcggaactccaaggcgacgtcgccgagttcggtgacgcggccggcatcgaggagagcttcggcttcttcggcgagaggcgtggcgggggtgaccgcagccgccgcagccgcgagcggaggagcgaggaccggtcgcgacgcagacgcaagggcagcaagggccatcgcgaggccggttcgtctgcagcaaccccaggctcgagacacctgcggcaggtggaccgccgatccggattggcgcgcgccgaagacgtcgaccccgaagagagcagtgaggaaagtcgcggaagccgtgaagagcactccatgaaaaagctgccagcccgcgagcgcagctcccgatcggccggtccgagcctttcgcgcagacgttcgcgcctcgatcacgaactggagcagcgacgtgccaaggaagcgatggaggcggcagagacgttcgacgagcgcggtgggtacggcagcggaggtcacaactggctgacgcctgggccgcccctcgttgtgtctggtgagagctggccgagacgcgggctgctgtatccggagccggcgttgctgttggaggactctcgcgcggtgcagatgatggagaacgcggcgaaggaacttgcgcattcgcggcagacgccagttctcccgggcgaccgcggcagagtcgccgccgcgggtggcgcgttcgagaggctctttccacgtggtgccctgttcacactgcagccgacgcacggtcagccgttcgagccgaagaccttgaagcgcggccgcttcctcaaggccggcggaggcacccttctcttcgaagtctgggagggtcgaacgcgctgggccctgcgcctgcacctgacggagctgagtgagcgggagcggactgggctcgtgtcacgtttccccgtcgaccgagtttcgggtgccggcgtgagtgcatggcagcggacggcggatggcgtctgcgcagaggctgaggagctcgagctgcatgcagtgcggattctcatgcagcagaacgagcaaccgcgggacctgttctgccgcgagagaatcgcgctgcccgtagccgtgggcgaagtctcctcgctgcccaaggtgacgcagctccgcgacggcgagcacgtgaccaacatcggaggcctgtacccgctcgcggcatgcgacatgcgggagctggcggagcagtacgtgatgcccgaggaagtgaagctcgaggccgtgcggcagatggttgcggcggtcggccgtctgcactcgcgtggagtcgtccacctggacctgaagctcgagcactttctgctcgacaaccatggcaaagtgtaccttggagacttgtcgacgagcgagaagatcacgggcgtcaacgtcgagccgaccagctgcgagttcggctccctcgagagtctgagccccgagcacctcgcctgctgggcgcgacagcaaaggaagttcacgccctcaatggccaccgactcgtggtctctcggtgtcgccatcgtccagctatggtgcggcgaagcgcccttccgcgtccccgacgcgctctggagcaatggcccggtcgccgtcgcgcagtacctcgaccaactcctcagacggacagatggggagatcgacttctccggctgtccaggaggcgacatcacgaaccctgaactgaagcgcattgtgactggcctcctcacttacgaccgcgtcaagcgctggctgccgcttgacgtcctcttcacctctcctctgatgatcgaccccgctgtggccagaaacgcatcgagcccttccgtttctcccttgacctccgggaaacgctcgagcaaaaacagaaaaagaaataactga

SEQ ID NO: 134 - DNA, 1617 bp, Toxoplasma gondii
atggcgggtccccgatctcctctccgctttgttcttcttctctctctacttgcactgaaagtcttcgtcgactctccttcagtgcttcccgcgctcgcgggcgagtctgcggctgacttgtccacttccattgacgacgatgacttcgacagttcctcgggtgtcgcggtccccagcttgaccaccgagcaggaagtgcaccggacccaagaggctctcgatccggaggtggttgacctcggaaagcccagtccgtacgcagaggaggagagcgggattctggcggcgtctgcgtcgcgactgaacttcagtccgatgatggcgctgaagagtttcttccacatgggaggcgagacaggcgccccaggccacagatcccgcatcgacgttgtcaaaaacgcggctatggaccacgtccaccgtctcctgcagatgctgcgcgagtcgagtgaggatgaagaagaacggctcctctttgctgacagaagagaaaagaaagtcatcactgttaatgagtggtacaccacgacggtcgccgccacgatgctcggcaggcggcccacagacgaagacgctatcctcgtcagtgcacctgcgacgagtcgcccaaacgttcgcataaaagctgtattcgacggccatgcaggggaggccacctcccagtactgcgccaagcacgccgccaaacacttggggaagctctccgagttcaccttcgcggaagtgaagaaagcgtgtctctctctggacgctgagatcatccgaaagctgggaccgaagcacgttgcagggtccacaggcatcatcgtcgcgatcgagcgtctcagcgcacctgtggtcgagaacgttgtggggcgggagatcgttcctcgtgctcacgaagaaacgttcgtgcctctggagaagctgattcaagaggaagaggaggcagaacatccggagcttgtcggccgctacccccgcgtccccgacgtgcagcaaaagacgattcctgcaggctctttcctcgtcaccgccatcaacataggcgattcgagagcgacgctgatccacagtgacggaggactgacgcgactgtcgaaagatcacaagccgaaccatccgactgaggcctctcgcatcgagaaggccggggggtctgtcgaaacgttcgacgtccctcgcgtggacggtgttctggcgctttcacgagccttcggagactctgacttcaaaatgaatcccaaccttcctccagaagagcagaaggtcattgccgttccagacgtcaggcagttctacgcgctgtcgagcgatcttctcttgctggcgtgcgatggtgtgtatgaaccaagcggcatggactgggcgtatgttcgagacctcactgttgctgagatgcagaggtcaaagggggatttggaggaggtggcggctcgcgtgatggattacgcctatgacatgaattctcaggataacatcagcgtcatgctcgttgctttccataaccaagaagttgaacaccctactgctgtctacaaggtcgtctctggccaaggtgtagttctgtcggagacacgacggccgagcgacgcggaggacgacagcgtcgagggcgacacagtttccctgttttag

SEQ ID NO: 135 - DNA, 1440 bp, Toxoplasma gondii
atgttttcgtgcgagtgtcacttttgttgtgcaaacccaaataaatctctgcctgtcattgaacaagtaactgcatacacttgtgccaaagctaccgcagccatggcttcgttaagagtgttggcgctggcatgccttccgctcttcgcagtgctccatgcggacgccaagacattgctggggaaagtcaaaagagcaacagggatgggagtgggagaaggtccttcagttgccaaaaagccgaaatacacagcgacggtcccaggattcactccaccgtctggcgatcagcggatgaatgaattcatggctgtggacacatcaggggaattcatgcgtcatctctacatcgaagaagggcgcacagtgtgtgctagtgccacctcccgcaatagaagaccgacgagcgagagcccccacagcgatgatgtggtggtcgtcgaaggaatgctccggggaagaccagaaacgcgagtacatgccatgttcgacggattccagggacgccacagtgctatgtggctcgcgcagaatgtgatgaactatctcaacgatctgagagatgtcaacgaagaggagattactcggcagttcgagagaatggatggagacttaagagcagcgaatctccctggcgggtcgtcagctctaatcatttttgtacggtatgaaaaaaaaccgactgaggcccgggtggtcggtaggcagatagtaccggaaggtgccaaggagttcacgtcagtcgctgaggcgctaggaggtccgctcatgccagtggtagccatgaacttcaggcgcgatcccagagctgccaaggggatctataccatacatgtcgctagcttaggcaactctcgttgtgtacttaagtctggcagaactgcgattcacttgtcgactcctcacactgcctcgtctcataaggaaagacaccgcgtccaggcagcaggaggggtattcactacagtcaatggcgagcttttgctaggcggagttgtccctatgacgagggcattcggcagttttgacttcaagaaaggaggacaagggaaacttcaacaggatttggtgtctgcagttccagacgtaacgacgttttttgcatatcctggtgacgatatcgtcgcgggtactgcaggcgcattcgctcatttcagatcacatgcggcaatagcggctgcgatcgctctctacccggtcagtccagaaacagttcttgacgcagcaaaagcaatggtggtgaatgcaaaaaggaggaaggtaaccaaaaacatcagcaccttcgtaaggcatctccccgagtcacgcacaaggagtcaaaagatgctggagggcacctccggagagaatggcgaagaagacttctcgatcgacaggacaaacgagcttacacaggcgcttcaggcgggatttttttccttcttattgtattatccatga

SEQ ID NO: 136 - DNA, 961 bp, Toxoplasma gondii
atgacgggcggcgcggctgcgccccgctcctcttcgggggcctctcgcacacctctctctctgcgtttctctctgacgcttctctgctctctcgtagccctcctcactctctctgtctctctctccactcccgcttctcacacctatgtcttcgccgtcgtcgccgccgacaccggcgtatcctctgtccctggacacgagcgtggagcttccaaggccgggccagacgcggctgtgaaatctaagaagcgtcgtgagagatccaagaaaagcgatggaaacgtctccgcgaaaggcggtccagaagagtcagagatgcaggaccaatcgaccaccgacgtcgacttcgagacaacgcctcccgtggcacgtgatgcaatgactcaaagcaaacgcgatgcaacgacaagagggaagaagagtaagagtaagaggagcaggagcagaaggaagcgtggtgagaagtccaagaaaggcaatcgggaggcgggagcgaaaggcgattcagaggcgtcactgacggaaggcgaatcgaaggccgacatcggaggggagacgacagcccaggtggaacgcgatgcaacaacaaaagggaagaagagtaagaggagcaggagcaggagcaggaggaagcgtggtgagaagtccaagaaaggcaatcgggaggcgggagcgaaaggcgattctgaggcgtcactgacggaaggcgaatcgaaggccgacatcggaggggagacgacagcccaggtggaacgcgatgcaacaacaaaagggaagaagagtaagaggagaaggagcaggagcaggaggaagcgtggtgagaagtccaagaaaggcaatcgggaggcgggagcgaaaggcgattctgaggcgtcactgacggaaggcgaatcgaaggccgacatcggaggggagacgacagcccaggtggaacgcgatgcaacaacaaaagggaagaaga

SEQ ID NO: 137 - DNA, 3963 bp, Toxoplasma gondii
ggagcgaaaggcgattctgaggcgtcactgacggaaggcgaatcgaaggccgacatcggaggggagacgacagcccaggtggaacgcgatgcaacaacaaaagggaagaacagtaagaggagcaggagcaagggaaagcgtggtgagaagtctaaggaagctgatcttcaggcgggtgcgaaaggcgattcagaggcgtcactgacggaaggcgaatcgaaggccgacatcggaggggagacgacagcccaggtggaacgcgatgcaacaacaaaagggaagaagagtaagaggagcaggagcaaggggaagcgtggtgagaagtctaaggaagccgatcttcaggagggtgcgaaaggcgattcagaggcgtcactgacggaaggcgaatcgaaggccgacatcggaggggagacgacagcccaggtggaacgcgatgcaacaacaaaagggaagaagagtaagaggagcaggagcaaggggaagcgtggtgagaagaccatgaaacgcgatacgcagttggctgggaaaggcgagccgcagacggctgcgattgtcgatgcattgctccagatggagagcgggtcgttgaccgaaagggaagccgtggcaaaagatccgaaagaaggtaatgcagatgcgattgtcgggaccgactcgatcgacgcgagagtcgctgtcagcgcggagagaacggaagaaggcggcaagccagctgaggcggtttctgtcgccgatgcttccaaatcggccgaacagggccggcagaagtccacgaagagggggaagaagcgccaccgcagaaaccgcaagaggagcaagtcgaagaagtctcacacaggctccagcgcgccgaccaccgctggtgtttccgcaccgacaggctcgctccccctgtcttccgagactccgacctctgcagaaaaggaggcgacagagtttctgctcagcagcggtttccccgccatctcagcggttctcgcgagtcgcgggtcgaagcttgacgccgcgaaaaagtcgaagggggcccccgggtcgacctcggtggtcgattcggagtcagtcgtttcaggacgcgagcgacagacgcacgatgagtttctgcctcccgtcgacgtcgcttccgtactcaggagggcgaacacaggggacgagtctctcttcgacccagacgaggcggataacaccagcgctgcgaccaaggcttttgaggtgacagatgacgaacccaaggctgaaaagccgagtgagactgaaacgcagttacaggagttgatggcgactgttcctcagcttgacgagctgttgcagaagttacctaagcttgaagagctcgcgacgagggttcctcagcttgaaaggctgtccgagagtgaggctcagcgtgaagcgtcaaacgagcatggtcgtcattctgccgagctgagagcgactggtccttcgctggatgagccaatgcgtgggcctcggtttggcgcgctgcaagcgaccgagtcgaagccagtcccgacgtctctcgcgaacgttctaatctcgtctcttgtcttccctcctcgcttatcgttgctcttcgcccagcctgccagcggggcgacgcagaagaaggcgaccgttggagaacaaacttctccggcagactccccgcagacgaaaggagcgctgccgccgactgcagagttgccgaaggagcgggcagcggctaactcgaatgtcgagacaacagctaagtctcagggcgacagcgaagcggagaagctgttgaaagagttgagggagctcgagaaggggatgcagtcgcagacggtcggagacatcagttcgacgcggggtgagacagagtctgacaattcgcggactcggcccgagagcgatatcaagtaccgggggatgtcgggctcgttttccggttccggcccggcatcttcgcggcatatgaagcaccgcgtgagtattcgtggttcgtttggtgaagcggatgttgtccttctgcaccaaaagccacaacgcggcaacgagaccgccgagcgcaccagcagcttctcggcaaccgccgacaacagcgtctctgggcctcggcgccgcggcttcggccctgtcccgcgctccatcttcggttccgcgttcagcgacttggaagcggaactccaaggcgacgtcgccgagttcggtgacgcggccggcatcgaggagagcttcggcttcttcggcgagaggcgtggcgggggtgaccgcagccgccgcagccgcgagcggaggagcgaggaccggtcgcgacgcagacgcaagggcagcaagggccatcgcgaggccggttcgtctgcagcagccccaggctcgagacacctgcggcaggtggaccgccgatccggattggcgcgcgccgaagacgtcgaccccgaagagagcagcgaggaaagtcgcggaagccgtgaagagcactccatgaaaaagctgccagcccgcgagcgcagctcccgatcggccggtccgagcctttcgcgcagacgttcgcgcctcgatcacgaactggagcagcgacgagccaaggaagcgatggaggcggcagagacgttcgacgagcgcggtgggtacggcagcggagggcacaactggctgacgcctgggccgcccctcgtggtgtctggtgagagctggccgagacgcgggctgctgtatccggagccggcgttgctgttggaggactcccgcgcggtgcagatgatggagaacgcggcgaaggaacttgcgcattcgcggcagacgccagttctcccgggcgaccgcggcagagtcgccgccgcgggtggcgcgttcgagaggctctttccacgtggtgccctgttcacactgcagccgacgcacggtcagccgttcgagccgaagaccttgaagcgcggccgcttcctcaaggccggcggaggcaccctgctcttcgaagtctgggagggtcgaacgcgctgggccctgcgcctgcacctgacggagctgagtgagcgggagcggactgggctcgtgtcgcgtttccccgtcgaccgagtgtcgggtgccggcgtgagtgcatggcagcggacggcggatggcgtctgcgcagaggctgaggagctcgagctgcatgcagtgcggattctcatgcagcagaacgagcaaccgcgggacctgttctgccgcgagagaatcgcgctgcccgtagccgtgggcgaagtctcctcgctgcccaaggtgacgcagctccgcgacggcgagcacgtgaccaacatcggaggcctgtacccgctcgcggcatgcgacatgcgggagctggcggagcagtacgtgatgcccgaggaagtgaagctcgaggccgtgcggcagatggttgcggcggtcggccgtctgcactcgcgtggagtcgtccacctggacctgaagctcgagcactttctgctcgacaaccatggcaaagtgtaccttggagacttgtcgacgagcgagaagatcacgggcgtcaacgtcgagccgaccagctgcgagttcggctccctcgagagtctgagccccgagcacctcgcctgctgggcgcgacagcaaaggaagtttacgccctcaatggccaccgactcgtggtctctcggtgtcgccatcgtccagctatggtgcggcgaagcgcccttccgcgtccccgacgcgctctggagcaacggcccggtcgccgtcgcgcagtacctcgaccaactcctcagacggacagatggggagatcgacttctccggctgtccaggaggcgacatcacgaaccctgaactgaagcgcattgtgactggcctcctcacttacgaccgcgtcaagcgctggctgccgcttgacgtcctcttcacctctccgctgatgatcgaccccgctgtggccagaaacgcatcgagcccttccatttctcccttgacccccgggaaacgctcgagcaaaaacagaaaaagaaataactga

SEQ ID NO: 138 - DNA, 660 bp, Toxoplasma gondii
atggcggctaaagatgaatactacgattatctctacaagattgtcctgattggagacagtggcgtcgggaaatccaacatgctttctcgatttacgcgggacgagttcaacttggagagcaaatcaacgatcggcgttgagttcgcaacaaagagcgtatacttagatgagggcaaggtcatcaaggcacagatttgggataccgcgggacaagagagatatcgagccattacttccgcgtactacaggggagctgttggagcacttcttgtgtacgacatcacgaaacgtcagtcgttcgagaatgtagaaagatggcttaaagagcttcgcgaccatgcggaccccaacatcgtcattctgctcgtgggaaacaaaagcgatctgaagcatctgcgtgctgtttccgttgaggaggcgacaaagtttgcgaacagagagcacctcgccttcatcgagacttccgcgttggatgcgacaaacgttgagcaggcgttccaccagattctggcggaaatctatcttcttcggcagaagaagcaaatcgaggataacccccagtcgactactcaaccagggagaggacagaaaatccaccttgatgaggagcgaacagatagccaaatacggcaaagcagacgtggctgctgttccgcctga

SEQ ID NO: 139 - DNA, 997 bp, Toxoplasma gondii
atggcgacggatgccaggagactagccaccggccttgtcttgttaacgtgcctggtatggcgggcaggcgcatttcagccatcgcctccaacctccagagccaatgagctgacgtcgggcattcccggtgaggctccggagaacactgcggaggagcgaggaatcggagacatctcagattaccctcattcagtggtcgacgatgcggccgatattagcggtggcacagttcccgaagggccaggatcgcctgccagcacatctgggtctgggggtgtcttcaacagattatttagcagatttcgtcaggtaagtggatccacacaaggcacgggagtcgctgacgaacctcagcaggggccgcgaccgtcacttcgggagagacttgctcagcacttccgcaggctgagggtcttgtttgggcgccttatgccgaggtggggctttggattcggtcgccatgtaggcaggtggtggccaaggaggtggccggacccgctgtttccttgtatggaaccgggggatgagttcattcgctctagactgagtcagacagaatatcggactcgcttttaccgccggggaatggtggaagggtacgaggtggaggttaaagctgtgacggcagctatttggccccagaatactgccagagaagtggcgtcgctgttggacagaagaaaaaggacactgagagtggttggggcttttggacgaagtgttcgatctgtcttgtatctggcgcaagatgtggagagtcaagagcgcatggccatcgaagtcttcactctgacgagcgggaacactgtatcagaccttgctcgtgtgcatgacaacttgtttgctatgacggggttggttagtgaaagcccccagcaggcacgggacatctgcagactccttcttcccaccgatgctgtgacagttccgactcaaccccccttcgaggaactgaatccaggacagagcaattatccagtagcgaactattcctcct

SEQ ID NO: 140 - DNA, 669 bp, Toxoplasma gondii
atgtttccccgtgtcgctttattccctgtcctcacttgcgatctttttcttgtcggtaggagccgtctatcacgtgctgcgaagttgcatcttacgcgacagctggtggtgtctgttgcgtggctgcatcgtcacggcgtcgctcacaatgacttgaagcctgagaatgtctttctcagtgaagaagggaaggctgttattggcgactttggtttcgcagcggaagttgggacctcaacagaactccggtcaacccctgcctttctagacccgcaaaccgcggaagaatatcttcaacggaaaacggaaacggtcgtgactgaggaaagagatgcatgggctctgggaactatcatatttgtgatttggtgcggatcttacccgttcttttcatttgaagaggctgtccttcctcctgcagtgttgtggcaaaatgtggtgtttatgtcaaagaccactagacctgcacctccacttcagcattgtaaggggatgccatctccagtgaaagccctcataaccggctttctccagtggaactctgacgatcgacgccgccctcgtgatgtcgttgaaggattcctcgccgctacagcctcggaaccagcgacctcttcggcgactgcggcagaaggaagcgtcaggccgcgcgcatccagatctcagtga

SEQ ID NO: 141 - DNA, 1369 bp, Toxoplasma gondii
atgagaaggctgctgctttcacctgttggtttcgtcattgtcctggctacactgttagaatgtcacccgcccgatcggtgtgttgctcatcatggcagcagcactgatgaatcgaacgtgtggtctcctcgaggggcccaatttgtacccggggcgtcagaggccgctgtaaaaaatcaggttggtattcctgacagtgcccttctgtggccgtcgcaagatgctacggaaaccgggctgcggcctacggagcaagtagaggcacgatcgtcatttcctgctgcaaagcaatatttatcagaggcggcacctgcgcgtggcgaccttccaccgcgcgccacaggccttctgagacgtcgaggagctagagtgcgaacggtgaaagctcacgagatcgttgtggagactccaaaaacgtatggctgggatcacagggttgtcgacagtgaggagcagaccacggtgcccgttgcagattcaagtggcttcattcaaatcccctcttcgcgcgccacgcctaccaccctgaacgctccgattgacctccagggacggcgcgatatcagaaacatcgtcaggaatcgacctcccgccgactcagatttatcgcctagcgagattgcagccaaaaacggattcgagcgaagatttgtccagggtttacaactgaaggttgagtcattatttagcggaggtgttttcacgttgacaggaccggcgcagttcctgggaattgggtcaacggcaattgtgtatagtttgaataaggtgcaagcggacacagcaagtgcgccagaacgggtggcggccaagataagcgtcaggaatctaaattctctaagagacgcttctgcgtctgagagacaacaggtgctagatcaggctccagaacgctttgtctcaagcgaaggcgcagtgaggaaccttctgccaggcgtgacaccagaaacggctctggaacaaggaattctgctaccgctagatatttgccgcgttactaacatgccgtctaattttcgtgctggcccggactacaacgtgtttccccgtgttgctttattccctgtcctcacttgcgatctttttcttgtcgttgagagcggtctgtcacgtgctgcgaagttgcatcttacgcggcagctggtggtgtctgttgcgtggctgcatcgtaatggcgtcgctcacaatgacttgaagcttgagaatgtctttctcagtgaagaagggaaggctgttattggcgactttggtttcgcagcggaagttgggacctcaacaagactccaatcaacccctacctttctagacccgcaaaccgcggaagaatctcttcaacggaaaacggaaacggtcgtgactgaggaaagag

SEQ ID NO: 142 - DNA, 1056 bp, Toxoplasma gondii
gtccggggtttacaactgaaggttgagtcattattcagcggaggtgttttcacgttgacaggaccggcgcagttcctgggaattgggtcaacggcaattgtgtatagtttgaataaggtgcaagcggacacagcaagtgcgccagaacgggtggcggttaagataagcatcaacaatctacaacgcctaagaagcctttctgtttttgacaggcaagagttgctagataagacgccagaacgctttgtctcaagcgaaggcgcagtgaggaaccttctgccaggtgtgacaccagaaacggctctggaacacggaattctgctaccgctggatatttgccgcgttactaacttgccgtccggttttcgtgctggcccggactacaagatgtttccccgtgtcgctttattccctgtcctcacttgcgatctttttcttgtcggtaggagccgtctatcacgtgctgcgaagttgcatcttacgcgacagctggtggtgtctgttgcgtggctgcatcgtcacggcgtcgctcacaatgacttgaagcttgagaatgtctttctcagtgaagaagggaaggctgttattggcgactttggtttcgcagcggaagttggaacctcaacaaaactccggtcaacccctgcctttctagacccgcaaaccgcggaagaatatcttcaacggaaaacggaaacggtcgtgactgaggaaagagatgcatgggctctgggaactatcatatttgtgatttggtgcggatcttacccgttcttttcatttgaagaggctgtccttcctcctgcagtgttgtggcaaaatgtggtgtttatgtcaaagaccactagacctgcacctccacttcagcattgtaaggggatgccatctccagtgaaagccctcataaccggctttctccagtggaactctgacgatcgacgccgccctcgtgatgtcgttgaaggattcctcgccgctacagcctcggaaccagcgacctcttcggcgactgcggcagaaggaagcgtcaggccgcgcgcatccagatctcagtga

SEQ ID NO: 143 - DNA, 330 bp, Toxoplasma gondii
atgcagagcaccacttctcttgccacgcctgctgacctgaacgctccggttgacacccagggacagctcgatatcaacagcgtcctgaagaatcgacctcccgcagaggcacagctctcgcctcgcgagattgcagccaaaacccatttcgaagcaatgtttgccaaaggcctgcaactgacggttgaatccatattcaccggagaaacctttaccctgacaaaaccggcccgtttcttaggatggggatcaacggcgattgtttttggtttgcaccgcgtgaaagcgggcggagcaagtgctccacaacaattggcagctaagataaac

SEQ ID NO: 144 - DNA, 1064 bp, Toxoplasma gondii
ggctgggatcacagggttgtcgacagtgagaagcagaccacggcgcccgttgcagattcaagtggcttcattcaaatcccctcttcgcgcgccacgcctaccaccctgaacgctccgattgacctccagggacggcgcgatatcagaaacatcgtcaggaatcgacctcccgctgactcagatttatcgcgtagcgagattgcagccaaaaacggattcgagcgaagatttgtccggggtttacaactgaaggttgagtcattattcagcggaggtgttttcacgttgacaggaccggcgcagttcctgggaattgggtcaacggcaattgtgtatagtttgaataaggtgcaagcggacacagcaagtgcgccagaacgggtggcggttaagataagcatcaacaatctacaacgcctaagaagcctttctgtttttgacaggcaagagttgctagataagacgccagaacgctttgtctcaagcgaaggcgcagtgaggaaccttctgccaggtgtgacaccagaaacggctctggaacacggaattctgctaccgctggatatttgccgcgttactaacttgccgtccggttttcgtgctggcccggactacaagatgtttccccgtgtcgctttattccctgtcctcacttgcgatctttttcttgtcggtaggagccgtctatcacgtgctgcgaagttgcatcttacgcgacagctggtggtgtctgttgcgtggctgcatcgtcacggcgtcgctcacaatgacttgaagcttgagaatgtctttctcagtgaagaagggaaggctgttattggcgactttggtttcgcagcggaagttggaacctcaacaaaactccggtcaacccctgcctttctagacccgcaaaccgcggaagaatatcttcaacggaaaacggaaacggtcgtgactgaggaaagagatgcatgggctctgggaactatcatatttgtgatttggtgcggatcttacccgttcttttcatttgaagaggctgtccttcctcctgcagtgttgtggcaaaatgtggtgtttat

SEQ ID NO: 145 - DNA, 1617 bp, Toxoplasma gondii
atggcgacggacgccaggagactagccaccggccttgtcttgttaacgtgcctggtatggcgggcaggcgcatttcagccatcgcctccaaccgccagagccaatgagctgacgtcgggcattcccggtgaggctccggagaacactgcggaggagcgaggaatcggagacatctcagattaccctcattcagtggtcgacgatgcggccgatattagcggtggcacagttcccgaagggccaggatcgcctgccagcacatctgggtctgggggtgtcttcaacagattatttagcagatttcgtcaggtaagtggatccacacaaggcaggggagtcgccgacgaacctcagcaggggccgcgaccgtcacttcgggagagacttgctcagcacttccgcaggctgagggtcttgtttgggcgccttatgccgaggtggggctttggattcggtcgccatgtaggcaggtggtggccaaggaggtggccggacccgctgtttccttgtatggaaccgggggatgagttcattcgctcccgactgagtcagacagaatatcggactcgcttttaccgccggggaatggtggaagggtacgaggtggaggttaaagctgtgacggcagctatttggccccagaatactgccagagaagtggcgtcgctgttggacagaagaaaaaggacactgagagtggttggggcttttggacgaagtgttcgatctgtcttgtatctggcgcaagatgtggagactcaagagcgcatggccatcgaagtcttcactctgacgagcgggaacactgtatcagaccttgcgcgtgtgcatgacaacttgtttgctatgacggggttgcttagtgaaagcccccagcaggcacgggacatctgcagactccttcttcccaccgatgctgtgacagttccgtctcaaccccccttcgaggaactgaatccaggacagagcaactatccagtagcgaactatttcctcctcatgcccccgcctataatgagccttgagccgctccatagaatagtcgatcacgaagaattcctcacgggcgacatcggccgagtagtacgtatggtcttgactgcggaactcataagaattgcagcaaacattcagatccgcggacttgtgcacggacgtatcacatcagaaaaccttttcattatgcctgatggccgcctgatgctgggggatgtatccgcgttgaggaaggtcggaacccgaggaccggtgtcgagtgttccagtcacctatgccccacgagagttcttgtcgaacacagagacggcggcatttacacacgcactcgatgcgtggcaattaggcctcgttatacatcgaatttggtgcctcatcttgcctttcggactggtgacacctcgaatgaagagatcagggaggaggccaagcatgcgtgttccaggattagacgttctgtcagtcgaagcgtgcacgccaatgcccgacgctgtagagatgctagtgaggcactttctcaatttcaacactcgaaaacgcctgcttcccctgacagccatggggacgcctgaattccgccagctacagctcgacatatccaccagcctgtcatcaaaataa

SEQ ID NO: 146 - DNA, 1617 bp, Toxoplasma gondii
atggcgacggacgccaggagactagccaccggccttgtcttgttaacgtgcctggtatggcgggcaggcgcatttcagccatcgcctccaaccgccagagccaatgagctgacgtcgggcattcccggtgaggctccggagaacactgcggaggagcgaggaatcggagacatctcagattaccctcattcagtggtcgacgatgcggccgatattagcggtggcacagttcccgaagggccaggatcgcctgccagcacatctgggtctgggggtgtcttcaacagattatttagcagatttcgtcaggtaagtggatccacacaaggcaggggagtcgccgacgaacctcagcaggggccgcgaccgtcacttcgggagagacttgctcagcacttccgcaggctgagggtcttgtttgggcgccttatgccgaggtggggctttggattcggtcgccatgtaggcaggtggtggccaaggaggtggccggacccgctgtttccttgtatggaaccgggggatgagttcattcgctacctggttagagcgaagaaagaccggattggtttctaccgccggggaatggtggaaggatacgaggtggaggttaaagctgtgacggcagctatttggccccagaatactgccagagaagtggcgtcgctgttggacagaagaaaaaggacactgagagtggttggggcttttggacgaagtgttcgatctgtcttgtatctggcgcaagatgtggagactcaagagcatatagctgcagaggtcttcactctgaccggcgagagtcgagggttggaccttcagcgtgtgcatgacaacttgtttctctcagcggcgtttcttgctgagagccctgtgctgtcaagggacaggaggcgtcttttgcttccctacgatgctgtgacagttccgtctcaaccccccttcgaggaactgaatccaggacagagcaactatccagtagcgaactatttcctcctcatgcccccgccaatgatgagccttgagacgctccatagaatagtcgatcacgaagaattcctcacgggcgacatcggccgagtagtacgtatggtcttgactgcggaactcataagaattgcagcaaacattcagatccgcggacttgtgcacggacgtatcacatcagaaacccttttcattatgcctgatggccgcctgatgctgggggatgtatccgcgttgaggaaggtcggaacccgaggaccggtgtcgagtgttccagtcacctatgccccacgagagttcttgtcgaacacagagacggcggcatttacacacgcactcgatgcgtggcaattaggcctcgttatacatcgaatttggtgcctcatcttgcctttcggactggtgacacctcgaatgaagagatcagggaggaggccaagcatgcgtgttccaggactagacgttctgtcagtcgaagcgtgcacgccaatgcccgacgctgtagagatgctagtgaggcactttctcaatttcaacactcgaaaacgcctgcttcccctgacagccatggggacgcctgaattccgccagctacagctcgacatatccaccagcctgtcatcaaaataa

SEQ ID NO: 147 - DNA, 1578 bp, Toxoplasma gondii
atgtcgtcatccagattggtactcgtttccaagatggtcgatagctgtgcccggctggcgtgcttttgcataggattatttttctgtctcgctgtctggcagcatcaagcaggtcatgcctacagtgcaactcaccaccatgcagtgaacagtgacaacaaatccttcaacgactctgcgccccactggacccttaaccaggtgctccgggatggcacggtgcagagtgaatccccatcctacctgcagcacagttcgcttccatctaacatcagtccagcactcgaactggctgcgctaggtcaggatcccgtgagacgtcgcccacaaccggtgcaagtggccaggactggtaccactacgacaggcagagtgcagctcggtcgccaagtcgcgagagttacaccggaggagcttgcaacgatggtagagccatccttgaaagacttgttgaatagaagcactctccctcaaacaccgttcgtgattgaaaccttgcgagtgttcgcaacgccagagggtgacacctctctcccatacaccatggagcgcattctcggggcaggcgctgcttccattgtcatccaggctgtacaggaaactgtcccacaagagccagcacggcggcgacggtcctggttttcgaggttgaggaagtcacacgctccagcggatactcgtcctcgtgtagcgctgcggtttcctgtggtggacgtgcgtaagaagcagcaagaactacccgaagtgcctgaggcagaattactgtcccagctggcggaggagcagttgcgactggaaatccacaaagttgcactggtttcgtcagctgctgggaccgagggcaattttgatagtgagtggggctttgcgctacccttcagggtcggacgtctctccaacgaggggttggtgctggcaatggatgggtcaggaaaggctattctaaattttgttacggtgtcacctgctatgatgtgcgatcttcacactcttcgatccagttcacgcacaccagccatggacgagtttgtggtcatgcgcgttttacaacttgccgcgaacttggagagattacagctgacgcaccttgatataacggatgaaaatgtgctcgtcggtcgtgacgggcaactgtttctggggggtttccagcatgtccgagcaaaggacggaggtatttcttgcgggaaaatcccgtctgtcaccttcactgacccgcggctagcccactgcgccgtcaataacccaggcagttatgctgccgttaacccagctgttgacgcatggatggctggaatgatgttgctacgatggttctgcggcgatgtttttttcaaccgaagatcatctcttgctgagccgcgccaagcggttcaggtcctggctcagttacaagcagacttcattgctgccaacgactatatggtctctttccctgcattcacacaatgggacagatgcagacatcacgtcaacgaaagattccagtttatcattcagagcctactcgatgtcaacccctacaaaaggggtgcaccgtctgctcaactgactgcgtacttccccgtcacggggtag

SEQ ID NO: 148 - DNA, 1707 bp, Toxoplasma gondii
atgagaaggctgctgctttcacctgttggtttcgtcattgtcctggctacactgttagaatgtcacccgcccgatcggtgtgttgctcatcatggcagcagcactgatgaatcgaacgtgtggtctcctcgaggggcccaatttgtacccggggcgtcagaggccgctgtaaaaaatcaggttggtattcctgacagtgcccttctgtggccgtcgcaagatgctacggaaaccgggctgcggcctacggagcaagtagaggcacgatcgtcatttcctgctgcaaagcaatatttatcagaggcggcacctgcgcgtggcgaccttccaccgcgcgccacaggccttctgagacgtcgaggagctagagtgcgaacggtgaaagctcacgagatcgttgtggagactccaaaaacgtatggctgggatcacagggttgtcgacagtgaggagcagaccacggtgcccgttgcagattcaagtggcttcattcaaatcccctcttcgcgcgccacgcctaccaccctgaacgctccgattgacctccagggacggcgcgatatcagaaacatcgtcaggaatcgacctcccgccgactcagatttatcgcctagcgagattgcagccaaaaacggattcgagcgaagatttgtccagggtttacaactgaaggttgagtcattatttagcggaggtgttttcacgttgacaggaccggcgcagttcctgggaattgggtcaacggcaattgtgtatagtttgaataaggtgcaagcggacacagcaagtgcgccagaacgggtggcggccaagataagcgtcaggaatctaaattctctaagagacgcttctgcgtctgagagacaacaggtgctagatcaggctccagaacgctttgtctcaagcgaaggcgcagtgaggaaccttctgccaggcgtgacaccagaaacggctctggaacaaggaattctgctaccgctagatatttgccgcgttactaacatgccgtctaattttcgtgctggcccggactggaacgtgtttccccgtgttgctttattccctgtcctcacttgcgatctttttcttgtcgttgagagcggtctgtcacgtgctgcgaagttgcatcttacgcggcagctggtggtgtctgttgcgtggctgcatcgtaatggcgtcgctcacaatgacttgaagcttgagaatgtctttctcagtgaagaagggaaggctgttattggcgactttggtttcgcagcggaagttgggacctcaacaagactccaatcaacccctacctttctagacccgcaaaccgcggaagaatctcttcaacggaaaacggaaacggtcgtgactgaggaaagagatgcatgggctctgggaactatgatatttttgatttggtgcggatcttacccgttcttttctttcgaagaggctgtccttcctcttgcagcgttgttgcaaaatgtggtgtttaagtcaaagaccactagacctgcacctccacttcagcattgtaaggggatgccatctccagtgaaagccctcataaccggctttctccagtggaactctgacgatcgacgccgccctcgtgatgtcgttgaaggattcctcgccgctacagcctcggaaccagcgacctcttcggcgactgcggcagaaggaagcgtcaggccgcgcgcatccagatctcagtga

SEQ ID NO: 149 - DNA, 1533 bp, Toxoplasma gondii
atgaagaacagtctgctctctcccgttggtttcttcgttgttgtcgctgtacttataggatgctgcccgccaggtcggtgtttggctcattatggcagcagctctattaatgaatcacaatggactgacagggaaacacagatgttggctgctgctgtaaagccccatgccgggtataccgacagtggtcctcggacgtccagccgggagatgaatgacactggatcgtgggccacggaacgatcaggggcattgccgcgattccgcactacaggggagcagttgtcggaaggggcgtcagtgcgtgaggaccttgcgccggggatcagaggagttctgacaaagaaaggagcgagagcgaggacgacaaaacgccacgagctcgtctctgtgacgtcggaagaacattactggaaccaagggattgccgaccacaagggacagaccgcgcctcctgttgcagcttcaagcagtttcatgcaaagcccctcttcgcttgccacgcctgtggtcctgaacgctcctgttgacttccatggacagggcgatatcactgctgctgtgaggagtcgacctcttgtcacggcaggcttgtcgcggcatcagattgaagccaaaaatgatttgaataaggtgcaagcggacacagcaagtgcgccagaacgggtggcggccaagataagcgtcaggaatctaaattctctaagagacgcttctgcgtctgagagacaacaggtgctagatcagactccagaacgctttgtctcaagcgaaggcgcagtgaggaaccttctgccaggcgtgacaccagaaacggctctggaacacggaattctgctaccgctggatatttgccgcgttactaacttgccgtccggttttcgtgctggcccggactacaagatgtttccccgtgtcgctttattccctgtcctcacttgcgatctttttcttgtcggtaggagccgtctatcacgtgctgcgaagttgcatcttacgcgacagctggtggtgtctgttgcgtggctgcatcgtcacggcgtcgctcacaatgacttgaagcttgagaatgtctttcccagtgaagaagggaaggctgtcattggcgatttgggtttcggagtgcaaattggaacgtcggcgagactgaaatacacagcggcctatttagaccctcatgctgcggaggaatgccttaataatcaagtagaaacagttgcaaatgaagggacaggtgcgtgggcactgggaactctcgtctttgtgatatggtgtagatcctacccagtcgtttcgcgtgagcaagcctgcctttccactcgtgatttgcgggaccgcctggtgacaatggcaaagacaactaaacccacgccatcatttcaccactgccaggaactcccctctccggtgaaagacctaatagccggatttctacagtggagccgtgaagcgcgacgtctcccaggtgatgttgttgacgaattccttgctgctacagtctcagaagcagcgacctcctcagcgagtgtgtga

SEQ ID NO: 150 - DNA, 1659 bp, Toxoplasma gondii
atgcgcctggatgctgtgtattacttggcgcaaatggctagccaccgaattccacgatgccaggcgacattccggcacttcatctgctggttcctcatctttgcagcattcgctgtgtcagatttttcaaatgtgcatggcagtttcctaccggaccctcatttcctctgtcaccatagaactctacggtttcggaggggttatgtcccccagctcagtccttgcccccacgcgagcacgcaccatgtaaaatccggcagtttctcaagcaagatatcctttctagaggaggcggcgcagccgccgtctccaatttcttctccagagtcgaagactgaactgttgctgtctctttcagtcggacattatggaaaatggatgaccgatgaagacgaacgaggtcggagaaaagtagccgcgtcggtttcacgcctgcttcgctcagagcgtccgaaaagcatttcagacagagtacaattccttcttgatgagacggtcgcaccagacaccgtcttcgtcgtcgagtcactagagggtgttccgaccgcgggcgttcaggtacaggcatttcgtagaggcagtccactagctagcggcagttacaatgtgctttcagaggctaccccagttccagtcccgttgccaacatctcttctcgtgaggcctaagagaggagaggtttcacagcaatctgcgcgcatgatgaatgtcgttgtggctgcggtgaaaggctctgagggacacgcagctcaagttgaagaggggaaaacaggcaaagctggtgtgtcgtcagagcccgtagccgtgagaatagcactatccgcccgttccagctgtgaggtggaggcggaagatgagtgtctctccttggcacggaggtacagcaatttaatgagtaaactgccacccttttcgagtagagatctgcttgaaaaattcgggatggtcgtcccgcagttagtgggtcagcttaggggacggccatcgttacttcgaaaacaaggtgatacatcgctgctaaacttcgtgcagataatgccgcttatggcatgcgatcttaaccagttccgaattacggacccagacgcggtcaagtttgtggtcaagcgcatgatacagctactagcgttgttcggggctgccggtctagtgcatcaggacataaaggccgagaacttcctcgtcagccggcaaggtcgcctgtatttggcggattttgacgctgtggtacgagagaacgacaccattcaatgcaacaaaaaactgagcctgttgttttcgcccccggaagtgcttcgatgcttctttaatactccagaggaaaagatagctctcacccaggttgtagactcctggagtctcgggatggcagcttgggaggtcctatgcatgagcgagccttttgacggaatgcggttcagcgaagatgatttatataatatgaaggtaatcgccgcgctgcctgaaggcggcgacgacaccagggccctagactggaatcgttgtagaggacgaccgcctgcaccgttgaggaaggctgttgaatgtcttctcgacagaaacgccgccacccgctgcaaggccttggatctgtttaaatcttcacctcttttcgctgaggaacggccagtgccaccggagccaagttcaagtgactag

SEQ ID NO: 151 - DNA, 2250 bp, Toxoplasma gondii
atggttcacgggcaaatgcattacgtgagctgggttaaagacggctgtcgacagtttgctcccgacaacctgcagccacatggactagatttagaggttctccgctctttcttcattttacagatgaatccacatgcagttgcggagattgcgcccggcgacagagcagaatggacgcgtgcaaccatatacaggcagtgtcgggcggcggcgccctctcccggcggaagccccgtcagcactggcatatcctctgtctctaattcgcgttttcctcgcagcattttgtccccgcgatctgccgcgctttcaactctcaagcttccgttttcctttctgcgtttaccttggagaaagttcgaagtgaacgcgcccacccgtggggcggtcgaagcctccagcgtcaaaagccacggcgagacttcggccgcttcgagcctcgcgggcctcggcgcaaccgatgaggacggcgacgctgaggaggctgtgggccttgtagatgaggaactcatgggggaagagaagcttatcccgctggagcagcgaatggtgctggcgcgccaacttctggagggcagcgaggcgtacaatgagtccttctccagcgacgaagactggttcgacagcgctcgcgtttcatccccacttggcttccctgcgaaaaccacgctcgagctcggcttccccacgaaccgcactgcgcgtgaacctgcagacttgcacggctcggaaggctcagacgagttcgaggatcacggacctgcgtccaccctcgtacccacggtcaagtctccccaccggcagggcggtgtgaaaagcgccgtcgactccagcgttgacagcatccagcaccatgggccatcgccgaagtcctcgcccaccacccctgccgccgcttcaccttctcacgccgcaggaggcgcgcgaacgcaaaatacgcgacaggaagctggatccagggaaggtcggacccaacgaaggctcgcaggtcaagagggtgccgcgcggaaaacagggcggccggtgcttacagtgcacactggtggaaacgctccccccgtcgtaactgacgctcgattcaagatgccttctaccaccttgaagagtctagtcaccccccaggaccctggcgagtggactgccgagaaggaagagttcgagagaagctatcctctccatacgcccattcaagttcgctccacacgcacaaacgagaagttcagcgtccaactcgaagacgtcctcggcgcaggtggctacggagtcgttttctcagcacgagacctcaggacaggtcaaggcatcgctctgaaggtcttccgcattcgcccagaccagcgtcgggaagagagcaaagaagacgtgattctgagacgtcgagtgcagtcggagttggcgatctgggagtacgtccctcgaggcatcgaacctaagcaatggagcgaaatgtctcatttggtcattccctttgatgtcatcgaagttgttacgccttgcgcgacgcctccgatggatcagactcgatacgcgagcgagtgggtcgtgatggatctctttgcaggcgatgtggcgcggatgccgaagatcatggcggcggatccaagcgtcaagctggaagtaacggagcaagtttttctggcaaacatgtatttgcatgatatgggtctggtgcactcggacatcaagctccccaactatttcatcagcatcgacggacgaattttcctcggggaccactccctcgcaagccctactggggaaaatgtcccatgcatgtggggaacactccgttaccttcctccggagaacatgaaatgcatcagcgacggccgaaagcgcatcatgaccacggagagaaaagacgtctgggctctaggagttgtgttatacaaactgtggtgcaatcaacagtacccgtacgagatgggagagctgtggtccaaagacctttttgttcgaacggcgcgcgcacacgtcgatgagttggacctaactctctgcgatggtcacgtcacgatctctatcctgagtctcctccgcaccatgctgaccccgaatgccagtcgccgcccaacgctccgagaaatctacaaattccaccctgtcttcaagcagcggaaaagcatgattctccaaaagaagactttggtgtccatcttgaaggaagtcgatcacaagaaaggagaaaacccgggggccggcggtggcgcgcaagcaggcagcgacatcggctcgacagaagaagactag

SEQ ID NO: 152 - DNA, 1836 bp, Toxoplasma gondii
atgaacttgctcttgctcaacgaaccgtccctccggctccccaggatctttacagtatcgctatgtgcgatcctttcctggggacatgctgctttccctctgttttttgcggaatgcggacttgccacaaggaacctacatgacacaggcgccagctcctgggacacagacacacggcacattgcgtcaacattcaactccagtcgtggaagcgcagaccactcgttcgcccagcgagcggaggctgtctcagacaaatctgtcgcgtactggaaaggtcgaatagtcgaggatggtgatgtcgaggtagaagacaaaatcgttcacgtggcgcaagaaatcgtcgggggcggcgacagtttgtctgcggtggacccaacggagctgacagatgttgcacgcatcctcgcggcaacagaaaggccaaaggtcgtagcgaatgcagatgccttcaaggaaaagcggttcgcgatcttcagcgctggtctccgcacgtccagctcaggtccaaaggcgaacacattccgtttcctggctccagaccgcactgagaagttcgcgtttcctggccgtcgcagcgcggacccgcaggcagtatcgcggcagttggtcccgcccgcaaacctcgtcacccgtggatcgggggaaacagtgaagctaaaaggaatagagttaaccggtgcagctcggggactgtttgtgacgaaagtttctgcagtagtcagacaggaggcagacgggtcttcgactaagaacccgctgtcaagctcgcttcagacacgcagcacacagcgccgcccatggtaccagatgctcgacggctttgtggctgaagtagacaaagtctacgaagaagaagtggaagctcgtctcgcgtgggaactgaggatatggcgccaccttccgtcttctcgtgcagaacagttagccgcagaggaacacattctgattccgggagctctgctgagccacagcggccgggggtcgccttcttcgcgacggaaggacgctgcccgcttttcgagggagttggagggaaagtggaacgaccttttgtccgaaaaagtgttcaacgtgttcatatggtacccggcggggtaccgcgacaccctagaatcgtctatgatgcactcagaccaaattacggagccgtggttcagctccacgcctcgggacgttatggagtcgataaccgtccagatgattctcgctgtggcaaatctgaatagttacggcctagtccatacgcatttgcgttcatccagtttcgtcttcactccagaagggatcgttcttctgtcggatctaaaccgcgtcgtgcgacaaggagagttcatggactgcgtagcagaccgtgaagcctcgctgaatgacttgacggcttccccagaggaacgcgtgtgcgttcacgagcacggctacaagggcagagacgcgaaaaaaaaagaagagcttgtcggacctctggaggcacacccaactgtggatgcgtggcgactagcggtgattctctacaaactttggtgcttggaaagcatgtacgaacggtcttcgtaccaccagttcgttgctcgacaagacctccaacgcgttccagactcggagtccaacatcaccttcctcagacaaaatcccttccccatgtctgcctgtcggaaagacatgccctcttccctgcaacgtctcctccgccagatgttcgagcccgaccctgcgaaccggatcacttcggctgaagccgtgaagaatagttccttctttcacgacaaaaagagagcagtgctgcgaaaaaagcaggagcggctcatccagaaatcccaaccggcagacggctag

SEQ ID NO: 153 - DNA, 1647 bp, Toxoplasma gondii
atggaaaagatcctgtgggcggcgtccgttttcatcgctgcccaactggacagcagcttcacagtccatgtttacgccaaagaatccacggtactgtcagaactcgtggaatctggaacacgtttgcgaccagaagaagaaggatcattcctgacatctccacgttcagacgaggagacattggttcaaggggcaggacccagaggaccagaagaaaaggctcaggcagcgattgatgaggcagaggtagagccgtttgcaacaaactccaacactgggacattttcgtcatttcctccggagctccatgcattcagccctttcggagtcattgttcgagagccgaaggatatgtttttcacagtgttttcaagactaggagggagggttaaagagagggactttgtgggtgagttaatacagcgtctcgccagagcggtctttccgctatttcgccgcttgcatttctggggagaatcccctggaacccaacacgcccaacagtctggtggtggcgtagagtggggacacaaggctgtagttcgtgtactaagaattatgagggacagaccggtgccgccagtatacgaagattccaggcgtcgtgtaatgctgaagacaggagtgggtgtccttcgagagcactctcctttggtaatgaattccctgtctggtaacagaaaagtcactatcactgtcaaggactacattcctgtcgcagggtggggactctgcgtgggagtggtccatccagagtcaaaccaggagtttcttttgctcaacttcgtttccttagccgatgcagcatggggaaaatggttcgaatggaggcttcgcaaaatagcggaaccgcttcaatggctaggactgaggaacccaagcgaggcgtattcgcaagaccgcttaatgcttcctctcgatctgctggaaatttccaactccagccgctactttgtgagagcgccgttcgtcgtccccaacctgttcgtcctgatgccaagaccagcgacatctctcagtgaccttgtttcgtttatgagcacgacaaaaaatatcgggcagacacttgctgttcgtctcagtctgaccttgcaaaccattcgggtggtagcagggttcaataacagaggattcattgatgcagatattcgtccagcttcgtttttcgtcaacgcgaaaggactcgtcttccttgggatattcactcgcacgacgatagccaagcgtggacgtcgtgcatctggaaggcggcagttcgatgtcgccacagctcctgaactggtcttcagggagaaggtgttttttcgccgagacgaaaaaaccaatgcgtgggctctaggcataacgctgtactatatctggtgcaacaggtttccgtttggtattttggatggagactcggcaccgcctccagagctgttccaacccgtcccaccggagttcggcgtatgcgtacacaacatgcctgacccggttaaagttctggtcgcggagctgctcgatcgacagagacgagcaagacccacagcaaatacagccatgcagagagagattttccgacatctccaggatctcctatctgcatcaaaattatctgccctgccacgcacggtgccagtagttgccctgttgaaaggcatcaagtag

SEQ ID NO: 154 - DNA, 1608 bp, Toxoplasma gondii
atggcaacgcgttcattccttttcgtgtttttggcgctctcgtcccttgggggtctgtgtagcgagtatgctactcaacgaccactagaaccgtacagaggtgaaaccgaacggccgctgcctgaacgcttgggccaaaagatgtacatttcagtagtgcaacataagacactctcgttcagtcgtagctctgggggcccgttccgtcgtcaaaaccctcagacgtggccgaattttgttcaacttaccagcacgtctggggtgccccaccggcgacgcgaaagggtagccgacgctgatgaaccgacaacaagtacgggcaatcgtcgcgacagagcgttccctctccgttcatggcttcgacacgcaatacggcgtttaggtgtaggtgcaaacaaccggagacaaggcgtccaacataaggaggtcttgccgtctaccgaagtggcatcgatagtgacactgctgcagcagctgcagcaggagatcgggcggtgccgcctgcaacaacggaccaatgcacatttggaagacacagttacgatactctttttccgccggggttccacaagagtgctcttgtccgatggcgggagacatacgcgaaacatacgctatgatggtgaaattctcggctcggggccgtggtcccttgtcttgcgcgtgatggatgtcgacgagaatcaggagtacgctttgaaggtcgctcgactgcgtgcttcgctatctggcgctgccggataccggcaactcttaagacagggcctactccaccacaggttcacaccgcctgtttctccgcatcacgcgttgtggtgcttgcagttgatggtcgctattgacctcctcaagcttccacgcattcccaggttcgtcagagaacctagctcacgactaacaattgcaaaccgtttcctcttgctgccgctcgcgtatactgaccttctggcagtactgcgggcgctgttcaccagacaggatgtcagcgaaagccccggcggttttcttgctcgactgcacatgaccgctcaagttgtgaaggcgctggcgagctaccacagccaaggcttcgtccacggagacctaaagccacagaaattcttggtcatggcaaatggaagccttgttctaggtggtttcacagaggtccgcacccccggcgcactgcgctccggcgacgtattcactgagtcgtacctgcctccggagcatctagaccgaaacagcgtctactcatttgaaagtgatacctggcagctgggcttgaccatataccagatatggtgtttgctgctaccgttcgggctgatgacaccattcgttgccgagggcccagaacgccgtgtttttgaagaagtcgtgcagcaccccggggttcaaccgtcgttcaacgatcctgactgcttctcgaatgttccggagtatatcgagatgatggtacatcacatgcttcagttccatccagaagaccgcccaagaccagctgatatcctcatcagcgataacttccagcgactccaggatcacattcagcgtttggagcggtcgcaggaagaggaagagtcggtccacggcagtccagcaggaacactctcccgtaatccctga

SEQ ID NO: 155 - DNA, 3369 bp, Toxoplasma gondii
atggcgggctaccagccgagcgccgcgtggcccgtggcttcgtttccctcagcctcgcttcccttgacctcgttctcctcttttgttgcgcgcgtcgcccgccagtttcttctcttctgtctgatttccattttcgcgagtgcatggtctgtgctggcaacggacgcgactggagaagagggagaagccgtcgacgacgggtcggcggacgcgtcgaacgacgctgaggtgtggctgcgtcggcaagactactcatcatcgggtcttcacattccgcaagctatcgcagagcatgacagagaaggcgagtctccgttgttcgattcagagcgcatcacgcgaacgcagtcccagcagcgctgggtttccgagctcgggcgccaaccttcccaggtgtcagaaagtctcccgtatggggggatgaaagcaggttcgtttggagggtacgaaacgtttcgacccgacaagctggaggccgtctgggacagaggaaccgcggcaaccgagctgcaccggtctggaggagctcgcgcttctgtgaaccctgcggctgcagccgcaggctcggcgggcggctcgacagacgtttatcgcgacgaaaaaggcgaagggaaacgcacggaaagagacggacgaaatcgggaggaatcagcgcgagtcagccgcgagggggagatccagttttccacggggtgggaggccgaagcagacccagagcctgcctggcgggtcgagacacgtcgttcggagcaggggaacgcgtcccagtggaccgaggagaagccgcagcactcgagttcaaacggcactcaaaaggcgacggccagttcccgctggggtgcctcgcctcactcggacgcttccctccgacctccccaagagagctcctggccctcgctcctgccgcccgctggacgtccccagccgccggctccgagccccacgcacttacccagtctcttgcccgggaccccgtggccctcgacgcctttcgccctcgacccccgcgcgcgcttgctgaactatcgaaacgaagggcatgcgctgcgcgacgtgtacgacgaggaagaaggcgagctctccgacacagagtctctgcaccgcgcgcatcgactgagcctcgaagggcctcggtacggcttccgcgcagggtcgtatgcgccgcgcaggcgagaaaacgacgcaggcgatctctacggggaagtctcagcgacgatcgagcttccggagacaaaccccagcgccgtgtacccgaaccagcacggagaaggacttcccgacttcgcatctgccccccgcacaaatgtccacttgcctccgcaactcggccgaagtggcgtggaccccgaccaagtccgcgccgcccagctccgactcgcgaacttggctggacatactggacatacaccaggggacgggtcttcgagctacggggcttcccgcgacgaggttcccgcgcgtcgcgaccaggtgcaaggtcgtggaggcccaagtttgctgcctggggctctgcgcgcggggttcgaccctagtgcaggtcttgtgtctctgcagtatccgggcgtctctgcgtttcggcgtcccggtgttctgggcgccgcgagctcccaaggcccggcgaagtcgctgctggtggagggcgcgccccagcagcggcagtttggagcctcaggtttcgcccaaacccccagcctcctgtcctcgtcgccgtttctggacgctttcatgcataaccggggtgggttgaatctcggggcgcagctgttcgcgacgcagcaggttctgtcggggcctgcggggatgtggggttctgccggcagctctgaaggtgaggcagacaaatggtggcgcgaacaggacgggtgggtatggccggagttgcctagcctgtcggcgacggacctcgaggccggcgtcaaagacatctctggacatgcccagatggttcgtgtcgaggcgcacctggtcaggtcccaggtcaatgcaggcaacgctcttgggctgtacatacaccaggggaagcggtacgagctcctggacgtcgaggggcgtctcgcccccatgacggccattcgcgggaaggttctcggcttcggcgcgtacggggtcgtcgtggagttggtcgacgtctcggcttctggagctcaccgccgcagctcgccaagttccacagacgcgactgctggtgagttcgggggcaccgccgtcaactcggggagtccgtctgcgtcgaactctgggaacaaggtctcgacctcggggaacaaggtctcgagctcggggaccaccgcggcgaacgtggaggcagagcccgggcagctgtccagtgccgagcgcgagggcgaacccgcggcgaaggtcgatggggacgcggcgagcgaggccggcggaccgcccagagagcacacagagaggagcagcagaatcccggggaagcgcgcgtcgggggccgtggagaagagcgggggttcggggatcgagccgcggggcgacagcgcgcgagtcagccgctccgtgacttatgccgcgaagattatgtactgggcgaaggcgaagacatctgcgaagccggaggaagtgcgacagacacttgaaggcttcgtacacgaggagttggaggcgttcaaactgctcagagagacaggcatctccgacagtgacctgttccagaaacatggactcgtagtcccgcagagcgtgcgacgcgtggcgaagctgccgacgctgctgcgcgcgagccccgcgctcttcccagacactccgctgttcttccataaccagctgattatgttccccgcgctcaagtgctcgctggacatgctggcgcaagaccgcttcacgcgcgagggtctccgggtgctcgttcgcagcctcgtgcgcctggttgcggggctgcatgcgctcggcttcagccacaacgacgtcaagccccagaacttcctcgtcggcggagatggcggcctgttcctgggagacttcgcgtacctcgcgccaatcgacgaggtccaggactgcaacaaaggcttcacggtcgactacagctcacccgagctcatggcctgcgcgctgaagaacggacggatgtccatgggtcccgaacgcgactcgtgggcagtcggcgtgagcgcgtaccgtctcgcatgcagaaacaggttccccttcctcctcgaccgaaagttcaacgcaaagtccgacccaagactcatcgccacacacatcgccaacctgaaagagacagacctcgaaacctcccgctgcggaactgaagaccgagttgtgatgtccatcgtccttcgactccttcaccccgacctatcgaaacgcgcaactgtcgaccaactcgtccacgaacctttcttccaagactag

SEQ ID NO: 156 - DNA, 1308 bp, Toxoplasma gondii
atgttgttaagcatatctgctggaactggcgatacactgagctcgagaagccaactatatagagaattgcagaatcaggcaatgaatcccgcggctgcctcacagaggcccaatttcgccgcaggtctcggtgtgatccttaccaagggaagacaatatagggtacgattaccgtcagaggaggacctgaatcttctcaggaccatgctaactgcccgaggacgtctgattccaccgagtggacaaccgtcgctgagcatgcgtctccgtcctattggaattggtgggaccgaaaaacatgtcagttttctcggagtggctggtgtgcacgaagggtttattctcttgaaaatgcgagacaagcaggatggaggaaatgtacctgaccacatttactggcaacctctcttttatacgaatccacacagtgaaaaagaaagtgtcgacccgcaattcttgaaacacgggctcgtgcagagggtgcagaagcaaatttcacttattcctccaggatacgaaggaagatccgaacacctctgttcacattatggcgtgatgtttccaggtggaacgtatgtccttgccgcggacaacgctcccctacaattcgacgtggagagcgatcagagtggatcccgagcagtcttgaaccttttcattcaattttctccggcagagattcccttatccgtgttgagctataaaaacctgagtccgacactggctgcgtttctagtgaaacagatgattctcaataccgccatgttgcattcaatgggcgttgtccataatggaatttcttctgcagcattcttcttgagtggaagcgaattgacagggacaacgccaccagctcgtctgctctatttggtgaactttggtgcggctaggttttacacaggaaagccggaaccattcgaagaggcgggacacgttatgtattatgaccctgaaactgcgtcggtcttcacaaaagttgctgcgttacgtcctaatgtcgtatatggtcaagctcgagattcttggtcattgggacgagttatgtttcagcttctttgtggtggatctcagcatccctttggacaccttgggccgcctgcctcgccgctcgtcactgcgaagcgaatttctatgttggctcgggacagacctgctctccgattgtcaacctgtttccccccgacatcggcgcctgaaatgcaagatctcatgtccatcatggctaacttcctcaaattcgatgccaatgaaaggccaacgcctctcgaaattgtcaggagatatccgcagttgtttaccccattataa

SEQ ID NO: 157 - DNA, 2928 bp, Toxoplasma gondii
atgaagtcacaggttctccccggcggcggcgttggcgccttgccagtgttccccgtcaagcctctcggcctcgtcgtgctctgttttcttctccttctgctcgtctccgaagtgttgttcttgtggcgcctccaacagctggagaacgacgcgtccaggccatcgctcgactctctctcgccctcgacagagacttccaccaagccaccaccctcgtctcctctggaggccgatctctctgcgtccctcgtggacgcgaaggacctccttcgtctcctctccaacatttccaccgtcactcgagagaaaaccatcgtttctgagaactcgacacgcgttgcggacgaccctggagccgtccactcggacctggacacacacattgtctcttctgtctcctcgctcacagcgcggccctcagtctccgacaccccacgtctccgctctctccagagcccgaaggctcctctccctccgcctgcaccgagccactccgaggcgtcttccatctctccttcttcctctctgacgggcaaggaagaagaaatgtctctccatcacacaccctccactcctcccaggccttcctcttcttctcctgcacatggccaccgctctcctgactcgccgcactcccccgcaggaacgacctcccttgtctctgcctctggggaagtgcaggcgtctgcggttcatgcgatctcgactgcagaccctcttgaggcgaacagacgaacacagccagaagagcgtggaagcgagaagaagaggacctcggcgaatgagaagagagggcgtcgcgaccgcgaggcggtctctgtggcgcctgcagctgtcgaagacgaggaagaagtcgaagaagtcgaggctttccacgacccgttcagcgaagacgacgtcgctcttctgcgggtgccagacctccttgtgtcccagaacgccacggcctttcgcatgcagttcctctccgaggatgagcgccggcgggtcgcgaagcagaagcctctagcggtccagggtgctccgtctcgggcgaagaaaaaacgcgcccctgacacgtcagcctctgcgtcgttctcgcctccagcttcgcatgcatatggaagccttcggtggaaggacgtatcctttcccgcgtccgcgactgtcacgcacatccccggacacacgggttcgttcgcagaggtctacgaaccgttcctcaaaggcgaagatcctcggttgctcccgcactacctgctcggcggatctctcggcttgacaggcgcatacggagccttcgccgcggagggtgcgtacccgagattcagtgcagggtcgacggaacgccgtctgaagacagacctagcgtctccagatggagcggcgacgctcggccaccgcagtccggcccgcgtgtccagacaccgcagcgcggagcggagccgcagctcgctgcgcgcggggcagcgggcggcgggggtcgatgggaactctgtggacccgcagcagcaggaagcgaagggtgaagaagccgcgcgacgcgagctgcagagagacgcggaccacgtggaaaacgcaaaggggaaggaagcagaaaacgaggcaagaccgaccgcaagaataacgcgatccgtcgtcgggaacgcgctcttgactcgcgaggtacgggagagctccgaaaacttggcaaacctcgtcaacgccttagacagcggcggaagcccagctggagagcaccgcggggccctgcagacagaagacaaggaaggaggaagcaatgttccagaggcgacgactccccgccttcgccttgccgacctgcccaaggtgctcttcagcaaaccgtcgaggagcctcgtcaaagctgcgcgcgctctcgaacgatctgtctcgtctaaagaaaagcaaaaactcgctggtattattccgtttgacgtccccgttgtggtccgaagtttggcaacgcagaaaaggcgaaccgtcattttcgatggtgtgttgggcgcaggcggccagggtgtcgttctgctggcccgggacgtggatcaccccgggttggagatggccgtgaaaattttccgcatcaaaaagaagaaccggggagcctcagcgctgcacgaaatcgcgaggctccagcgaagactgcgttgggagacagcgattttgaagcatgcgcccagggacgtgtcgtcctacgtctggtctcaactcgctcatctggtcatgccgcttgacatcgtcgagccggtagaaaagtgggaacactcagatgctgaaatgcgctactggcaccagtggctgatctttgaaagcttcgcaggtgatgtcactcgtctcaagaagctacattccggctcgggacaagctcgcctggatgcctccaaacaaatttttatggcgtgcatgcgactgcacgatactggcatggttcactcagacatcaaattggcgaactactttatttcgtcagagggccgtatcttcctgggagactactctctgtcccgaccaattggggacgtgagtccgtgtgttgaaggaacgctccgcttccttcctccagaaaacatgaagtgcattcgagacggagagaagaaccttgttctctcatcgaagaaagacacctgggcagtaggcgtcgccttatacaagctctggtgccgcaacttcttccctttcgacctcgattccttgtcttctgaacacgccgtcgatcgcgttgcggaagtgtcacgagatgaactaaatttctatccctgcgctcccgatatgcccgtagcagttatggatttgattcagcaaatgttggatccgaacatagagactcggccgacgctgagagaccttttcgtctctcaccctgttttttctcagctacgaaaagtcactttgcagtacacacttgcggatttccgcgaggaacaggcgaaccagaagggcatttga

SEQ ID NO: 158 - DNA, 2085 bp, Toxoplasma gondii
atggccgaacagaaagtgtgccataaaaagatgacgcagttcgccgcgcagagcatggtatcaagcctcagctcgccaccacgcgttctccgtgtcatccaactgttgctgctgcaaattacacttgtgacttttgctgttgatgcacaggtagaaccgcgacgattgctgcggcaagctcggaaaccgtttgaagcgcacttgcgtgggcagaatcgcttttacccccatttggagaggcggaaccctccgaggggacagcaacgctacgtgccgccccgtaatcagcagatcctcagacatgggcagttctcgccggatgatggtgccatgcatttcaaacctcccgctaaccgtgtccagtcaccctacaatttcgtgaaggcaggtcaagcacctacgtcaactccctaccgggtgtacgttccgctcaaggagcgtcgcggacttgctgtgcctgtgaatagccgagaggaagacaagcttatcaacaaacgggatgggctacgtacatttcgaaaggaacgaaacgtccctacatctgcatcttcacagcctaaggaagagtgggctgatccacagatgatacgtcctcttgatgctaaggtgctgaacgaaggcaagcaattcatcgctcgagccgttatggctgttcaaggaaaaggtgtttctccgtctttccttacgctgcaaacactctcccaacatgcagggggagatgaaaaacgcaaccatctccacagaaggtatgaagaagccgaaggggaatccgacgagagcgttatttgggacacagcagctctgatacagtggatgaaacccagtcgatcctataatattcgtgccacggatgcccttggcataaaaaatgcatcaggtgcccagcaagaatctagttggccactgagtacttcgtcattcctagaaatagctcgcaagttcaacaactggactcgtgcctctggctttctcaacaccgtcaggcggttctggccttctggcacggtagccaaagtcgctgacgatgcaggtttaaagcacaacataatctggcacaagcttttgggagtaggaggcattggtggtgtgctgctccttgaagacaaggatgagccggttggaagcccccttaagaaattcgcaggaaaaattctgtatcaattaagcgacccatccatgaacctgagtcagtcgaaagaatatttctaccaggcacgcaacgaggagatcggagtagcatcactgtttaagcatgcggccctgagtttgcatgactgcccagtgactgctactgataggatgcagtttcttttccagaggggctttgtactcccgcaaaaagcgttctggtttgaaggcactacacagataccacgctttcaggatatcgtcgaggccagtccccgggtagtcggctcccccggcggagagattatgcgacttgatcgctacatcatcgcctaccctatagtggggcctgaccttgaggacttggatccgcggaagttcagcttaagcgctgtaacgtatatcatttataagcttactaagttgatggccacgatgcaagagatgaacctcgtgcacacggacattaaggcggagaactttcttgctcgagatgacggcgaactgtttgctgcggatctctctatgtcaattaagatggaccctgcgacattgattccctgtcttcaagggactatgctgtacttagacccgaacggagccgaatgtgcttatagaagaggctatcagtcaccaagggccaaacgggacgcttatgctctcggtgttactttctataagctcatctgccacgacggcccttttcatcttggacgactcgaaaaagaagcaatggaacagaccaaaacatgtccgggaaacaacccattgctgctaatgctctctggcatatccagatttacaaggaaggactgggtcgaacggaaatgccccttagccgataccagtctcctgacaatcgtgaagctactcttagaccctcgggaggatcgacggtggacaccgcttgatcttgtgagaaaaactgcgttttttgatcaagcgccgggaatttag

SEQ ID NO: 159 - DNA, 1470 bp, Toxoplasma gondii
atgagcatcttgggaaagcatacggcgaccgtcggagaccgatacaaggtacgactcacaccagaatatggcccagggggcggttatgggcattgtcgcgattacctgctgcagagcgagagttgttggaggggggaccttacgtcgggggtcagaggagttctgacaaagaaaggaacgagagcgagaacgacaaaacgccacgatctcgtcgctgtgacgtcgggagaacattactggaaccaagggcttgtctaccacgaggaacagacagcgcctcctgttgcagcttctaacagtttcatgcagagcaccacttctcttgctacgcctgctgacctgaacgctccggttgacacccagggacagctcgatatcaacagcgtcctgaagaatcgacctcccgcagaggcacagctctcgcctcgcgagattgcagccaaaacccatttcgaagcaatgtttgccaaaggcctgcaactgacggttgaatccatattcaccggagaaacctttaccctgacaaaaccggcccgtttcttaggatggggatcaacggcgattgtttttggtttgcaccgcgtgaaagtgggcggagcaagtgctccacaacaattggcagctaagataaacgtcaggagtttgcaagaactgcaacatctttcctcgtctcagaaaaaaacggctcttgaggatatacaagaacgttttctccgggaagagagctcagcgaggaatgcgctgcaacatgtgaccccagaaacggctctggagcacggtgtcctcttcccagttgatgtttgccgtatttctaaattgttctccggattttgtgcaggcatttcctacgtaatacttcctgttctagcattgtttcctgtttttacttgcgacctccagcaggtcgttaagagtggcctatcacgtgcggcgaagttgtatatcacccggctgctgctgcaggctgttgcgtggctacatgccaatggcgtggctcacaacgacttgaagctagagaatgtccttctcagtgcagaaggaaaggctgtcattgcggattttggtttcgcagtgaagcttggaaccgcatcagccattcagttcactgctccctatttggatccgcaaaccgcagaggcagtgcctcaagagaaaacgaaaacgaccgcgagtgaggaaagagatgcatgggcgttagcaactctcctgtttttgctttggtgtggatcgtttccatacgtatcggatgagcaggccgacctccccaccagcgacttgctgaaattgctggtgacactgggaaagacagaaaagccagcgccgaacttccatctgtgtaaagacctcccacctgcggtgggacatctcgtaaccgcatttctacagtggaacagcgacaatcggtctcgccccggggatgttcttgacgatttccttgctgctacagtgtccgaaggagcgagcgcctaa

SEQ ID NO: 160 - DNA, 1413 bp, Toxoplasma gondii
atgcgtgactcctcaaggtttgggaggactgtattttctcgtattttcaatgtcatcgcacacttcgaaaatatgtcgtttttttcgcttctgcatcttcactcccaccaaagcgtagagaatgcgacgccatcgacatcgccagtcgcggagcctaatgcgaacgccaaggatcatccgccacgcgcgggtgacactggatatctgttgcccaagccagactccggaaagtcttcgtcgacgcacagtggttggtgtctctcaccacatcgagatgcccgagatcacattttctcccattcgtgcatctcttcagctgcgtcggtgaaaattcctcggcggacgaaatctaccaaccccgtggatcccaactccaacccatcgccctcgactccaccacccgaaggtctttgcgcgaagcgcagtcatagcgaaggaggtagcgcagcagctcggtcgaaggcacacggatggggccaccgagaaaggcacgcaagtcgcaggcacacgacccagcacctgaatccggtgaaagccggacagccgggtgcgtatggcgctgacgggggcacacacgagaagaacatgagagagaagggcgaggaaagtgctccacagtgccggtcgtcgaggtggcaccttggcgagtctcagagagagcacagtctcgcctctgtattccattccgtgatggttgcaatgaagtctctgccggcgacgtttcagcgcgagtggagcctggtgcgtaaaatctaccggcaaagtgggcgagtgaagcacgcgcagagactggagcgggcgcgggaggcaaagctccagaaattcggactctctcgaagagccagttccagaaagccgctgccctcgcttgtatccatgcagcaggtggtcccgacggcggaatgtgcgagcgcgctgatcaaagaggtccgtcgcaacttggagaagagtatgcgggatttccagcatgcttcgccagccctgagtttccgcagagagcgtcttttccctccaggacgcgaattcgtcgtgcggagtctcgcgcgaaacccgccgtttaccactatggcgctggtcgcggggcgtctgctcgggggaggttcggaggcaatggttttcgcggctgaagagatcgagttgccggagaagcgtgacgtgtttataggcgcagacgacgcgtccagggagacgtccggcgaatatctgccccggctattggcgataaagatctacctgtgcgaggcgaacttgctcgaccagccagtcaaagcagcggaggaggcagaagctgtggagtggctccagatggcattctggcgtctcgttccgtcttgcgtggacgttctgctttcgcgtcagctgggagtggccgcgccttcctggcgctacgagtggcggaccgaatctacttga

SEQ ID NO: 161 - DNA, 1596 bp, Toxoplasma gondii
atgcgagcccaggtggcactgtgtttgtccctgtttttgtttgcgactggtgttttcggtatcaagctacagattacgtccagacaaaagaaagtgggcaggctccctgctgacactcagcctgaagaatctgcactcgagacaggtttctcagactcacgggcaaaacgcggcttctcccaggcaagcccggacgggagaaggcagtctgcgggacggtcaccgagtagacgaagcgactggatatctgaaatcagtgcctcccctctggagacaccttccagtgcgacatctacaggaagaagcgggacgtatgctgttgatcgaacacagcagcgaagaccagtgtggaacagattcagagccgttcaaacgcatttcgcccgcttggcttggcgactttgcaggccgttcatctgcccgtccgttcgccgtcggttccgacacactgagcatgggccaattcccgcagtcaactttcgtatgggtcttgagactggtcaggctgcgcttgccgattactgtggcatgcttcgtctgacggaaagagaggcatgcacggaaactgcgcaacaagtgagcgacttgctaatctccacccaagtgatgcctcccgacagaaatcttgtgtttgaatctctgttcaatccgggatcgagagtcaaccttacaaggggagagctcctcggctgtggaggtactagcaatgtctactctatgactcaggaggacggcaccaaagtcgcagtcaaaattttgagtagttacgctcaaatgactaatttggcatcagtcctgtcagctggcgcctcagccatgaaaattatgcgccgagaagcgggaatttccgagcttctaggcaatcaagatctcgacgatattctatataacgaccggctactagtccccagcgacgtgctgcggctccctggcaaaaatgattggtttttcccggaacagtcaacggtgatatacaatttttttctggcgttcccgatcgcggcaggaactttagaagatgtcgttccgcttcttgacaccacgcagaagagtttcgcagcgagagtttccgctacagtccaaatggtcaaagtggtagcgggactccaccgaaaaggtctggttcacggcgacctcaagccgtcgaacttccttgtgtccaacagtggcatcgtgctccttggcgacttctcgtacgcgtatgtgcgaggtcaaatgtctacttttccaattatcacttgggcttttttcagtccagagaacattcgaatggctacgcaattttctcaagttcgggttgagctgacccacgattcttggatgctcgccttcacgatctactttctctggtgcggtcgcctcccatggggtatagccatcgaagaaggcgattacagaaaaatcgttgctatcctcgatcagaatacgccggagacgctaaacttccacaactgcaatggaattcctgcaggcatccagcagcttattcggctgctcctagcgaaagaccccagtcggcgttggacgccggaaaaagcaatagctgaattgaatatattcaaactcaaccgctccgaatatgcggcgcaaacatga

SEQ ID NO: 162 - DNA, 1899 bp, Toxoplasma gondii
atggctgccgtttgccgagaccttcttccttacttcacatcatggcgaattctcctgtgctgctattccgtggggctgtttatgcacatgtcaaggtcgctgcttccgaacactatggtatgggcgtcagctaactctccgcgccggctgagtcactcaacgccaagtgttttccgttcctatacagaaattgataacaccgcgcccgtcgggtctattcacagtccaactgaatcaaatgtagaaccaacggccggtcgcaacaaacgggcactggcaacggcttctgaagagcagttgcccacaagtcaccggagtcggcggggggcagcgacaagcatactgtctggtctgaggagcgtctacaatgcttcatcgcgtccagctgttgactccagaaatcgtgccaaggatccagatcgatttgtaatgcgaagagcagtcgtacactcaattgaagaagtaacagagaggtccgatcaccacgaccttcgtggagaggacagcgcccaaaccgacagcgtcaacgcacctgacgacgaactagtcagcgagcttctacaccttggcgagtatccacatcatattgagtccctctctgatccggaagcggtgaaaatacttgcccatctcgtggctaccacaaacacgcatgacattgtctcgcaatcgcgaaagaagaaactggtcgaagcgttcaacatgtaccttccagatggcgaccgtttctttgtcgaatctctctctgatgcatctgagtccaaagaatttgtcagaggcccgcttctgggtgtgggaggaaacggtctagtttttgaggcgcaggacagtgacggccacgtatacgcactgaaactcctgcttgtgcgtatgagcacgtttctagaggccgtgggggacctcagccacgatgcctggaggcgcgaagaggattgggcattcgccagggctcttcgcaaggagatgaaagtactcaggttgtttccacctgacaagtcacccgagcagttgtacgaagaagggtttgtcctgccgttgtttcagggtatcctcgcggggaagccgcgaatgactccgttaacggaggagttcggtgcgacgagtgttgtggtcggatttcataaggtggcgtgtagtgtagggcaacttttcagtgcgcatcgtctcccggacggagtcaagctcgagctgactaagcaaatggtcgaccgcgtggctcggcttcatagctacggcattctgcacggcgacgtcaagtgggaaaacttcttcctggacgacaacggacgcgtttttctcggagatttcgagcaggctcaatctctcggtcaccgccggacggggccctgcggtccccgaggtggaggcactccttccctgcacgagcctgcacgcgctgcgtgctacttcagtgagccagatcgtcggttggatttgctcgaaagtcgagacagctggtgcctcggagtcgtttcttataaactctggtgtcatcgcttaccctttggcttgcacctaaatcgagctgacatggaagggttcatgaaccaggtggccaccatagaacgagatcgcctggtccccgacttcgacgattgccgcggttccgaacaaacaccggaagacgtgaaagagttgattgctgcattgctctatcatgaccggtaccgtcgggagacgccactgagtctcatcgaaaaatcgcatcttttccgtcgccctccttccgagaggaacgacgtcagcgtggaacttagagcccatgaaagtgacgcggccgacgtactccgtccagcggctcctttgccggaggagcgcttgcatgcgccagaaacaaagtttttcaaaccgagaaaacactggtggaggagttatttgcaagcctgttcaattcaataa

SEQ ID NO: 163 - DNA, 2241 bp, Toxoplasma gondii
atggcttctccacgccgctttccatgttccaccatggcgcggctatgtgttttgcttcttttctttactctgtgtctcaccactgcgtcgtccctggctgcgtcggacgcgaaactcgcttcgggtgctcccgccagtgacaatgagacacaggagagaagccaggcaaatacagcgtcaccctcgctaaccttggcgctgagtccgtcggacaactctgaagcggagacagaaaatgcgggggaacactctaattcctcgcagcaggcgaccgtcgcgcctgcaaccgagtcggtcttgatgagtgactcagtaggctctgatccgctggccgcgaaaaccacaagcgaggagacaactgtcgaagcgctaaactcggaggcgacaaccagcgaagatccactcgctggcagggcgttttcagagagcctcgatgcctctgtgaagagcgacactgcgtcaggcgaaagcgcagaagttgcggattcgctagaatctcaggaggcttctcacctggttggagcagacgtcctgattggaaaggaacgaccgactgatagcgaagtttcgagtgcgacaagcagtcccgagtcttctgctgtcagtagcgagccggagagaggggaggatgccgtcgccctcgcgtcgcctagtggtgaggacgtaggccaagcgtctggcgacttaggtcccctagcgccccgcgtttcgttaccgtcgccgttggaagttcaaggccgcaacagagacaaacaggcggtcggcacaagcctcgaggcggcccagcgagaggcgccagtcgacgcgggcgcgatacgcgacctccaccacctccggcctcccgcgccttcccgtggaagggccgctggcgacggcaacggaaacaagccgattggaggcaagcagagtggagcggcgccagtgcctcccggctctcctgccaatcaacaggctgacaccaacccagcgaatgagacctcgacaggccctggagccggtgcgggtgcggcgaatgatgacagtggagagcaatccgcgacagaggacaagagtgacagttgcgggtcgtcctgccgaagaggccggagcgagaggcgccacaggagaggactgcagattctcacggacattgcttcgtcgacgtggaacgctatcaaagcggtaccaacggcagtcctttcgggcgccaggaaaatgcgtctgatcgctcgcgggaagctgccactgtcgtggcggaggttcctaagtaaggtgcctcgggtggatgtgaatgcggtccccgagttccgtagactgaaagagcagatgcgtcgcgaggatcgcatggtgatgctcgtggagactccgtcgaaggagctgagagcgctggtgaagtcggcgatgcgtgcgctggggctgtctcgcgtcaggccggggatcactcacgcgacggacccgtcgccaggcgatgatgccaacgcgcagatgctcgaagagccgctggtggtgaaggcgcgcgtttttgacgaacgagacgggacgcgcgtgggcctggaagtgaatgggcagctttgggccgcgccgaagaacgcctttatcctgccagcttacggagcgtggatctctgacttgggtgactggaagccgcgggcgaatgagggggagcgccgcaggaggaaaaagaagctgttcatggccttcatggtgatgcctcggacgcgaggcgacgttcgagactacctgtgcaagcggtcgcttcccgtcgacgtcaagtacgctgcagctgagatgctgtacgcagtccagaagctgcaccgcgaaggctttttacacagagacatcaagctgacaaatttcttcgtggggtacgacggccatgtgctcctcgccgacttcgacggcgtctggccgatcggagtgccggcggacgcagacaagtacctcgtctacacccggggctacttggcccctgagatagaccctcacgaccaagtcattttgaacaccgcaaagtctgatgtgtacgccctcggcgtctgcctcaagcagctggcgaagcggtacccgaagacagccgacgtagacaagctgcacgacttgagtgataagatgacggaggcgaatcctcgcagaagattcacgcttgaggaagctctggggcacagtttcttcgacggcgtcgacttcgaaacgctcgaacaacttaaacacccggcgccgttccctggagacttccaaaatcgcgcgacgttttatcgatag

SEQ ID NO: 164 - DNA, 1662 bp, Toxoplasma gondii
atgatgtttcctgccgtcgctgcaccgcggcgtcggctgcccggcgagcgtctgcagaggtcgcagaacccagtggaaacgtcttggctttctttccggatactcgcgactcgcggtccttgcgtgactttcacattcctctttctcactgtcgccttcctggggctttcctgggtctccgtcgccgtcgctgcacatgcagagcatcccgaagactctgcaaccaactttcttttttctttcgcggagaactcgctcgcgaatcgcgaaccaccggaagacagcgctgcgcgaccctccagccgcagcggtggagctgaacgccgccgtctcgactcactcatcccaggttttctgaagcggcgccgcatcttcaagcagttgcggcctgtcgacgagtttcagcttcgagagtttcaggaggcgtcgtcgaaggtgaaggctcagttcttcagcgcaggtcactcgagggtgacgtttgtggaccggccgtcggcggcgttgctaagttttctccacctcgaggaggaggacgtcccctacggcgtcgtgatcaaggcgattccgtacgacgccttcgacttctacgagtccgtggcggagccgtacatccaccgcatgttcgacgacccgcgaaagtttccgtacgtcgtgcctgtgctcgcggcgctgcgaagtacatcgaagcgagtcctgtacctggtactgccgctctaccgcgagctaccggagacggtcgacgaagaggcgcgatcggtcgactttgtgttgctgcttgcggagatggccatggcggtgtgccagcttcacgagcgcaacttggcacaccgcgacctgaaggaggacaactttctggtgagccccgagggtcacatcgtcgtctcggacttggcgacgctggacatcacagacaacaagtcgtttctgattggaacgtccggctacatgcccccagaaacgcgcagcagctacttgctgcggaagggatacacgcgctcgcggtacggcgagaagacggacgtatacagtctcggagttgccttccggcaccttgcattcatgctcgaaggactgggcgttcaggtgcctcacaggacgcagctcgcgaagctcatcaaaaagatgacaagcgccgaccccgagaaacgcccgcttatcggcgaggtgatggaagacccgttcttcgcctccgtcgacttccgcctcgtcagacaacgagctgggaaacatcctttcaagaaactccccggcgcggacttactggtcgagcgccagcgcgcgcggctcgaagcgcgcgagaaagcggacgcggcggcgaaggcggcagacaacgcagaggtcccggccgccaagtcacccgccggaaaaaccggcggagcggggacactgagtggcgaccgcgaccgcgcaggaagcggcgagaagcctgcagaacgagcagaagaagagaaaggacgcggacgcggagcacagacgcacgaaggaaaccacgaccggacagacgacaccggaagagaagaactgcgggaaggacccggggaccagaaaccatcgggagaggaaaaccgaggaggaggccaaccacctggccagcgagaagagcagagagaggggacaggactcgaagagggcttcaacaaggaagacgcacaggagagctga

SEQ ID NO: 165 - DNA, 1923 bp, Toxoplasma gondii
atgccggaacaagatcttgctagcgggtttctgcttcgcttccaaaacgcaaggcctgtctgtctctctgtgggatcttttgtttctttccgaactgtccaaccaaggaaaatgagggacagaggctggcgatgtgtctggcatcggatggcgggagttggggcgctatttggaatatttggagtcttatgcacggtcgaagcaggcgccaccgtcgccgctccccaggttgagacagggcctcttctgtctgtgcgtgcgccgcgttcgcctctccatctcagagatgtcgacgccccagaagtgacgcatgcctcctcggaaggatcccctcaattcgaatccagtctctcccaacagaggttgaggcgcccagcggatagaggagaagcacacaatggcgaggagccacgcaaagacgctgcaacgcagacagtgaggggttatggtggccagagcacggaaccaccgcctgcatcaatcgttcctgtctcttccgaggcgccacaggatggggcagaacagagacaagcttcgtctgcagcggagtcccttgctggcctagatcctgatgcgggcgacactggtctccgtagccaagaaatggacgaagaaggctcgggtgcagcccaagatatggagcgagcgcatgcggcgcagccaaccgtcagtacttgggatgacgcacacctcgtccaagtttccaccagccacccggacatgtttcctgtcgatggaagtttctccaagaaacaagaggggcgaagggaacggcgacttgctgttcgtggcgatgactcgtttgctagaggtcacaatcgcgatagggacgcatccaatggtcgctcgattctcaggagggcaccagggtgggccaaaatcgccgccctggcaaccggattgctggtatccgcgttcggatacagctcgtacaagcatggtggcccgcgggtcgctttacgaattcacaagctgcatctgaagaggaagttaccgatttcgtggcggcggtatttgaacaatttaccggtgttggatgagaggcttttcccggagtttgaagacattttgccgtggctgaggagaggggcgcgtctggtgaagcgcgtgccgcacgtgtccgaggcgctggcggactttatagggttggacgaggagacgcggaggacagggattgtgataaaggtaaagtcttcaacggacgctgaggcgcggcgcctggtttacgaagtaaacgctcacgcaaacatggtgccggataatcccttctttctgccgattatcggcgcctaccaaggtgcgagcaagcgtgctgtgtacatgattcttcctcgcgcgcgtgcggacgtggcggactatgtgagagcgcgtccgtacgatgtcgacgttcgccttgctgccgctgagatggtctactcgaactacattctccatacacacggcttcctgcatcgggacatcaaggctcacaactacttcgtgacgttcgacggccatgtcgttctcgctgacttcgaaggcgttggcgtgctccagcagcgcacccccgtcgtcggcacccgcggatacttcgccccggaactgtcgcgggccactgaccacacagagaaatccgatgtcttcgctcttggccagactctcaaacgcctggtcaagtatatgcggccgaccgtgcgtgtgccgcacctacgcgagctctgggccctcactaagcggatgaccgcgaaagatccagaggagcggccgacgctgaaacaggtcatggaagacccctactttgacggaatcgatttcgagcgacttgaggcaaaagaccagggcgttcctttcaggggggacttctcgatcgacgatcccgacgctggggggaaaatgtacataccgccatccaaggaacaagaccatgaacaggaaaacgaatga

SEQ ID NO: 166 - DNA, 1875 bp, Toxoplasma gondii
atgtaccagctactgagaataaggtcgctgttcatttttgtgtcaattctcgttctacagacggtcacagtagcggcgctggacgatggcgccgagtcacttgatccacagcctactgcaggtgagggtgcaaaggagctgggaaacagaacaacttcccgaaggaaagatgccgttgctctaaaaaccgatggaacattgtcggaggcagaagcgaaacgccctgtggaggagcggtcaccgcagtccacgtatgacttttcttctgcagcgtccgcctttcagaagtgggcggacggtatgacgcctaaaaagaaagaaccagataatcttctggttgtgaaaggagatcgaaaaccgaaggccccccggatagcggaagacaacgggaccgatgatattgcagtggacgaaggcaacgagatagaagaagtcattcttcctccgctgaccacttttctagaaagagagcactacagtgcagtagctcagatgctcaacggcatgcatgaaagatacgagcactacctctccgcgactgtgttggaggagacccgggcgttccttgacaaggtgaaagatctccggagcaatcacatcgagcgattcaacaaagtaatcggcaacaatgaatttgcattccttcgtcccctacggtactccagactgcctcacccgtccagcgatgtgttgcgcaatcttcatccagagcacaacgcagtggctgaaaagcactggaaacgtgcctggggaaatcactatgcctcgggagaagtcttgaaaatcaagagactcgacatgattaactacgggtacgcgagcgccacgtacgcggtcaagcgcatttttccgtacactctcgatcccgacgaccgccagtctcggaccctcgatcaagacggagccctcaaggtgtttgttgtgaagagaaatcgaattgaagtggatctcgtcgaagaactgctcctccaccagacgcgcgcctggcgcttttttcctcccgaacgtgcggagcagctggcagaaacggaaggtctcctgatccctgtttctctgctcaagctcgtgaacgacgatgacgaggagatcggccagaaggaagacaggatcaacgaactgctgggtccgaagggcgacatcctcaatgcgttcctactctacccgcgtgcctacgcgtgcagcctcaaattcttcctcatctcttggggacgaacggaccttctaatcaagacggcgccaatgaaagcgatgatctccatcagcattcaaatggtctacgcggtcgcgtcactcaatagttatggactcgttcacggacacattcgaccgagcagcttcgtcatgacgacagacggaaaggtgctcttgacggacttccacacagttgtggaggagggctccaaactcagctgttcccacaaacgcgttcgtgcaatggcggaccttaacgcctctccggaagagctggaatgctctcaccatggaccaggacagacgttcgaggcgtcttttgctctcgacgcttggcgactcggagtgagtctgtacaaactctggtgtcgagagtcttggcgtgaaccgaagccaggagaaacctggaccgagcgtctgaccacgagacaagtcgctttcgtcaaagcccagcagcggggacgcacgtcgcgttccggcctcgacctccaacactgcagagcagacaccccttccttcattcttcgtcttattcagcaattcctcgagccgaaccccgagactcggctaacgcctatcgatgctgtcaagggaactagcctctttcgccatatggaaaggaggttgaaagtcgttcaagatattcgcgagaccatgctgagaaagcgcagcgaggagctgtag

SEQ ID NO: 167 - DNA, 2331 bp, Toxoplasma gondii
atgggacgggcaatatctttcgtcctcctcctgtcggcattgttgccggaaggccgaggtagtgtaggggcagctgcgctgggctccttgtcgctggcgcctacggcgacaccacaaaccttgctcgaactctctgcatcctcagtcacgcctgaagagacaggcgctgctcctttagccacaccaggggacgatagcagaaagcggaaggaagatcaggctgcaggcgaactactcctctcttggctgcaagttgccggcacatctccctacttccctgcggctggaccccagacacgcagaccggtagcatcctcttaccaaagtagaccaagaaacccttctcatcagcctcctccacgaggccgaaggggtccagtgcgacgctccccgcaaccggattctgtgccgtataatcttcgccggagacctcaggccgttggggtacaaccggggtctgcggccaccagaggtcgacttcaggagaggggtggcttgcggcagttggggtcaaatcttcggcaccgaccgttagcgcggcacatgccacccgaatattctgttttaccagatcaattctctgctcctttgtttacttcggggggaaatgcccggtggttgggcgttgacccccaagaaggctctgacagtgttccagcatcgctaactgatcccgtgtctggaccactaagtgaggagccgtctatcgctggtagagaccaacggccatgccaacctgtcgcctcacctccccgttcgtatgcaccgcagcctctcgggaccagttcgcccactttcccagggtcatcgccgttggtgtcgaaacaagtaggttcagacaccccacctgcgacgacgcacacaagccagactccatcaaaaggcaaaaaaccgccagcaccgcggccttgggtagagccttccgtactttccagtgttaaaagatccgaactgacacttggccaacgtgatcttgctgaccttgtcgggggcagcccaccgcagacgacccctactatacagaaggcgtcgccaccaataacagatgtctccacagaccctcccgagcttggcgtttctccacaacgggtgctgcgaccaaggaggatgcctgagacacttccggctcgcattttaccacctcagcacatatctcagcaagtgaagcaatggagagcgttcgtacagattagtccggcgatatccgccgcttctgcgtcgagcgcacagtcgcctgaaagtcaggcgatgtcagagagtatcgatcgtatggttccacctcaggcaagttactcggtcgccgcgccagacgggacggtgcgacaatttatgcgcggtgcattcctcggggccggagccacaggtatcgtaactgagctcattgaaaagacaagtggcagatattttgcggcaaaattctttttcaaagaagttgcctcaatggagggggcgtccccggctgcttttcaggccgcccagcagcgactgcagaaagaaagcaacggcaacgaattgctccgtacgacggccgcacaagtccgcgatttgtggcaaaaaggcttcgttgccagccttggcacatacaaattgagtgcgagaagcggagacggaaaccagttgctaggcacaaatttggttgatcccgagtacaccggactcgacggccaccagcttatggtcctcagcgattttctgctccttccattgatgggtcccaggctagattcgcttcctcacactgctttatctgacaatgcacagaaatacctttttcatacgcttgtgactgtcgtcgggtccctccacaagagtggtcttgttcacggtaacattcgcaccaccaacgttctcatcaataaactaaccggagaagctggacttgcagatttctctcttctcatgcaaacgggaagcgatgtgactgacactatgagcttccatcctactcagagcgaaccggaacgcgtccactccctcttcggcctcggcacccagttacccgcgagcgaggattttgattcctggaatttgggtcagctgctctttagtcttctgtgcggatttgacaagcttccctgggctctcggtcaagtatttgcgagattttccgcagaatcgccatgggaaatggcagcagagaagttctaccgacaatttatcaaggaagtgaaacgagaaaaattcgatgccttctgcccaggcatgacaggcacgaaattgcagctcataagcattgtaaagctgttactggaccccactcatgaaacaagatggacagcacgaaaacttgtcgatgaacaccccttctttcaggtggtggaggacgcatga

SEQ ID NO: 168 - DNA, 1626 bp, Toxoplasma gondii
atgaaaaatactctgttgtcacctgttggtttctttaccgctctcgctgtacttatagaatgccacctgagtgaccggtgtgttgctcatcatggcagcagcactgatggatcaggcctacggccccctcaagaggtcgactcggcaccacgaacgccgtcgatcgctgttaaagagcttgccacgtttcctggagatgacattcagacgtcatctcaagaattgcccggctatgaactttggaccagggaacaatcaggggcatctgtgcgtgttgggtttccgcagaacgccgaaagttttctgacacaaagagaagcgagagacgaaatcgcgaatgctcacgagctcgtcgctgtaactccagaaggcgatgcgtggaatcacagtggtgttgtccccgaggagcagactgtcacgcctgcttcaggtagcttcattcagaggcaagccgcgcatgcaccgccttcgactcgattgacgcccgtggaccgccgtggcaggtcacacacagtgtcagctgtcagacggcgggtgaccgtggaagacgttatgcgaccggaccaatcggcagccatgcatgcagtgttgtcagcatttggaggaggcctggttctgaaggctaagaacaaatggggtagaacacgttacacgctacagggacccgcaacattcttaggaatgggagccgagggcattgttgtacgtctaaatcaggtgaaaagcgaccgggaaagatcggtgacaccggtggcagtcaagctgtgcctcattcgtgcagcagtgttctcggggctgacatggtggagaaaacgaaggaccagaacagaactaatgaaactgtttctgtcgaacgagaattctgtgaagcgtgctctaccagatttggacccggccgaaatgctagagcacggtctcgtcgttccacatcatgctgagcttgtttccggtatgcccacgtggtttgccgcgggcgactcattttttgtattacccgttgtttctgtgtctcctctttttacttgcgacctcgaaacggtcgtgcaaaacccgttgaccttttgggcgaagatgtacattacccgccagttgctaaagagtattgcgtggatgcatcaaaaaggcatttctcataatgacttgaagcttgagaatgtcctgctcagtgcagacggaagggttgccatcggcgattttggtttttcaagccccttcggggcttcgttgcccatcaggggcactcatctatacatggaccccgacagctcagaagcattttttgaacaacgagagaacgaaatcactccccacagagatgcatgggcgactggagtccttcttttctatctgtggtgtggcgtgtttccattcgggttacagaatgtcgctaacgcgggtccgccacaggtgatgagggtcacagtcatgcatgcaaggactaccaggccgccgcccaacttccggctgtgtcggcgcatcccgcgtgaggttcggaacctcgttaccggatttctgcagtggaacgaggaagctcggcgtctccccagcgatgttgccgacgcgttccttgccgctacggacgacggtggtagagaggcgcgtcggataagaacgcatcaattttga

SEQ ID NO: 169 - DNA, 1767 bp, Toxoplasma gondii
atgagcaaaccttttttcccacaggtgtgggtatcgtgtacaggtggagtgttgaatttgagaaggcactggctgcgtgtgggaaatatgtcacgagcttttgcgccgacagtcctgttcgttttgctaaatgtaggggggagtttgtgggtacctagaacattgccagtgagcgcttttcaggacgctgttgcacctcatcacccctgcatcggtcgtccgtgcgaccaggtggcgtctgttgtggccgtaccgccggccaacaacctcggctttaaacgtgaaccatccgtaggttctccagggcatttctccttcctgcaagcagtcggcggggtgggagggcctccttacgcaggcgacggaagcccccttcttgccagtcggttagactggcagtttctgcagcaatggcacacggatgaagacgaaaatgcccgtgacggcttcgtcgccgctctatcgagagttacacgtctaagtcaaattctagaggactgcaatatggagatggtcttgctccttgatcgcgttttttcccgcagccctcgtatcacgctgtccgctgttgagcccaggacacaccggcgtcgaaccctaaaacttaaaattcgctctgtggcgggcacaggaggatacaacatcgtcgtgaaagccttcgtaataaagtcgtggtttttccggctagggcactggctagggtcgctgggcaggcaaagaaacaccgcgcgtgcacccggcggagaaaccggtcagcagacaggcacatctggcagacggagctcgcgctccagagggcagtctggcagggaggaaggcaggcgcgagccacaaatggtatccctgcgaatccgagtggggggggctcccgattgtcaagtggcgaacgagatgcaggcagctgaagtagtccagaagtgcgtttcagaggcagatcgcatcatgcatgtgttccccgaagatgtaactcctgatgtcctggtgtcgcgttttcggttcgcagttccattgtattcggggaggatccgccacagatctgcgctcctgggacaatcccgcggttatgcgctgctaaactacatggatgtgttgccaccgatgctgtgtgatctcttcgctgcccagagtgtcgtacagccttctatgacgagagccatagcaaaacagttgcttgagctcgtcgcacatcttcaggcgcttggggttgtgcactcggatctaaaaccggaaaatgtgctagtcgacgaagccggaaatttgtttctggcagactttgacaaagcccacaaggtagggtcccgggtccgttgcagcagtcttccacactcgctgttcgcggatccacaaacggtgatttgccgagagaccactcctgatcaggaggtgactctggctttctcgcaagacgcgtgggcactcggaatgttgatgtacgacactttctgccgcaactggcccttcatgggtatggactataacaacgactcagacacatccaacacaattgtactcgcagggcttttggaccgggctgctgccgtagacacgcgagctcccattgactggataggctgtgataatcctcgagtggagagtgaaataaaagaccttatttcccgcctcctggatattgatccggaaaaccgactcgatgtcttaagcttctacatgcactcagactttttcaacgaaggacgaaacgaggcaaatcggtcacctccacagcggggcgctcccattttgcctcttcgggagtcaattgtttaa

SEQ ID NO: 170 - DNA, 1578 bp, Toxoplasma gondii
atgacaccgtcgacttgctgctttggagttttgtttcagagctttaggggtaattccgcgtctgcgtccgaggagtcatgtcttggggggggccaccctgacgggactaccgcaaccgttttccgaccgaagaccttccaggcactggggctcgccacggattctgacagtgagccagagggaaggggcggttaccaacgactgacagagtcgactcggcgaaagaagaaagcgactggacgcattgcctctctctttggccgaggcagaggcaaaggggatgaggaggcatcaggcgatgaaggcgccagcggaggaaaagaacagccactcggtcccccctctggtattccacggcgccgtcggttctggcagaaagaacacgtggagcccgaggatgcagtggtaagggcgtttcgcaggttcttgaaatacagagtattggatgtggaaaccatagagggagctccctcacagttggatcgatcgtcttggacgccttcaccgccgttctttcagccaggagaggggtcgtcgaaagccgtcgagtatttcgtcaaacagcagacaccagcgttaactgacgagatgcataaactattggaagttgtcgacccagttatgcctcccggcaggccgcttcagatgtcgagtccgtcctcgaaacgaaccacccacttcgaaaggggccccatgctgaggacagatttctttgcactgacagttgaccaccagcctttcaatatgaggatattcccgttgcctggcggattcgaaggggaacagaaggtggaacaatacaaaaaagttatgctaaatgaacagaaggttttaagcatatttggtgttgcggatggtaagaaagtcagcaatgcctatcactgttatcttccagtcgaagaagtcttttttggaaagggacagcaggtgatctcacttggtccaagcttaaaaatgcccagtgttgtttttctgtacccgagcgcaagcgcgacgctcggtcaagtcgctgaggcgataaaactagcagctcaacagcagggaactgcacttgtcgctcaggctgcccagctgcacattacactgcaactcatcaagttggtcgcgatcaccacctcaaaagggatcctgctaagaaggctctcacttgaaaatttccttttgaggggggatggggtggtttttttgagtggcttttctgaactcgtaaacgaaaaggaaattttttacgaaacagaggatgggacccttgttacacagccaccgacgcggacttcccgcggaagacgtttcacccctgcagacaacagctgtgatttaggacttgtcatctttagtttgtggtgcaacggttcgcctcctgagagagagccaagtggatgggtcaacctggatttctcgagttgcgagtcagaggtgccggtgcttgtccagcaaataatttgcgggttgtgcagggcccacggctaccctcctcagaacgctttccaaacccttgggagtcacgagtttaaacaactgaggcaattgtaccgagacgtggaacaacgtgctgaggtacatttattagtggaatga

SEQ ID NO: 171 - DNA, 1473 bp, Toxoplasma gondii
atgcgtcacgtgttcaactctagcgcttggcgcgtagatttgtcggggtctgcgaatgtcggccgcgttgcagaggagtttgatagacaggagggccctgacgctcttattgggcaaccaacgcatgcggacaatcaagaatctttgtcgaacttgtgtcatacacagaatgatacttcgaccgagccagcgggacctgtgtcgaacacctcacggaggaaagcgtttcgctggagggttcaccacgtgaatacccgggttttttctacactgcaccgctatcttcgctgtacgcctctctgttcgcgggctaagtatgatatccgcaaaaacgggctggcgtttgctcagcttgacgagcaccggggtcgttctgacatcatggcggtacttcgctgggtagacgtcgaggcgtgtgtatacaaacaagataaaggtgcgattgctgctgccgttgcagttgacagcctcgtcagcaatggtagtcatttcactttagacgtccttgataaggaatgccaacctctgcggatggtccgggggcggtacttaggagtaggggggaatggcatagttttcgaggcttcgactgctcactcaggagagttggactctttggccctcaaactactgttcctcgaccgcaccttcctgcaaagcccgcagtctgatatttcaaaagctcttgctgtaagcaaacgcatggaaatgaggatccgtctacttcttcgttccgttacatcggctcaactatacttccgcgacaggtttgccgtacctctcttttgtggacgaatacgtggacttccggatctcttcgatattggcagcaggggcgcgggatgcagcattgtggtcctttataagaggctatattgtagcctggctgaccttctgtcggcgtgcgctagcttatcgtaccaagcaaggctgttcctcacaaagcagatgatagaggttgtgcacaacttgcactgcaagggcctcgtgcatcgggatattaaagactctaacttttttcttgatgaacagggtaacatttacctcggcgatttcggccttagtgttcccaacggtagtactgaagctcttgtttacacaccaaagttgacagatccttcagacgtcggaatcgtactggcggggtgggacagaagacgagcgattttcgctcaagttacggaggctgctgatttgtgggctttgggtatgacattgtacaaattatggacaggcgtctacccttttggtctttcttcgaagcattttcgtaggacaaaggatgtcacaatgtacattcaacagttgagcgaggacaaatcattgcctgacctttttcgccagcgccgagacgctggcggtcagcaggtgcaccccgaagttcagaggatcatcaggggtctcctttgtttcgacagaacacaaaggttgcgtttaagcgaggttgtacggacctcacaagtgctttcctaa

SEQ ID NO: 172 - DNA, 621 bp, Toxoplasma gondii
atgaattatctgggtctctgtgtaacgagggaaaagaaaggatgcacgacgggcaacgtatacatgttcacgccccttttgcagggagacatcaggcgggtcgccgttcagcatccttctcagtgcatcagcggcgagcttgtcctgaaggaaatggcggcgtcgctgaaggttctccatgatgcgggccttgttcacggcgatgtaaaggagcaaaacttttttgtggggagagatggccacgtagtgattgctgacttcggtgccctaggctaccctggttgtagtttagaagctggtaccctaggctacattgcaccggagcgacttgtcaacgacaacgcaaactcttttgcctcagacatatgggctctcggagtgactttcaaaaacgtgttaactgccttacgcgctacagtccgagcagaccgggaagtgttagatggattgtcaaaccggatgaccgcttccgatcctgctgctcgtccatcagtggacgacgtgctgttagacccctgtctctccgccccgcccagtctcgcaagccacgatgttgcaccgttcactcccgatgcttttggttattattgtttgactggagcgaccaatacatcagattaa

SEQ ID NO: 173 - DNA, 1533 bp, Toxoplasma gondii
atgcggttctcagccgtcctctacatgctgtcgacttgcgcggtgtgtggcgcttcgttaggtttaacgtctgatgaggtggatacggtggccaacaccgatgctgccggtcccgcggagcagaatgaccgtttccggaaactgggtgaaaaactccgttcgtcttccgataaaaatgaaacagatcaggctacttcagagtctgaggacgcccatctgtggtcaagtggatccgaaggagcgtctggagctcctgacgagctgaccagtgtgacttctatgccgttcgaggaagacatagggtacagccaagcagatttgacggggtactccgcgtccactagtcagcagtcagaaagctgggcgaaaagggcggtccgcaaaggtgccgcacctttcctcgaagcttctgagtcatcctccgcgtcaccaggagtccttggtctcggctggtctttcgtccggagtgtctgggatgatctgaaagaccttcagtcgtccaactcaagcagagataaacagaaggaaggcgacgaagcagtgaacgagactggacaaaacgagtctttctcctggatgtcgctctggaaatggtggtctttctatgcgaatctgccggaattggttgagacggactacgaagaaatgaaggacgtggtacggtcgatggagtcctcgaaggagcctgtgacgaggcaggtgtacatggggagtgcaaagctggctgaagatcttcgcgttccacatgcactgttgacgggcggcttcaccgtcaagatgtgcccggggagcagaagcaagccgtggaaagcgcttacagagatttttctcaggaagaaacttctgccgccgaattccccgttttttgtgccgctggttgcaacagcgaaagggaaggaggcagccacgcttcagttttttcctccgacgcgcggcagtctccgggcgatcgccacgcaggccccagaaaagctgaatgtagtcttggtgatggccgagatggtggcggctgtggaggcgctgcacggcctcggaatcctccacggagcgctctcgctggatgccttttacgtcagccgggagggtcatgttcagctgagcgacttcgacagcgccattgtcgacaacgtcttccggccgatctcggagatggccgaaccggtgcgggacgggtatagggcgctgtcgcggaagctgaacatttctctcctccacactaaggcagcagacgtcttcagtctagggaaggcatttgaggctctcgcggacctcacagatctcgagaacggggaccgactcatgctggaagttctggtggagcgcatgacccaagcggactcggagaagagaccgagtctcaacgacattgcacgagacaaatttttcgaccgcgtcgatttcgactcggtgcgagctcgcacaaatccatgtgtctactcatgccgctggcggcgggagaaaatgtctgcaaatgacgcagccactacggcttcagacgctgacgaagacagcgacgacgatgaccttccttaa

SEQ ID NO: 174 - DNA, 1134 bp, Toxoplasma gondii
atggcaaatactagcgtacggcgtcgtcagcttctttcgtctgttcttttgttacaatggctgacaacagtattaggtgttgcttggggtcccaatcccattgacgggtcaaaacatgggcaatttccttctttacggagaacagagggcgtcagtcagagcggcagcggccacagagggagtgtgtaccgcattccccttgcagatatgactttctggtcgtggatgtcttacctgaaggaactaccggacattgacgagagcaggaatcccattttgaagcgcctgctgagtggaagtttcctgcgccgggatgggtctacaactgtcaacgtccgcgtgcccgccagagagttagtgaggttactttcgctaacaccagaacaacaaagagagggtgtcagcgcgaaagtccggctaatcaatttacttgacccgaagtattcggtgtacgaaccatacttgtacagagaaatccttccaaaaagaagccccctactcctgccatcgcttggcgagtacagaggggcattcttaacttacatatttcatcctttatccaaaggtttggtcggagatatgctggagacgggccgctctcaccccgatgtgcaagtcttagcggcgaacatggtcgctgccttgaagtcactgcacaacttgggtttgcttcaccgaagcattgagctgaacagtttcagtgtgttaccggacggaacggtggtcctcggtggtttagatacggcggcgccaatagggacagaaacaagattgtgggtgggattctttgggcaggaaacggcccctgaaattgataggaactttctggcggatttagctctcacgcaaggccgccacacggtgaagagtgatgtgtactcacttggtgtcgcatttcgcaaccttgtgcaactgctcgggaacggtaatcttggaccggaggaccgcggtgcggttcggcaggaccacctggaactgttggataagctaagccagaaaatgatagaagaagaaccaggtaaccggccaaccattgaggaaatcatgaaggatccgctttttgagggactgaacttcgaagacatcgaggaagggaaagcgaggccgtttaggtacaagcagaaccgtctgtga

SEQ ID NO: 175 - DNA, 480 bp, Toxoplasma gondii
atgaatgacactggatcgtgggccacggaacgatcaggggcattgccgcgattccgcactacaggggagcagttgtcggaaggggcgtcagtgcgtgaggaccttgcgccggggatcagaggagttctgacaaagaaaggagcgagagcgaggacgacaaaacgccacgagctcgtctctgtgacgtcggaagaacattactggaaccaagggattgccgaccacaagggacagaccgcgcctcctgttgcagcttcaagcagtttcatgcaaagcccctcttcgcttgccacgcctgtggtcctgaacgctcctgttgacttccatggacagggcgatatcactgctgctgtgaggagtcgacctcttgtcacggcaggcttgtcgcggcatcagattgaagccaaaaatgagttcgacagaagatttgctgaaggctttcaactgactgctgaatctattttcaccggagaaacctga

SEQ ID NO: 176 - DNA, 4092 bp, Toxoplasma gondii
atgaagcagggaacgacccgcccgcgggttggtctaacaggagctgttctactccttgtagtctggactgtcgcgatcctcatagattgttcttcaggcagtcgggtcctttttgaccgccgtcctatactagcccggctacgtcgcgcaacttcctttgtcgactccaccagcggtcagaatgcctccccccgcccgacgaaaacagataaaattcggaaaccacgaaacgacagtagaaactaccgctacatcgagctgccaaacgagttgcgagccctcctcgtttcagatccggaatgcgatgaagcagctgcatcgatgcgtgtgggtgtgggctccatgtcggacccgcccaagatacctggcctggcccattttacagaacacatgctgtttcagggatccaagcggttccccggtacgcatgacttcttcgatttcgtccacaaccatggtggctataccaatgccttcacgagcaagttttcgacggtcttctccttctccattggccccgggttcctggaacctgggctcgaccgcttggctgacctcttctctgccccgctgctgaaaagcgaaaacctgctcaaagaagtcaacgccgttcattcggagtacatcattgacctcaccgatgacggccgtaggaagcaccatctcattcggcagacagctaaaggcggtccgttctctaatttcaccgtcggaaacctcgagagcctcatggagcggacgaagcagcagggcatcgacccggtcaaagccatgcgcgagttccacaacaaatggtactcgtcaaatctcatgacgttggctgtggtgggccgagaatctcttgatgtcctcgaaagtcacgtccgcaagcacttcggcaacgtccccaatggtcgtgtcacccctccagtattcgaagaatgttctgaagcattcattcctcttgatccgaatgaactcggcactgaaacgctcgtagttccggaagcagaccttcacgatgccactttcgtcttttatctgccaccccaagcgaagaactggcgaagcaagcctctgcagttcatttctgaaatgctggaacacgaaggaccaacatctctgtcaagcaaactcaaacgcgagggtctcatcacgtctcttgttacggattactggtcgccagagctttgcaccgtcttacaggtcaacgtgcgcttaacagaaggaggacgatccaaggagagcgtctataaaataggccacgctcttttcacctttcttcgaaacctcggcgtctctcgccctgaacgctggcgtgtgacggagatggccaagatccgccagcttggattcacgtttgccgacatgccggatccgtatgcattaactgttagagccgtggaaggactgaactactacacgcctgaggaagtgattgctggagatcggcttatctaccatttcgacccggacatcattcagcagtatgtgcagaagttcctggttcccgataacgttcgtcttttcatatttgataagaaacttgcggcagatgtggatcgcgaggagtactggttcaagatcaagcatggagttgaacccataatggattccgtgttcaagaagtggaaggaaatcacctcagccccagctaacacggtgcagagtatgatgcgaatggaaggcatggcacttcctgctccaaatcgattccttccaaataacgtcgccatccttcctcgtccgcctggttccggtcaaggcgctgagaagagtgccttcccggagcctcttgtctttgccggcgaccacatctgcgccaacaaatgtgctgtttttcacaagcaagacaccacttttcactctccaaaggctgtcgtcgagcttcaaatatattatactggaagtcatgaagacggcgtccgcgagcgcatcctgactgcgctgtacgtgcagagtcttagattcgctctgcgtgagcggttcgccgatacgcacagggcaggcatgtctcttggcctgggtagcggtgtcgccgtcgggtccaccacgcttccgaccgtaaagcgacagagagtgctgacactctctgcggcaggcttttcggacaagctcgattatgtgcttcgcgcattcgcaaagtctctcgcggcaactgagggtgcgtcagatgaaaagccaatcccttcacctatggaacttggagtcactatgtctcacggcgtgagacatttgatgcactcccgcgtcaccgctccatctaatgtactcgcttcggtccagtcaagccgtgtatacaccaccgcagttcgcttgcctggaggcggccgagccgcgcgtcggaccctgacacacgaccagatcacaactatgcatcggaaaccggcctcgatggatgtaactctgatgagaactcccgtatcctcattgggcatccggatcgtcggcggaagagcagaaagagaagctacaccggttgttgctggtggaggaaaacccctcctggagaagcgtttcttcaggctggcctttgatcagctgcggacagacttgcgagtagcaaccctcaaccgcacccctttagcgcaagcgaacgacgctgttttggagctgatcatgcacccacatgttccagtccacaaaatgtatgccgccttattcgaaatggaaaagaatcacccgaccctggacgcaatcttcgaagaggttgcagactggggggtaaagctttggaatgaagctgccgtcgagggtcttgtccagggtaacattacctccgagtcagccacacagctcgtaggggacgtaatttccctacttccactcaaaaacatcgtcgcggccaacacgattgccaaacccacaatttcgtcgttttcttccctgaggagagcaagttccgttgccccacaatcctcgtccaaacaagattccgttccttcatctgacatgcctacgtcgaccgagacattatccatgccgtcgtctgcggagagtcaaacgcctgaatcaacagaccgcgcctctttccctatggagtctactacaggccccgcgccttactctgtggagttgtcaacagggcgcacaccataccctgatgatcttccaacaagcagtacaccataccctgatgatcttccaacaagcagtacaccatactctgatgatcttccaacaagcagtacaccataccctgatgatcttccaacaagcagtacaccatactctgattatcttccaacaagcagtacaccataccctgatgatcttccaacaagcagtacaccataccctgatgatcttccaacaagcggtacaccataccctgatgatcttccaacaaggagtacaccagccgctgatgatcttccagcaagcagtacaccataccctgatgatcttccaacaagcggtacaccataccctgatgattttccaacaagcagtacaccataccctgatgatcttccaacaagcagtacaccataccctgatgatcttccaacaaggagtacaccagccgctgatgatcttccaacaagcaggacaccataccctgatgatctcccaataaggagtacaccttcaccgattgtgctttcagcgggacgggcaccgtccgttgtcgtctctccaatagagcgtacatcatcccctgctctccttccaacagagcgtacacctctcactgaacgtattgcgcaggctctacggccagttggagaggcggcagctgtgaggaggctcttagtattgagaagatcaagcatccaccgaatgccctatagtcccttccagtactcgagtacctggtttcatccgagctcgaatagtcgaagacaaatgatgctgcgcatggcattaaggaggcagctgggggcactgactagacaggcgcagccagacacagaggggaagccatcgactgtcttcgtgttccgtcgtcttgccccaatgccacggcgcctaaacattgaacaaggtccctcatttctgcaacgccaaggcgagtatgccgcctccggttcagccccgcatagtgattgtacaaacggtgcttgtgcaaagggtgcatgcagcggcactggatgtcagaaacgcctgtaa

SEQ ID NO: 177 - DNA, 1065 bp, Toxoplasma gondii
atgccacggcgcctaaacattgaacaaggtccctcatttctgcaacgccaaggcgagtatgccgcctccggttcagccccgcatagtgattgtacaaacggtgcttgtgcaaagggtgcatgcagcggcactggatgtcagaaaacgcctgtaaagccatctggaggtccttgtaaaggggatgcgtgtaccggatcatcttgcaattcactcgaatgccaacgatcctcttcgagcaaatctgatcatccatgcacgggtgacgagtgcccggtcccatgcagagggccgggttgttcagcaccagcctctcatccctccccttgcactgaagcagagtgtggaaagaactcctgtcctggctgcaaacaggaggaagagaaactggttcagttgcgttcaataaggaagaatctgaacccgaatgacaagaagaaccaggcgtatcttttaattgaggttggtgcgcttccgaacatccacgaccgggcagtattgtacatggtcagccgatggatgtctcagcgattcttcaacaagcttcgaactgagcagcaacttggttatctgacagcgatgcattccagtcgtctagaagacagattttattatagatttttcatcacttcgacttatgacccggctgaagtggccgaccgcattgtggagttcattaacgcagaacgctccaagatcccaacccaggaggagtttgccactcttaagcaggcggctatcgacgtctggaagcagaaaccgaagaacattttcgaggaattccgcaagaaccggcgtcaagttgtactaggcgataggctctttgacatcaatgaacgcatggttgctgaactcgagcgagtgactccggaggaaattcagagtttcaaggagaagacaatgttcaacgcatcctggttgctcatggaagtctactcgcagcgagaaaagccgcagatgcttccacaagccaacggtgcatccggcgaaagcaagctcgacccgtgggtggacattgatcctgaattgctgtcgaacatcactgtccctgatatggaatctgattaa

SEQ ID NO: 178 - DNA, 4938 bp, Toxoplasma gondii
atgaagcagggaacgacccgcccgcgggttggtctaacaggagctgttctactccttgtagtctggactgtcgcgatcctcatagattgttcttcaggcagtcgggtcctttttgaccgccgtcctatactagcccggctacgtcgcgcaacttcctttgtcgactccaccagcggtcagaatgcctccccccgcccgacgaaaacagataaaattcggaaaccacgaaacgacagtagaaactaccgctacatcgagctgccaaacgagttgcgagccctcctcgtttcagatccggaatgcgatgaagcagctgcatcgatgcgtgtgggtgtgggctccatgtcggacccgcccaagatacctggcctggcccattttacagaacacatgctgtttcagggatccaagcggttccccggtacgcatgacttcttcgatttcgtccacaaccatggtggctataccaatgccttcacgagcaagttttcgacggtcttctccttctccattggccccgggttcctggaacctgggctcgaccgcttggctgacctcttctctgccccgctgctgaaaagcgaaaacctgctcaaagaagtcaacgccgttcattcggagtacatcattgacctcaccgatgacggccgtaggaagcaccatctcattcggcagacagctaaaggcggtccgttctctaatttcaccgtcggaaacctcgagagcctcatggagcggacgaagcagcagggcatcgacccggtcaaagccatgcgcgagttccacaacaaatggtactcgtcaaatctcatgacgttggctgtggtgggccgagaatctcttgatgtcctcgaaagtcacgtccgcaagcacttcggcaacgtccccaatggtcgtgtcacccctccagtattcgaagaatgttctgaagcattcattcctcttgatccgaatgaactcggtactgaaacgctcgtagttccggaagcagaccttcacgatgccactttcgtcttttatctgccaccccaagcgaagaactggcgaagcaagcctctgcagttcatttctgaaatgctggaacacgaaggaccaacatctctgtcaagcaaactcaaacgcgagggtctcatcacgtctcttgttacggattactggtcgccagagctttgcaccgtcttacaggtcaacgtgcgcttaacagaaggaggacgatccaaggagagcgtctataaaataggccacgctcttttcacctttcttcgaaacctcggcgtctctcgccctgaacgctggcgtgtgacggagatggccaagatccgccagcttggattcgcgtttgccgacatgccggatccgtatgcattaactgttagagccgtggaagggctgaactactacacgcctgaggaagtgattgctggagatcggcttatctaccatttcgacccggacatcattcagcagtatgtgcagaagttcctggttcccgataacgttcgtcttttcatatttgataagaaacttgcggcagatgtggatcgcgaggagtactggttcaagatcaagcatggagttgaacccataatggattccgcgttcaagaagtggaaggaaatcacctcagccccagctaacacggtgcagagtatgatgcgaatggaaggcatggcacttcctgctccaaatcgattccttccaaataatgtcgccatccttcctcgtccgcctggttccgggcaaggcgctgagaagagtgccttcccggagcctcttgtctttgccggcgaccacatctgcgccaacaaatgtgctgtttttcacaagcaagacaccacttttcactctccaaaggctgtcgtcgagcttcaaatatattatactggaagtcatgaagacggcgtccgcgagcgcatcctgactgcgctgtacgtgcagagtcttagattcgctctgcgtgagcggttcgccgatacgcacagggcaggcatgtctcttggcctgggtagcggtgtcgccgtcgggtccaccacgcttccgaccgtaaagcgacagagagtgctgacactctctgcggcaggcttttcggacaagctcgattatgtgcttcgcgcattcgcaaagtctctcgcggcaactgagggtgcgtcagatgaaaagccaatcccttcacctatggaacttggagtcactatgtctcacggcgtgagacatttgatgcactcccgcgtcaccgctccatctaatgtactcgcttcggtccagtcaagccgtgtatacaccaccgcagttcgcttgcctggaggcggccgagccgcgcgtcggaccctgacacacgaccagatcacaactatgcatcggaaaccggcctcgatggatgtaactctgatgagaactcccgtatcctcattgggcatccggatcgtcggcggaagagcagaaagagaagctacatcggttgttgctggtggaggaaaacccctcctggagaagcgtttcttcaggctggcctttgatcagctgcggacagacttgcgagtagcaaccctcaaccgcacccctttagcgcaagcgaacgacgctgttttggagctgatcatgcacccacatgttccagtccacaaaatgtatgccgccttattcgaaatggaaaagaatcacccgactctggacgcaatcttcgaagaggttgcagactggggggtaaagctttggaatgaagctgccgtcgagggacttgtccagggtaacattacctccgagtcagccacacagctcgtaggggacgtaatttccctacttccactcaaaaacatcgtcgcggccaacacgattgccaaacccacaatttcgtcgttttcttccctgaggagagcaagttccgttgccccacaatcctcgtccaaacaagattccgttccttcatctgacatgcctacgtcgaccgagacactatccatgccgtcgtctgcggagagtcaaacgcctgaatcaacagaccgcgcctctttccctatggagtctactacaggccccgcgccttactctgtggagttgtcaacagggcgcacaccataccctgatgatcttccaacaagcagtacaccataccctgatgatcttccaacaagcagtacaccataccctgatgatcttccaacaagcagtacaccataccctgatgatcttccaacaagcagtacaccataccctgatgatcttccaacaagcagtacaccataccctgatgatcttccaacaaggagtacaccagccgctgatgatcttccagcaagcagtacaccataccctgatgatcttccaacaagcggtacaccataccctgatgatcttccaacaagcagtacaccataccctgatgatcttccaacaagcagtacaccataccctgatgatcttccaacaaggagtacaccagccgctgatgatcttccaacaagcaggacaccataccctgatgatctcccaataaggagtacaccttcaccgattgtgctttcagcgggacgggcaccgtccgttgtcgtctctccaatagagcgtacatcatcccctgctctccttccaacagagcgtacacctctcactgaacgtattgcgcaggctctacggccagttggagaggcggcagctgtgaggaggctcttagtattgagaagatcaagcatccaccgaatgccctatagtcccttccagtactcgagtacctggtttcatccgagctcgaatagtcgaagacaaatgatgctgcgcatggcattaaggaggcagctgggggcactgactagacaggcgcagccagacacagaggggaagccatcgactgtcttcgtgttccgtcgtcttgccccaatgccacggcgcctaaacattgaacaaggtccctcatttctgcaacgccaaggcgagtatgccgcctccggttcagccccgcatagtgattgtacaaacggtgcttgtgcaaagggtgcatgcagcggcactggatgtcagaaaacgcctgtaaagccatctggaggtccttgtaaaggggatgcgtgtaccggatcatcttgcaattcactcgaatgccaacgatcctcttcgagcaaatctgatcatccatgcacgggtgacgagtgcccggtcccatgcagagggccgggttgttcagcaccagcctctcatccctccccttgcactgaaacagagtgtggaaagaactcctgtcctggctgcaaacaggaggaagagaaactggttcagttgcgttcaataaggaagaatctgaacccgaatgacaagaagaaccaggcgtatcttttaattgaggttggtgcgcttccgaacatccacgaccgggcagtattgtacatggtcagccgatggatgtctcagcgattcttcaacaagcttcgaactgagcagcaacttggttatctgacagcgatgcattccagtcgtctagaagacagattttattatagatttttcatcacttcgacttatgacccggctgaagtggccgaccgcattgtggagttcattaacgcagaacgctccaagatcccaacccaggaggagtttgccactcttaagcaggcggctatcgacgtctggaagcagaaaccgaagaacattttcgaggaattccgcaagaaccggcgtcaagttgtactaggcgataggctctttgacatcaatgaacgcatggttgctgaactcgagcgagtgactccggaggaaattcagagtttcaaggagaagacaatgttcaacgcaccctggttgctcatggaagtctactcgcagcgagaaaagccgcagatgcttccacaagccaacggtgcatccggcgaaagcaagctcgacccgtgggtggacattgatcctgaattgctgtcgaacatcactgtccctgatatggaatctgattaa

SEQ ID NO: 179 - DNA, 2352 bp, Toxoplasma gondii
atggcgcgttcgtcgcgagctgccccgagcggggcgttcgctcacggagtagccaaagcatcgtttacgtggatttcgggaatgaaaactccgtttggctgcgtgtttttcttctgtctcattgctttatgggggttttcggccgcccttcggacctctgacattggtgttgacgccttgtccgtctcgtctcgtgcggcggcgaacggttccgaaggtggcgtggctcagtcggaacaagagcgtgctagcgatgaacagcgcaacgactcagaggcccacgattccgtcgcttcctcggagtcctccgatgcggaacggaaagacgaccctcccgacaacaagagtactagtgaaactccggaagcaaagctggcgggacgggatgcatccaaccctcctgcctcatcgaagagcccgaccccaagccctgccccaactccagctgtaagtacaagcaccactccagccaagtcgtcggcagacacatcaaaggacccgaaaaacaaactgagttcggcgaggaaagagaaacgaataggcaagaaattcaaaaggcatgatgagtttctcgcagatgctgttattgacaagttggacagcatgagatctgtgcaagtttccggtgccttgctccggcggatctggaaggagcaccagcgggttggggacgacatgcgggatctgctgcgagaatacatcttggctctcgaacgggagctgtacacccaacaggcggaagttttcggggtggagcaactaaagatggacgacgtgatccaccacgagcactcctcggaggcgaggaagcgcgaggtggagctggagatgcaggctctcgcggaacaacacaattttatgaagaagctcttcggtcacattcaggctaatgtggaagcgaaaaacaccagtgcgctcgtgaacaggatcgaagaactggacaaaccaattgatatcatcgacgcaatcgacaagaggtctggatcggatgttcttcattgtttgaaagtaatcggcaaaagcatcagatacatgcaggagtcggtgaagaagttttcccgcgaactcaagacgctggagcggcttgatgccgaacgcccctctggagaagcggagcgaatcagagaaaccctcggattcgtgatggatcctctgtccggacccctcagttctatggactatgagtcactttcctggatcccgtcaaagggacaagctctcctccatgtggacaaagcctaccacgaccgcatgcaacacgactatgactcttttctgatggacaacgatgacgcagatttcgaccacagccaccactacgatccattcgactataatgacccctttgacttcgacgacgaagacgatgacgatgacgatgtgcctcgaaaaaaaagaacgcacggacacccggagaagcagttacattttaagaggaaccagggatcttggaagcatgatttccgcctgccttgggagaaggaagaggcacacccctggtacaagggttccagcaagccttctcgcgctcattcgcaccgtcagtccgtgtccgtctatgcgtctccaacggaacccgtggaggaccacgaggaagattcctccatgaaccacgaggattctgctgttttccctggtctctttttcctcgaactaggcagcaaacgcaccgttggcacagcagccgacaatacaccatacgccaagcagaaatcgtttgtgcagcgggctcaacactccgtgcaagacattcgggaacaccgggacgtagacagagaagacggagttgaaggagagcagccgttgagcttcctcgagaccagaagctcggcagaggagggcggaggctctgatgagatgcgctcggaaagcgaaggacaaggatccgcagcgaatggaacagaaggtgaaagtgacaaagctgaagaggcagggaaaacggcaggagggtctgcagagaaagataaggacgcttcggaagcagagggtgcagaggaagcctcaagtgagaagacggatgggcaagggggaaacgatcagccatcggagagtgaaagcgccggcggagcagcgacgcacggggagagctctacgccagaggagggggaaggcagcgaaaaggctgaagagaaagggggtcacgataagcctgaagagaacgacagcagtgaaaaggctgaagagaaagggggtcatgataagcctgaagagaacgacagcagcgaaaaggctgaagagaaagggggtcacgataagcctgaagagaacgacagcagtgaaaaggctgaagagaaagggggtcatgataagcctgaagagaacgacagcagtgaaaaggctgaagagaaaggg

SEQ ID NO: 180 - DNA, 876 bp, Toxoplasma gondii
atgaaacacttctgcctaaagacgcctgcgtcaaccaaggcaagtcgttttacatccggtttctgcagaaacaaattcccacctgctgcagctccaagctaccagtccgtctcgctaacaaagcaagcattcgaaggcatcatgcgtggctgcgaggagttcagggacaagccgtcgtgtgatatgatggaaaaggcgacacaacgactcaaagagtcggggacccctgttatctatgactgccactggctttctgagggtcccgaggtttcaggtgaagtgcttagtgatggcacacaacctggcgacaacgaagaaaaagaggttggcaaggaggaggcggctcagacgcaaggtggccgtagcatctgcgtgaaccgcctggaggcgcccacagctgagaaacttctgtgggggacaatcattgcagagaaagaaaggaagctccaagagctgcaaattagcaggaacctcacaccagacaaagtctgtgttcggcctcgcgaactggctaacgccatgctcaatcctgataaacctttctacgcactgggcgaccaagttgaggcaagtcattgttgttttgtgaaatgccggcccggtgcctcgttcatgggaataagtcgggtaatcacttgtcatgaggaaggggtattcgatccgcaggttgcctgtatcgcgaaggggacactttccagtcagcaacaagcgttcatgaaggaggtacaagactacgctgatgtcgtagaggcagcacccgaattggcagccgctggcttggagacaggcggagccttggctacagctagcacacaaggcgtggcagttgcggctttcgcgctaatcggagtttcagcaatcgtcaagacattctag

SEQ ID NO: 181 - DNA, 3477 bp, Toxoplasma gondii
atggcgcgttcgtcgcgagctgccccgagcggggcgttcgctcacggagtagccaaagcatcgtttacgtggatttcgggaatgaaaactccgtttggctgcgtgtttttcttctgtctcattgctttatgggggttttcggccgcccttcggacctctgacattggtgttgacgccttgtccgtctcgtctcgtgcggcggcgaacggttccgaaggtggcgtggctcagtcggaacaagagcgtgctagcgatgaacagcgcaacgactcagaggcccacgattccgtcgcttcctcggagtcctccgatgcggaacggaaagacgaccctcccgacaacaagagtactagtgaaactccggaagcaaagctggcgggacgggatgcatccaaccctcctgcctcatcgaagagcccgaccccaagccctgccccaactccagctgtaagtacaagcaccactccagccaagtcgtcggcagacacatcaaaggacccgaaaaacaaactgagttcggcgaggaaagagaaacgaataggcaagaaattcaaaaggcatgatgagtttctcgcagatgctgttattgacaagttggacagcatgagatctgtgcaagtttccggtgccttgctccggcggatctggaaggagcaccagcgggttggggacgacatgcgggatctgctgcgagaatacatcttggctctcgaacgggagctgtacacccaacaggcggaagttttcggggtggagcaactaaagatggacgacgtgatccaccacgagcactcctcggaggcgaggaagcgcgaggtggagctggagatgcaggctctcgcggaacaacacaattttatgaagaagctcttcggtcacattcaggctaatgtggaagcgaaaaacaccagtgcgctcgtgaacaggatcgaagaactggacaaaccaattgatatcatcgacgcaatcgacaagaggtctggatcggatgttcttcattgtttgaaagtaatcggcaaaagcatcagatacatgcaggagtcggtgaagaagttttcccgcgaactcaagacgctggagcggcttgatgccgaacgcccctctggagaagcggagcgaatcagagaaaccctcggattcgtgatggatcctctgtccggacccctcagttctatggactatgagtcactttcctggatcccgtcaaagggacaagctctcctccatgtggacaaagcctaccacgaccgcatgcaacacgactatgactcttttctgatggacaacgatgacgcagatttcgaccacagccaccactacgatccattcgactataatgacccctttgacttcgacgacgaagacgatgacgatgacgatgtgcctcgaaaaaaaagaacgcacggacacccggagaagcagttacattttaagaggaaccagggatcttggaagcatgatttccgcctgccttgggagaaggaagaggcacacccctggtacaagggttccagcaagccttctcgcgctcattcgcaccgtcagtccgtgtccgtctatgcgtctccaacggaacccgtggaggaccacgaggaagattcctccatgaaccacgaggattctgctgttttccctggtctctttttcctcgaactaggcagcaaacgcaccgttggcacagcagccgacaatacaccatacgccaagcagaaatcgtttgtgcagcgggctcaacactccgtgcaagacattcgggaacaccgggacgtagacagagaagacggagttgaaggagagcagccgttgagcttcctcgagaccagaagctcggcagaggagggcggaggctctgatgagatgcgctcggaaagcgaaggacaaggatccgcagcgaatggaacagaaggtgaaagtgacaaagctgaagaggcagggaaaacggcaggagggtctgcagagaaagataaggacgcttcggaagcagagggtgcagaggaagcctcaagtgagaagacggatgggcaagggggaaacgatcagccatcggagagtgaaagcgccggcggagcagcgacgcacggggagagctctacgccagaggagggggaaggcagcgaaaaggctgaagagaaagggggtcacgataagcctgaagagaacgacagcagtgaaaaggctgaagagaaagggggtcatgataagcctgaagagaacgacagcagcgaaaaggctgaagagaaagggggtcacgataagcctgaagagaacgacagcagtgaaaaggctgaagagaaagggggtcatgataagcctgaagagaacgacagcagtgaaaaggctgaagagaaagggggtcatgataagcctgaagagaacgacagcagtgaaaaggctgaagagaaagggggtcatgataagagtgaagagaacgacagcagtgaaaaggctgaagagacaggtagtcacgataaacctgaagagaacgacagcagtgaaaaggcagaagcaacaagtcataccaggagcgaggaccatcccagatgcattgagatcatggatccgcaggagtgtgttaagaccaaaaactgcttccacgacgacgtctatcgtcagtgctttttcaactgtacggccatcgtcgaggctgacaaatgcaaagagcaccagaattgcagatatgaaacacttctgcctaaagacgcctgcgtcaaccaaggctaccagtccgtctcgctaacaaagcaagcattcgaaggcatcatgcgtggctgcgaggagttcagggacaagccgtcgtgtgatatgatggaaaaggcgacacaacgactcaaagagtcggggacccctgttatctatgactgccactggctttctgagggtcccgaggtttcaggtgaagtgcttagtgatggcacacaacctggcgacaacgaagaaaaagaggttggcaaggaggaggcggctcagacgcaaggtggccgtagcatctgcgtgaaccgcctggaggcgcccacagctgagaaacttctgtgggggacaatcattgcagagaaagaaaggaagctccaagagctgcaaattagcaggaacctcacaccagacaaagtctgtgttcggcctcgcgaactggctaacgccatgctcaatcctgataaacctttctacgcactgggcgaccaagttgaggtgaaatgccggcccggtgcctcgttcatgggaataagtcgggtaatcacttgtcatgaggaaggggtattcgatccgcaggttgcctgtatcgcgaaggggacactttccagtcagcaacaagcgttcatgaaggaggtacaagactacgctgatgtcgtagaggcagcacccgaattggcagccgctggcttggagacaggcggagccttggctacagctagcacacaaggcgtggcagttgcggctttcgcgctaatcggagtttcagcaatcgtcaagacattctag

SEQ ID NO: 182 - DNA, 2508 bp, Toxoplasma gondii
atgcctgaggttaactgcctcggtgcagaacctgcattctgcaacccctccaaatgtattttcaaccttcgtctccgtggggcctctcctcttgtttccatctttgtcttgactcttcttgtcgctgcgccaaagttgagtcctcagtgggccaccgcgacgaccgttttaaaggaccagggcttccatgcggcaattcaccatttgggaaataacagggaagggaggcgccctgagtcgtcttcttggggattctcagaccagtctccctcagctcccaggtttgcagcaatcccgaagtcagtcgagctgtcctctttcctccagactgatgcctcaccctccagcggaggcatctgggctggcgtaaagaaatacgtcgagctcggcaccagtggcgagcggcacgtagcccaagatgataatgagaaaaagacaacgaatggcgatactgctcaaggggacatgccttcgcaggaaggtgccactgcggcagaagcacagccgcaagaagcaaaggagtcggaagatgcattttcacacgaaaccacaggaaaggtggagacagaaacggaaaataaatcggaagtgtaccgccacatggcccaggaagagctacgaagcgccagggccgatttggtcaagcaaacaaacggaacaccggaagagtacgaggagacaggaagctttccttccctctgtgggtcatggcagacagtaccgtcttcgccgcacttctcctcaaataaggagttcacgcgctacagccagcaaaatgccagccttttggaaggcgagtcggacacagcagatcccttaccgtatccaacatgccagtggctaccgcgacgcggcattcacatttccgagaggcgtacttacgggttcaaaccaaatgtcgtcagcatagaacgcctcgagttccattctgaagagggatgcctaccgaaacacctggcaaaagtctggcgttactcgggatactgggacccgcagtctgcggcaaaagatccgcagacgaaatcagaggaaatcccagcaaagctttcctggtcaagagtaaacatcaagatggaagtcaatgctctatcgcgctcacagcacctggcgccacccgatgcgcgttcaggggagccgacgcctgtagaggcggagtgcttgggcgatggagaccgcatgtggattccgccggtaaggcacatgcacttggatcttcgagacacatgcacgcgacctcacggaaatttcctttattctcaaccagtaccacctgagttcatcatcacgcctcaagagatccccgtcagccacgaagtgttggcgcatcgactcaaacgccgactgcgggcacggatgagtattctgcaacggaaacacacgaactctcctgatgtgccgcgcgacgtctctctaaaatccgaggcggaggaagcgattgcaagcaaatggactgacgccgttgaccagcgattcgccacccggtggagagactacttggttcaacagaacctttggatcgaaaaagtgtgccagtggcatttgctccgagaaagctgtttggtcccgcctcccttggcaggtcccactccaccggaacatcacaaggataaaggagacggcaagaaggagcacgagagccagtgctacattccatcagtccgacactctctgacccgagagaatggcattgactacctcgatgttcctctgtttccttttaccgaagacgctgaacacgtgcggctacgcaaagtcggcggttgtaatccccacttacaagttgacttacgacagaacaaagacgctagtaaattggctgaagaacaggaacggcactccgcagacgaagagttagcctccgttgcagttacttcgaagagtattcaccctcacaaccacgcatcgtcgcctggtgtgaatcagggtgccgcgggaggaaccgcgattcccgtgcccagtgtaacggatgcgaaaaacgttaatacacatgaacgtgcagaaaacgcaccagacgctgttgcaccggagatgctggctcagaacgtcccgactgatgaagctgggcagcaggacgcagccaagctcggcagtcaagatgaagcaactatcaaacctgtggcacaacaagacatcccggtggaaaaagctacctccacagatgcgacagagtcggttgaaacgcctgttgagaagattggtgaaaactcgcaggaggagcctgcggctgtcgagcagccgtcgtcagtagagggacagacggagccagaccagcagcccagtgacgaggaagcccaaaaggatggtgctgaaaacgagacaccagaatctacgggtgaaacagcagagacaccagctgcagagattccagagcaagaagcagagagtgcagctcccgccgtcgatgctagttcgtcggacgcagccggtccggcagccacagaggcacccgaccaggagacgggtgaagcaaacgaggaagcatcttcggcgacagaagactcttcttaa

SEQ ID NO: 183 - DNA, 4440 bp, Toxoplasma gondii
atgactaaacgcgctggcctgcccttgggcagggcatttcttgtcctgattcttctatctgcagcggattcactcttcttctctagctttccccgctctgctctccaactcttttcttccgttcttttcacagacgctgcagaacctgactcggacgccaccccgggtctgcggccgcaacccagcccacgcactttccggcctacggggtatcagcgaatcgaggtgaaaactgtcgatgaagagttacccgaagacctcaaagtttacaccgcgtcgacacgcggatcttcgtctcgtacattcgaagtcagaaatgccggaggccgacaggaaggctttactttgtccgtcctcaccgccggcgggcctctgccgcacggttcctggtcttggagcggaacccctccggaagtgcagaccacggggggttctcaaatcagtttcggctgggtgccagacaccgaaacgccgagtttgcccgaacggaatcttctccagttgaagagaatgcttcgcgacgagggtttgatcgaggctgttcagctgagggccgcggaaaaggggtgccccgtggccgttctgcacaatctgcggcaacttccggtgaatttccgcgaggttctccacgaggagtacgagagccgcagcaaccccgcgaaaatgtacgaagtcgcgaatagctatgtccaacagaggggcagcgatgctgctcgctggtcagtctctcagtccgtcgagctttctctcctggaaatgcatgcgacgtcaaccacggatccccgcggttcgagtgccgtcccgtcctttctggaaactggacctcaagtgcgagttgcaatgactgacgccgtcccctcaggaattcgcgtgtacgcaacgcctccggcgcctcgtccagtgcctgtgcaaagtaaccagacagaaaaggagagaagtccgacctccaagcgccttgttggtatgcagctcggcctctacttgatttgcaagcttgcggctctttttggccacccgactttgtttctaaatccgtactacacggagcagcagctcctcgaagccgtggcgcaggctctcgggatcgcgccaccgcaccgcggtgatttcgaaaacgaaggaaatgaagcgcaagcgacagccaaccagcacaacgggagcgccgaccagctgcttgcagccatcgaaatctttcgcctagggccgaatccctacactatcggtcacgttctgaccctgatgattgcctacctggactacgagtctttcttcggagcctcgccgtcaaagccttttcactcttgggtctcgttggcagcttctgcggggaacaacacaggcttcgcgatgctcgacgaaatgtgcgacaaccaccgtggacctaagcgacgtggacagaaacactggtaccagaccgggggcgcgaggaagcacaaaaaccgagacatgttgcctctccaccgccagctgtgcgacgccctcgaactagtgctcaacggcgttcagcagatccaaatcgacctgatggatgaacttggaaaatacaagactggcgtcgagcctctcgtcgaccccgcaactaacagcgcgagaattcacactcgcacctgccgaggtttgtccccggtctgcgactacgaagcaacaattctcgctcctgtgcgcgctttagagccgcacgaacaacaagactctctccgtaccaagaaggcgttcaacctggtcacgggatacgggagcggtcacgtcggacaaatcacaggaagcatcgccgagccgttctcgcatagctggcggacgcggtggggaaaagttgtggcggacccaactgcctacggcgaaatcttcgagcgcactctgtggttcgacgaccgcgagttgatggcgaagagcagcggcgctctcttcagacaatacgacagaattgcaaaagactcaatgtctttcggtgtcttcatgaacgtcgaaaacggactcctgaagaaagacatgcgcagcaagttggaggcttacatctcgcaaagaaagagcttcgtcgagaagagacagcagtcgagattcgcgaagcttcgaaagaaaatccccgaaaacgacccttacgcactcagagccgccatcttcctcgcgctcaattctcggacgttctgcgcgcagccgacgtcgtttttatcgagtttccggacctttctcacgaaccaataccacaagctaagtcaaggaagaaatctcccgagatctcagagatcgttgatggcgttcatgcgcaccgggcaggttaaattctttcaagagtggtgcagcttcgaccccctcgctgtcaacgccctctttctcttccgattcgcggtctctggaacagaccccgcggcgctgcacgacaggcaacacacccgtgtcagcagaaacaagaagacgatgcggattttgaattccaagtggactcccgcggtgctgaagaagctgatgcgaaaagtcaaccacaaacacatggcgcgcgaagcgaaggctctactgcttcggagcttggatccgacagtcttgtcgagcatcgtgacggcgtttgacttcatcacccacacacaggcgaacctggaagtgaatcagaacgcgttcatgtaccacgaggtgcgggcgcgggaggtttcgcgccagtcagcggcagagaaaggctcgcacaggctgcatgagaggggtctcgttcgcgagacagacgacatgatcaagaggtgggcagagcacggaattccaggggacatcaagcgtcgcctggcacgaggcgagaagcttccagaagggatgtcgtttggcggcatccccatccccaatctgacgaactgggatgcacagctgaattccaagtggcttgaggcgtacaacgcgtatctgcgacacccgtacggccgagcagcactgaacgcgcgcgacccagttgcgttgctcgtgaaggactcgcgagaccgcctccaggctgaggccgagggcaccatctttcttgggcgcatcgcgaagcgcgtgcaccagagcaaaaaccttctgcgacgagccgggcgggcgctgaagactttttttctgtcgctgctgagagagaacgaacgcagcgagtacgccgtctggtttggtgtgaaggtcgacatgcggcaggtgattcagacctgcaggcaaatcaactcggtggcggaagtcgtgaagaacgaccgcctctacgatttcatcaccgacggctggatggagctcgtgaaagacgtcgtcgcagggtacacgaaggcgtcggtgcgagttcctggtttcgacacgatttctgcggcaaacgagcaattgcggaaggagggagtagcagctgccactgcgcggaaccaaggtttcctgtcgattcactacgattacgcgaacctgccggaggaagagcgcaagaaggagttccagcggtcgatgtgcatggagcagtgcgaagcgctttggaagctggtcatggcgttcgtgatgccgaatctgcagaatccgaagaagctgaaggggtacgagaaggacttttcgggagcgaaggaaattgagaagctgaacagtccacaccacgtgaacgcgttccgctttagtctctctgtgcagatcgacttcttcgacaacatgctcgacaagacgtccaaaaagaatctgaaggcgatgaagttcggcgcgagcacttggttcacctacgccatgaagcttgcgggacaggtcaactcggagatgggcaatccgaacctcggcactgcgctgtacatgcaggccgcgtactacgggaactacattcgaaagtggatggagcagcggcggaagtcgcggaagcaagccattatcggagtcttgacgctcggcatgatgggtctgtacgcgctgctgaatgttgcagacatcgtgcaacatatggaagacattggcggcgcgccgccggtctcctgcgtgacgaacgagatcctcggagtcacctgcgcgccgcaggccatcgccaaggccaccacgagcgccgcgagagtggcgacccaagacttcctcaaagtcggcctcttcgcaggcatggcgccgtacctcatgctgcccatggccgtcgtctccgtctggaacatcctcaagtcggaaatcaaggtgttgctgcagttcgaaatggctctcaaacacaccttcacgcgcctcaagaggtggcttgcggcgcctttcaagaactggtgggcgaagcgcggcagactgaaggacgcgctcttccggagagcctcgcagacttacagaaaaacggaacaggaaacgaagcagccgcctcgacccagaaatctgcacaacccaagcagctggggagacaccgaactcgacagtctcggcgtgcctccagagcccttcgtccaagacttcgaaatcaagtacacgacccccgtcttccccatgagtgcgcctctcatcaaagcctga

SEQ ID NO: 184 - DNA, 5877 bp, Toxoplasma gondii
atgacgacgtctccccgagtcgccaagtgggcacttcgcgtgctagctctcgtctttctgcaccatgtgacagtctgtacggtatgcgaggcgaaagccttgcacgtgatccgtcctcatcgcaattttgccggactcgacgttcaacagtcgtccgttgccgacttgcaggatgaaggaaagggaatcagttttgcccagacgtaccgcgagcgggatatctggttcggcatgctgtatttcgagtacgtcatcactgcgtcgacgacaatgactctcgccttcaagtcaatggctaagtacatctatacagcgccgttcctgacgaagttgtttgccagcaaccgctggctcaagtactcgacacttgactttccacagaagcagcagatcatccgcaagattgctcggcgcgcctcttcgaagtcccttttctccagagctctaccaggcgatagggtggcggatcttttcgccgacatgtacctcagaagagtgacatcacgcctgtcgcgcaccccgggtttccgcaaaccgcagtaccttaagatgaaggaggatctcactcagctgattaaggccaccaatgctccgactgaggcaatggaagttgttcttggcaacaacactcaaaacatgtttacgtggatcgactcagtgagacagaacccatttgcgacagtcaagaacgtcgttgtccacgcatttgaaaacggtttgaagggcgtctctgggatggtggagtgggagctgaaccaagggtgctttgccatcgctcagcagacgcgccacattttgcctttcggcagtctctttcccggaggcattctcgggaaaatcatgcagaaactgatgcggtcctacatcatgtttttccacccagtgcttgcgaacttcaaggggctcctagcgctcttcctcggtgtcctctgcaaggtccgtctcccgcagctgattaacgcagtctttggagcgatcttccgggcaaaacgtcgcgccgggcgctacatccacaaattcttctttaaaaccatttctctccgcaaagacatcaccgggaagatcctcgttgacgatctagtcagggggtcgggagccgtgatgatcactctgctctttcagctccacggtgttgatatcgatgccatcagtcgacgtggaggggccgtcgagtcaggcgttctcgccggccagggcgtgtggaccttgtccgatggtctcttcgtcggcttgaaggatttcggccaactcttccgagcctattttgaacgatacgtaaatctcacatccgcaatccacacctactgcgcaaagcaaacgaccaacttcttcacagaaaccgaactcgatgaattctataacggcgaaaacgtcgacagaattccccctcgtgaaagactgttggcatggtgtgacaagaacaagagttatctcgcaatcatcgagaaggactttatcggcttggccaccaacttcctcaaccacatgatcaagtgtctgaagatggacttcaagtacttcgagggttacctggcgaacatcatgtctattttctacgagatgacctttgcgactctggaaagcgacatcgtcagtgccatcaacgcgaaccagggccgcgctccgcatacgctggagctggaagccattctaaagcgtcggcagcaagccaataacccgccgaaagaggcggagatgcctcgcacgatgttcagaaaaccctggatgagggcggcgattcggaagcttgctcacggatacttttcctccgctgctggcttcgctttgaagactcttctgcagcaaatcaaacccgcgaacgcagagaagcttctggataaagccttcacgcgcgtcaaggaggggtcgaaactcattcgatcttccctgacagtgatcctaggtcgcttcttcaacagccaagcgctaattgttcgagcgcacgatcagaccgtgcgcatgagaatgtacgaattcatcaaccagtgccagaacccagaagacccgaaccaccgagacgtttgcgggaacaatgtaacaacgaacatcgatgaagtgaaatttgtatccaagtcgcttctcgcgttgaaccttggtattttggtcagtcctagagatttgctcctgtcgcaagttatcgaaacagaccctgcgaaggattccattgatccgacagagttcttcgcggagtgggaagcgtggctacaagccaaaggctacaagcctcaccagaaaggaaaggagtatctgctgttcgcggaagacatcaaccagaaagcaaatattatcgccttcgtggaagctttgaggcatacgctgcgcgacagactgcgctttggccgcttcgatcaggaaggcgcagacaatctccgcctttttgatgttaacggacgttctgcaatcttccgccccagggatccacagtccatgtgggatcgcatcaaggaggtccgcccagatccgctggatgcaccggcaacttttgaagtgcttgactataatgaaggaatcctccgctttagtagtaaacctggaattcctttcgaaggaaggctggagtatgccgatgaccgtagagagcttcgcagcatccagcaagatccacaggcaatcaaagagcttctcgtctcgcagattatgcaaatcaaaccgcgtctcagcgctgaaatgactgcgacattgatgatggtcttgcatcgatacactacttccttccacaggcacagcttcgccaccttcctgcagaacctgtcgccaaagatgttcttcgacggtgtcttggctttcgcggaccagcaccaacagcaggccgaagccactcttcacctggatcgtcgactctactcgttccccatgactttccagactttcaaggacatcgttttcaactcgttgaacacgatggtgttgcgtatgcattcgctggacactgctgactcgctgtccgtttttctcgtcggtctggttcactacgcctaccagaaaatccagaagaacaggactggaagaaccctcgtcatgcagcatttcctacggggcttggtgcatgtcatgcggtcggtggatgctgagcggttccgggaagactttcccgagtgtcagttcctcattgaaccaaacggaacgatcgacgaggttgttgccatcaaatgcgcgctgtaccgtttcgtcaaactccgctctttagaactgccacgagccatcgctccggacgtggaagaatcgagaatgacggaggcccgggcaagaacttacctgaacggcttcgttgagtatctagacaggctgcggtccgagaggacaagctgggcatcttttttgaactttaagggcttcttggagacggcagagctgtacagagaaacagtcggggcctacagctacgaggagttggagcgccagatcaagacggaaccgatcactgacctcgacgtgttggaacagttgcgagccttgatggatccctcgcttgggcgcatcgtggctccgaagaaggatgaaggcacagcccaggtcattcggaaaatctggggaaacttgggcgaattctcgagtggcacgcgccaaagagtccgcagcgcgctcagccagatgagaagccggctcgtcagcgttatgggcagcacgacactccctaaggcgatgagactgttcaacgtgatgaacagcagccaattcttcggtgcattggagttcgcagaattcagagcttttccggacacgaggacaccgcccgaagatatcctaaaggcttccgacttggccctctttggaagggtgcttctcgtgctggagacgacgccattgtatctcgacaaccccaagcaaatgtcagacatcgtaatgcaaatgcgctccattccatttatttcgccagaatgccaagaattgttccgcgaaatcgaagagatggtgcggcatatgtcccacgaagatgtcagggttgcggtgggatggctgttgactttcaacatcggcaaaggcctgacgggcagcactgtggcgctcgggcttctcgccctagcaggcgttcccttcgccaacagccaaatcagccaccaggataaaatcggcattctcaggactctggacgcggacacccttcgcttcatcaaaaaacaccttctcatgcccatggtgttcagacacatggcctcactgtctgacggagaagcgatgaatctcctccgctttgttcctaaagcgaccttgctggtcgcgtacccggcgtcaatccgatatcttccattatcggagccggtcaacgtcgtggacgcagtcgacaaactcattgcttcaaaagccatagatgcagtgcagcagcacttgggccaggtccggcagctcccgggagaggcgtcccatgacgcagtttgccgaaccatgatcaataacatcaaagtggaattaggtctgtccaccgaggatgccatgaagttctggactcgctcgcacatgttctttgacaagcgtctaccggcggcctgcattctgttgatccacctgaaagccatgcgcgagcaaaacattcgcgagacaaccgtggctgcgcttgtcgacatgttgtactacaatggcactgcgctgaacgaccacctcgctttcattgcgaagaaaggagctaacgaacttgagcgacaaaagcagattgaccgagtcggctccctccttacgatggtgtatgtggctgtcgtgagcggatcccttcaagtggatgccagctttatggggtacagcggcgagacaaagaatttgacttttcactctcgaagaagctctcgtggaactgaagttcctcttctgaccgcatgcatacaggccaccacacatataatgggccctccgaaggaaaagcccgagattttccaagcctccctgagcagctatttccttggcgaatggttccgtttcgtggagacgagccgccttgaagaatatgcggctgcgtaccgccgtggaggtggcttccagaacatcagcagagagaccttaaaaaatatcagctcggtctacaactactatgatattggagactacttcatttcgatcagacaacggtccctctatcctcagaatgagatcgtgaaaaccgcaagcatggctttgattcaagatgaagcaacgatcgatgactacggaatggcaatgcttacagttgatatgggacaccgggttagaaaggcaaaaatcaaatgctatgaggacgccctcaaagactacgtcgaatacgttgacaagagccgcagcgcccaggaaatgttcaaaattgactgcgtgcacaactatttcatcgatatgggctctctcggctactcagctgcgtcaatcactccagaacaaaaagatcaaatcattgcatcattagacagagtatttgcaggtaaatgcgaagacatgtacacggctcttattggatcacaacctgacatccacaagctgaaacagcaggcgtgggcatttgccacgcttgcgcacaactctttgaatagcgccacacgcttgggttctatcgtcaatatgttacataacctcattacggacatagccgccgggaccccctggaataatgttgttgacggaattgcggcggagcgagccaacaagatatgggagcgcttgggcgatgtatcacacagaactccgatttatacggcgatagatcgcccgtatctcttcaatccatttgccttccttttggacttcctgctctacgttaaaaccaataaagctcacaaactccggatgccgaagatgcttctaatgaagagagctgccgtactgaaggaacttcctttcaaaaagaagacgactccgccaggaatgaccgaatacaaggaaagggcagcggccctgaaggatgcctttttcgcaccctaa

SEQ ID NO: 185 - DNA, 2955 bp, Toxoplasma gondii
atggcgataaagaacacgttaactggaagtggccttctggtgttgctgactctagcatgtggaacgacggtgcagtctagtccgccaacgcctgctccacggatgtatccgaacatgaatgagcgtccgctaagcgctgagagcagactcactcctgggacatacaggagtgaacttcacatcgacctgaaatctccacagaaaactgcttctcagagttctctagcacctacaggtgacaacaacagcaaagtggagagcatcattgccgggtccgatacaacacccagatcagccgaaggtacgtctgagagcccaccagtaccacaacttggaacgccgccaagacccgcacctcgccggtcgaagggcgaaggcgagagacaacctcctactgctgctcctcggacttcacgttcggtggataccggttctgggagcgacgccagtaccgaacaacaagcaggagggcagaaggtggtcacgccgatccccgcgtcaaagggaatctaccccagcttggatgaattgcggcggagccaggagagcaacgtggatgctgggtctggtacctccacaaatgagggcggaggcacgtctgagggcccacaagtgccgcaatctggaataccaccaaggactggacgtcgccgagccaaggccaggaacaggaagcgacatcccactccagcatctcgtgagtccagcagcgaagatgagaatcaacctcctactactgcctctcgcccgtccaatggcgagggtgagagtcagcctcctactgctgctcctcggacttcacgttcggtggataccggttctgggagcgacgccagtaccgaacaacaagcaggagggcagaaggtggtcacgccgatccccgcgtcaaagggaatctaccccaacttggatgaacttcgacaaactcaggaaggtgaagaatcagcccctcaaccagctgatgtaacctggttttcaatgagcgtgcctatgggtgtcgtcgatcgccgggtttctcgtgctttgaaagagcagttctttcaatttcttcagcatctatcggcggactatcccaagcaggtgcagacggtgtacgagttcctcggctgggttgctgacaaattaccagagaacgaagaagaagttcagatgtttattgacgcccttaacacaactgaagctatggtgggcaaggccgcccggtggatcttcaaggcaatacctgaacgggaacgcgaaaccatttactcatctttctaccaaatgttccgcgacaagctaccaaagaagttcttcgaaaccgcagaaggaatgaatccggatgtcggtcaatattttagtgctgaggaaccggttgcagttactccagaaattcctgcaaaaagtgaggaagactcggaggctgcagaaactcccacacctctaagacgtcaggcgaatgtggctgctcaagttctccatccacttcccgcgaaaggagtcacgcggcgtgagtggattccttggccgaaaatgcaaaacgctatctcgaaagcccatggacctctgacgcgggtaccggagtggacaccagtcacgggcagctgtgctctaggtgatggttacacggatatcgatgtgacaaaggcgacaacggacgtgctgttccgcatcactctcttaattctccagcaaataaggagaaagaaaacagaaaggggcaaactggaagatgatcaggctctcgtggctctctgctcagccgctggggctttcgtcgatgcatggcaacatcagcagcaggcacttatcctagaggacccaggcacacccaaggcgcacgcccaattgattgagcgcctccgcaatgcgggaaaatacttcatgaaatcctacgacgaaacgactggagagagcgaccatcaacagtggaaaaaaaacaaagcagaagtttcgaagcttggcaagagtgctctgatgaagtcctgcgtgaaatacataaaggcatccggcgatgtcgcgactcgacccttcgactcaggaacggcgaaatatccctctcgatcactctatggcggaatcgccaacactctggaaacgccatttgccgactctgaagcggtggcgaaagctgtgcatgactacgcgaaagagcacaagaagcctgagaaacttgtaggcctctgcggggctctccaaatctcaggatacttcaagaagtgcttttctgacgctggccgcctctcctcggtcagttttttccaccagcatgttgacggggccagcgttctcgtccgaacactcgcgcgcgaaaggccaatcgggaggcatgctctatcccaggccatctgcgatccgaacatctcggcccagtattttgagggcgcgtttcgactgttctcgtctacggtatcccaagagtgggagaaagaaaacttgtttgcccagctggcgtcctggacaggaaaggaaatggtccttgctccgtcccttgaggagcaagctgctgttcctcctgcgcagcccgcgtacgagacggtttacggagacgaggaagaccggatctaccgcattcacgtttcaggccgccactcatcgcctcaggaagtgctctacgtgggaggcattccatcgacagtgaagcctcagcaagtccacgtgctggggccgactgtctctgacgaatcgagacgagtgatccatcccgttcgccatcggtctcgcacagcgccgtcatcggaagccgcaagtgcagcagcagagagctcagacgaagatcctttacctgctgaaaatgccacagcttttctcggcgtaacaccccaggaggaagagtccgatgcgtataaacacacgctcgatttcgatgcggtgtctccacgcaagaacaaaaacaaagagaacaggatctcagctccgctcaagcagagcgacactttgatcgaagagagtaccagcaaaactagcgagctttaa

SEQ ID NO: 186 - DNA, 5109 bp, Toxoplasma gondii
atggcagaattcacttggcggccccttttaatgtctttaccgaagatgatcgctttcttccatatcctgctcttctcgggcgctctggctgcggctgcaggttctcctgctgccgatctggtcgccagcgtccaaacagtttcaaatgaacgcaaggacctttatgcgagggatactcaaccgactgcgaggactggcattgacatcggtgtttccttcacacagcaggctagcggaaacgctcggacatttgaaattcgtcagcatggatccggtccccccagacctgcgccgagacgcgccgccgctgtagcggatgacatttttggttcggaggacttttcgcctccccccatgaatgttgcaggtgctcctttgcgggacatgggtgtacactttttggagtgccaggccactgatggcaagatcgagtgcactggacaaggcgctggggcgaggccgccgtttttccgcggcggcgttgacccgacagaaatacatgagatcgtgcagtccaggaccgtcggtcctgcagactacgatgaagaacgaccagaacaaacaccggactacctatctcccactgatgtcgtcaccctgcagcggttcgtgtcctccgcaaacgcctccaactccccacttctggaagaccctgttcaagtatgcctgtctcgaagaaagcctacgtacacgtgccacctccttcatgaattcgcagctacatccgtgatcgtcgaggaatctggcaacctagtatgtgaagataaggcacccttgacagttgcagaaaagagaaaaatcaacgacgctgtgaaagccggacggactcctcaggccactggtggacaatcatcccgtcccccaaacccgacggtgtccccttcgaaagcaggcgcagcgccgcaaaacgccgcgtcgcgtcaaccagtaagctttgtggaacaggaaaacagcgaagcctctatgcctacggcaaacaccgaacaagcatctgctactacggaagataccaagatagcatctgctgctacggatagtggagactacggagaagcggcagcaggagaaagcgctcaagaaggcgatcgccctccaccgtacaatcctgatgcagacgaggcaggggtcccacgtgcagttcaagaagcctatgaagaagctcgccccctccaggaagctaccattgacaaatttaagcaagacgccgctgcagcggctgaggcagccgaccactttgcgcaggtctctgcgtttaacgcaatgcagtctgcgttgacgaagatttccgctggctaccaccttcgtgctggctcccacgtcgtcttgagcgcctgcaagcgtctcgtcgaagccgttgcggcaaaccctcccggtccgggcactgtcattccactggaagagcttcggatgcagctcgtggcaaccttgacgcaggacttcgccttggctcaggcctttatcgactatgcgatccatatcgtccacagcgcgatcgaaaccctaactcctcagatggtagccaacgcgctgctcgagctctcaggaatcgaagagctgattaatcacacagccagagtaaaatctcgactggctgcgcgtgggcaagattctcctgcaaacgtcaggaaagaaattgtccaggaatccttcagacaactcaaagtggagctctttcaggaaattgtcactagagtttgtgaacttatggacgaccctgagtcgtttttaaagacagtacccatcatcgttggcacaacgcccacggcaccgctgcgcacaggaggccatctcggagcggactacatcattcacttgagaaacgacctttgcgatgtcacagcaagtgatgctcaaatctttccatcggccccagcggacgaaggccttcagggtttcccgagacacaatctgggggagcgcctcgtgggatggatggacgtcatggctcgtacgaagacggcgaggaaggaagtcttcaagattattgattttacaaaagcaaaagatgttttgcttttcgcttcggaaacgtggaaggcccggtacgcgaccctgcaggccccggctgcacctgctccgagcttctatggcatcaccactagcgggtgccggaatgtgaatgacataatgaagtctaaattcttcgacatgtatcttcatcagtccggtttcatgaaactccagcgacacggaaacgacaactcgcgacagagattcatgcacagagttacgctgctgcaaaacgacgggatccttcctcaactgccccttgaagctgactacgagcttatggagctcaatgcagcgatgcagaagaatttcgttgcagccaataaaagcattttttctagaagagcggcgcgccattcgaagtacggctacctggacctgtgcgacgtggcttgctatcaaaagattgacaggcttcacaacgatgtcatgactaatgtctttttctcgttggacaccacgctcatgaagatcgtcgctaaggtccacaggtcatacggaattgcaaaagcctttttccaacttggagccagacaacagcacatcgccgacccgaatctcggcatgtgggcacggcgtctcttcgtccactgggcgtcgcataacgaggtcaagcagatgcagggccaaaaagtcgtgaaggtcaattacgaaaaccttcgccatggcgaattcactctcgacacggttcgaatgcgggacgcgctcgtccgctacaccaacatgttgaaagccgacccgatcactcgggatctcatgagcctcgtcatccatacttggattcacatcagaggagtcaggaatgcggccatgggcttcaagaactcgcagaaactcaacgaatcaatgaatgcgtctgccattggggccgtctttgcgaagctgtggtatgaatctgacatttccgtcgtcgcaccgcaccaggagctgaagccgttcggggcaccattggcttcgatggctctccagattggtttcttcctccacactgtcgttgaggagtacaagatgtcgcttttagagaaagccggagctcagatcaaatcgtggttcgtgggaatgttccaaaaaaacaagcgccgaacggttccccggacctggaaggcagtcgtggcagcaacaaatcgggcccctaaagtgaacctaaaggcttaccagggcgctctcttagtgatcaaaactctcgcaaaaatgttccgtgagaggttcctctacagattctacatgcagggccagggcagcaaagtcgactttaacactcccacgcttcttatccacgctctcgtcgcttcttggatggacccctccctcgaccgtctggagttgtcaagtcgaaccattcctaatgccaagaaacttttctggtactacgtgtgggtcaacgagaatggcccgtcgaacgccgccacacgaatcgtgctgacgggttgcaagaagtacactttcctgctcccgggcgttgtccgaagcgtgacgagcagcacaagcgaagtcgtagaggcgggttccaatattttgaagattgataagattatcctcaagcgaagctcacttgaggcatatatgaatcacctccaagcgacgtatgacgacccactgacgatcgtccaggttgccctcgatttggcggcgagatgcgaggggtactcagcagccaaagatcagcctgcgcaggccatgagagggcctgccagggtgcgacgagcaactggagaatccaccacctttaccatcagaggtggtggcgtccagggtggcaccatgtcttttgtcgaagcggaagctgacgacgaacggaaagaagacagcgaagacaacaccgttgacttgagcgagcaagatcaagacagcagctttgttcaactcaagaaattgttcaacagacgggggagttcagctgcaggacaggcggtacaaacagatgcacagcctctaccaaaagcggtacaaacagatgcacagcctctaccaaaagttcgacgcgggggcccagacgtcgatgctagtgctgtgatcctcgggtcacgatttatgctggatctgtggtgcagcaaataccgaaaaatgcttgtggaaaagctctcgggcatcagtacgaaggatgccaccgtgatgcagcaggagatttccaaggtgttcagtgctgtttcctccattaaaattgccatccccgactacaaagacctctgggacttctctctccggtgcgactggatggatgggtacccagacgcagagaaaatgcgagcggctcgagcagaaatggtaacgtacgctatggcgaaggcaagcaccgggaagaggctgaagcggatgttgcagaaggtcaggtcttggataaggaaaaaagcattcgctgctgcgaggaaattgaagtccctcaagaaccgaattagcaccgcctttggacggggcaagcctcccaaggccaaggtgcccgactgggcagtcgtaaacgctgggatgggaatgtggaccggcaaagtcttcagcacacatttgaccttcaacgaagacgaaatgtcttgcaacgggccacacgagcccatccgcgtcatgtcttggaagcaaaatcatttcacaaccttcgcgtcgtcatcgaccaacgctgagcgtaactacgtgctcgttaagaagggagacgatagccactgttgggcaacacgagaggccctcgtccataagggttggtccggcattcccgtgtaccagtacgcagaacctgctgggttctggttgcaggaagtttctcctagcaaccagcccttcgtcgtcaattgggatggatacctaactaccagtgacaacctaacgctccaggatattgacatcaacgcgagctcggatagcttaaagtcacatgctgtaatgcgaatcgtcgactcaaatggaaagaccatctatcagggcccgcctacaggggtcgtgcaaactcagggaggggttgtgactctcggtagcatccgaaacctcgtctcgggtgtccactcgaccggcgatagcgttgaagttagagtcaccgcttcaggcccgcagctgacgagtgtggcggatctcgatactcagtttaaagaaatcccggatctggttcttcggtag

SEQ ID NO: 187 - DNA, 5216 bp, Toxoplasma gondii
atggggggccgagccaccacgtccggcgcacgctctctcgccctgcccctcctcgctctcttcaagccttcctttgttctcttgtttttcctctcttctgccgtctcatctggtctcgccggctctcgcatcgctgatggagtgcttctccccgccggtcaagatcgttcacgcagtgccccccctcaaatcaaacccggtgttgggcattttggtgaaggcagccatggtctgaacatttctcggacgtttttagcgaacagtgcgtccacttcactgcactcgagttctacgggtccttcgcgttctgcagctgctcggttgtccagtgtccactctgtcgcaccgtcttcgactcccttgtctccctcgtctctgttgcggggatcgaaagcttcccgttccgcatttccgtcgttttcctcactacgaaaagaaaagctatccacgagttcagcggagaagcaaggcatagttgacaattcttttgaagatgaaggtttggaaggacgtgcgcgtaagcccagagcgcctcccgctgttgacgagagtttgatagacttatctggacactcggatacacctgagatgtctccctcggcaggtgtcaacgacgttcttgctcctgcaagaatcttgaatccgaagcaattcgcaagacagctggtggccaaagttcacactgcgttcgtgcaacgagatcaacgcatagcagaggaccagaaggacgggaaggagaacgttgagaaagagcggagacatgggtccagtgcccttctcggcgtcgacgagcagctgaagcaggccgatcacggtgacgttgccgctgacgacggagaaactggcgagatagatgtcaacgaagcagaggctctgatccccgacgaagaatccgtcgggagatcagtcttcctgcaggatgcgagggaatttgaagatgacgatggcgagcaagacgacgacgccgacgatgtgtccagttcacacgacatacgcgctcgagacgcacacactttcgcgttcgtgcagaacacagaccagacagaaaaggaagaagccgaaggctcttcccaggaagacgacgacatggtcggcagtaacgaagagacaggaagcaagtcgaaatccgagggtggcgatgcttcagagaaggaggaaaagtcagaaaagggagacacgtcagagcggggagacaaatcagagaaggaagacacgacagagaaggaggaaaagtcagaaaatggagacacgtcagagcggggagacaaatcagaaaatggagacacgtcagagaaggaagaccagtcaggaaagggagacacgtcacagcagggagacaagtcagagaaggaagaaaagtcagaggcggcagacaagtccgaggcggacacgtcgaagaactcgtcgagtgcaaaagccggagtaagtgagaaatttaagagtgctgctcaaccacgtagccacctagtgcacattactactggatatttacctaaaattagagcgtaccgtgccacagtcaatccatctcacagcagacgtaggaagaagaagaaggaaggggagtccgaggacactgagtcgaaagcacatgagaaacaccgggaaggggaagcactcccggaacctcgtgactctgaaaaggagtcggagagcaaagcggaggcagccgcttctcacaacgaaccggggaacgagggcgacgaggcaccgggagactcaggtgatcaagagcgccaggctgggggagactcagtaccctctcatcctggcgacaacgcagtgaacgaatctagatccggtgataatcgcggtgaagctggagaaacacgggaggcagaaaatgacgctgcggtgggtcattccgacgagacgggaacgggtgagacaccgtcggcagagggtcaccatggggaggagagtggcgctgagacggctgttccatcggacccgcgtgaagagatgggcagggcagaagcaaggtcagctaacagccccgaagagaacactgcggaggccaccggcggcggcgcttctccctaccgtgaagaagcggagacaatagtacaaccatacactgacgcccgccaaggaggcaacaatgatgccagtgctgcctcgcccgtagctcgccatgactacacagaaggtagtcaagcatcgccagcttccagacccgatgacaatgcacgagcgacaggaagcgactcgtcgcctgtgtaccgtgaacatgcctggtcgggcgaagcacctgctggtgagggtcaacaagaatatacgggtggtgctggatatgctgcgcctgtatctcatcatgaccagacagaagcgagtccagcccggtcagtgaccacccccgaatggagcgcacaggcgaccgggagcgaaccacaacctggagaggatacagcacgcgaccaggaccatgtcgacaatgcttctgctgaccgtcaaaatgccgaggcggaaggcaatgaagcaaaatcagagggcagccccgaaaacaatgcacaggagacacatgagaccgggagtgaaccacagcctggagaggatacagcacgcgaccaggaccatgtcgacaatgcttctgctgaccgtcaaaatgccgaggcggaaggcaatgaagcaaaatcagagggcagccccgaaaacaatgcacaggagacacatgagaccgggagtgaaccacagcctggagaggatacagcacgcgaccaggaccatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaacatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaccatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaccatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaccatgtcgacaatgcttctgctgaccgtcaaaatgccgaggcggaaggcaatgaagcaaaatcagttaccgggccagacggcggtgcacaggcaaatggaggtgaatcggcgattactcaacataagcaggccagcgcgggtgatagtgagggtcgacaagactacaggaatggtgccggatatgcttcgcccgtagctcgccatgaccacgcagaagcgagcttagttcggtcagcaaccaccctcgaggggcgcgcacagaacacaggtacaccggcgtctgctcaacgtgaggagacaaaacccagacctgcagcggtcgaagacgtaagcaagaataaggaacccgagatcgaagaggaaccaatccacctccaacacacagggaccaacgcaaacataggacacacgaacgctacttccgcgaatcaccagcccaccacagaggccgaaggcggttcagcagatgctcaccacggtggagacgagcagaaggaaggcgagcacgagcgtgcgcctggtgaagggggtcatgaggcagcaggcggttcagcagatgctcaccacggtggagacgagcagaaggaaggcgagcacgagcgtgcgcctggtgaagggggtcatgaggccgaaggtggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgagcctggtgaagggggtcatgaggcagaaggcggttcagcagatgctcaccacggtggagacgagcagaaggaaggtgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgtgcctggtgaagggggtcatgaggccgaaggcggttcagcagatgctcaccacggtggagacgagcagaaggaaggcgagcacgagcgtgcgcctggtgaagggggtcacgaggccgaaggcggttcagcagatgctcaccacggtggagacgagcagaaggaaggcgagcacgagcgtgcgcctggtgaagggggtcatgaggccgaaggtggttcagcagatgctcaccacggtggagacgagcagaaggaaggcgagcacgagcgtgcgcctcgtgaagggggtcatgaggcagaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgagcctggtgaagggggtcatgaggccgaaggcggttcagcagatgctcaccacggtggagacgagcagaaggaaggcgagcacgagcgtgcgcctggtgaagggggtcacgaggccgaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggcaga

SEQ ID NO: 188 - DNA, 2202 bp, Toxoplasma gondii
gaagggggtcatgaggcagaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagattctcaccacggtggagacgagcagaaagaaagagggggtgagggctctgctgaggagcaagaacgcggttctggaggtgcgtgggaggcggcagtgcatccgcatgaacaggggagagtaacggaagcagagggcgaatcgtctcgcgttgaagaggaacacgaggccggaggagcgccagtgcatgcgcacctcggcaatgaaggaggaaacgaagtgggactgtctctcggtgaccagaaacaaggtagtggaggagagtcttcctcatctcaagctggtcacgcgaagacagaggaacggaagtcagggtattcgcatcatgggcctgagactgaagaggataccgcattttcacactctgggggcggaacgggagatgaaagggaaacaaggcgttctaatagtgaacagaggaaggaaagaacggaggagggaggagcaagggatcagcctcagaatgagaagaagacggaagagcaacatgcacagaagcaggaggaacaatataaacgtgatatcgctctcagcaaacatcaagaagctgaggagaatcgtcgacatgcggacgtgctgctgcaacaccatcatctcgggcaaggcgggcctcgtggacgcacggccgtgacgtcgcattcgcacatgcatgtgcaagatgtgactcagcaccaccagttgcaggaggctacgcagatggcggggaagttgacccgccacttacaaattcagaactctctgaagctgagagaaatgtttttgaagcgcaaggaagttggccacctcaatttgctcaagcactttcaggatctgatgcaggcagttgtctcgagaatctacagtaaactcaagggggccaagcgctcgctcaaacgcatgtattcccacagtcgctcgatcatcaaacgattcctgcatgagaccgaccacaaagtcgtgcgtccagaggagctaccgtctgcggtgctgacgcccccggatgaaggcaatgtgctggggaagacaacaaacggaatagtcatggactgccccacagattgcaatccggctgcatgcgataacaagcccgtagagccagctcagtgcttcaaatacgaagcagttgccggtggcggaggctttcggcgctgcgagccgtttgcggatcctctgactgcgacatgtggaaaaggattcactagatgtgcaatggcggcacccacgcgcggcaagcactaccagatgtttgcctcgcctccagatcaccctctccctcagcctctcctcattcaaggaagcaacttgcacgcctgcttgcgcctgctgcctgttcaccaagcgaccaggtgcagcccggagagtgccgagacggttgaggcagctctgaaggatacccaggcagtcgcgcaacagcctcctcctcacgttttggaacaagccgttctctttgagaatatccaggtcccgatgccagggtcgtataagctgtgcatgctccaatattggcgacctcctgactcgaaacccaccgacaacgtattcatcatgggaatcgacgagataggcactctcgatgtcctacagcagcctgacgcagaaacgttaaagcatgtgcaaggactgcataaaaaggattcacaaatgcactaa

SEQ ID NO: 189 - DNA, 6798 bp, Toxoplasma gondii
atggggggccgagccaccacgtccggcgcacgctctctcgccctgcccctcctcgctctcttcaagccttcctttgttctcttgtttttcctctcttctgccgtctcatctggtctcgccggctctcgcatcgctgatggagtgcttctccccgccggtcaagatcgttcacgcagtgccccccctcaaatcaaacccggtgttgggcattttggtgaaggcagccatggtctgaacatttcccggacgtttttagcgaacagtgcgtccacttcactgcactcgagttctacgggtccttcgcgttctgcagctgctcggttgtccagtgtccactctgtcgcaccgtcttcgactcccttgtctccctcgtctctgttgcggggatcgaaagcttcccgttccgcatttccgtcgttttcctcactacgaaaagaaaagctatccacgagttcagcggagaagcaaggcatagttgacaattcttttgaagatgaaggtttggaaggacgtgcgcgtaagcccagagcgcctcccgctgttgacgagagtttgatagacttatctggacactcggatacacctgagatgtctccctcggcaggtgtcaacgacgttcttgctcctgcaagaatcttgaatccgaagcaattcgcaagacagctggtggccaaagttcacactgcgttcgtgcaacgagatcaacgcatagcagaggaccagaaggacgggaaggagaacgttgagaaagagcggagacaggggtccagtgcccttctcggcgtcgacgagcagctgaagcaggccgatcacggtgacgttgccgctgacgacggagaaactggcgagatagatgtcaacgaagcagaggctctgatccccgacgaagaatccgtcgggagatcagtcttcctgcaggatgcgagggaatttgaagatgacgatggcaagcaagacgacgacgccgacgatgtgtccagttcacacgacatacgcgctcgagacgcacacactttcgcgttcgtgcagaacacagaccagacagaaaaggaagaagccgaaggctcttcccaggaagacgacgacatggtcggcagtaacgaagagacaggaagcaagtcgaaatccgagggtggcgatgcttcagagaaggaggaaaagtcagaaaagggagacacgtcagagcggggagacaaatcagagaaggaagacacgacagagaaggaggaaaagtcagaaaatggagacacgtcagagcggggagacaaatcagaaaatggagacacgtcagagaaggaagaccagtcaggaaagggagacacgtcacagcagggagacaagtcagagaaggaagaaaagtcagaggcggcagacaagtccgaggcggacacgtcgaagaactcgtcgagtgcaaaagccggagtaagtgagaaatttaagagtgctgctcaaccacgtagccacctagtgcacattactactggatatttacctaaaattagagcgtaccgtgccacagtcaatccatctcacagcagacgtaggaagaagaagaaggaaggggggtccgaggacactgagtcgaaagcacacgagaaacaccgggaaggggaagcactcccggaacctcgtgactctgaaaaggagtcggagagcaaagcggaggcagccgcttctcacaacgaaccggggaacgagggcgacgaggcaccgggagactcaggtgatcaagagcgccaggctgggggagactcagtaccctctcatcctggcgacaacgcagtgaacgaatctagatccggtgataatcgcggtgaagctggagaaacacgggaggcagaaaatgacgctgcggtgggtcattccgaggacacgggaacgggtgagacaccgtcggcagagggtcaccatggggaggagagtggcgctgagacggttgttccatcggacccgcgtgaagagatgggcatggcagaagcaaggtcagctaacagccccgaagagaacactgcggaggccaccggcggcggcgcttctccctaccgtgaagaagcggagacaatagtacaaccatacactgacgcccgccaaggaggcaacaatgatgccagtgctgcctcgcccgtagctcgccatgactacacagaaggtagtcaagcatcgccagcttccagacccgatgacaatgcacgagcgacaggaagcgactcgtcgcctgtgtaccgtgaacatgcctggtcgggcgaagcacctgctggtgagggtcaacaagaatacacgggtggtgctggatatgctgcgcctgtatctcatcatgaccagacagaagcgagtccagcccggtcagtgaccacccccgaatggagcgcacaggcgaccgggagcgaaccacaacctggagagggtacagcacgcgaccaggaacatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaacatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaccatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaacatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaacatgtcgacaatgcttctgctgaccgtcaaaatgccgaggcggaaggcaatgaagcaaaatcagagggcagccccgaaaacaatgcacaggagacacatgagaccgggagtgaaccacagcctggagagggtacagcacgcgaccaggaccatgtcgacaatgcttctgctgaccgtcaaaatgccgaggcggaaggcaatgaagcaaaatcagttaccgggccagacggcggtgcacaggcaaatggaggtgaatcggcggttactcaacataagcaggccagcgcgggtgatagtgagggtcgacaagactacaggaatggtgccggatatgcttcgcccgtagctcgccatgaccacgcagaagcgagcttagctcggtcagcaaccaccctcgaggggcgcgcacagaacacaggtacaccggcgtctgctcaacgtgaggagacaaaacccagacctgcagcggtcgaagacgtaagcaagaataaggaacccgagatcgaagaggaaccaatccacctccaacacacagggaccaacgcaaacataggacacacgaacgctacttccgcgaatcaccagcccaccacagaggccgaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctagtgaagggggtcatgaggccgaaagcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgcgcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggccgaaggcggttcagcagatgctcaccacggtggagacgagcagaaggaaggcgagcacgagcgtgcgcctggtgaagggggtcatgaggcagaaggcggttcagcagatgctcaccacggtggagacgagcagaaagaaagagggggtgagggctctgctgaggagcaagaacgcggttctggagttgcgtgggaggcggcagtgcatccgcatgaacaggggagagtaacggaagcagagggcgaatcgtctcgcgttgaagaggaacacgaggccggaggagcgccagtgcatgcgcacctcggcaatgaaggaggaaacgaagtgggactgtctctcggtgaccagaaacaaggtagtggaggagagtcttcctcatctcaagctggtcacgcgaagacagaggaacggaagtcagggtattcgcatcatgggcctgagactgaagaggataccgcattttcacactctgggggcggaacgggagatgaaagggaaacaaggcgttctaatagtgaacagaggaaggaaagaacggaggagggaggagcaagggatcagcctcagaatgagaagaagacggaagagcaacatgcacagaagcaggaggaacaacataaacgtgatatcgctctcagcaaacatcaagaagctgaggagaatcgtcgacatgcggacgtgctgctgcaacaccatcatctcgggcaaggcgggcctcgtggacgcacggccgtgacgtcgcattcgcacatgcatgtgcaagatgtgactcagcaccaccagttgcaggaggctacgcagatggcggggaagttgacccgccacttacaaattcagaactctctgaagctgagagaaatgtttttgaagcgcaaggaagttggccacctcaatttgctcaagcactttcaggatctgatgcaggcagttgtctcgagaatctacagtaaactcaagggggccaagcgctcgctcaaacgcatgtattcccacagtcgctcgatcatcaaacgattcctgcatgagaccgaccacaaagtcgtgcgtccagaggagctaccgtctgcggtgctgacgcccccggatgaaggcaatgtgctggggaagacaacaaacggaatagtcatggactgccccacagattgcaatccggctgcatgcgataacaagcccgtagagccagctcagtgcttcaaatacgaagcagttgccggtggcggaggctttcggcggtgcgagccgtttgcggatcctctgactgcgacatgtggaaaaggattcactagatgtgcaatggcggcgcccacgcgcggcaagcactaccagatgtttgcctcgcctccagatcaccctctccctcagcctctcctcattcaaggaagcaacttgcacgcctgcttgcgcctgctgcctgttcaccaagcgaccaggtgcagcccggagagtgccgagacggttgaggcagctctgaaggatacccaggcagtcgcgcaacagcctcctcctcacgttttggaacaagccgttctctttgagaatatccaggtcccgatgccagggtcgtataagctgtgcatgctccaatattggcgacctcctgactcgaaacccaccgacaacgtattcatcatgggaatcgacgagataggcactctcgatgtcctacagcagcctgacgcagaaacgttaaagcatgtgcaaggactgcataaaaaggattcacaaatgcactaa

SEQ ID NO: 190 - DNA, 8943 bp, Toxoplasma gondii
atggtggccaccaccctccattcgttgccgtcccgctacctgtacactcttttgatgtcatttctgtttgtttgtggagctcttgcgcttcacgaaagtcccgatggcttacctgaggctcctgaccgcccccagaatgcggaatcgggtgatggcccgccgacactcgttctgacgctggatccagagtatgctgggaagtcagaagagtttgcttttactgctgaatatttccctcctacggaatcatctaaaaatgaagatggcgcgcaacagagtttcgtcgaaactccgaatcggcggctacctggaacgttcgatcccatgtcatcgagcgacgtgcggagtgaggtgcagctacgcgtgacgacgcaacaaatggagaggggactgcttgctgagatcgtcgtgctacaggagggccagatggtatcaggctttcgagcatcgcttcagacgaaagaacaggctgcactcttgcaccgtctggccgatttaacaaatgacccaaatatccatttcagggttgagtggaggggccggggcgacggcaccggcggcctctacattcggacggccgtccatctgctcgcgaccgcctacaaaccgtcggttcacttcaagctaaacctccaccaaaccggtgcgaggggagcgcgggagactattaaattgctttccagtgtgcctattgatgacctgaacgctccgggtgtagacatagggacgctcaagcagctcattgtggatcacgcggagccagaaaacattctcactgggcccgggtcattctccatcaaacggatgttcaaggaatctgacccgaagaatgccaacacacaggaggcaactcttgttccgtggctgctgcgtcttcttgacctggcgtcgcctgtcacaatcgtcggtgatctgacgcggaatcgagagttttccacagtgcttccacaagggcccgcgaattggaatgaccttctcttactttacacaggcatgggagacgcggcaaaccggggccagaacgctcccgattttgctcagcgtgaacccggttaccgtccaggaagtatatttttgtctcctgatggtttccgtggcgcggcacatctgggtgatcatcagcctgaccgtctgaaacagttctggcgacagggtggcgagacgggtctcaatcctggagacatcgagcattactacagtcctctttttgggcggtcatacgatacctcgaacaatcctctcttgatcctggatatgtacggaaatcctgtttattcggagggcggcgtgcctaagttcattgtcgggccaggcgagaacgacctgacgaaactaccggaccatgtcagtgggatggttctccccagtgtgtctgctcgattcttattcccggataagcgatcattcacagagttcattaaccctgctcggccttggaatgatatcagcaaaggctggaaagctctaatggcgaaacataaaatgaagttcaactaccgagaaccaggccttgtcggggtgtcggtcaacgggaactggtacggtttgacgagtgaatttatacaaacgtatcccactcttcttcatcttcttggaagcttggcccaaagtactccaggattttctcttgaggacgtaaccctccattttgatgacaagctccctcccaagcttcctacactttttgtcctcgatgacgcacacgatcgtcagattccatggtgcgcctttgaatttgtgattccgctttcaccgcgcggaacggttaacatcaaatcccttttagcgaaagggaaatccgcggcagagtctcccaaagggtgcaatttccgggagaagggatttcacttcaccactgttcacagatggggcttcgtcgagtctcggaatcctttgagtattcagtggcacggcgtattggactacaccggatccaagcaggaatgcgcattgcttggaaatgttctgaaggatgctcatctagctggacgtcaaattgcggtcagtttccatgcggaacataaagccacggtcattccggttatcgagacatttggccctgatggcgaactcctgaagtcgaaacctcagaagccagtgacggctactgtgcagtttggtgatgatttgcccggacttttgtatgattttcacaaacccttccaaaagaaaaaagtccccaccgtcgtgtacccctttcttcagggtcagggacagggttcgcgggatgcactcaacggtggcgttcttggagaggaatattaccatcggccgcgcaaaacaaaaatcacgatgcgccccgagattcccattctcaacactcatgatacgttcgtggatggatctgggcctcacccgaatgtccctcacttcgtcattcctttaacagcgggtccgcagcaacatctggcgcccctcaaagcgctgcggcagtggcttcgtaaggagtaccctgggtctcagttgccctttaaactcgatcgaatgagcgacgaggatctcttgggtatcgcagatcatcttgtgttccggtttcccgatggaaccgaagcaacgttgcgatcgattttcggtccagaagtgttcagtccaaactgggcgacgatgaatcccgacgcctaccaaaaactaatggatgttcttacgaggcccaaaaaggtgtatcttgcgaagaatttccgcatcgtcgtgactgacgtcgacggacagcagatccctttcgacatccagatcgagccaggagacacatgggcgaaaacacttgatgacttcttcaaggcacacccgaacttaaaacccgccaacgtcaagcttgttttgtacgacgacaaagataccgccctgcggcaattcgacataaatttggatatgtatgcttcgccctacaccgaggctgtggaccaacaacacatgaagggccttcaaataaccctggaaactcctgcgccaattgtctcgtgttatcaagctgacccggcacgtccagggcaatgcctcgccgttgacatgaaacgcattttctgcgggcgtgtcaaccctgcgaaaatggtgtcgcgtgcctggaatgaggagtgcacagctgcttggattgcgcgtgcggatctcggggaagtcgaagacagatatctcatgggtccggatgacgttcgggcccgatcaattcgagaccttctgacgtcggcaaagaatgcgctgaagcagaggaacccagagaaggcaaagcatctgaacatccctgttgcggatgtcaccgaatccgaagagctgaacaggaaaatgagggagaggacggagttggcgatgaagagtggcaagacgctggaagacttggatcgcctgagacacctcaagttcgagattagaactcttcagcgtcaaggagagctgcagtgggccaaactggtaggcgcgactatcacgaccacagaaaagggcaagcccgctgagagacacatccgtctcgatcccaagaagtttttcttaaacgacaaactctggaaagtcttcaaggaacttgcggctcaggtccctggtctcaaatttgaaaacgttttcaacttctctttcgaagttatgaacaaggaagcacgagagcagtggaagaaggagcagaccacagtcacgaaagaggcaaagaagcaaatgcggtcgcagaaaacagtggttgatgtgatattcgttgggcctgacggctccgctctttttcgagacatcggtgtggagctgcggcagctttcggatgaagccctggggcgactttcgaagggagacaagagaggtctgatcaaccagctggccaagcgttacgacatcccaaggcaatacttcattcgacggggagggtttccgtcggccgcagttaatggaaccaaatgggtcatcacagccatgctgggtcttgtcggaggcgccggcaaaaagggcctggccagtttgttaaaagatccacatgcattcgtgacacatctccagtcggcaggaggcttcagccccacagatactgtgaaactcgttttcgataacggctccgtactcgacgtgcccctcagtcagcttcctgaccaggaccttggcagtctcgcggagatctattttccgtggaagaagaccgctggccaagcccaagaggaaaagaaaaaggcagtggaatcgaaagtcgccgaaggctcaggtattatgcggaaactcgaagtcacagtcatgcagccgtctttgtggccagaggtgtttggtgcctggctctctgacttgcatgaaatggatctttttgacgacggtccaatactcttgcaagtgcgcccggaaggggcgcagaaaggccaggtgattcgatgctcggtgaagacactgggcgagctgtatcaggcgctcaacaagcccgaaattattcgctcgaagtgtcccggaatggccgacttgaaaaagccgttcacgttcgagttatcgatcagaactccggcggagcagtattacaagctctacaatcgatctcgatcacccgaagaccagaggcgtactgcagccgtcctcttgaagctgaaagatcacatacgtaacctccctgatgatggacaagtgatcttcgaatacagaaagatcaagaggactctgactccgcaagagcttcagcagctcaaggctctcatcgaggggctccaacctaacgaaaacacggatgatgtgttgaccaagattctgaggttgctggggatttcggaccaggatatcgccaagtcgggcaggttgcggttcggcatcaagcaggcgccgacttcgtcagaacaacagatgctgcgcgagggttcgattaccgctgtggtcgaggacttccaggggggcagaagaaaggcgactgtccgtatttcgatcccggaggaggagccgcttcgcctcggcgcttctgcccagaattaccaggtgcatatgtctctgttttcgaaaaacgctcaacacctcaatacgccgtgtggctcaaagtccggcgcagaagtcgccaaagcgacttggggacagctgtgccggtggtgcaatctgaaactcgccgacctccctggtctcggtcatccgacgttgtacattcgaattatctctaacgagaagactcaaaccgtgcgaggaggccagccggtgacgaccaacgtagacggccatccggtggtgtacgacatccggatgccaggagatccacgttctgcctctggaatgccaaagtcggttttctggaatttggtcgagcgacctggttccaacgaactgggtcctgtctggcaccaatcaattccgaaggccgacggaggcttgcggaaagattacagctacttcgatccgaaccctggggcgtgggacccgacgctcttcgggccgtcttcaggcacttttccgcagaacacccgagctggcattgatattgtcaccaaccccgaagccatggaaactggcgacgcctatgcgcccccaataaggtttggttttgggttcaggaactggaatgaccgagatgctgtgaaacctcagttcaacaatatggtctcaggcatcgcccctcaggagcgagacttgtacaaagtgtacattcaaatcccgaaaggagatggcaactactacccctgcagcggcgtggatatcaatctgttcatgcagctgaccaaggaacagattgcccgagcctgtggcatacatccatctctgctggaggcgcccttcggtgtgtatctgctgaaagagacacccacatacgcccgggcgcagccgagctttccgctcttcttcgtagatggcgaaggtcaggaacatccgtcattggggcactggacagacgcgcctgcaaagttcttcagtcctcacctgcggggtgcctcgccgaactccttgattcagctcgaatttgctccgggggttacctgcaatttgacccagcaagaactcatgtctctgcatacttgggaggcactcctgaagagatgtaatattgatgcgggcaaagagcgaccggcaacaatcacgacacgcattgtgcccatgttctccaccccaaacgtgacggtcaaagttcccaatgagctgttgcagccacttcttcggcagcatagaggtatctcgcctgaccagttgttcaggcagaaacccttggaggaagtcgtggcacttctgctgtcgaatgcccatctcggactctaccacgttggtttgaagtacatcgatgggactgaccaaccgtacagtgaatgcccagaacatctgcggcagctgcctccgagccaaattcccggtctccagcatatctatattgtgccggcgagcgagggcgaaggagatttcccaggggtgttccgcggaggaactctgggcgacatgatgaaaggcatgaacctcagcccccaaaccacatatggcgactttgtgcggacagtgaagaagaagatcaacagtcctgaaggtctgactattccgggagtgcggcagcacgttggtggctccggtcgtccagcccaacagattattgacttcgatttcgctggcccggaatcgccaccaggagctgccggaaaaccagggtgggaagccacgtggcggcctgctacagtgggagcgttccccgacaacatgccaattggcgatattgacagggagatgcaccacccatttctggtcttcacgaccggccacccccccaaatacgacctgaatggtttagcggcctacggcggccagcccttccgtgaggagaccacacatctagatgcaagtcttcgcaacctcgtcgagtggatgaaggactctttgggcatatctgacccgaacggaatcctagctgaaatcgtaatagatacgattcgatgcccgtttcctctgagtgctgcacaactcatttcggccacgattgggcatctactgcaccactgccaggtcaatgacttggaaatgagtcatagtatctacgtgacgccgacccccgttcccggctacactgccactccaaagcgcaacggaccgcaaattgttatcaacggccataattacggagctcctggcacagcacctcgagacttcgggcagctgttcaacctccctggcaggcctggagctcgaccgctcaatcaggacctcgaggtctcgttcagtcctcttcccggaaagccaccggtgcgcggagtccttccgggggatgttctccccttgctgcaatctatttccgacaaacatggccagcctggcgtcgctgtggtgttgaacttcctgcgacaactgcatgcgctggcggaactcccgccgggtgccaccctcaacatcgacacgaaactcattccgtcgcaaagtcctcaacagctatacgcgccagaccaagttccacaacctggcccttggattgctggcccgactgggggcggacggtttccaggcggcggtgttgtggtgaatgaatctggcgggagaaggggaccaggtggttccgcagctgtgaagtttatgccgtcgaccttgcgacttccactgcttcggcagccttccgtcgagctgcctcggaattcgatgctcagaggttccataggaggagttggaggcctgccgaggacagagtttgtcgttccgattttgccttctcagaagtcgatgcctattgaacaggttctgaaattcttcggcatcgctccggcagctgttcagaccttggatgtccaagaaaagcctgagcaaggcgcaattttgattgagtccgggacagtgacttttgtgccactgaagggacctacgttcaccgtctcgatgaagaaaataaacgcgacggacaaaaacactctagcaacgctgctcaaagcggcaggtcgctcgatcattgatctagttggggcctctgacggcactcaacctttggttctgaaaattgttgttgatcacggggcggtcagtcccacgaaggtcaccacaccggttgggacgccttcgcacgcaagatctgccatggaaggattgacaatctggaacctcttgcctccgctgattgacgtccattctgtgaagacaatcacaatcagagtccaggctgccaaggcattccaacaagctgcgaaggctgctgcggccgcagaaggtaccgaaggcgattccgctggagagcccctgtcgcgccccaaaaacgttgagccggcagtgagaaccaagttcaagaataagatcccggaactccctgccgcgttcaagcccagacagagaactgtgtccgagataaatggcgcaccgaatccgaaactggttattttcgtggaacaggatggccagaaaacaatcaggttcacttttccatcgcgcgtcaacgacgttgtcatcggtcagtcgaccgttagtgtggtcttagacgctttgcttccaaaccccggcacctggcatcggactttctggggagccctatcgccagatggcacaagctgcaagccaacaatggagttccagtacccccactggcttcagacaaaaatggcagaacttcccgttccgaaccactcttcatgcctgttgatccgcgaggtttctctcaatatcaaacaacgacctaacttcttcatcaaaccgtacatcttccacagccccctggtcattttcgcactacaaggcaagcagcggatacctatttttgaggaacaggtcgacccggcagtcacgagtcagcctttgactgccctccttgaacagctgggtatccccaaaacccagctcgatacaatccttcagtgcagtagcacgaacatagacgcccccggggagtgcccatctgatagctctacgacagttgatcccgaaaccgtgattcctgacgcggtggcaacacagtcggcgttcttggttgtgacggggaagcagaaacaggctccaggcagctttcttcaggttttgtggaggcgacagaggaggcgtaactccattcagaagcgaataacttcgcactag

SEQ ID NO: 191 - DNA, 1267 bp, Toxoplasma gondii
atgctctccgttttcccagaatctgcccgcaaaatggagagtgtcaaccggcctcgttttccccctttcttttgcccgccgtccctcggtgtctctggcgcgacggtgcttcttccgttcgtcggtgtgcttcttttttcgtcgctcttctcgtccgctacgacggtggcctccatccctaatcccgccggtgcctggtcaccgtatttgtcgtcgatgtctgtttggccagcgaacgacgaggacggctccacatctgttagctctgacactgctctcgatatttctccttttgcggacgatgaaaaggacagtctcccggtggccgcttctctctctccgtctctctttcgcgctcagcggtggcagaccccacacaacaaccgtaggacccctctcgcccactcttcccttccggtgcacgacgacggcctcggggctagctgggtggctttgaccgaagataggaacgaaggaagcggtgcggaggaggagggagaaaataaggagggggagtccgacaaagccgagagtgaagaggaaaagtcgtcagtgagtgagaatgacagcaaaaacgaagaaaagacagaatcgaaggactcggagacgggagacgaagcggcggcgaggtctgaggacagagacgagcaggacggagagacaaacaagccaggaaaacaggctcaggccgctccagaggaaggcgaaaatgcatcggcctcatctgagaagttgtcttgtccgcgtgcttgtctgatcgcaagcaagtcaggagggaagacaggaacagacgggcacgaaaaaacgaacgaggtgagagcagatcagaaaggtggtgagggagcttctaccacgcagcacgaagaggggcaggaaacggaacaaggcagcgaagaggcgaattccagttcatcctctgcacccgcacaatcgcatgaaactcctgtagccgaacatgcgccatgccctcacgcagaggaacacaacgccacgaacggcagcaactctgcagaggccgcgagcgaagattccaacccccatgaagcagtgaaacatacggacgcgcatgggcaaacgcaagcttcagaccaagctcaaggacacgatcaggaagaggcctcacagtcttcagaaacacctgcagaagaaaatgctgaagaaccgaaacaggcagaggagcaggcgaacgcctcgcagtcatccgaaacgcctgccgaagaaaatgctgaagaaccgaaacagcagaggagcagcgacgcctcgcagt

SEQ ID NO: 192 - DNA, 3480 bp, Toxoplasma gondii
acagacgggcacgaaaaaacgaacgaggtgagagcagatcagaaaggtggtgagggagcttctaccacgcagcacgaagaggggcaggaaacggaacaaggcagcgaagaggcgaattccagttcatcctctgcacccgcacaatcgcatgaaactcctgtagccgaacatgcgccatgccctcacgcagaggaacacaacgccacgaacggcagcaactctgcagaggccgcgagcgaagattccaacccccatgaagcagtgaaacatacggacgcgcatgggcaaacgcaagcttcagaccaagctcaaggacacgatcaggaagaggcctcacagtcttcagaaacacctgcagaagaaaatgctgaagaaccgaaacaggcagaggagcaggcgaacgcctcgcagtcatccgaaacgcctgccgaagaaaatgctgaagaaccgaaacaggcagaggagcaggcgaacgcctcgcagtcatccgaaacgcctgccgaagaaaacgctgaagaaccgaaacaggcagaggagcaggcgaacgcctcgcagtcatccgaaacgcctgccgaagaaaatgctgaagaaccgaaacaggcagaggagcaggcgaacgcctcgcaatcatccgaaacacctgccgaagaaaatgctgaagaaccgaaacaggcagaggagcaggcgaacgcctcgcagtcatcccaaacgcctgccgaagaaaacgctcaagaaccgaaacaggcagaggagcgggcgaacgcctcgcaatcatccgaaacgcctgcggaagaaaatgctcaagaaccgaaacagggagaggagcaggcgaacgcctcgcagtcatcggcaacgcctgccgaagaaaacgctgaagaaccgaaacaggcagaggagcaggcgaacgcctcgcagtcatccgaaacgcctgccgaagaaaacgctcaagaaccgaaacaggcagaggagcgtgagaacgcctcgcaatcatcagaaacgcctgccgaagaaaacgctcaagaaccgaaacaggcagaggagcaggcgaacgcctcgcaatcatccgaaacacctgccgaagaaaatgctgaagaaccgaaacagggagaggagcaggcaaacgcctcgcaatcatccgaaacgcctgcggaagaaaatgctcaagtaccgaaacaggcagaggagcaggcgaacgcctcgcaatcatccgaaacacctgccgaagaaaatgctgaagaaccgaaacagggagaggagcaggcgaacgcctcgcagtcatccgaaacgcctgccgaagaaaatgctgaagaaccgaaacaggcagaggagcaggcgaacgcctcgcaatcatccgaaacacctgccgaagaaaatgctgaagaaccgaaacagggagaggagcaggcgaacgcctcgcaatcatccgaaacgcctgcaggagaaaatgctgaagaaccgaaacagacagaggaaccggaagaggcctcacagtctacgcattcaccggcggaagaacagtccccagaacaggctcagggacaagagcgggagaacgcgtcacagccttcagagtcacctgcagaagaatccactcctgagcaagctgaagaaaagggtacggaggcagcggaagagccggcacaggagcaaccggcggagacgcaggagggttcagatgctgaagccgatgcggaaggcggatctggagcgaatggcgaagcacagccacaggaggagagcggcgagaataaagatgtgcctgccgcggaccaggaggcccctggcctagatgaacagggccgcgacgaagttggaaccggcgctccagaagccgcggctgcttcagctgccggagctagccacgagaacgaagcccatggggcagatcaacaagatgattctgtggagtccgcaggccccgcagctgacgagcagcaaaaagacgcgacaggcgaggtcggggagctgcacggggctgagactcagacaccacagcttgcagctgaagcggagacagctggcgcggagcaggaggcggggagagcagatagcgtcagcgacggatgctatgtcacgaggagacaggaggtcgaggccgaggcgaagaagctgctggaagtctgtgaaaggaacgataatttcaccaaagtcgaccaacaattttgtgatgaactgttcaagaggatcgatggcccgttcacagttggcgaggtctcagcgtttctccgagctgccgacactgcaaacaacatcagtcgcaatttccggttctgtcgggcaactccgacaagcagcccaccgagagtgcgggatggagacagcgttattcacgcagcgatcgctgcatccaaacctcgcgttgtcgagattctgcttcagtacggagcgttccccaacatcgaggccttcccgcgttctcccgatgcagctaatagaatgggcatgcgacctctgcactacgttgcacggtacccaacgctggaaaattacgaatctctttttcttcttttgaagtacggctctcccgtaaacgttcgagacgtcggagggcggacccctctgatgatcgccgcgcgttcaagtcaccccttctcaaagctttttgccagagctctgattgaccgcaatgcagatgtcactgcacgagacaaagctgggctctccgccctacattacgcagcggcctcgaactcgtgcaaattggtcaagctgctcatcaaccgaggtgcagacgtgatgtctcaggatattcggggaaacactcccctccactacgctgcagctttcaacgcagacaagtccatgaacactttgctcaatttggcagggaatgcgatcaaggtgaatgtgccgaataagaatggaaaggcgcctattcatttggctgccgcgccatcgtcgttcgacgtcgtcccagccaagattgttccggctctctcgctggaattgcttttagagaagcatgcagaccctgtggcgcgggacgcccacgggaacacacctctcatggacgcggttttgggcgggtacctcgaaatcgcgaaacgccttctgcagattgccagggttcccctacatgacaaaaacatggatggcaaaactgctctcgatctcgctcaggaagcagcagaacgaactggcgacgacgtcctcgcatacctcacggccgttagcagcaagccctcctgccccttcatcccgcgcgtcgcgaactcgatacacgtcttgtcagacacacaattcggttcgctcatgcgtgtgggagacacagtcacctacgagtgccaccacggcttccgcttgctcgggcatgctaccctcacctgtatgagtcgtgacggctcaccagagttcatcccagaccctcctgtgtgcattcccatggaacaaggcgccgcttcgtctctgtattcggctcctcttgggctggctactgccctgttagtctatctaattccttttttcctaactcagttctaa

SEQ ID NO: 193 - DNA, 4482 bp, Toxoplasma gondii
atgctctccgttttcccagaatctgcccgcaaaatggagagtgtcaaccggcctcgttttccccctttcttttgcccgccgtccctcggtgtctctggcgcgacggtgcttcttccgttcgtcggtgtgcttcttttttcgtcgctcttctcgtccgctacgacggtggcctccatccctaatcccgccggtgcctggtcaccgtatttgtcgtcgatgtctgtttggccagcgaacgacgaggacggctccacatctgttagctctgacactgctctcgatatttctccttttgcggacgatgaaaaggacagtctcccggtggccgcttctctctctccgtctctctttcgcgctcagcggtggcagaccccacacaacaaccgtaggacccctctcgcccactcttcccttccggtgcacgacgacggcctcggggctagctgggtggctttgaccgaagataggaacgaaggaagcggtgcggaggaggagggagaaaataaggagggggagtccgacaaagccgagagtgaagaggaaaagtcgtcagtgagtgagaatgacagcaaaaacgaagaaaagacagaatcgaaggactcggagacgggagacgaagcggcggcgaggtctgaggacagagacgagcaggacggagagacaaacaagccaggaaaacaggctcaggccgctccagaggaaggcgaaaatgcatcggcctcatctgagaagttgtcttgtccgcgtgcttgtctgatcgcaagcaagtcaggagggaagacaggaacagacgggcacgaaaaaacgaacgaggtgagagcagatcagaaaggtggtgagggagcttctaccacgcagcacgaagaggggcaggaaacggaacaaggcagcgaagaggcgaattccagttcatcctctgcacccgcacaatcgcatgaaactcctgtagccgaacatgcgccatgccctcacgcagaggaacacaacgccacgaacggcagcaactctgcagaggccgcgagcgaagattccaacccccatgaagcagtgaaacatacggacgcgcatgggcaaacgcaagcttcagaccaagctcaaggacacgatcaggaagaggcctcacagtcttcagaaacacctgcagaagaaaatgctgaagaaccgaaacaggcagaggagcaggcgaacgcctcgcagtcatccgaaacgcctgccgaagaaaatgctgaagaaccgaaacaggcagaggagcaggcgaacgcctcgcagtcatccgaaacgcctgccgaagaaaacgctgaagaaccgaaacaggcagaggagcaggcgaacgcctcgcagtcatccgaaacgcctgccgaagaaaatgctgaagaaccgaaacaggcagaggagcaggcgaacgcctcgcaatcatccgaaacacctgccgaagaaaatgctgaagaaccgaaacaggcagaggagcaggcgaacgcctcgcagtcatcccaaacgcctgccgaagaaaacgctcaagaaccgaaacaggcagaggagcaggcgaacgcctcgcagtcatccgaaacgcctgccgaagaaaatgctgaagaaccgaaacaggcagaggagcaggcgaacgcctcgcaatcatccgaaacgcctgccgaagaaaatgctgaagaaccgaaacaggcagaggagcaggcgaacgcctcgcagtcatccgaaacgcctgccgaagaaaacactgaagaaccgaaacaggcagaggagcgggcgaacgcctcgcaatcatccgaaacgcctgcggaagaaaatgctcaagaaccgaaacagggagaggagcaggcgaacgcctcgcagtcatcggcaacgcctgccgaagaaaacgctgaagaaccgaaacaggcagaggagcaggcgaacgcctcgcagtcatccgaaacgcctgccgaagaaaacgctcaagaaccgaaacaggcagaggagcgtgagaacgcctcgcaatcatcagaaacgcctgccgaagaaaacgctcaagaaccgaaacaggcagaggagcaggcgaacgcctcgcaatcatccgaaacacctgccgaagaaaatgctgaagaaccgaaacagggagaggagcaggcaaacgcctcgcaatcatccgaaacgcctgcggaagaaaatgctcaagtaccgaaacaggcagaggagcaggcgaacgcctcgcaatcatccgaaacacctgccgaagaaaatgctgaagaaccgaaacagggagaggagcaggcgaacgcctcgcagtcatccgaaacgcctgccgaagaaaatgctgaagaaccgaaacaggcagaggagcaggcgaacgcctcgcaatcatccgaaacacctgccgaagaaaatgctgaagaaccgaaacagggagaggagcaggcgaacgcctcgcaatcatccgaaacgcctgcaggagaaaatgctgaagaaccgaaacagacagaggaaccggaagaggcctcacagtctacgcattcaccggcggaagaacagtccccagaacaggctcagggacaagagcgggagaacgcgtcacagccttcagagtcacctgcagaagaatccactcctgagcaagctgaagaaaagggtacggaggcagcggaagagccggcacaggagcaaccggcggagacgcaggagggttcagatgctgaagccgatgcggaaggcggatctggagcgaatggcgaagcacagccacaggaggagagcggcgagaataaagatgtgcctgccgcggaccaggaggcccctggcctagatgaacagggccgcgacgaagttggaaccggcgctccagaagccgcggctgcttcagctgccggagctagccacgagaacgaagcccatggggcagatcaacaagatgattctgtggagtccgcaggccccgcagctgacgagcagcaaaaagacgcgacaggcgaggtcggggagctgcacggggctgagactcagacaccacagcttgcagctgaagcggagacagctggcgcggagcaggaggcggggagagcagatagcgtcagcgacggatgctatgtcacgaggagacaggaggtcgaggccgaggcgaagaagctgctggaagtctgtgaaaggaacgataatttcaccaaagtcgaccaacaattttgtgatgaactgttcaagaggatcgatggcccgttcacagttggcgaggtctcagcgtttctccgagctgccgacactgcaaacaacatcagtcgcaatttccggttctgtcgggcaactccgacaagcagcccaccgagagtgcgggatggagacagcgttattcacgcagcgatcgctgcatccaaacctcgcgttgtcgagattctgcttcagtacggagcgttccccaacatcgaggccttcccgcgttctcccgatgcagctaatagaatgggcatgcgacctctgcactacgttgcacggtacccaacgctggaaaattacgaatctctttttcttcttttgaagtacggctctcccgtaaacgttcgagacgtcggagggcggacccctctgatgatcgccgcgcgttcaagtcaccccttctcaaagctttttgccagagctctgattgaccgcaatgcagatgtcactgcacgagacaaagctgggctctccgccctacattacgcagcggcctcgaactcgtgcaaattggtcaagctgctcatcaaccgaggtgcagacgtgatgtctcaggatattcggggaaacactcccctccactacgctgcagctttcaacgcagacaagtccatgaacactttgctcaatttggcagggaatgcgatcaaggtgaatgtgccgaataagaatggaaaggcgcctattcatttggctgccgcgccatcgtcgttcgacgtcgtcccagccaagattgttccggctctctcgctggaattgcttttagagaagcatgcagaccctgtggcgcgggacgcccacgggaacacacctctcatggacgcggttttgggcgggtacctcgaaatcgcgaaacgccttctgcagattgccagggttcccctacatgacaaaaacatggatggcaaaactgctctcgatctcgctcaggaagcagcagaacgaactggcgacgacgtcctcgcatacctcacggccgttagcagcaagccctcctgccccttcatcccgcgcgtcgcgaactcgatacacgtcttgtcagacacacaattcggttcgctcatgcgtgtgggagacacagtcacctacgagtgccaccacggcttccgcttgctcgggcatgctaccctcacctgtatgagtcgtgacggctcaccagagttcatcccagaccctcctgtgtgcattcccatggaacaaggcgccgcttcgtctctgtattcggctcctcttgggctggctactgccctgttagtctatctaattccttttttcctaactcagttctaa

SEQ ID NO: 194 - DNA, 3504 bp, Toxoplasma gondii
atgtctagcaatcttgcttttctgtctctttcccttgcggagtcaacggcctctctaggaaagtctctcgaagaaaccaggacgaggctcaccgagaagctgaagctcgtagctggaatggcgttagggtttgatcaattcgccatgcaccaaacagctacggggcccggcctttccgtggaaggaaagcaaaccgaacagatgagccggaaatcggcggaggatactagagcttcatcactgtcatctgacccagacgatggtagagccgcacaattagcgggccaaaaggggcatgtgacgccttgcattgccggactcattgcaacctcaaacccgtttctgtttacgcatatgctggcgctaggagccgcttaccttgggtacgataagtacttcggtgatggcacatctgaactgctgcctttctacgggactcgtacactactgtcgacgctatctccgctggatacgccacgacttttagacagcatggcagctgccgatcgactgtcaccgaagcgttccatactttcacgtttttcaagaagaaaaaggtcgttagacgcacctgcgccggagcccagtggttgggaccaaaagaggaaatcacgtctccctttgggaagtcttcgcctcgtactggatatactggataggcacctggaagctttaacgacttatgtacagcaacagattgaaatattccggcaagcaggagttccactggaagcgtcagtaacgatgactcacaacctgaacaggttacacgtcactcgctgccagtctagaaataaccagatggtaattccctgtaggtggaaagacacaaccttcttcgaagaactgtcaaatgaaacaaatccaggcctgacagacgaggagcagctggaaaagcgtgtcaaatttcacaagcttgagaatgctttcaacacggttacaggactaggcgcgcttgaagcaatgcttgacgaggacagcgttctgctcggtggtcctgcggaggaatcagtggctcgtctttattcagacttccatctgggtgcagcaatgaacaactggtatttctacgacgccctcaacatcaataaaatgctgtcccgatttcaaaaagttggtacgaaggtcttgaagcagtacgggctggagaacctgatgaatctggccacttcccatcaagcaggaagtaccgcgtcctgggatcggacagatatcgacactaaattggctaaacaccatcattatgggagcgctcttcgtgtccgactgtacatcatggctcttcttccacaatttactccacatcgggaaggaatcctgtctccagttgatttcattcgagaagctttcgctggagaaagaagttatgctatgtcgactgctcgcctgaagcctctattatctgatgacctggtcattctcggcgttcccaagggcttctcgtttttgtggctctttgaattcctcctcgaagaagattcaccaaacgcattggtggcaaaacgtagagccttgaaacggattcccaattggacaaagaggctgttctcccacagtcgttcgatcccgatgcttttccgccaattctataaggccctgaatgctggtgtcttcgcaaaagcgagaaggcggaccctcgacagatccaaaacgttgctcagtcggcaattaccagaagggtggcgcgatattgtgatggatgctttcgccttcaccgcccacagcgcagctctcatgcaagtggtgaactaccactcattgttccgtgaccgaacactcaatgacctgcaagaggcctcctatctcgctacgcctccagctttttccattgaggatcaaagtgtcatgaagaggtgcgatgagcaaatatacgaatggtcacgttttggcttctcgcccgacgttctcgaagctgatttgcacaatgagacattcaagggcaagtgggaaaatctacggcttgaaacgatgcccacaccagacactcatcaatggtggaggcgccttcatagggctattctcgactccctcgaaatataccaagctcacgaaaggcatctgaaggggatgagcgataacttgtatacccttgtcgaggatacaataaagaatctgcaagacggaagctctcgggacgacaccattttcttcggacgaattgcgagaggcgcccgcgaatctgtgggccaaaaaatgtggcgcggcgttaaaacgttctttctcgaccttgtacgcgatgttccaggctcggatcatgccgtctggtttggtgtcggcttcaatttcccacggatcttccaaattctccgcaaaatgaaagaaattgctctacacgctgcaggagaccaaggctcggccatcctgctggacgaggcatttgtggagctggtacaagagacagtggcggtacgggcacaaacgtatagacggcaaccccctacaaccctcagaaacatcggtgtaatcgggttgagaccggactacgccaatcttgacactgaacagagatcgatggaataccagctgtcaatgtgtgcagaccactgtgtctcactctgggtgcaaatcctcggattcatatatccctatgtgctcaatccatctcttttaacagattacgagaagtcatttgggactggccacgcaatcaaaaagttggatgatcccagctatgtgaattcgtttcgctacatttttgcaaacgacgcctcgctgaacttcttcgagcacaatacccctcaagacacacggaaggctttggtgtcactcaagagtggacaggcgttcatgtacgcaaacatgatgagattcgccggaattgcattcgaacaactcagtatgccgtatttggcggtttctcttcaaaggcaggcgcccttcatgggccagatggtcaaggattgggtggccaagagaagcagatcgcggaagctcgccatagtcagcgtgctttctctcgggctcatttttgcgtacacgctgctctccgcgttagacatcgctcagttcctcaccgactcagggatgaaggcaattgaagattgcagctggaaccctattatgcaacaaatggcgtgcgtggtcgtggcaggaagtggatctctggtggctccaacgttcgctgcgctgtcggatgtcttcaaggtgggcctgtattccggaatcgggtcgacactcatcgccgcttcagtcgtaggtaatgcatatatgatcatccgttctcagagcagaacaattctgaggaccgaaatggctatcaagaacgtggctgtgaaactctggaaacagatgcgaaagtatttttcctgggttaccagattcacgaaacgccgaaaagctattcttagcaccatgatggctcgagccacggcccttgccaaaaacaagaaaccacgcagcgaaactgctgcaaccatgacaagatctggtgactccgtaatggacatgcttctacagggagtctcaccggcaacgccacagcgagcgcaggacggcagccgctga

SEQ ID NO: 195 - DNA, 655 bp, Toxoplasma gondii
cagcagacgcgccacattttgcctttcggcagtctctttcccggaggcattctcgggaaaatcatgcagaaactgatgcggtcctacatcatgtttttccacccagtgcttgcgaacttcaaggggctcctagcgctcttcctcggtgtcctctgcaaggtccgtctcccgcagctgattaacgcagtctttggagcgatcttccgggcaaaacgtcgcgccgggcgctacatccacaaattcttctttaaaaccatttctctccgcaaagacatcaccgggaagatcctcgttgacgatctagtcagggggtcgggagccgtgatgatcactctgctctttcagctccacggtgttgatatcgatgccatcagtcgacgtggaggggccgtcgagtcaggcgttctcgccggccagggcgtgtggaccttgtccgatggtctcttcgtcggcttgaaggatttcggccaactcttccgagcctattttgaacgatacgtaaatctcacatccgcaatccacacctactgcgcaaagcaaacgaccaacttcttcacagaaaccgaactcgatgaattctataacggcgaaaacgtcgacagaattccccctcgtgaaagactgttggcatggctccagatacctatggccgcca

SEQ ID NO: 196 - DNA, 1341 bp, Toxoplasma gondii
atggcttgtcgtcagttactttgttcagtacaaaatcttttgttttatttcttgcctgacatatactgcactgacttcgacaccatggagcaaaggctgccaattattctacttgttctctctgtgttcttcagttcaaccccaagcgccgccctttcgagccacaatggagtccccgcttatccatcgtatgcacaggcatcgctctcttccaacggcgagccacggcacaggggcatacgcggcagcttcctcatgcccgtaaagccacacgcaaacgctgatgacttcgcctccgacgacaactacgaaacgctgccgagtttcgtggaagctcctgtcagagacccgcgccaagtccctggcagaggagaagctgctcttggcacagaggagactccaggacaacagccgccggtggctctaggcagtgcagaaggggaggggacctccactaatgaatccgcctccgaaaattctgaagatgacacgtttcacgatgccctccaagagcttccagaggatggcctcgaagtgcccccaccaaatgcacaggagctgcccccaccaaattcacaggagctgcccccaccaaattcacaggagctgcccccaccaaattcacaggagctgcccccaccaaatgcacaggagctgctcccaccaactgaacaggatctgcccccaccaactgaacaggagctgcccccaccagtgggcgaaggtcaaggtctgcaagtccctggggaacatggaccacaggggcccccagatgatgatcagcagctgcttttagagcctacggaagagcaacaggagggccctcaggagccgctgccaccgccgccgcccccgactcagggcgaacaacccgaaggacagcagccgcagggaccagttcgtcaaaatttttttcgtcgggcgttgggggccgcaagaagccgattcggaggtgcacgacgccatgtcagtggggtgttccgaagagtcagaggtggtttgaaccgtatagtaggtggagtgagaagtggtttcaggcgtgcaagagaaggtgtcgttgggggagtccgtcgtttaacaagtgctgccagtcagggtctccgtcgtgcaggagaaggtttacgtaggggtttcactcgtgtaagaggagctctcagaggtcgtggtcgtgcagcagatggtgccagtagtgtaagagaaagattcggtgccgcaagcgggagagtcagagacgctttcagcgcgggattgacgcgcctccgcaggcgcggcagaactagtggcgaggagggcaggcccctactgggcgaaggaagagagcaggatgatggatcgcaataa

SEQ ID NO: 197 - DNA, 1761 bp, Toxoplasma gondii
atgggacgacccaggtggcctcttccttccatgttctttttaagcttgctgtgtgtatctgaaaagcgcttctctgttagcggactccatcttcgatttcgcgaatcgccgcaatgggacagcctgttgcctctgcaggaccgccgcgccgtccagccgtcatcacgctgggactcctccctcacccttgaagcgcatgcaccacaaaggatcgataccagtgacgccggggacgatgacttatttttggacgcaactcaacaggtgtacagaggtgaccctgtactggagacatcttcgctaccgcccgcggcgctgcctgtacgacctgtgagttcaaaaactgaggacggcttcagcggctctagggaagaagaatctgacggaggtgttccgactgggtcagaccaaggagaagtttggcgatcaagctcactggtagatgtgtcgtcccctggagaccgtggtggtgaggaacaagaatcgtcagcccaggctaaaggggaggcggacacgaaagacgaagcagagaaatcagaggatcaaagtcagtcttcgacggccgaccctaacactcctaccgcacaggggacggacgcctcagagtcgggtgaagattctggctctgacaccatgggtgattcggaagtaacagacatacctgtagatccacttaacagtggtccagagactgcctctagtggtgaaactggacagcgaattggggctgaatcaggagcccaaccatcagcggaggcttcacaggatagcgcagctgcatctgagactattccagctgccgatgccacgtcgccaactgatctcccgggcacccttgctggcgccactgtggcggacgactcacggcaagaggcgacgacagatggcctcgagaagagcccaggcgagcctaaagaggtagatgtgtttaacccccctcttgcaacaaaaagcgatgttgcccctctgagtgtatcgaccatcagagcacaggctgccccggacactgaagcgaatataggagctgaggtggccactggaaatgagggagcccctgaagttgaggaggccactgaagatgtagcaggcacaggagctgatatgagcactggaactgacgcggccactgaagatgtagcaggcacaggagctgatatgagcattggaactgacgcggccactgaagatgtagcaggcacaggagctgatatgatcccaggagctgagccaggcactgaaaatgaggcatccactggagctgagggggccaccgaagcggatgagcaggtgccgctaaaaacagaggcccagggtagtgccggaagttctccaactcagggacacgcgtcacattcagtggaagaaacaggtcgattctcagtgattccgtttgaatttggcagcagtccacggcttcgccggtggactacccagttcctaataagggggaaagatttatttaatctgatgcagaagtccaacattgcgaaacaagcagagaaaggagccaagaatcttcgcagctccatggaaatcctgcataacaccacttctttcttcaacgccttccgcgctcaacagcgtagcaaggaggcacagagcaagaacgtccaactgtctgtcacaagtgtaccaaccgaccaaccagaagagcaaaacgcaaccacccaggagggttccaccgcttcaccagaggaagcggcacgagaggcagccgaagcgataggcacgcctgtttctacggaagatgcgcccaactga

SEQ ID NO: 198 - DNA, 711 bp, Toxoplasma gondii
atggcacgcgttcttccttgtgttttccttgttgcttatttatcatgttttttactagccggagagcttacacacacgacagcccttagtgtggctccaaaggcgcagctattctccaccgatgagggccccgtgtcggagtcggcttcaaagctggatgcggagcttgaggagaaggcgattcaagaagccaaagaagctcaagaagatgaagtggacgacatcccgacagaccgtaacgccccacccacgaacggcgatcccaccgatcagccagatgtacaactcaacgctgttgatattgacgggtttcctaccccagaggtccccctccccgtcgagttagacgctgaaaagttacaggaagacgagttcaaccgagaagaagaggcagacaatactgttcccaacattcttgtcggtccggctcaaacccccgaacccgtcgccattcccgttacgtccctgctggctcctgcaccggggactgtcaccacggcctctccacaggagggagttgaagcaaaggaagagcccccggcagccacaggtgtcccctctgccccctcatcaccagctagaagacgtgccttcttccgttcccgagggacaaggacgattactgtgaacgtgaggcacttctttcctaacggtgtgccaatcgtcgttgtacgccctcagcggcgtagttttctcttgaggcggttctga

SEQ ID NO: 199 - DNA, 1203 bp, Toxoplasma gondii
atgaagagaacagagctttgtatcgcagccctcgtggctgttggtgcgtttgcttttacctcaccaaatgcagtggcgaagagctttgagcggagcctcggccacctggacgcgtcctcgttcttgtcgtctcccctcaattcggatgtggagctcggtaggagcactttccctgctcagtcactgtctttcactgaaggcaccaacgagacaaacccaccgacatcccggcccccaggttggaaatacgaaggcagcgacctgcagcgaagagtggcggctcgacgggaggaacacaaaaagcgtcaagaagagtgggaacagaggaaagccagtcgacgctctgcactcactccgagtgcacccgatcccgatggtgacggtgatccagcaacttcatttccatcacaacggagactccttgaccgttgtcttcaacaattccgtgaacaactcgtggatttggagaatctctgcaagggcagcccggaacctgatgactgcaggtcgacggtccaagaaatcctggggaagcagtcgtttggggctcttcacacaactgtcataagtttctccattttcgtcaatagggaccctcgacgtttgtcatttccagtcctcgatgcaacagatttgcgcctcacggtcaagctcaaacatctcctggatagaattccgggatgcgcagctctctccctgccagtatacattgggttggtctcttcggacgtgttcaagagcgaagaattcactagaaaggtaaatcgatgctcggaggatttcggcaggagcgccagagaggagccaagcagagctgggagggcggctgcggctgtcattcgattcatgggacttacgccggagagacaaacgttctaccaacctttcatgttcgtcacaacccaggcagcaatgctgctgtcgatggttttgaaacatccgtttctctcgatactcgtaaacatggcctgtgtagcggggagcctttgccgcaagggaattcgagaggtactcttgcgagctcttcgggaggcagacttcctgacggaggatgtgccactggactccgcacctcaggaacttgtggaccatctcaaagtgtacttgaaactacttttcttaaggaaataccgcaggttgaggaggcaagccgctaatgttgctgcccaagttgtctatgcgaattccttgaggctattgtga

SEQ ID NO: 200 - DNA, 3186 bp, Toxoplasma gondii
atgtattcctcccctcagtcagaagaggctagcctcgtgaacagtaggggcatccgagatgaaagtgggcctaatggattctctattggatctgcaacagacacggccctgaaggcaggctccccgacaggaaaaagctggaagcaactgagcctcaaccttgggcggcgcgtgtgggacgcactggatccaacatggtcttgcgctgagaagagacgccgcctggacccggagactttgaggaaactaaaatcaacgtactggctttcacggattgtttttctgcgcgcgttgggatttgtttatttcttcgcgtttcttatcgccttcaaccagtctcagggactcattgggtccgatggcattctcccagcatcggattacgtggcaatggtgaaggactcgtttgccgacgcagaggcgtggcaacgagtcaaagcatttccttcactttttctcctattccctgcaacggatttctggctgcatgccatcccttttgttggtatgatcctgtcgctgttcatgaccatacaaggtgccagcaacggtttccttctgttcctcctctggatcttgtaccagacggtgaacagtgtgggccaggcctggtttagcgtcgggtgggaggcgcagcttctcgagttggggtttctggccatctggatggcccccttctggagtttctcgcgtctccctccttcctggccgactcccaaaatctgcgtgtggggtaatcgctggcttgtctttcgcgttatgttgggttctggactcatcaagctccgcacagacagagcttggaaagatctgacagcgctcgactaccactatgagacgcagccgctgccgaacccattgtcctggtacttccaaaaccagtcgcacggcgttcatgcggcgcaagttgtgatcacacatattgtcgagtgcgtcatttctttcctggtcattcttccctttcgccagtgtcggctcttcgccggcatagtccaaatcgcgttccaggtcggcattctcctctcaggaaacctagccttcctgaactacttgacaatcgtgtcggcaatcatgtgcctcgacgatcactttctcacctgcctcttcccgtcggcaattctcagtcgcctcccggagcttgttcgcggatgtgcgggctattggtcgctccctcagatccaggcatggccattcccacaactgtttcctggcgaggagcacggaaagggcaaaggacgtcaggcgaacgacaggcccgaagctgaggcgtctttgctcgacaaagatgcaggcagagatgagactcttccttttaatgccgctacagacgacagtctggacagcccccgaagctgctgctgctggtatcgaccgtactttccccggattgtgcgttccctgaaaattccatctcgcgtgcggaaacaagtgaaggaggagatcaaagagaactgggggaaaatgcttgctgaggtggtggcatctgtggcaatgcttacatgcatggcgtttgtgaccaaccccgcgacttcggctgtttggatggttatcgccgtgtttttcctcgccatcatcctctcggcctcgtccacgtttttcacaaacactctcgtgtcaaatgcgttcacggaactcgtccttcttatcgtcaccctctggagctgcatcgccatataccagcacggcccggctgtctggtctgtttggctcaccacctgtctatttacggttctgattgcgttcgcgtacacgaccctgacgaacgcagcactcatattcaaaatccatgtcgaagtcctgatcttcctcctcatcgccgctctttccgtccccgtcgtcgcaaatctgatttcaccagaccaggttatggattcagatctcggaaatcccttttccgtggtcaacacacatggagccttcggatacattggcaaggaacggtacgaactcattattcaaggcaccaatgcgtcttcaccgacccagaccctgtattggcaaaattacgagttcaagtgcaaacctggagatctctatcggagaccctgctgggctgcgccctatcactaccgccttgattggctcatgtggctagcttctatgggtgacaaggagacagtaaaagatatgcatccctggctttccaatttcctctccagactgcttcagaactcgaaaagcgtgacaggactgttggcccataatcccttccagaactccgacccgccgactgcgcttcgagtccttcgcattcagtataggtttaccaaaggccccgtatttggaggaggaccttggtgggaggtcgtgcctgagaccagggagcttttcgttgccccgtctcaggtgcccggagctgctgcacacctcaggaaacaactgttgattcttcgcagacgagaagaaaaacagagactcgagcagagacgaaaagaagaagcagagataagaagaaaggaggaagaggccttcaaacgtcgtagagagagggccatgaaggaagaagaacgacgaaagcgcgaggcagaggaagccgagaaaaggaggatcgctgagcaagcgcgccaggctgaagacgagaaacgcatcagagagcaggcggaggcagccagaaaagctgaggaagaagcggtgaggaaacaaatagaagaagaaaagaaacgccacgaagaagaggagaaggaacgtcaagcagaagaagaaagagaacgccgagaacaacaggaagaagaagaaaaacgccgagccgaagacgagaagagacgcaaggaaaaggaacaggccacgttgctggcgaggcagcggtctgaagaggcgctaaaagaggcagagaagaaagctcgaaaggatgcggaagaagaagagcggaagcgaaaggaagatgctttacaggaagaaaagaggcaaaaagaagagaaagaagctgaggaaaaacggcgaaagcaggcagaggcacgcagggaagcagcgcgcgccgcggctgaaaaggagtctgagaaagcgagacagttgcaagagcaagaggcgaaaaggaaagcattggaggaacaagaaaggagaaaagctcgggaacggcagcgctctgctagcagtcaagtcgcggtatatacagctcaaccccacgacggcggaggagtgccactacggcatgctccgttgttgactaggaagaagcaagcgctgtag

SEQ ID NO: 201 - DNA, 1002 bp, Toxoplasma gondii
atgctgaaaacgacacctgcattcttcctcttcctaacgtggatgttccctagatgcgacggctttgtgttaacgcataagaacgggaccaccgacgcatacgattctgctgttctatcgttcttattaactacggaaggagttcgcgaaggggcggcgaagagctctggcacggagataccttcgacgttagcttgcccatcgtcgtcgccacttaagacggcaaaagacaaacatgatgcctctctacttgggctcgtatcctccgtaccggacagcagcatattgaaaccggaattcgtcggagccggagcggctttggtagctgtcaccaggagtgtaaagtggactcagctaaaacaaagtctgaaagccctggtagacacgggtgtcaaatgtaaggtgaactgcaaacacaacaataagaaactctccaaaaataccgatttcaaagaccaacaggagtttccacaaacgagtgcaaggatcttgcccacaagcgacagggagccgctcattgccggaccgcagaaagtcactgaagaagatttgcaagttcttctgttcgagatagcccacgactgcaaaatgtcagctcctcaggcggcaatcacgaagcctctgacgattctcctcgcgggtattccaggggcccacattagcaagaggcctttcgaggctgctattcctcacttcatcctacagaaagaagacactgtcgaccttttgctgactgtcgatagaagctggtgcgggaagggtctaagtcacctcgtaaggtaccatgtaggatatatgtcgttcaaccttgaggtaaacggccgacgacttgctgatgacgataccttcgaggacgacaggctataccgtcaagttgttttgacaacaaaatttacggccaagtccctcgggggtaccttaaaacaagttaggagcctgacagatatccataagaaaaccggtaaacatggagaaaaccgacctcatagctcacctttctag

SEQ ID NO: 202 - DNA, 2124 bp, Toxoplasma gondii
atgaaagtgaccacgaaagggcttgcttttgctcttgcactgttgttttgtacacgctgcgcaactgcacgatacatgtcgtttgaggaagcgcaaaaagcaagtgaagcagcgaagcgccagattgccacactcccctctccagattctactctttcgaatccaggtagcaagcatagaaaccggggagggtctcctgcggcagggcaaccttctcaatccacactacaacctgaacaagcggcggctgaagtaggtctcggtgctggtggctcgactcaggggcagggacgcaccggtggcagcgcgggtgctagagaggagcggaggagtccttccccccaatctgcttatccggcgactagctcagcctcgctaaggggctaccaaacccagctttcaccctcgcatcttccaccacgcagcagcggaccgggaggatggtttccaacagagtcaatatttacgccatggagttctccgccgcaaccattgacacaacgaaagccatctctatctggggtggtcgttaccgaatttcaagagccacaagaacagtatggcgcagcgagcagtcttgcgtcctcgccaaagcgatacgtcagtggcgcaagctcgagtgcattgtcaggaaaggcggtgccaacgcctgcgtcgcttggtcaagaaaatcctcttttccctgttcagagcgctacattggattcaggaatacagtctccggcacaagagcgtcggggatcccctcaaagacagattgcgatgtcgaccgaaaatccagcggatagcggcgcctcgcagcttgcctccagtgtttctagttatgtagcagtacaaactcctcatgtgaaacgttcagaacgcatccggcgcgttcgactttcagaagagggtctggaagaagttcagcagctgaaagcagctgccgcacagcttctcgtagcggttccggactatgaggcaatgcgggctgttctgcaagaggcggtcctctcagaacagagggttgctacccgtaagcggaagagaaagcaacctccaggagcggtggagtcagctgttgacgaagtgttccctccaaatgagcgtgtcatgatgataaatgccaacggagtgccgatcgctctatacaatcgtgggcacctcggcagtggacatttcggggctgtcatcaaggccagcttagacgatgggacgttgtatgcagcgaaggtgccgtacagccagatcgtcccgaatgctgatgccacgtcagcagaactggaggcggaaatttcctcagctagggcggagttggtaaagacaattcgacaggagttggatgttcgggataagctggtggctaaagggctcacacttacagagactgcggagcaatacggtctaccattgtgccaaatgactttaacgcttcctgagaacaaagcaaccgtggtacgtcgaggttctcgactcgttgtcgtgtctaaagaagtcatgctgctgccattaattgatggctccccatcgaacagtctagtccagtcgcaaccaccatttctcttccagcgagctgtggcaagggaagcaattattgcattggccaagcttcacgaacttggattcgcgcatggagatgttaaattgaacaacatgatgatcgatgtccacggctttgggcatatgcttgacatgggcagtgtgcggcctgttgacagctgtgtaagcgaggaagataaatattacctgcgtttgtgggctcctgaacttgcgaaatcacagcacacgtcgcagcagacatgtctgaagcgtggcgctctcgatgtgtgggccttagggttggcaatcttcgagttcgtctgcttcaaccgacttccttacagcctttcgaatctgccgagttcactctggtcgagagttgaacacctttcgcgccttcgcctctcagatttctctgccaaggattgtaacgaatctgatccagcagtgatgggaattgttgctcaatttctaaatccaaatcctgaagagcgccctgaactcccgaaattcgtcagcagttacaccttctttcggcaagcccctggagttacttctcatctcactaggattccaactaccgaactttcttcacatcggatgtag

SEQ ID NO: 203 - DNA, 1827 bp, Toxoplasma gondii
atggagttggtgttgtgctttgtgataataacgatctctggcgtcattcgcgagagctctgcccttcttttacggtcaccaacgagcaatgatgtgtttggagagttggtggcgtcggcggaacgtgcccagcctctggcgacccgccttacaaaacgcatatcaaggttgaacttcaacgaccgcgaggacgacttctgggaagaccatggagacgcttcctggaacaattcctatacgttggtgaacggcaggacaacactaggtagcgagaaccgacgaagacctgccagtcattctctgatcgaaagaccctattaccgtgatgggaggttgtcacccgttttaggtgttcaggaacgtagggggcgcagtgttcattcgtatcatgaagaaccagtttcctttttcgatcagcgtgcttttgatgagtataccttcagaagaagatcacagcttcatagacaacgggcacgggccggactgcgctcaagaataaaacagaatgtgagacgactctggagatcggccagaggcgccgtgggcgggtggggtaggcgagtacgacgaaaaatcggggatttgttcgttgggcacttgatgccccagctgcggaggctacggttttgggaccagggcctcccaccggtagttccgcctttgataggcaacgagccggggcaggcttctgtcgcactggtggcggagcgcatggaagctggccttcgcgagaaagcactcacggagaaaaaccccactgaagcccaacaagcggtcgggacatacctgataaactccgccgaaaatacgtggtttatcagtagtccgggtggccgatacatcttgttaaaaaaacgtggcttccttggtggtggcggctttggtcttgtgtaccatgttgaacatcccaccacagggcaaccattcgcgctgaagatatttgttcaacgggtgatgaacaatgaggtaggggataaaatatctgacctgatcgaggatgaatttggagtcatgaagtacttcccccccgaatggacgcctgcgcgcatgtactcggaactccggtttatggtgccacttctaaagctcagagttttaggaaagcccgaattccaggatgtgcggaaccatttgcgtatatacagtgtttgcgccctatttccgaaggcgcaaggagacttagaagaagctgttgttttacttgcagacatggacagaacaaacgcttacaacattcgtatgagctgtacgattcaaatggtcaaactacttgcaagattccacgcgtttgaacttgttcatggcgatgtgaaactgcaaaattttcttgttgataaatcgggattgcttctactttctgacttcactcaaattcttcgtacgaatgagagacgctatccacctgtggtaacagtgatttacatgtctccagaaatagcgacctgtatgatcactcgcttgcggaatgctattccatacacgcctcagatagactcgtggatgctaggaatatccttgtatcgtttgtggtgtggtaacttccccttcggaatgactctggacgccaccgcactgcaggtggctggaattgtaatcaggtcttctgcgtcgtctcttgacttcgccagttgccacgacattccagaacagttccgcgagatgatagtgggatttctacgcaaaacacctggtgttcgactatctccacaacaggcgctggagcagttctcgttactcaactggaaaggaccatccccggcatcggatacggcttccgaaagtgaaccagtcagtaccgaggaggcggctttattacagaaggagtaa

SEQ ID NO: 204 - DNA, 1665 bp, Toxoplasma gondii
atgttttcggtacagcggccacctcttacgcgtaccgtcgtccgaatgggtttagcgactcttctcccgaagacagcctgtcttgcggtgttaaatgtagcgcttgtcttcctgctcttccaagtccaggatgggaccggaatcacacttgatccttcaaaactcgactccaaaccgacaagtttggattcgcaacagcacgttgctgacaagcggtggcctgctacagttggccactacaaatatttagcaggagcgacagaaagcactcgagacgtttcattgctggaggaaagggctcaacaccgggtaaatgcgcaagaaacaaaccaacggcgcacgatttttcagaggcttctgaatctcttgagacggagagaaagagatggtgaagtctcgggttccgcagctgatagctcctcgagaccccgtctgtccgtacgacagaggcttgctcaactttggcgtaaagcgaaatcgttcttcacacgcggaatcccgaggtacttttctcaagggcgtaaccgactgcgaagtttgcgggcacaaagacggcgatctgaattgttttttgagaaggcggattctggatgcgtcatcggcaaacgcatcctggcgcacatgcaagaacaaatcgggcagcctcaagcgctaggaaatagtgaacgactggatagaattctgactgtcgctgcctggcctccggacgttccagaaagatttgtttctgtgactaccggtgaaacccggacgctggtgagaggtgcaccccttggctctggtggattcgccactgtatatgaggctacagacgtggagacgaatgaagagttggctgttaaggttttcatgtcagaaaaggagcccaccgatgagactatgcgtgacttgcagagggagtcgttctgctacaggaactttagtctagccaagacggcgaaggatgcccaggaacgctgtagattcatggttcctagtgatgttgtgatgttagagggacagccagcatccacagaggtcgtgattggtttgacgactcggtgggtaccaaactattttcttctcatgatgcgggcagaaacggacatgagcaaagtcatttcatgggtatttggagatgcgtctgtcaataacagtgaattaggcctggtcgttcgaatgtacctatccagtcaggcaatcagactagtggccaatgttcaagctcagggaattgtgcatacggatatcaaaccggcgaatttcctcctcttgaaagacggtcgcctgtttctcggcgacttcggaacgtatagaatcaataattcggttggacccgcgataggtactcccggttacgagcctccggagcgaccgtttcagactacagacatcacctatacattcaccactgacgcgtggcaactcggtataactttgtactgcatctggtgcaaggaacgtccaactccggccgacggcatctgggactacttacacttcgcagattgtccttccacgcctgagctggttcaagacctcatccgaaacctcttgaatcgagagcctcagaaacggatgctcccgctacaagccttggagaccgcagcgtttaacgagatggattcagtagtaaaacgcgccgcgcaaaacttcgaacagcaggaacatctccacacagaataa

SEQ ID NO: 205 - DNA, 1300 bp, Toxoplasma gondii
atggaaaactgtgcgtcggtcagatcatcgtcgtgtcttatctggctagctgccgcattctttgtttcggcacttggccacgtacagcaaggcgctggcgttgtgcggcctcgccactggcagaactcggaagccgctgttagtgtccggccgccgggaggcgcgtcccctagacctttccacagcccaattgagccagtagcatttattgatggggagcacgttgaagacaagcatggaggctcatggctggagcaggaagcggccgaggaagtgacccccttattgaacagccacacagagaccccgacacagtcccccagtgcttttagaaggttactcaggcgtttgcgtttttggcgacgtgggaggacaggcggatcagatggcggaggagaaccaccgcagacgcctcgcccttccctaccgacccgactgtttcagcatttgcggcgtgcggcagcagcaattcccgcggcggcatctagattctttgggagatttcgacgaggccgactacctgtattccctcccgacgagtttccggaggatgtcgacacgaaccctatttatttccgtggtacggatcctggagacgttgtcattgaggagctgttcaatcgtataccgcaagcaaacgtacggactacaagtgaatacatgcagtccgcagctgacagtctagtgtccacatcgttgtggaatactggacagcccttccgcgtagagtcggagcttggcgagcgtccaaggacgctagtcaggggcacagtgctcggccaggaagacccttatgcatatctcgaggcgaccgaccaggagacaggagaatcatttgaggtgcacgttccatatttcacggaacggccgccttccaacgcgatcaagcagatgaaggaggaggtgctgcgcctacgcttgctacgaggcatcaaaaaccagaagcaagccaaggtgcatctcagatttatattccccttcgatttggtgaaggacccacagaaaaagaagatgatccgggttcgcttagatgagagggatatgtgggtcttgagcagattctttctgtatccccgaatgcagagtaaccttcagacgtttggagaagtcctactgagtcattcctcaacacacaagtccctcgtgcaccacgctcggttgcagctcacgcttcaggtcataaggctgcttgcgagtctccatcactatggccttgtgcatacctatttgaggcccgtcgacatcgtcttggaccagcgtggtggcgtgtttttgaccggctttgaacatctggtgcgag

SEQ ID NO: 206 - DNA, 1149 bp, Toxoplasma gondii
  misc_feature (380)..(380): n is a, c, g, or t
atggggcaccctacctctttcggacagccgtcgtgtcttgtctggctagctgcggcattccttgttctggggctttgcctcgtccagcaaggcgctggcagacagcggcctcaccagtggaagagctcggaagccgctttgagtgtcagtccggcaggagacatcgtggacaagtattctcgtgattccactgagggagaaaacactgtctcagagggggaagctgagggcagtcgggggggttcatggctggagcaggagggggttgaattaaggtcgccttcacaggacagccagacaggaacctcgaccgcgtcccccacaggcttcagaaggttactcaagcgtttgcgtttttggcgtcgggggagtacacgcgntaacaggtatctaagatttctggccccgttcgatttggtgacgatcccggggaagccattagttcagaaagctaagtcacgtaatgaggttggctgggtcaaaaatctgttgtttctgcttcctccaactcatgtcgatatggaaacgtttgtcgacgagattggtcgatttccacaagaggaccgccccctagctgatgccgctcgattgtatcttactgttcaggcggtgaggttggtagcgcacctccaagacgaaggagtggtgcacgggaagataatgcctgattcgttttgtttgaagcgtgaggggggcctgtacttgcgtgactttggctctctggtgagagcgggcgcaaaagtggtggtgcccgcggaatatgatgagtatacgccgccagaaggtcgtgcggccgcccgaagtcgtttcggctctggggcgaccacgatgacgtacgcattcgacgcctggacactgggttcggttatatttttaatttggtgctctcgagctcccgatacaaaatcggggtacgaatacagtgtcgaattctttttttcgaggtgccggcgggtgccagagaacgtgaaacttctggtttacaagttgattaacccttctgtcgaggcccgcctgctcgccttgcaagcgatagagactccggaatacagggagatggaagaacagctgtccgctgcttcgcgcctgtactcaggtgatgggacgttgacagggggagacgatgacatgccaccactggaaacgtga

SEQ ID NO: 207 - DNA, 1386 bp, Toxoplasma gondii
atgagcggcggcagagttccccgagtgccagcatcgtctaccaccacatctgcgtccgaggggattttcagaagattagttcgcagacttcgtcggggaagaggaaccgcagatggcgcaggagttgctgacgaaacccatcaggagccgcgcccgccacttcggaagagacttgctcagcacttccgtaggctgaggggcttcttcggacgccttacgccgaggtggctctccggtctcggccgccgggcgcaaagatggtggagagggagacagagaccgctgctggacccttcgtttcatgggttggaagctggagattcgttcatgcgcgacctgctgaaacgtgaaaaagagctgattggatactgtcgcgaagaagcgttgaaagaacctgcagcgatggttgaggctgtcacggcaactgtatggccgcaaaatgctgaaacaaccgtggattcacttttgagtcagggagagcggaagttgaaattggtgcagcctcttcgagtcggtgaccgatctgtcgtatttttagtaagggatgtagagcgcctggagtatttcgctctgaaggtcttcactatgggtgccgagaattcccgatcagagctggagcggttgcatgaagcgacttttgcggcagcgaggttgcttggggagagtccagaggaggcacgggacagacgcaggcttttacttccctccgatgttgtggcagttcagtctcagccccctttcgctcagctgagtccaggacagagcgactatgcagtcgcgaactatttgcttctcatgcccgctgcgtcggggggagaaggtattttagcgcgtcacatactaacggcacagctgatccgtctggcagccaacctgcagagcaaaggacttgtgcatggacgcttcacaccggataacctttttcttatgccgtatggccccgtgatgctgggggatgtatccgcattgtggaaggtcggaacccgaggaccggcatcaagcgtcccggttacctatgcgcctcgggagttcttgaatgcaaacacggcaacatttacacacgcgctcaatgcgtggcaactgggtcttagcatataccgggtttggtgcctattcttgcctttcggactcgtgacacctgggatcaaagggtcatggaaaaggccaagtctactagttccagggactgacagtctgtcattcttcccatgtgcacctgtgcctgacttcgtggagacactgattagacggttcctcaacttcgataggcggcgacgcctgcttcccttggaggccatggagacgccagagttcctccagctccaaaacgaaatatcgaggcgcctatcaacaggacaacctactgctgcgccctcagtcgcttga

SEQ ID NO: 208 - DNA, 1650 bp, Toxoplasma gondii
atggcgacgaagctcgctagactagccacgtggcttgtcttggtaggttgcctgttgtggcgggcaggggcagttcagctctctccgccaaactccaggacgaatgatctggcttcgggaaccccgcatgtggctcgtggggacactgaggcgcagtcaggaactggagacgattcagattttccgcaggccgtggccgaagaggtggcagatatgagcggcggcagagttccccgagtgccagcatcgtctaccaccacatctgcgtccgaggggattttcagaagattagttcgcagacttcgtcggggaagaggaaccgcagatggcgcaggagttgctgacgaaacccatcaggagccgcgcccgccacttcggaagagacttgctcagcacttccgtaggctgaggggcttcttcggacgccttacgccgaggtggctctccggtctcggccgccgggcgcaaagatggtggagagggagacagagaccgctgctggacccttcgtttcatgggttggaagctggagattcgttcatgcgcgacctgctgaaacgtgaaaaagagctgattggatactgtcgcgaagaagcgttgaaagaacctgcagcgatggttgaggctgtcacggcaactgtatggccgcaaaatgctgaaacaaccgtggattcacttttgagtcagggagagcggaagttgaaattggtgcagcctcttcgagtcggtgaccgatctgtcgtatttttagtaagggatgtagagcgcctggagtatttcgctctgaaggtcttcactatgggtgccgagaattcccgatcagagctggagcggttgcatgaagcgacttttgcggcagcgaggttgcttggggagagtccagaggaggcacgggacagacgcaggcttttacttccctccgatgttgtggcagttcagtctcagccccctttcgctcagctgagtccaggacagagcgactatgcagtcgcgaactatttgcttctcatgcccgctgcgtcggtggatcttgaattgctctttagcacattgaacttcgtgtatgtattcagggggggagaaggtattttagcgcgtcacatactaacggcacagctgatccgtctggcagccaacctgcagagcaaaggacttgtgcatggacgcttcacaccggataacctttttcttatgccgtatggccccgtgatgctgggggatgtatccgcattgtggaaggtcggaacccgaggaccggcatcaagcgtcccggttacctatgcgcctcgggagttcttgaatgcaaacacggcaacatttacacacgcgctcaatgcgtggcaactgggtcttagcatataccgggtttggtgcctagtcttgcctttcggactcgtgacacctgggatcaaagggtcatggaaaaggccaagtctactagttccagggactgacagtctgtcattcttcccatgtgcacctgtgcctgacttcgtggagacactgattagacggttcctcaacttcgataggcggcgacgcctgcttcccttggaggccatggagacgccagagttcctccagctccaaaacgaaatatcgaggcgcctatcaacaggacaacctactgctgcgccctcagtcgcttga

SEQ ID NO: 209 - DNA, 1650 bp, Toxoplasma gondii
atggcgacgaagctcgctagactagccacgtggcttgtcttggtaggttgcctgttgtggcgggcgggggcagttcagctctctccgccaaactccaggacgaatgatctggcttcgggaaccccgcatgtggctcgtggggacactgaggcgcagtcaggaactggagacgattcagatttcccgcagggcgtggtcgaagaggtggcagatatgagcggcggcagagttccccgagtgccagcatcgtctaccaccacatctgcgtccgaggggattttcagaagattagttcgcagacttcgtcggggaagaggaaccgcagatggcgcaggagttgctgacgaaacccatcaggggccgcgcccgccacttcggaagagacttgctcagcacttccgtaggctgaggggcttcttcggacgccttacgccgaggtggctctccggtctcggccgccgggcgcaaagatggtggagagggagacagagaccgctgctggacccttcgtttcatgggttggaagctggagattcgttcatgcgcgacctgctgaaacgtgaagaagagctgattggatactgtcgcgaagaagcgttgaaagaacctgcagcgatggttgaggctgtcatggcaactgtatggccgcaaaatgctgaaacaaccgtggattcacttttgagtcagggagagcggaagttgaaattggtggagcctcttcgagtcggtgaccgatctgtcgtatttttagtaagggatgtagagcgcctggaggatttcgctctgaaggtcttcactatgggtgccgagaattcccgatcagagctggagcggttgcatgaagcgacttttgcggcagcgaggttgcttggggagagtccagaggaggcacgggacagacgcaggcttttacttccctccgatgctgtggcagttcagtctcagccccctttcgctcagctgagtccaggacagagcgactatgcagtcgcgaactatttctttctcatgcccgctgcgtcggtggatcttgaattgctctttaggacattggacttcgtgtatgtattcaggggggaagaaggtattttagcgcgtcacttactaacggcacagctgatccgtctggcagccaacctgcagagcaaaggacttgtgcatggacgcttcacacctgaaaaccttttcattatgcccgatggccgcctgatgatgggggatgtatccacgttgaggaaggtcggaacccgaggaccggcatcaagcgtcccggttacctatgcgcctcgggagttcttgaatgcaaacacggcaacatttacacacgcgctcaatgcgtggcaactgggtcttagcatataccgggtttggtgcctagtcttgcctttcggactcgtgacacctgggatcaaacggacatggaaaaggccaagtctacgagttccagggactgacagtctgctattcgactcatgtatacctgtgcctgacttcgtgcagacacttactagacggttcctcaacttcgataggcggcgacgcctgcttcccttggaggccatggagacgccagagttcctccagctccaaaacgaaatatcgagcagcctatcaacaggacaacctactgctgcgccctcagtcgcttga

SEQ ID NO: 210 - DNA, 1443 bp, Toxoplasma gondii
atgaggagctcagtagggcagtctcgtctgccgctcaagtttttccttgcgccgttctcggtgaaaaattcggttttcgccctctttttcgtgttcgctcttgtctgcgtctccggtctgtcttgggaagatgctgaggacggcgcagcgtgggactcagtctcgaacgattcggacgacagcttcgcgaaagggtctgacttcggggaagtcaagttgggcagcgcaggccaacggcagctcctcagtcagctccagaacgagttgggcggtgaattcgaggacgcagacgtgagtatgctccagagggatcacggaatccacggagaggaagccggtttgttccgcaaggctgttccgggcttggacgacccagctgaagacgatgaagccgacggcgaaagtgcctcggatgaggcagaagccgactctgacgtcttggcggacgacgaagaagggacatccctcatcgaaaatgcgagtgaggaagacacagacaactccgaggcagacagtcaacaggaggatgacagtgtgggagaggattcctttctccagcaggagggcgaggactccgaggaagaaagagcagtcgaggacccgtatgctgccgccgaaccctcttatcttgaagaggacaacactgttgacgacagcgcggcggaggattatgcccctgcttcgtttgtccagatcggcagtggagagagaaaaatccgggcgcacatgcatcttgacagccgccaagttgcccccgaaagattcgcgcatgcgttcaaccaggatcatgtcagacttctggaccagaccgccgtcgaggacgaacttctcgatgaggccgccccgggcggaggcgcgagcgccgtagtctcccccatcgacgaaaaccctgcagagatggaaagcaccatctccgagggcgaagcaggttctgcggtggcggctcctgaacaaggtatccagccagaggcagaatttgctaccgccagcgaagaaccacgtcccctggaacctgtcgaccccgaaatggcagctcagcagccgcaactgcctcaagaagctatgccaactgagaatgcggaccttcttggaaaccagcccagaatgcgcaatgctctcgaaccctctgccaaggtcctcgaaccggaaaccctggaagggtcacctgctctcgtcccgccggcagagactgaagaggggacagccgcccaaattgcggaggaaatgagcaagcaggatcagggcatgcaggaagccaggcctcaagaagttctcacacgacacacctggcaagatatggagagaactgaggacctacgaaagaacgacgtcccggctgcagtggcgaattccggcagccagatcatcacggctgcgtcgtccgtcgcccttgctggtctactggtcgcaggacagcttttgttcagcgtgggcatgtactga

SEQ ID NO: 211 - DNA, 274 bp, Toxoplasma gondii
atggggcaccctacctctttcggacagccgtcgtgtcttgtctggctagctgcggcattccttgttctggggctttgcctcgtccagcaaggcgctggcatacagcggcctcaccagtggaagagctcggaagccgctttgagtgtcagtccggcgggagacatcgtggacaagtattctcatgattccactgaaggagagaacactgtctcagagggggaagctgagggcagtcgggggggttcatggctggagcaggagggggttgaattaa

SEQ ID NO: 212 - DNA, 1728 bp, Toxoplasma gondii
atggggcaccctacctctttcggacagccgtcgtgtcttgtctggctagctgcggcattccttgttctggggctttgcctcgtccagcaaggcgctggcatacagcggcctcaccagtggaagagctcggaagccgctttgagtgtcagtccggcgggagacatcgtggacaagtattctcatgattccactgaaggagagaacactgtctcagagggggaagctgagggcagtcgggggggttcatggctggagcaggagggggttgaattaaggccgcctttactggacagccagacaggaacctcgaccgcgtcccccacaggcttcagaaggttcctcaggcatttgcgtttttggcgtcgtgggagtacacgcggatccgatgatgcagcagaagtttccaggaggactcgggttccgctgcatacccgtctgcttcagcatttgcggcgggttggaagatttttccgacatggcattccagcggcagctggcagatttttcaggcgagtttggccggagcgtccacaacccgttttcactgaaggtgatcctccggatctcgagacgaattccttgtattatcgtgacaaggttccaggagaggtgataatccgggaggttcttggcaaggtggcggggttcggaccaacgtccgggcatggtgtgtttgccgcatatgaaaacgcattctcggaaatgctgtgggcggaaggtggggctgtcacagtgatttctgaattgggccggcccgggagacagctcgtcaggggtaacctaatcaacattgttgatggaggattgctgtttcaagcgacagaccaagcgacaggagaaccgatgactgtactggttggcagtacttggaacaaaccgtctgggaaggacttagataagctgcggcaccaagcactagctattgggttgtttcaaaaggtgaagaacccatatctagctaacaggtatctaagatttctggccccgttcgatttggtgacgatcccggggaagccattagttcagaaagctaagtcacataatgaggttggctgggtcataaatctgttgttactgcttcctgcaattgagatcgatatgggaaggtttgtcgaggagctgtacgagcttccaacagaggaccgccccctagctgatgccgctcgattgtatcttactgttcaggcggtgaggctggtagctcacctccaagacgaaggagtggtgcacgggaagatattgcctgattcgttttgtttgaagcgtgaggggggcctgtacttgcgtgactttggctctctggtgagagcgggcacaaaagtggtggctgaaaatgctcaaggcttttcgccgccggaagttcgtggatcccgcggaggacttctttttggtccacgcaagacccagatgacacacggaatggatgcgtgggggttgggagcgactatattttttatttggtgctttaaagctccaactacaggacctgaagaggaatactccatcgaattcttgttctcattgtgccggcgggcaccagagaacgtgaaactcctggtttacaagttgattaacccttctgtcgaggcccgcctgctcgccttgcaagcgacggagactccggaatacagggagatggaagaacagctgtccgctgcttcgcgcctgtactcaggtgatgggacgttgacagggggagacgatgacatgccaccaccggaaacgtga

SEQ ID NO: 213 - DNA, 1764 bp, Toxoplasma gondii
atgccaaagattctcgcgagaactgtggatgcccttgtcacatgtgaacggttgttttgtgtgttacacatctgcaacatggaaaactgtgcgtcggtcagatcatcgtcgtgtcttatctggctagctgccgcattctttgtttcggcacttggccacgtacagcaaggcgctggcgttgtgcggcctcgccactggcagaactcggaagccgctgttagtgtccggccgccgggaggcgcgtcccctagacatttccacagcccaattgagccagtagcatttattgatggggagcacgttgaagacaagcatggaggctcatggctggagcaggaagcggccgaggaagtgacccccttactgaacagccacacagagaccccgacacagtcccccagtgcttttagaaggttactcaggcgtttgcgtttttggcgacgtgggaggacaggcggatcagatggcggaggagaaccaccgcagacgcctcgcccttccctaccgacccgactgtttcagcatttgcggcgtgcggcagcagcaattcccgcggcggcatctagattctttaggagatttcgacgagtccaagaacctgtattccctcccgacgagtttccggaggatgtcgacacgaaccctatgtatttccgcggtacggatcctggagacgtcgtcattgaggagctgttcaatcgtataccggaaacaagcgtatggaatgagaacgaacgcgtcctgtcgaacgccaaccatctagtgtccacagcattgtggcgtaatgagcagagcttccgcgtggagtcggagctgggcgagcgtccaaggacgctagtcagaggcccagtgctccgcgacgacggctcgtatatctgtctcgaggcgaccgaccaggagacaggagaaccacttgaggtgcacgttccatatttcacggaacggccgccttccaacgcgatcaagcagttgagcgagcaggtgctgcgcctacgcttgctacgaggcatcaaaaaccagaggcaagccaaggcgtatctcagatttatattccccatcgatttggtgaaggacccaaagaaaaggaagatgatccgggttcgcttagatgagagggatatgtgggtcttgagcagattctttctgtatccccgaatgcagagtaaccttcatattcttggagacgtcctactgagtcattcctcaacacacaagtccctcgtgcaccacgctcggttgcagctcacgcttcagctcataaggttggccgcgagtctccagcactatggccttgtgcatgccgattttcaagtcaggaatatcctgttagaccagcgtggtggcgtgtttttgaccggctttgaacatctggtgcgagacggcgccagtgcggtgtcgcccatcggtcgaggatttgccccgccggagactacagcggaacgaatgctcccctaccgccagcaccacccaacgctgatgacatttccgtttgatacatggacattggggttggcgatctactggatttggtgcgccgatttgcccaataccgaggacgcggagctaggcggaattgaatggatctatcgacgctgcaagaatatcccacagccagtcagagctttgcttgagggattcttgcgatactcgaaagaggatcggctcctcccattgcaagccatggagacttctgagtacgagcaactgcgcacagagctatcagccgttttgcccctgtatcaaactgatggagaaccggcatga

SEQ ID NO: 214 - DNA, 1728 bp, Toxoplasma gondii
atgttttctgtgttacgtaaccgcaacatgagacacggtccctcgattggatcgtcatcatgtcttatctggctagctgccgcattctttgtttcggcacttggccacgtacagcaaggcgctggcgttgtgcggcctcgccactggcagaactcggaagccgctgttagtgtccggtcgccgggaggcgcgtcccctagacctttccacagcccaattgagccagtagcatttattgatggggagcacgatgaagacaagcatgaaggctcatggttggagcaggaagcggccgaggatgtgacccctttaccggacagccacacagaggcccagacacagtcccccagtgcttttagaaggttaaccaggcgtttgcgtttttggcgacgtggggtgacaggcggatcagatgctggagaagaggcgcctcagacgcctcgaccttcactacgtacacgaatacttcagtacttgcggcgtgtgggaacatttttcagacgagacattccagcggcagcacttcgattcttcaggcgctttcgacgagtccgccaacctgtattccctcccgacgagtttccggaggatgtcgacacgaaccctatttatttccgtggtacggatcctggagacgttgtcattgaggagctgttcaatcgtataccgcaagcaaacgtacggactacaagtgaatacatgcagtccgcagctgacagtctagtgtccacatcgttgtggaatactggacagcccttccgcgtagagtcggagcttggcgagcgtccaaggacgctagtcaggggcacagtgctcggccaggaagacccttatgcatatctcgaggcgaccgaccaggagacaggagaatcatttgaggtgcacgttccatatttcacggaacggccgccttccaacgcgatcaagcagatgaaggaggaggtgctgcgcctacgcttgctacgaggcatcaaaaaccagaagcaagccaaggtgcatctcagatttatattccccttcgatttggtgaaggacccacagaaaaagaagatgatccgggttcgcttagatgagagggatatgtgggtcttgagcagattctttctgtatccccgaatgcagagtaaccttcagacgtttggagaagtcctactgagtcattcctcaacacacaagtccctcgtgcaccacgctcggttgcagctcacgcttcaggtcataaggctgcttgcgagtctccatcactatggccttgtgcatacctatttgaggcccgtcgacatcgtcttggaccagcgtggtggcgtgtttttgaccggctttgaacatctggtgcgagacggtgccagggtggtgtcgtccgtcagtcgaggattcgaaccgccggagcttgaagccagacgagcaaccatatcttaccacagggaccgcaggacgctgatgacattttcgtttgatgcatgggcattggggttggtgatctactggatttggtgcgccgatttgcccattaccaaggacgcggcgctaggcggaagtgaatggatctttcgaagctgcaagaatatcccacagccagtcagagctttgcttgagggattcttgcgatacccgaaagaggatcggctcctcccattgcaagccatggaaactcctgagtacgagcaactgcgcacagagctatcagccgttttgcccctgtatcaaactgatggagaaccggcatga

SEQ ID NO: 215 - DNA, 1062 bp, Toxoplasma gondii
atgacgcacccaaatccccttcaaacacgtttttcgcgcagtgcttccctcgtttctcggatgccgctggttcggctcttcttcaccatcgccgcgccacttctcttctccccctccccctgtccgtttctgcctctcaaaacgcactgcctcgcaattcagctgggaaaaccccaaggatcgccgccggcgtcacaaaaagaagcaattagggacacgggggtttctcaccagaaaggggaaccgtcggatagctcatctgaacctaaaccgcaaggcaccgtcgcggagacgcccggagcagcgtctgccgcagcagcggaagttggtcgaccttctcggtcctccgctgggccggggaagaagaagagaggtccatccttgttcaccgaggaaacgatgggaccgtccaagagacatccttgcttaaagaccctggctgcagctgtcgagcgctttcaggcacagcacctcactggcagggacgcagctaaagcgtttgttgacgccatccaagaatgcggcattcaagtagtcgccagcgactacgacagaaccgccatttcggttcactcgggtggcagtgcgcgacgcgacgatctttccgtgcttggggctttgactcctgacttcaagttgcttggagaagaacttacaagacgaaatatcccaatttactttgtcaccttttctgataagggggagaatcgcggtgacaggatagcggcgggacccctcgtcgaggctacgctgaaagccagtaatgcgaatttcgaagcccagggtgtctttggctactacccaccgttttactcggaacccgaggactatgcgccacttggtctgtccgcgcctatgccgaccgacaaatcgttccatatccagcaggtctccaaggcttcaggggtgcctgaagataaaattcttcttctggatgacgatagggccaactgcgtgaacttctgcaggagtggtggtgcagcaattcatgtctctggccatgaaggctttgatttcggtgctgttcgcgttgtggtcaagccctcgttgatcatgcagtga

SEQ ID NO: 216 - DNA, 309 bp, Toxoplasma gondii
atggggcaccctacctctttcggacagccgtcgtgtcttgtctggctagctgcggcattccttgttctggggctttgcctcgtccagcaaggcgctggcatacagcggcctcaccagtggaagagctcggaagccgctttgagtgtcagtccggcgggagacatcgtggacaagtattctcatgattccactgaaggagagaacactgtctcagagggggaagctgagggcagtcgggggggttcatggctggagcaggagggggttgaattaacgtcgcgtttactggacagccaggcaggatcgtag

SEQ ID NO: 217 - DNA, 3033 bp, Toxoplasma gondii
atgaaaccaccgcgagagacaagcaggggtggaatggagggaaaggtggggtttggggcctcaattcgtgaccgttggttttttcagaacttttctgatggtctatccaacggggaaaagtcctggtggcgtcgaagcgtcgtccattttcttcagatggcagaccctacgtggtcctgcagagaaactcggcgcgctttggagccaggaatgctggagaaaatgaagtctacgtattggctcaccagaatcgtttttatcagagcgctgtccttcgtgtacttcgtcgcctttctagtcgcgttcaatcaggcgcaagggcttattggctccgatggcattctgccagcacagacccacgccgactccatcagggaagtcttggcggaggaagacacctggacaaaaatcaaggccttcccgtctctgtttctcttcctcccggccaatgacttttggatacactgtctcccatttctaggtatcctcgtctctttggtgacaggcgtactcggcgggagcaacgggttcgtgatgctgtttctctggatactttaccagagcgtgaacagcatcggccaagagtggtatgccttcggctgggaaagcgagctccttgagatcggcttcctctccatttggctatgcccattctggagtttctcccgccttcctgcctcatggcccacgccgaaaatctgcgtgtggggaaaccgctggctgctttttcggctcatgctgggcgcggggctgattaaactccgcaacgacaacctatggacggacctaacggctcttgactaccactacgaaacgatgccgatccctaatcccttttcgtggtacatgcacaatcagtcccatactgctcacgcttttcaagtgattgtgaaccacgtcgttgagtgcgttttccccttcctcctcctcattccttttcgccagtgccgccttgtcggtggcgtcacacaaatcctttttcagggagcgattattttctcaggaaatttctcgttcctgaaccacctctcgatactgccggctctcatgaccttagatgacaacttcgtctcttgtctcttcccttccaaaacactggagaggcttcagcctctccttcagggatgcttaggagcttggtcgctgcctaagcaccaggcctggcctgtcgattcatgttcagaacacacgaatgaacaccaaggagtgggttctgtcaaggacccagaggctgctgcgctcctcaacgatggagggagtcagctggagtggtctgtggacactgatgatgattcaaaccaagcctccgcgcgcacctgctgctgctggtattctccgaggatactgcaattcttccgctcgattccacggaccattttcccttcccgtgcaagaaatcgaatgaagcgagatatggaggaatcttggaagagcatgttgctcgaactagttgtgtccatcggagtacttgtgttgatggccgtcgcgacgagctctgaatctccgtctctgttgagtgtccttgccataattttcttgtgtcttgctcttgcgacgtcgtctcatttctatacgaaaactgccacatccaatgtatttaccgagttagttcttctggtcgtttctctgtggagtgctgtttcgctatacaagtacggccccttgccgtcgtgcctctggctcacgatcgttcttttcaccattcttcttgcattttcttacaagactatttccaatgcggttttagtctataaaattcacgtcgaattactcctacttctcctcatcatcagcttgtctgtgccagtggtagcaaacctcctctctcccaaccagctcatgaacgccagcatggcaaatcccttcgacatcttgaatacatatggggcgttcggcactgtcacaacggagcggtgggagctcattgtacaaggaaccgacgatccaacacccgacgagaacagcacctggataaactacgaattcaaatgcaagcctggtgatgtcaaccgccgcccgtgcctcatctcgccttaccactatcgcctagattggctgatgtggtttgtgcccatggacattcctgagatagttggcgtccggcatccatggttcccacgttttctcggcaagctgcttcaaaattcgccaagtgttactgggcttttagcggacaacccattcaaaaataaagatcctcctacagctgtccgagtgcttaagacgctgtaccggttcaccaagaggcccttttggggttctggcccgtggtgggaaattgtgccgaacacgacaagtgtgttcgttgctccgggcgatgtccctgacgccgatcagcatttggaacaaatgattgtgttaaaaagggtacaagagcagaaggcccaagaagagctacttaggaaggagctcaaagaggagcagaggaaggctcgggagagagccgaggcagagaagatggtggcagaagaagaacgaaagaaattactggagcagcgaactcaggaagagttggagacgaagaggcgtatccaagaagagaaggagctgcgtgagaagcaggcagaagaaatgaggaaacaagaggaagaacagcggaaaaaacaggaggcggaagagaaggcgagggcagcagctgaagaggcgcggaagaggaaggaggtagaaattgcccgtgcccaagaagaacaggaagcggagcgacaacgcgaggctgcagaagaagagaagagaaaaaaagaggctcagaggacggctgaggaagaagcagcgaagctgcgtaaagaggaggcacgtaaacgtgacgaagaagctgctaagcttgcggaacagagagagtccctgcgacgtaaagaacaaaaggagaaacaagcaatgcttgcaaagaagagagcagaagctgctgaaaaagaacaagagaggaattcacaactctctgaccagagcagagcttctgcagatggaggcgtccctctccgagcggccgccctgttcaaccgcaagaaagcagcaattttcagactgaatcagtaa

SEQ ID NO: 218 - DNA, 3192 bp, Toxoplasma gondii
atgttgcgccacttcggtggcgggttcatgccttggcgtcacctagacatcagctcgcttcactgggtggacagcgccaggttcggcagtcattgtaagcgttacaaccaggagtcagcgacagagcgtctgcgcgaaggagatgcatggaacccatcaaccgtgcttgccgtgaacccctccgtttcaacaatgagtaacggggccgtggccgactctgctggtgattcggggcagcagacaccggaggaaaccagaggctccagagacactttcgtttttgggccgttcaaagaatggttgaaacaccactgcagtctctcaaaaaaggaccatgccctaactgccgaggatctgaaggttatggaaggcacgtactggctggctcgcattgttttcttccgcactttgggattcgtgtacttcacggctttccttatcgcccacatgcagggaccgggcctcttcggacaggatggtttgctccgcctcgaggatacgcctccgtgcaagagcagtggccaagacagccgagagttgtggacacgcttcgctgctgagccgtctctcttccacttcttcagctgcacggacgcatccctcctgttcatcacgtccagcggtctggttctttcagccgtgctcatcctcactggaggcgtcactgtgccagtgctcttgtggctgtggctgtcgtacatgacgattcaggcagccggtcagaggttctacactttcacctgggacactctgctgctggaggtcggcttctgggcgatgcctttgacgctggtctgcttcttgcgccctttcttgccactgacgagcgctccttcaccctctaatacgacgccggatggtcctggcgcacggccctcgaccctgaaatctgcgacgatgtcacagtctgcgggaggtggcggcgtttccggcgctcaactcgaccccggccatccgaaagagggagcagacggtcgtggaagtacatcggctgccgcggagctctcttcgacagatggcgttcgcgaaaatccctctggtcctgagagcgacagttcttccagtgggaaacgttccaccctgcgaggtcagcagatgctgaggtggccgcgcgcagccctccagcttcttcttcggtgttgccattcactcgtctctcccggggcgccattcttgccaccgacctggccaaccccatggatttctgtgtggggataccggtggttgttgtttagactgatgctcggcgcaggcctcatcaaactccgcgcagacactgcgtggaccaacctgacagcgatgcagtggcactacgagactcagccgctcccgaaccctgttgcctggttcgtgcacatgttgcctatgagcatgcacaagtttgaggtactgatgaatcactttgcggaactggttctccccttcgccgtcttgtccccctggagacaactccgcttgttctccggctgcttccaacttctcttccaagtcgccatcatcatcacgggaaatctggcgttcatcaactggctcacaatcgtcttcattgtgtttcttttcgacgaccgattcctcatgtggttgtttccgacttcgactctgaataaattgcggcctctcctccagggctgtccgggcaactggtctttcccgtcgagcgactctgtgaccaaagacaccagcacaagtgtctcgaagagcgagtccgagaagtccccaagggagccacaagcttgcagtgaacagaggccgctcttgcgcaacgacgtaaaactcagagaaacctcagaagctgaagaggcgcactgtcctccatcttcgtcatcggccaccacggctgcggtgtctcgagcgcttccgtggcgtctcttgacggggccaaagtggacggggcgggcactccggcgcatgctcgcaacctggggctgctggcgaattccgttgtttctgttcatcgcggccgttctggtcaccagcgatggcattcttcttctccttctcgggaaagccgctacagccccatccttgtcgacgacactcgtctgggagtctgcgggtctccttcttctcatcctgacttccgtggtggctttgggcggtcttgccggggccgcgggagtcccgtggtctcttctgggggcagctgtatctgccttttctccccgtttcaccgtagagaaccaacaccctctgacaaacctggcgtctgtggagcggtcggagacagcagagaatgcgagcttaccaacacaccctcaagactctgaacggcgcggcacggtgctgcgccggcctcgacagactgaggaggatgtgggaggacacgagggcggagtagtcgagagtcgaagacagtcgaagtctgtggtcgatgcagacgaaggccgcgatgaggcaaaacttctgtggaaaagaacgcaagatgtaggagcccttgccttcgaggttctggtcgccggcgtcgtgcttgcgaatctcctgttcatgcactttcacctcggtccaactttcgccggtcttgatctcctgaccgggttgctctgcgtccttttgtttgccttcgcacatcgccactgttcaaactccttccttgttctgcgtgtgatgacggaagtggggctccttatcgttctggtttggcgttcgatccccgttgtcgagaatcttctctcgccccaccagatcatgaacgatacatacgactcctttcgcctcgttaacagttatggtcttttcggattcatgaccaagcaacgggaggagctcgtcattcagggaacgtatgaaccagatcccccgtcggcacctgccaacccagcgtggcaaacatatgagttctactgcaagcccggagacatagaccggcgtccatgtttcgtctcgccatactattaccgcctagactggctgatgtggtttgccgcgttcaacgccgacttgcaagctccatattggctccttcggctagtcaaaaaaatgcttgccaacgatcccaaaacttcggctctgctcgcgcacaatcccttccgaggaaaacgccctcccacattcattcgaattctccgctacgactaccactttgcgtacaaaggaaaggaacaggacatgtacgagcagggaaagtggtggcagagaaagtatttgtccgagtttctgccacctgttagcgccgccctgttccgcaagatttga

SEQ ID NO: 219 - DNA, 3765 bp, Toxoplasma gondii
atgggatgggttcccccctgtgcggcacctgcccactcgcaggcggctgcgaacctacgggtggagtctctgggttctcgttcttttcctgacgggtcgactaaaaagaggcgaagggaggaaagaacagacaggtttcggaacctgcatttccggactttgctctactcttgctccagtttctcctgcagcagaaacgcgcctgcaaacggacacaaaaccagctctcctggacatcctgaagaaagcctacgacccactcccctgttcgtgaagcgcgctcgtttctgtttttatcttctctttcttttctctgttctggcctccaactttttttctcaccgcgctgacgaatgcactcgcttctgcaacgtctttgctcaagcgctgcatgtgaaactcgacaatccggaactttctcggcagacgcttccagcctcgttgcggtggcagcaagtgaagacgaagaatggagaagaggtgaacgcggcagagagtgcctcttggaaaggtttcgctgacgtccaacttgccccttttcgccccgacgaaaagccaagccgcgaacgaacggttcacgaacacagagacactgtacacggactttcggggcgcgatacgctgggaattgactccttccgaggcactgacctccgtggaaaccgcctctttgttcgccttccgcggccagcactccactcgcccttcctcttcccctcgttctcttttccggctgctacacaacctgcagagtcgtctgtgttcttcggcgcagatggcatcccgtccttctcagagatccacagtgaacagtcagaggacgcggaagaaccggaaagtcaggactcttcgtcttccagaaatcaggacgaggcgcccaagccaactgaacatgccagccaagaaaaagcacacgaaagtcaaggcgaaccgacggaggactcgggggcagctgagtcggcttcggaacacccttcgccttccaactccatcccagctgaagaagaaagttctgcaactgcaacccaagagaaacccactgaggggccttctgccccgcagaccctggcctcgccgcttggtggggacactgcttcctcttcggggacggaacagacggagcgtcggtcgggatcccctgtggaagagcaaggcaaggacagtacgcgaacagcttctttgggatccgtgtcgtattcctccacaacaacgacgaccggcactcccagcgccttcaacgtcaaagaggccctcctggcgccggtacccacgggcgcggtcgcgggaccgctagctgggcgcgaggcgagggcccagcgaggggcctcggcggacagcggcgagcgcggcgccgctggggcgaaggaagcggcgggagaggcgcagggaccgagcgaagtttcagaggagaaggccgagccgaagcagaaggaagcgacagaaggaggaaagactggcggagacaaagacggacaagaacgtggaagtgcggccgggaaagaagacagcgcccccacgacggagaagccgctctcgaaagccgagatggaaagagcggccgcagaattcgtcaagaaagagggtggaatggggtcgttggagaaaaaattggccgaaagtggacctcaactcaccgaggaacagacgaagactttcgtcgacacccaagaggttgcacagaatgtgcggaagctcattggactgaaggccggctcgaacctccatctggaaaaccagaaactgatcaaagcggactgcgacttggcaaccttcggacccgagtactgcgctgcccgcgataatccgaacgccctcagtctcctgtggtcactggagcaccggaaaaacacaatttactttgtcattgccatgattacgcttgctttcggcattgcagtgcagacgtgcattcgcttgctcgagaggaaaatcagcgaaggaagagacgagttctcgaaggaagtgatggaaactgcttttcgacaaatcgcgaccatcagcatcgtcaacgtgattctctggggaacgatgcagtccaacgtcgcagaagtcctcgacgaactcgtctttggagatgtcatgccgccccttcgggacagcgacaccgtgctggagaatgtttctccgatgctcgaggtccttttcgaagagcttttcttcgtctcggtcattcttctcgtctggtatgttgtctttgtcattctcttccagtgcatgatccgacaaatcatcgagtggatgcggaaaatcgacgaagaagaagacattcctttgatcgctcgagatgcagagacacagagccaccgctggtgcggggccgtcctgggacgctctgccctcgacaaagcaaatttcattgcgcacagatacgaattcactgacaacgttcagtccatgagtatcccaggcgtcgacccttccggctactacttcatggagtatttgcgtgcaagtcttctcaagatggccatcgagatgattcgtctgccgaattcgacgctgttcttcctcatgattatggacatatgccttcgaccgacgtttagttttcggttaggccaagaagttggcctcatcagtgggttgtccgctacatgcctggtggggatgctgctcgtctgggcgtacaccgccaggatcgaaaagcagctcttgcctcgtcacgttccacactacctggttatgcgctaccatatggaagtcggaggagacaccagctctgagtatctgaaggagttcgcgccgccgtacaagctgcagaagcaaaagaatgcatggccgggcgtctgttcgacgttcttgcgcgggacgacgctgccgaacaaacatcagcagctgttctgtttctgggcgaacggcccgaacattgttttgcgagcggtggaggcttcgttcttttgccagctcctcgtcctcgcctggtgggtgcagctcttcagaagccacccggcaacttggctcaacttctgttggtggggcaacgtcgtcgtcgtcctctgtgccggttcgcagttcgcactgttgaagagcgtcgtttacacggttcttcttgccctcaactcaggcatgcttgtcgatcctgaactccttgagaaggtatgggatctgcagcgggcggagaatgtcaggcgaacggcagagcttatcgacgccctccgcgttcagtccacgctcttcgctatcagcgagggaggggacatgttctggcggcagttgctcatacggtccaagggagcttccaggcaggcccaggaacagcgactgagtttgtgggcagcgctagacgaagagcatcagggcgagatcagtcgcgcaaaaattttcaagttcctcacgtctcagggattaccgatcaaatcggaatctggcgttaatgactttctgcatgtctttgatcgaaaccataaaggcggtgtgaacgaagatgagtttttcgtcatggtcatggtcgtgaagcaaatgctcatggagcctcttgaccgcgacgctgttcgggaactgttcgaaggccgctacggcattccctggacgtctcctgtcggaattgatttggcaaacttaagcaagattcttgcagagcttcggctcaccttgtcggaaggaaagaagaggtatttgctcgacttcattggtggaaagcgaggcacgactgccgtctctccagatcacttcgtttcccagctccaagccatggaagaacaggctttgaatccgatccaaagcgaaagtctgcgaggcccaccaattcctggagagcgagtgtaa

SEQ ID NO: 220 - DNA, 3774 bp, Toxoplasma gondii
atggtgtctctttgccttccttccccacttctggggttacaggggccgtgcccctccagaaaaaagccgactcgttcaaacgggaaactacagtcacaaccttgtgctcgctggaagccagtggacttaaccaccccacagtcacggcttctttgtcactcgttgccgactgttcccagttccatctctccatctcagtcttcagcttcttccaggctctccgttaatccttcttgccttgctttttctcctgccgtttgttttctcgatgcgaaccgccgggcttcgtggtccccctgtttcagtctcaaatgttcctttagaaactccagacgacccttcctctgtatggcgctttgtatcgtgcatctctggctcttttccgccctctccttcagagaaatcgtttatgtctcggactccgctcaccacaacaaagcaaatcctacctgtcttagcagctggtcactcgctgctccagtagacgctcgccaaccagtgaatgcagctctgacaaaggaggcgcaaattgacttgtacgaaccacgaaacaccctcggaggattgggaaaaagtggcagaggcagcggcttttcactgaagacgggagatgccttcaaggacgtcgctcctgatgacagtggtgtggcactcctatcgcacgagtctcagcagtccagtgctgctcacgagctgaatatgcaccacgacattcagcctgatccctcgtctactgaattctcgaacggcaggtctgccccagtctcatttcttctatcacgggccttccatttatcaaggcagccaggccacctgtcgctgcacgactctttgagccgcctctctctttttccttcaaaaggttcttccatctcgttttcttctatgtcgtctccgtctttgtctgctctgccctcatcttcggctgactctcctctgtcgtccggactgactccacctctcagtttgtcgactgaatctgtccctgccgctgaggaatctccttcctcgggtgcctcttcttcttcgtcgccttgcgaattctctccttcccgggatttcgccttcctggaggcagggcaggcgacttctggaaagaactcccttccacgagcgtgtgcctatgcgggctgtaaggcgggcttcttcacgccgcggccagcgaacgatccgaacacatgttacactctttccgagtgttctcagtgccgcgttcatccggaaagccacgccgatctctgcagccaagtagaagagagaaatggcctgctgctgctgatgaaatcgtcgctaggtctgatgccaaacccaacaatgcctttccgctacaagcctctcagtgctaaagacatagctcgccttcgcgattccaagggcaaagggtcagcgggaggaggcggggacggtgctgagggggagtacgatgacgcaggcggcgaagagtatggagaggacggcgcgtcaggcgaaggagagggagcggatgactgggaaggatccgatgaaggctttctccaactgcacagcctggaaacccgcacgaagggggagtctgaaccgacgggaaacgctcgaggctcgagtcaacctctcaggagacaaggacgattgccgtcatcagtgagtggcactgaggagatattccatccttctgattttcgacttgccagcttcctcgaacaggctcaagaggtgcggcatggtcagagaactgctggcgagacagctaccggtttcgccgcctccttgtctccattgcccttttcatcggcttctggtgcctccttcgatctttctgtgtcctccgctccatctcactcgcagtctcccttttcgtttctcggcgagaaggtgtcttcctgggacaacgagtacggagatcaaggagacgactacgggtttggcgaccaagcgtcgatgttgggagagtacgacgacaatgaggggtcagacgaagactacgacgaaggcggggagcagccacggggcgcgacaggcgccaaatcaggaaaggctgttttcttgaagtttgatgagacacgcgtttaccgtattgttcccaactccctcttgggtgacgtcggccgctgcgcaaccgactcgaagaactacatgcgtctgcaaatcactgtggctctccagccgcggcgattccgcatgagtgtggcgaaagccaagaagctcatgggcttgagggcccggaagcccatcccaaggagctttcacgaaggagacgagggggaagacggcggttatgacgatgcagacggcggttatgacgacgaacagggcttccttgagctagagaatgaaagacgagaagggcgccctgtccaaggggatggaaccggagagctaggtaccgagagccgcgaacaggaaggcaactggcacgaactatctggccttacagagggacgggacacttcggaagacgcaagagaacgtcaacgaggcaaagatcgaggcgaaaacggacggcacacgggcgtcgtctctctcagcgacactgccgcagaacttggctacgaagggaaaagtgaacccgatctacaggacggtcgagagcaggacctgaaatttcgtttctcctcgactcgagtggcagatctcgaaggggaggcgaatcaaccgttgtctttcgtgcaggttgaagacgacgactatggcgatgatgaagacgatgatggcgaaggcagaggtcttggaaagaaaatgaagggcttctttgggggcgtgaagagggtgttttcgcgcaagaaacacggtgaagatgacgacgaagaagggggatacgacgacgacaacccgcctgacgatgagggggaggcatcgccttcaaagaagggtaaaagacgaggtagtttcatgaacaaagtgcgtggacttgtcagcagcaagagtccccaggagaagagattcaaaaaagaaacgaagaaagcgaggcgagggatcaaacgcgtttcgcgtgtggcggtagatatagcgttccactctcccgccgtcaaaaagtgtaggaagtctctctcttggtcagcaacttttccagccgccaaaattcttcaaaccagcttcttcattcttgcgagacagggagaggttggaggccaactttctgccttcatcaattcaggattcagcgtcactctgaaatgcaagatgaaaggcggctgcatgatgaacgaagtccccgtttcttgcgcgctggtctcgtgcgtgaaggcgaagcatgtctcgacggaggcgcttgaggagggcaagaagcgggcggctgctctggcagagcacaacctcaaattggcgcagacatcgctggtgatgagtccagcggaccgagctgctcgtgcggccgagtacgagcgcaagatccaagagaaacaacaggaaatcgaggcgggcaacctaacacagcagcaaatgctgactgcacaacagcagcagtttcttttgcagcaacagctcgcggcaatctcttcgtctcagagccccctcgatccgatgcaggcgaagctgcttgccgcggttcagggcggcgaagacgcttcgtcttcaacctcaggcgtgacaatgcaggaagcaagttctggtgtgacagacagccacacccagcgactgatacagcacatgatcgccttcgattcacggaggggcggaagagggtcgcgaatgagtggaggcgcgattgctgccttggtgattctaggcctgctcggaatcctggtggggggcatagcggttttcaagtaccgcggcggaaggcgccggcgacgatga

SEQ ID NO: 221 - DNA, 4473 bp, Toxoplasma gondii
atgaggatatttcatctcctcttacttggctgggccgtgtgcttggcgctcggtcttcgggtggacctcgccgccgccgagactgagacagacgggtttggcaggcgacgccgaaaaaaagaacaagagcactacggagataatatcgaaatgacgactcttcccacaaagaagggcggcacagctccagcggttccttcctcccctgcggaagcggcgaaatggcccttcaacagctcttgcatgtacagcgaggttgaaatttaccgcccggggataaaagagtatctgcatgcaagaacgtacgatcccctcgctcccatcgcgggcaaccagcaagaaaacctcaaggcccttcaggagctgctcactgctgatttcatgacgcaaggcgttgcaagtgttcttcttgccgtggaacaagtagctggatttgtagacttccagcaaccgcctttgtctgagggacgtctcttctgttcagaggccaaagacgagctctgccacagaatccgcgacgcactccggagtggacagccttgcaaggtcattgctcccgtactgaactgttcgcaattgaacaagaaggacatggaggcgtttctggaggccttcgaggctgaagctgcaattttgccgtcttctcctgacaacgagtgcgggaaggcctacgcagaggcggtctcgctctaccacttggtgattgtggacaccccactttcattctccgagacgcccatggaatctgaagaaatgaaagaaaaactcaatttgctctttgcggagaacacccggggaggacctacacccgcgaaggagggtgtcgtgtacgagacagttgatcttcaggctcctaacgattcaggcgatgcgccaggaaaaccggagcaggtcccaaaaccgtctcttttgtcgatcaactcttccatttggcctgctgatatctacgcgaactccgaggctgatagagaagcaagcatggtggaactcaagaaactgaaaaacagattcctcggaaagccactcggacctccagagacgacaaccctggaagcctttccttatgagcctgaagcgaccagaacgcttcactacagcgcagcgcgtcgactcttcttcattggagctcgaagtccacttgtggctctgctttacaacctccttttccaggcatggtatcgctgggatgagttgtttactggcgagggtgctgcgcgtccgttcccgaggatttccacgcttcttcgtgcagggtcccaggagagatactccagactcgatgccctctgcggagtggctctgaagaaggtgaagccccggccgaagacgccttcgactttgcccatccttccgcgagaaaaaatgttcagaaaaacgcgcgtcgtaggcgaagcaaagttctcctgtgacattctttaccgcgccgccaccgctctggacctcggtgaatctgcggccgtcgtggacttcaacgaacgcatggagtctctgaacgacgagaagaagaggcgcagtgtgcttcttgaacacaacgcgagcggttctgcaaacttcaggcgtgtttgcctctcctttcgcaagagcgtggacggcgtaacggagctaaccgacctcctctcgtgctccttctccgacactgttctcccttccgctctgagcgcctccacgtcctctgcgttgccgccgaaccttcgagaagtttcagagttcgactccgtcgttctcctcgaaacaaaggctgcggcggccccggcggtcgatgagtctgaggacgaagactctccccaggagcaagaagacagggcacgacggaacttcaattggctcaggctccgagccgcgccgcatctggaggcgggtctcttaggcgacgtcctgagcctcgactacggcacttggtggatttctctcttgttcgtggatgagcggagcttgggcgaggtggaggcgaagaggaagaagctgaaagcgacttgcgcgaaggcggccaagagcaagaagtcgaccgctgacgacggcgtctgcactgccacttggaacaaaagatggtgggataagaactgctcgaagaacctgacccgcttcctatgcactcctgtcctcgacgttctcgctctcgacggccaactcacctttgtgacctctcgagctctaaaggctcttgcggcaaacgacttgcaagtgaagaaacctggacaaagtgctaagggtcgtccattcgcctctctggctggcagccgggccacacagaagatgctctttgcgaggaacgcgtatgcccccgcgattttcggcgctcttcagttcttctccacgtccaccatggccaacgcagagctgcttggaggcctcgatcatccgggcatctgggacatcaacttcgcctcttctctcttcactggaaaaggaaagagaggctggctcttcagtcgcttaacaggttctctcttgaggagactcggaactcgactcgcggaaaaggcgtaccaaccgtacatgatgcagctcctgcatcagaaactgcgcccggagacacgcaagaagatgtttcaggcgatccaggtcatcgtccaccctctcgccttgaagcacctcaaccagatggcacctctctacagcgacagcaaaggaaacctcaacaaagaaggcggctttgccgaagaaatcgacaacactttgagggaatggtccgaatacggcatgaacgaaaaactcatcgatcgcctggagaagggtcagaatctgagtgcatcggactttgcgggagtaaacattttaaccatgcccattccgagccgcgagcggatggactcgctggtcgcggagcgtctcaacggagcgttgaaacgccttcaggagaatccggagaacgtcgaaacttcgcgcgcagcttgcgacttcctcagtcacgcgtcgaactccatttacgttaccaacgactctcgctacttgctgaacaagttcggccctgagaacctcctctttttggggaagatcgtgaagcgcagtgagacgcttgagaagccgcaaggctttttcgccagatcctgggctggagtagagaaaacgctcaaggggatcttgcgcctgccgccctacatggtcagacattttgtctttgcagctgtgaaagtccgagaggacttggtcagcgaagtcgtgagggaaatggcggccatctacaatcgattctcaaacttcttcaaggacgaaatcgcttttcggaaagccgtctcggaactcagcatcgcctacgaggatttgctccgccaacgtattcgagagccattcgctgtccccacgcactcgctcctggacaacattcatccggactacgcacaaatggacggtcagagtcggaaccaagagttccaggcctcggcgttgtcgcacattttctcgcaggcttggtcgctctttttctcggtttcgatgaacaactacatcaacccggagccgcttgccaagatcgaggccgagtactcaaccgacgcgtggaagaaatccgtcgacgaccacctcgcagtcaactcgttccgcatgattttcatgggcagcgacatgccgctgaaactctacgaccaactgattccaaacgaacagaagcgcatgctgaagcgtgccaagttcggtgtttccaccatgtttgcctaccagactctcttaacggggcgactctacgaggcgcagaacctcccgaacctcggcatgttcctccaagctcaagggccgtacttcggacctatgattgtccggtggcaacaacgaaggcgcacagacagactcatcgaaatcgtctcctggctcaccctgggagccttctgcttcgcggcggtcggagcagctatgcagcagacaacgcaagtcgttgagcagatcgtccagaatcagagcagcttggcgcccgagttgagtggctgcccgcccatgggcatttgcatggacgggacgatcggagatcccatcgcctcccctccggcgaccgccgccagtgctgttttccagtctattgcgctcgtgggtgtcggtatgatgttagggcctgcggtggcaatctggaaaatcgctgtttctcacttcaaggttcttgcacggtttgaaatggcaataggcaacgcgttccggcgtatggggcagtggttccgcaagaagtggagaggtcgttggttcgcgaacaagcagaatgcagaaattgaaaaggaaatgcagagacacacgaaaaagatgaaggaagagcaaaagaagatgatcgaccgcaaagctcccaacctcattgaccaggcggtgcccgctactgcccccgagctcgatttggttcctgatgggcctgaacccgtgcttggagcttcgacctctggatcgggaggaggcttctttgagattgcctccgcttacagacggaggccgcgcttcgacagactggcaagcatcaggagacacgatgcgctgcttgctcgtttcgataaactgtag

SEQ ID NO: 222 - DNA, 474 bp, Toxoplasma gondii
atggacttggaggcactctcgagtgtcagtccgcctagaggcatcgtggaggaccattcccagatttctgttgagcgagtcaactgcgtcgctgaactcgtgatagatgcgaagcgtgggggtcgtgagcgtgaagcagtcgagcaagtgccacccccagcggagagacaggccggaggttgcgatggagggcaagttcagatggtccaacagaagcacccaggaggccttaagttcctctacatatcagacttgctatgcacttacggcgagtggcaagatttttctgacacgacatcccagcggacggtgcccgattgctcgggtgctttcgaacagaacggccacgaccgtcacgaagaacccatggaccttcgaatgagtcctttgtattacagcgacggggatcctggaaaggccatgagctggcaagtattgactcggaaaccgggtactgaaaacgatgtcaattag

SEQ ID NO: 223 - DNA, 585 bp, Toxoplasma gondii
atgaacttttttatgtcgactgacgggagtgtatccttgggtgcatttggggccgtgaagaaggacggattcaggggggtgttggctacccacgaggaatttgcaccaccagatgtttttgtagtcctttcagaggtcatgttaacgtgtgcacctgatgcttggggtctgggagcgactgctttttggacatggtggaacaaggcgccggagaccggcgacactgtcggacatagtatacttcccctttttaaaacaagcgaggatgggccacaaccggttcagttcctcgttcaccagtttcttaaacgtttcgccagggaccgcccgctcgcactgcaagccttaggactacttagtaacaagcgatggcagaagagctgtccactgctttgccgctctaccgtgatggtggaacgtcaacaagaagagacggtgttgccaccacggggaacttctcaaggtgtcgaaggcataggcggcaaagggtgtgacggtttagtatccagaggagccaccggcatgccacttgaattctatgatgtcttcgatgccgaagcaaacgcgtcttgggagatgaattga

SEQ ID NO: 224 - DNA, 1896 bp, Toxoplasma gondii
atgcatgatcccgacttcaaagtacccttgaacgtcgttgtgtccatctacagacgtggctcgatcaaatgcgttcctgtttctagtctcctgccaataacccttccaggctgtacgagtgaaaaacacgcatacctcgcagcttacttcctccccaaattccttaatatcacatcagccgagcagccacccgccgccgctcgaatgcaactaccagcggggagctatatcctgtttggatggagcgtcaggcaacgtggttgtacgaagatgaaaaatactctgttgtcacctgttggtttctttaccgctctcgctgtacttatagaatgccacctgtgtgaccggtgtgttgctcatcatggcagcagcactgatggatcaggcctacggccccctcaagaggtcgactcggcaccacgaacgccgtcgatcgctgttaaagagcttgccacgtttcctggagatgacattcagacgtcatctcaagaattgcccggctatgaactttggaccagggaacaatcaggggcatctgtgcgtgttgggtttccgcagaacgccgaaagttttctgacacaaagagaagcgagagacgaaatcgcgaatgctcacgagctcgtcgctgtaactccagaaggcgatgcgtggaatcacagtggtgttgtccccgaggagcagactgtcacgcctgcttcaggtagcttcattcagaggcaagccgcgcatgcaccgccttcgactcgattgacgcccgtggaccgccgtggcaggtcacacacagtgtcagctgtcagacggcgggtgaccgtggaagacgttatgcgaccggaccaatcggcagccatgcatgcagtgttgtcagcatttggaggaggcctggttctgaaggctaagaacaaatggggtagaacacgttacacgctacagggacccgcaacattcttaggaatgggagccgagggcattgttgtacgtctaaatcaggtgaaaagcgaccgggaaagatcggtgacaccggtggcagtcaagctgtgcctcattcgtgcagcagtgttctcggggctgacatggtggagaaaacgaaggaccagaacagaactaatgaaactgtttctgtcgaacgagaattctgtgaagcgtgctctaccagatttggacccggccgaaatgctagagcacggtctcgtcgttccacatcatgctgagcttgtttccggtatgcccacgtggtttgccgcgggcgactcattttttgtattacccgttgtttctgtgtctcctctttttacttgcgacctcgaaacggtcgtgcaaaacccgttgacctttttgggcgaagatgtacattacccgccagttgctaaagagtattgcgtggatgcatcaaaaggcatttctcataatgacttgaagcttgagaatgtcctgctcagtgcagacggaagggttgccatcggcgattttgtttttcaagcccccttcggggcttcgttgcccatcaggggcactcatctatacatggaccccgacagctcagaagcattttttgaacaacgagagaacgaaatcactccccacagagatgcatgggcgactggagtccttcttttctatctgtggtgtggcgtgtttccattcgggttacagaatgtcgctaacgcgagtccgccacaggtgatgagggtcacagtcatgcatgcaaggactaccaggccgccgcccaacttccggctgtgtcggcgcatcccgcgtgaggttcggaacctcgttaccggatttctgcagtggaacgaggaagctcggcgtcttcccagcgatgttgccgacgcgttccttgccgctacggacgacggtggtagagaggcgcgtcggataagaacgcatcaattttga

SEQ ID NO: 225 - DNA, 396 bp, Toxoplasma gondii
atgacgctcaagatccgtatgatttgtctcgccgccgtcggggtgctgattgggggagtcgcaataacaacagttttcaagccagtaagcccggagtgtaccgtgcattctttcagcataggccttatatctgccgacgcacttcggataagggcttcacactcaagttccaaaggtgaagaaggtgacggggaaaagcacaaagacaagagctctgaagaaggcgcaggcgaccgtgacagggaggaggaaagagatggagaaggagaaggaagtgaaaaaggacctcagccttccccgtcagggaagccgctgcagcggcgggacgctggttattggaaaaaaaactcggatagtggcaagcatgaacgtgtgaaaggtcgaaaaagaaagtag

SEQ ID NO: 226 - DNA, 1092 bp, Toxoplasma gondii
atgtgttgcatgctggtgggcctcaaacactgggagtactgcttatccttgggcagcgctgctgtctggtatgctattgtctcgttttgttgcgcagtgtggcaactcgccgcagttttcgtacacgtagatttttctggagacattacggagcccatagttcgtgatgatgatggaacaagacaggtcgttttggggttgatgtccatcagccacgccggagctgccgctctgaacttcgccgtcgttctgcttaccggtttagctgtcggcctgcgatctccaaagttgtgtcgtctgtcatctactgtaatcttgactcaaggaatctacaattctctatttctcgtcggcgtctggagcattttcgattgttcccaacacggagcgaagacacacagtgcgggtctgcatcctgacgcttggttcggagcgttactggcatggcctgctgctgttattctcgcatctttggctactgttcaaagtgccggcaactcgggctttgaaggccgacaaaggattgcgtctcccagattgcataagccagatgacggacacgtttctgacgcgtgggcgagggtcggcacgtggaccgtgggcttgactctaggtcaaggcgtgcttctgttaagcggtgtgtgttttctgatggctgctaaaactcttcgcagcttctggaacctacacttcgttgagagctacgaggcacaacaaattggatgggcgttcatgctggaaggcttgattctctgttgtttggccgctacggcgttcgtcggcacagtgctgacatctaccttctcgctacttgtcgctcttttctgctgtattgggcttggaccaattgcgacaatagtggcagtttggtggaacgtgcttctgtacaggtggaaagtggaaccgggcgttttcgttggcatgcaattcagtatcattgagcaatacgtctgcgttttctgctgctgggctgcatgtcggacgctgaccgggttcattgccgcaaaaacaaagggtcgatttggcattgatatcccaaaggatgacagtccggaatctgaagcccttgtgccttctgcaagtccggcttaa

SEQ ID NO: 227 - DNA, 345 bp, Toxoplasma gondii
atgtgggtggatgggattcatctttcattattggcggttggaatgcctacacccgtgcgctttcgatcaatgtgttcttccccacacagttgctgtttcgtcgaaaattccgagcaaagggagattcagagtttgttctcaggtcaccagctactcctcctgggttcgtgtttctgtgacgctgccgagagtaccgtcgctggccggcggtcgtaccaaagacatactacgcgacctggatgggtgaccggcgctgttcagcagacctcaaacggatggagactggatgtgtctcggcagcagatgccacagtggaagcgtggacacatccgaggacgtccctaa

SEQ ID NO: 228 - DNA, 702 bp, Toxoplasma gondii
atggcggtgcaaacggcggtggacgacccggaggctccggctgaggatcagccgctgctcggaggttctctgaaaaagccttccacgtatcgtcagtgttgttgctgtgctcttggcacagctgtgactctctgggcagtgtttttgattgctttttctgtgtttctcgtgctggatttcaacatccggggagcggccttcacctcaggagctgtcctggggctagtcacagcgacgctgctgctctgtgcagcgggacaacaaaacgcatttatcgcgttcgtttctttctaccttcagattatggtctaccttctgtgggcacttcagatggctcttgcggcggtttctctatggaaggtcacgcacagttctgcctctgtagcggggagagaagacttccctcgtgtaacgctgagtcagtacgcggtcatgacggatacggtatctgaccaaagtggaaccagacccgtacaggtttatcggcaagtggaagtttcgtttgctttgtacgaggcaacgttatgtgcattctacgcagtgcagttgcttcttgcccacttcgtcttgagtatgctctggagtttctaccgggttctgcaagctggaggcacgggtttcgagaagcgaacggcagaagaaatcgaagaagatgccctctcagcccagttcccgtcttttgcagaagatactccgcggtga

SEQ ID NO: 229 - DNA, 1440 bp, Toxoplasma gondii
atggcaacggtaccaatggtctcgctgtcggctgcccgtttcacgctttctttcttgttttttcagctgtgtctttcgcggctgttccggcccgaaggaagaaatgagttggaaggaccgaaagatgtagacgcagacgtgatcagagcgcttgacctggcaagcgtttttgcgtttgcagaggcggtcaacaacccaccgccactcgagggagcctctgtgtcgcctgaaaatgccaccgacccaccagaaacgggcggttctcgtcgttggcggacagcccgttacgtcttgcgacgtcctttcacgcacatacgccgcgtgtcctctgcagttcgccgctatatcagccgcggcacgagctcattggcgtcgagttttgcgtggaaaaggcgtttgaggaaacttatccgcgggatggcaaaggacctcaagcaaaacagggtgcgcgacgcacaacaaaagccaggaagcgacgcggtagcctcgttcgtcaagactcctcacgctcttctgacgtctctggggactcccccagcagaactggccaacgccgtaggtttgttgttgccggttcagcatcctgtgccaatgaaatcgaaagtgacggggaaaagcctgcttgtgagtcatgcggcaactgtgggcgtctcgtcgtacggaagcgttctgctgaggtgcgagggttccggcgaatcggcgagctacttcctggaagctttcccggttttgagaggatccagggaagcgagcgtgagcgtcagaaaacagtacttggctgcaataaaggaactcagagctgcgtcgggagtcgcgcaagtcggtgttgtggtagacctgttgttgctgaagcgcgttcgcaacacctggtgcccgcggcctcacgaatctcactttgcgtttccgaatgtctttctcaagcgggctgtcgagggagaaactctcagagaggttttgttgcacattgcaagtaccgctgcgacggacacaccggggacgggacccgcccacgacgcgcgagtctcgctgacggaacaagtgcacaaattagcgaggagtgccgcagagctcggctccagaggcggaaaaatcaacatcgacactttttttgtcactcttgacgggatcgttcacctccagcctgtctctcttgtagaatcgccgccggtgcatcggggatcagctggcctagaatctcctatcgcggcagaactcgaggaaggcgaagagaaaccatcgccagaaaagcgcatgactgacgacttggctcttgccatcgttctggcacagatctggtgtccgcaacggagattcgacgacgtcgcctacgaactgttgctgcttcaccgattcgagagggaagtcacagaagagttctttgaacgctgcgccgacccgccagaggctgtccaggtcctggtcacaatgctggctttctga

SEQ ID NO: 230 - DNA, 681 bp, Toxoplasma gondii
atggacttgtggggaagagacatcagcagagtggaggctttgaaagacgagattttcagtctccttcagcagcgagagaaacagagaggtcccggaggaagcgccagcagctccggccgctcctctgccttgctcagaggcaaattttatcaattctgtcaggatgtggagcacctggagagagttatgaaggcttccgaagccgagcggtcgagcgatatgtcttctgcagactggcgtcgcaggcgcgaacaaatgtctcgcctcctcgccgaaaaatctgagcttcaactctccttttctcgcgcgttctcttcgaccgaagacgacctctgcggcttgccggagtccggcgcggtttgggtggacgtttcgggaggcgctcgcgcactgaaaacgcgcgaggaaaacattatcgcggagcaggacgaacaactctgtttcctcgctgggaccgtgagcaatctgaagagcattggacatgcagtcggcgacgaagtggatgtacaccggaagctgttggacgatttggacgtggacgtcgtccgagcgcagacgcgtctcgagaagaacaaagaactgctcaagaaaatcgtcgacagacagtccactgcatgcctcctcttcactgcgctcgcgcttctggtcgtcctcatcttcctcgtcgtggcgaccgcgtaa

SEQ ID NO: 231 - DNA, 2472 bp, Toxoplasma gondii
atgtcggcacatactgaaaccatgactctaggaattccattgtcccctacgggggaactcgtcgacgcagtgccgcacgcaactgcggctaccgagcacctgcacgagcatgcgattgtgatgatcattgccagcatttccttcatctatctcctctcggcagttcttgctggtcttgttggccttcttccgaaattcagacccccgatcacggttgttctgtttctggctggcatgtctttgcagccgctcttggaatggatgcaaaaccgtgtgcttcttcaaggcatacgactcatcggcaacgtcgatccatacctcatcttcttcgcgctccttcccatgtgcctttacgaaagttccgctttcgtcaattaccatatgttcaagcaggttctgccctcaagtctccttcttgcaatcccaggggttgcagtgaacatcgggctcgtcggagttttccttcgatacggagtttcgcgcgtctacgattggccggcagccctgatgactgcatctattgtctcagccacagatcctgtcgcagtcattgcgtgtctccgtgccctcggcgcccctgaaaagctttcttccctcatagacggggagtcgcttttgaatgatggatcggctgtcgtcttcttcgaggtcttccgctctatcgtgattgggacatacacaggagtcggctcttccgtcgttctcttcagtcaactctcgttcggggccttggggtacggtctagcagtagccatcgttctttacctctggctcttgacagtccgcgaattcgagattgttcaagtgactggaacaattgcggccgtcttcacggtcttcttcacagcggaccacttcctccacgtcagcggtgtcctggcggttgtcactctcgggatttttatggcggccaagggctcgacagctctccagaggtccattcagaaactccaccatgagtctgtcgagcttctttccacgctttcggtccaagccattttcgtctgtggtggagtcattgcatctcggcttctaattcagtacgcggacacctggcaagagtgggtcgagctactcctgctcttcgccgtgctgcaaactgcacgcttcgctgtcgtcttcggttcatggcccttcatcacatggatggggctgcccctcagctggaaggagtgtttcatcatctcgtacggtggccttcgcggcgtcatctgtctcgccttaggcctggttgtcgaggcagatcctctcatctccccaacgctgcgggagcacgtcggaatctgcgtggcaggcactgtgatctttacgcttctcataaatggaacgacagcagagctggcgtacacgcgtctgcggctgtaccccatctccaagtatcgccgagagtatctggattcggtgttggcctccattgatgtctcgttcaaccgcaagaaaaacgaactgaaggactactggctgttcagaggaacagacgtggttcaagcggcgaacgaggcgcttccgcagttttccaagggtcacctggatgtgaatggaaacctacatattcctaccaagtcgttcagagaagttcttcgaaaccctccgtcgtgcgagaactggaatgtccaagctcaagtgacgggattggcaaagctggaatcgagagattttggtgtgccatcacaactcggcgactggactcatggacttgtctcgacgatcaagaacgtgaagcagctgaccagccgccagcagcgtagcccagagtctagggatgaccagcacaaccctgaggaagtcacgttggtggataaggaggcagggcagctcgagaaggaagtccacgtcctccacatcatgttcagtgcgatgagagaattttactcaggcatgtacaagcggtcaaacattggcggaacagcatgcttgcttctcacgtcgactgttgacaaatgccactctcatctcgacgctcagcttcacgatatgactacgaataaaaagtcccggaagaacgcgaataacacaaatgtcttttccttcgaatgggaagttctcctggcttcccttagaacgcgttacggcttgtggaagtgtctcaacgcgatgccttgcgacgcattcgacctcctcaagtcctacctgatctccattatcgagacgctttacgctgtggtcgaggcccacgagttcgtgaatcagtctaaccggaaagaaatggaagagctcatcagtcaggcgacgctgatgccttcggacgacgttgtcacatccgcgaaagaactgctggagaaattgaggaacactttcccagtcgccttctcacagtgtcttgttattatcgccgcacatatgcttctcaacgcgaagcaaaaggtgctcgacgaagaaattgaacgaggcttggtcttcccggaagatgccgacaaactaaatgaggcccttattgaacaacgcatgatgcttgagcgaatcatccgatga

SEQ ID NO: 232 - DNA, 3903 bp, Toxoplasma gondii
atggctagacgcagaccatctgcgattgccacctgttttcgtatgattcttgcctttttcctttcgttcactttttcctctggtgcggactccctcctcgctccgagcactactcaggctcgtcggcttcaagcccgatcgggtgacaacgccctctcaaatggaggccgcttgccaaatggtgaacataatcaatttcgagctctccgtcggggagaccagaaggtggaaaaagacgcttttggggctgtaaatgccgaacagcgtacggctgtttcggggagcaagtttgaacgggaaaagtggaccccgattagttttacagagaaaggtctcttcgacgtgatcaatccgaccatcgctggtgatgaaaaagatgagctgaactggagcacgcatcaaaggatagaaggtagagggacagagccaaccaggtcagattcacagcagcgggatcaggcaaaacccagagctttggagagaagggaagaggcaggacagcctccaagggacgaacatcaggacactgatgttgaacaggccccgttgatcaaggaagatgaaagtgacagtccatcggtcgaagagccccgggcacaacccccagaaaataaggaggatgccatcacgaaaccatgggatgcagactggaatccatggaagttcctggatgaaaatccgctgcccatatatcgagacgactgggatgaagaagaagacaacagagatgacgcagaccacgaccctgggtttgcagagccaccgaacagccctcctgcaggcggtgtgccgaaaagggaagatgacaatgcacccgattatccgggagatgatactgcatcctctccaccgtatgatatgcgaccaaatccggaagatcatagtcgaactcagccaggagagtatggcggaggagtggatgatgagggtgaactgccagatgaagatactgcgaaaggcatgccaaggtcttcgacgccacctcctaatgaagagtcgatccctgctgttcccaccgagtcggagtggtccgggtcaggcgtttacgaaggcatcgcgatcactgtgaatgcgcgttggattgacacgcgcacaatcggagagggcggaattcaacttcagcatcagccgacagtttttcctgcgcctccagttcttcggaaggtgggtttaaaaagcaagtggaaacacaccatcaagattttcgtgcgtacaacgggggcaaagttcgttccggcacgtcgacaggttttcgtccctctggatgagacgccgacttcgagttcgactcttctcccctggtgggccaactggagtatctcagcggtcaaggcagcctcggcgaccaccagttcagtggcagcctttctctttggaaccggtagagctgtggacggcggagaagggatatccgaagggaaaggtcccaccataacctctatcaaaaacatgctgaaacagtacaaacggttcaaacgaaaacatcctggaaagcctggtgaacttgttatcgacttgtgcaaagatgaggaagacgcaagctctgccgctcgtacaccttcaccttcctccgcctcagagtcttcctccgacggtggcgtatgggagtcccttgaatctcccgcacctgctcctatgccttctttgacttcttcgtctccgtctgggtcgtctccatttgttgtgaagcagagcccagagggcgatttaaagacagaatctgaagggcctgctcgattgacgacgccttcagagaagcgacctgcaaaagcaaagcctcagaacacgaaaaagaagaccaagagaagaaaaaggacggttgccaacgcgtacaatattcttcaaactcaagaggggcttgcgttggtcaacaaaatccgcgacacaatggccgaaatttttagtagcccctccacgtctgttcaggtcctcacaagcacgggacacttggtgataactcttccatcagagggcgtggaccgatacaaactgaagggtttcctacaaactgtccaggagacgtttggagacaacatccaacaatggtcattctccgaaatagttcaactccggagtgaagttcccgaaccccacatcccgccgcgtgcccagatggctgccaagatggaatcgctgagtgggaaaagcaccaaaacgtcgaaaaaactaaatggtcggagtttgcccgcctccatgagtgagacgaccagcaagaaaaccccgtttgaggcaagtatgccgactgattctgctctggaatcaaagctttatgggatgcacatgatcacggcaacacatgcttggatccatggagaagccggtgacggcacggtggtcgccgtcgttgattccggtatcagccgccaccatgatttggattgcaatttgtggcaaaatccacacgaacaacaggatggtcgagacgatgacggcaatggtctgatagacgacaaccatggctatgacttccaagaaaacaagtctgaacctgaagatgagaatggccatggtacccatgttgcaggaattattggcgcgtgtgtaaatggaggaggcgttgttggcggggcaccaaagacacaactcatggctcttcgattcatcgacaaaggcggtcagggatctatggcaaacagtattcgcgccctgaactatgctattgatcacgaagttcaagttatcaacaatagctggggaggtccccagtcgacgactgtgttgcggagactagttcatatgagtgcggtcgcccgcaacggaaaaggcatccttcttatcaatgctgcaggcaacgaatcttccaacaatgatgttaacccgtcgtatcctgccaactgggatcaagataataccatcagtgtggcagcaattgacatcaatggcgatttagcagacttcagcaactacggcaaatcgtccgtggacatggcagcccctggtgtcaaaatatactcgaccaaaccgggtggtgactaccagcatatgtctggaacgtccatggcgacaccgcacgtctcagccgtcgctgctctagtattcggtgcctttctccgtaatggatacgatgcacccgctgcagaagtgaaagacatcattcggatcaccgcttctccggtcgagcagctccagggtgtgacgagatggggttcaatacctcatgctcgagatgctgttcttatggccagaatgggagggatgtttttacaagcaaagtgcgaagatatggttttcgagctggacgctggctctgctcacgtcgtcgacctccacttgatgccatatcgacagggcaactacacggcggacttaacattcgatgtcttcaccgaagatggctaccgtttggaccaaattaaagttcctgtgaaacttgctatctccgcggagccacgccaaggcaattcggactcacttgcggcggcggcattctcgagtgttgtgtcgacattcgcggctcaccccactgaagggtttgaagagctgtgtcgtttacaggcgaaaatccacgttgttcaggaaatgtccacggccatgattgtaatcatctgcctcggagtgatcgccgccatctcggttctcgttcttgtctactgctgttctagaaacgggcaacggaggtctgatgcggcaaagagaaggcgcgagtctgtccgagattcggccggagaagaaaggagaaaccaacttacagaaacgcatcgggcgcggaaacatgcagatacaagcgcagaggcaaataaagaatttctgaactgttcatcgagagcggaggatgacgcaaacgaccggagcgagacgcacacaaatcccaccgaccctttgtgccggaaagaacatgtatttctaccggcaacaaccctcgaacagttcgcgttatcgacgcccaacgagaatgagtcgtag

SEQ ID NO: 233 - DNA, 732 bp, Toxoplasma gondii
atggcgcaatacaagtcacgccctttggcagctgttctgctgctcattaccgtcggatcgctgctgaccgcttccgaatcggtccagctttctgaaggcatgaagaggctcagcatgagaggaagaagtcccagcccgaaaacgggaagatttgagagtggagacgaagggacatctacaatgtcgccctccgtcgcagcacgccaacaggaactagggctgctccgtccggaagagaggctcattgcgggtcaagccaaagcagcggcgctacagactgtccatcaattaggagcagttgttcttaccccagagcaagctaaagccgcattgctagacgaaattctcagagccacgcaaaatttggacctcaagaagtacgagaatctcaacacggagcaacaaaaggcctatgaacaagtccagaaggatctttcgctactgagtccggaaacgaaggctttgctcattgaaaatcataggaaggagaaatccctacttgaacaggcgaaaaggctgttccgaaaacgccactaccacgttaccaggcaggcggctttggctggacaaatcctcaacgagcagagggatgcgagtggagcattacaatcaggtgctgtgaaggctgcgatccgaaaagccaacgagcagtacaacgtcgctgaagaagacaagaactttaacgaggaacagcatgcagcacaactgaaaaaggtaggcgctatgccctag

SEQ ID NO: 234 - protein, 733 aa, Toxoplasma gondii
MEGMGSLRRRCAALPLVAGFLVFLGSIGVKADLPIHATVHDIKGDWTFYLSPAVPGDVSNCGSPSPNTNTSNLREELKDYKSFLSTQGGIKKELRVSLTDIPVSFATTRTAAALENPHRRTWKTLGVFDGQDKRKLVGSWTTVYDEGFEVDVGGRMRLMGFMKYNPQNNCSIVDGDLENSQGITDCYATDPTRTQIGWYIQQAEDGSRLSGCFYAEKPKAASSTPAAFVAIKETTRVEPASGALIGTDLKDSTSYISQSFVDTHNASPASSWRAGVNSVFANMNRRDLSRFVKDFGFKKMRPAGDSADGLSFMQSSTDISTADGDAASTQVYACPCKKGERSLDTRKLDESEQTLEVLSPVSALEVGHTNFLAAINPHVHESTATNGLDAQGTQAVAKAALSGAGATNTQEPLLLPKDFSWSDPFSNQAFDETVTNQGSCGSCYAVAATYALQKRFEIAASRMLGQEIRLFSAVQDEADGALSFLDLGSTSQLGELSAQSILSCSFYNQGCDGGFPYLVGKHARDIGVPQARCMEYQADHTQGCPFQKTASASESQSMLQADANAGACSEHARWYAKDYGYIGGCYECNHCSGEKQIMLEIYNNGPVPVAFDAPPSLFSYRSGVYDANSNHARVCDNDLPHHTGILTGWEYTNHAVTIVGWGETDGENGKPQKYWIVRNTWGPNWGVDGYVKIARGKNLGGIESQATFIDPDFSRGQGLKVAKAIEALKSKTM

SEQ ID NO: 235 - protein, 753 aa, Toxoplasma gondii
MSAAVEPRGRLSDGCCRRRLTPAAVLFLCRVLVLFWVNEAEPANGDLPAHCLVKHVLGEWEIQEGLWLPCQEEGNLTTDAARLHDPYCGYGIPDRVDAHGPMTPPNVSASFHALRTSRFTLFPDFRIEFEDGSSGLWTLVYDEGLHFEVSTPQNRRFFAFFKYQLAPDGQNRAWSYCHTTLVGWWERPAAPNLSLQDVEKAPPVYDIPEPIAPDTAADALLKSVKRGCWWGRKVGEDLSVPTNEVPKERRTPLEVPLWPTSRPPDVRTVAAVVRKNLAADAPWEPLDEEYVEIRGRKLRTMEEVWAHAGHQPLLISRQNIESTHLTLSVRPPLHLLAGIKPFGSPAGSDPPWRTVRDFDWANEDHVALRIGRRQSVIPDAPNQGGCGSCYAIATGTVLTSRLWIRYAANDDVFGKVNVSAFQGTSCNVYNQGCGGGYVFLALKFGQEHGFRTEDCVSEYHAMADKHKGSLSPNLQTCFDLGGQLGTSAFGCQAPPARASLPDSCNLSVKVTSWHYVGGVYGGCSEDDMLRTLWEHGPMAASIEPTIAFTVYKKGVFRAAYNSLVEQGDNWVWEKVDHAVVISGWGWAKHGDSWLPYWKVRNSWGTKWGEGGYARVLRGVNEMAIERVAVVGEVSLFRGGEHIPPLLARSLDSQGSSNASKDSERGETLVESVSPVFRGSASGSESGNPRDAATNESADMSESADADAESSSGSDDDEDGDMEKGDVESTTKQTTLFRPIQRHGEVLEEKRTGE

SEQ ID NO: 236 - protein, 894 aa, Toxoplasma gondii
MMLLYYRLSSEHAGSYRQCPLSCSALSLAEVKQLLAARCGLANEYGRKIDFRIFLAGSQVPGGAAEAEELTEIVDENQMIHAYSKVVLQRVAITYGGSGQSVLHKARSELSQEEWKTAEERKLSSRLKRLPPEWLCGLCHRVMTNPVLVRCATNCAQSACHACLEAHLGPNRICPFCNSPFRQAIRNKRLQEIIALANLSEFESAPGAACAVPQLQVQAYQAGDPASSAVAPGEGSRSTDLIRSACREGPSDASRLGSGESHSATGAGVADRVSGGNVCEDRETDDDVGADGSRGDSAGASDSFRSEADWVHFVYLVPQENLKLMRQYDMMVVESSSNLAVALVRKATQRGGSGNPDAAAELGEPAEGALRDGTGNSGPTTATGETEQQEQVRTTGSKNTDHEVFVVPLCSAGGGTSFSIAGFARINSARQVDPEADSAAATVVQQWQSSSGRASNLPGHGAGLAFGVYRISWDNKFNPMPMLPSRKQPLCSLLGAHRRQFHSNASGVPAVPGLLKREVFGGAGAGMIEAAVEAAKYEEVLACIKDYAQFGSRPAEPWQHPASQTSSAAAATPGLPKKGVPVGGIGQEGSRVPPPPPPPPGSVGESGFSLSSGNGVSVVEKRDVSSEGRGPSDGVSISFNARGASLPGSLGDERKALETGVFGIPVSLGPPSLGLRGDPGEPSNPYLGYCALLPLLTEEQFRHIRRLQKRAMVLCGYTQSPPESRKKRRRSGKKKRGKHSVSSHSTGSGTLPSDEPVDGCDRVREEAEKEGTGCMSADAPAVDTNTEALSIQNAATSVTRQPLSDPDSANATGSRVRAGRRALPRVPPVLKISRIGDKNDTDTTQNKDTGSMQSQRANSVIETCSVVEENTMAKIPGAEAKPEGVPDNGPCELP

SEQ ID NO: 237 - protein, 219 aa, Toxoplasma gondii
MAARAGSSGVSRRFLFVLFTVLAGSSFVSADDAFIDNVKKGVGEHIGGTPVDLVLNDLYPLIVKQGLGGVLGKIMYKVKGIMYYRLADGVADVVMSELEFYLFGEKGANQSSFKELRKLYEAYMRKFFAESPEDPVDALTTGVWKGLLQLFTEKLQDAFRGSPKGQKMADLLFDSNLTLVKSWTDAAHLQIMQLSSSSARANALRLLRAKQKKPLARKN

SEQ ID NO: 238 - protein, 190 aa, Toxoplasma gondii
MVRVSAIVGAAASVFVCLSAGAYAAEGGDNQSSAVSDRASLLGLLSGGTGQGLGIGESVELEMMGNTYRVERPTGNPDLLKIAIKTSDGSYSEVGNVNMEEVIDTMKSMQRDEEIFFRALNKGETVEEAIEDVAQAEGLNSEQTLQLEDAVSAVASVVQDEMNVIDDVQQLEKDKQQLKDDIGFLTGERE

SEQ ID NO: 239 - protein, 752 aa, Toxoplasma gondii
MSRRMASRSRLLFAAFCAGGVLLGAGPPAARQSAFTVASTVAGGETGYTSSLEVESPENVGVHEGDENSQHAHDEIPVEAAEGEEVGSSRLSSSNRSRTTHATSATRRGSRSRLLLPAALISALALSGLIGSSMMKETAEETGEPRAATPEKQADAKGAPPEEAKVVEQEGAQVAHPEGAQVAEEDSRSRQRRMQAAVLAAVLVAAVIYGVYDKASLTSPTTTSSESGTSFRHPELALEDSEADLGGQLEMALIDASHETPGGAPSEGMAGAVSSLIARVVDGVVQFLQDPASQRKSLGMAASAVALAFLAAGALRARQAAKALTHRPAPPPASKEQGESAQEALEELEPAPETQTEQVDQASMPLPPAPEDFDLPPMPLPEAPEDFDQAPMPLPEAAEVFDQAPMPLPEAPEVFDQAPMPLPEAPEVFDQPPMPLPEAAEVFDQAPMPLPEAPEDFDQAPEPLPEAAEEFDQAPKPVPEAAEEFDQPPEPLREAAEEFDQAPMPVPEAPEDFDQIPKPVPEAPEEFDQAPMPLPEAPEEFDQIPKPVPEAPEEFDQAPMPLPEAPEESEQAPEPLPEAPEESEQAPEPLPEAPEESEQAPEPLPEAPEESEQAPEPLPEAPEESEQAPEPLPEAPEELDQPPMPLPEAPEEFDQPPMPLPEAPEEFDQAPMPLPPAPEDFDQPAMPLPPAPEDFDQAPMPLPQAPEELEQAPASHPEEAEQEVPERKTDAGSEPEKDPETNLLEEEDELKP

SEQ ID NO: 240 - protein, 471 aa, Toxoplasma gondii
MSHRMASRSRLLFAAFCAGGVLLGAGPPAARQSAFTVASTVAGGETGYTSSSEVESPENVGGHEGGDSFQSAPNGVPVDGVEEDGRSTLISANRSRSTHAVSAARKGSRSRLLLPAALLSALALSGLIGSSMMKKTAEETDETKVASPATGTQQIQKKVAQPEDAKVAQPDDDQVARDALRARRRRQQAAVLMAALVAAAAYGMYSSLSGYEDAGSLSSPESASPELDTLIMQQGTQFAEQLEALHEMPVGAASEGSAEQSSLSHLLAEVVDALQQPSLQNILLGGASAAGLGLLGAAAARRRRRQAQPDTPAPPPASEEQVESAEEAPEKLDEALETHPEDTQKAAPFALLGAPEERESSPETHPAASEESEQAPMPLPPAPEELDQPPMPLPPAPEDFDQAPMPVPEAPEEFDQAPMPLPQAPEELEQAPASHPEEAEQEVPERKTDAGSEPEKDPETNLLEEEDELKP

SEQ ID NO: 241 - protein, 419 aa, Toxoplasma gondii
METGLKERGGSRHAPRLWRGPTRHLLSIRLAAFAGLTFLLAASRVSAEVGAFEGGIGDHVTMHLIGRSWEMHGGACFVGRPKNLVVDPVFGTYGRQPQVLETHKTGPRLCKWLDELFEQHQARRSEWERAHEAAKSQVSMFNAVRRFKNAVTVFPEFQVEIESNYLSLFHDDWYGNQLPWMAATVKYVEPKDGYGVFQHLNRVFAVPGVPQAQLVFFLLYPAPTFNQPVKLEKPGKGSIVSGFIGGTGLGASVSHMRRGDIGDLVDLGRVIYAAVKKNFTIQASLSDFWLNGGNCYMGSRFKVKGTIQGVTLCQFLAGEASKSVYGAYKAAKLKSVHLTVTGVDLFNRAQPELRCLVTEGLLLHDVHDFTVSLAVDTNPQLIQHFQRTTRLASMFRWVKLIGRFLVKIGSTFMKPSQKK

SEQ ID NO: 242 - protein, 436 aa, Toxoplasma gondii
MRAIVASTQQFLRPVGSRPLAGISIVVVVALAIALGTAADVGRHVGGFSGPFPMTLRSGQWRLDHGACFVGKAKNLVVDPLPRVSPQGPQPLDVTTTGSALCWWLDSMYAAHMSLKAAWERRHQEAKNRTSWLNLWRRFANWWASFPEFQIDVSVLYLDLWNDDFYGHPLPWFSAEFSYTPPSGRYAYNLFDKLQSHFASAPGTAVQEVFLLLAPAPTFNQPVEKRSSIVARAATVAAGNELFKEALGHQRVDEVLSMVPADPFRLMLSTSAFSFQAKIGDFWERGLDCMLGSRLNLRWDQVGTSVCRYMTAKASETGSGLAASFLNTVEVRVTGMDFFNHAAPVFKTEFIEGIITKRATYIPVSMYLSTDPTLTHEYEAAKTVKRAVQAGRVGAALARGLVNFARATNQKADESHEGQTKTPTSGVRGSAGSKHN

SEQ ID NO: 243 - protein, 408 aa, Toxoplasma gondii
MQAIARGDRSSGWSSCSWLFYFSFLLLTSEAVAAAASLEQTISYSVQHQPQQEGILGTQKPQTAPTPQQLIVPVSYLGDGLSYFSGVLRRLPLDVALERLTSAREIPTVAGFVQKYVLAAQLSRSLQSTANGVKKILMRLDAAKNEEGFITDLLKSAPEVQEVLSRFLGSVASALALLDINGLHEAVDASLPVTKAVVMLYLHLVSVVPPKQRDPFSPFLLYLQDAVGEFKIMEDHVASVVAGEAQEENVINSQPQGTETSHRAVVRGGIRMLQSGTSETTKLRRTWWRLFKVAALAVLTMALLKYGTPRVRAFLERRRMRRGGGGDSGDFGEEGRSKGDVSTSDDMPREPPPPYVPPMYPFAEPEHRWAGTYGTSHGGYRVQPTAPPAPASMLYPSLHRLGYQRPSE

SEQ ID NO: 244 - protein, 550 aa, Toxoplasma gondii
MVTTTTPTPPGAPAVVPIFDVVYQLNPHVFRSRFSRRNRARRVASSKSRSIIRWLGYLTVLAAVILLGAYAVRRVSRDLSDSVRETRRGRRITGSVPPGTTRPRSESCTGTQVDGGCGADTSTDGKSESEQTENGEDSRFSTRTPIHVTASTSPFATRKAAEERSSSPRDRKVPEGAQLPTSSTPHAQRKDSGSDSRNPSTLIPSPGTNTFNMNFYIIGAGSSALDFIFPHTPDAQATVVSPPRSAAAAPTVETVPRVRTYSTPTTLTLPTAPATATSNHMHASATPSPPERPQNFRGGLMRQNGMVEGTSLTTTEAGMPAPLQSPQHIETEARLTYSNHLKSPHTPETPTVHSIDPVVGTSGHSVAVGSQSPAGGPPTDSRTPAALTPTSSSFSHADSLETSEHPQSGPSLHPLISGIQDAVQSQLPLSQQETLPVVENATFFGPQQTPPWMDETAAAAIPLAPSQPGSRTQPISSPHTLLSRSGGVSAVPGPPRTENPRQPQVPGENSYYSVPTERTISDPGPQRAGAAQADGIGAGGPRDTQSAVTP

SEQ ID NO: 245 - protein, 185 aa, Toxoplasma gondii
MFAVKHCLLVVAVGALVNVSVRAAEFSGVVNQGPVDVPFSGKPLDERAVGGKGEHTPPLPDERQQEPEEPVSQRASRVAEQLFRKFLKFAENVGQHSEKAFKKAKVVAEKGFTAAKTHTVRGFKVAKEAAGRGMVTVGKKLANVESDRSTTTTQAPDSPNGLAETQAPVEPQQRAAHVPVPDFSQ

SEQ ID NO: 246 - protein, 220 aa, Toxoplasma gondii
MDRTICPFFIQSFTMSTALKRLIPFLVPFVVFLVAAALGGLAADQPGNHQALAEPVTGVGEAGVSPVNEAGESYSSATSGVQEATAPGAVLLEAIDAESDKVDNQAEGGERMKKVEEELSLLRRELYDRTDRPGLKRAVILSLGTSALIAGRMFSSTLRAAVPWYAVAFNAIVAAYYIRKVLTYRRRVMTKRQPFMSSVKNFFRRRPKDGGAGVDKASKK

SEQ ID NO: 247 - protein, 345 aa, Toxoplasma gondii
MQGTWFSLFVVVMVSHLAFGGECSFGSYLADMAGLTGREDKEHHAAKKRYYHSMYGNKTPYPYADGQQGSPPPQGQLLIIQNPDGSFMIVDQQGVPQAPQAAGGPGSPMNGGYYMPAGVYTAQVVPGTPGHPVQAIPQQPLRTQATATYYHPAAAPPPGPSVFVFTPSSVQPGAEVTPGYSGLQLRQQSQYDYSYPGTTSTPTPPRPASYGYPAFPAFPRLPAFSDSVSVSTEDSGLTVVRDSSSSESTVTPADEAASESEEGDKTSRKSKVKKGVLTGLGVAATLAAAAAAAKAVKGFGGTRTSTAPAEAGKTELDDGYRPPPFNPRPSPYAELLKDLERMRKE

SEQ ID NO: 248 - protein, 120 aa, Toxoplasma gondii
MASVKRVVVAVMIVNVLALIFVGVAGSTRDTGSGGDDSEGAWGGEQQQVQQHGQSEDRSLFERGRAAVTGHPVRTAVGLAAAVVAVVSLLRLLRRRRRRAIQEESKESATAEEEEVAEEE

SEQ ID NO: 249 - protein, 224 aa, Toxoplasma gondii
MAHGGIYLRQKRNFCPLTVSTVAVVFVVFMGVLVNSLGGVAVAADSGGVRQTPSETGSSGGQQEAVGTTEDYVNSSAMGGGQGDSLAEDDTTSDAAEGDVDPFPALANEGKSEARGPSLEERIEEQGTRRRYSSVQEPQAKVPSKRTQKRHRLIGAVVLAVSVAMLTAFFLRRTGRRSPQEPSGGGGGNDAGNNAGNGGNEGRGEGGEDDRRPLHPGSVNEFDF

SEQ ID NO: 250 - protein, 236 aa, Toxoplasma gondii
MARHAIFFALCVLGLVAAALPQFATAATASDDELMSRIRNSDFFDGQAPVDSLRPTNAGVDSKGTDDHLTTSMDKASVESQLPRREPLETEPDEQEEVHFRKRGVRSDAEVTDDNIYEEHTDRKVVPRKSEGKRSFKDLLKKLALPAVGMGASYFAADRILPELTEQQQTGEEPLTTGQNVSTVLGFAALAAAAAFLGMGLTRTYRHFSPRKNRSRQPALEQEVPESGKDGEDARQ

SEQ ID NO: 251 - protein, 269 aa, Toxoplasma gondii
MALPLRVSATVFVVFAVFGVARAMNGPLSYHPSSYGASYPNPSNPLHGMPKPENPVRPPPPGFHPSVIPNPPYPLGTPAGMPQPEVPPLQHPPPTGSPPAAAPQPPYPVGTPGMPQPEIPPVHRPPPPGFRPEVAPVPPYPVGTPTGMPQPEIPAVHHPFPYVTTTTTAAPRVLVYKIPYGGAAPPRAPPVPPRMGPSDISTHVRGAIRRQPATATTTTTTRNVLLRTAILAAAAATLIALFRQRPLFTEGVRMFPDFQYRFTVQTTQN

SEQ ID NO: 252 - protein, 318 aa, Toxoplasma gondii
MRSLKSIVVPLSAALVAAAELDLFLGESGVYLFGKASESDVALKVPEDPVPEEPRREPEKHVDLFGEDWKQFGGSGFGDFSKVEFENLFSQVHEMMRRLMGRGVDGFGPSLLGDSPGFHFPRLRALQPKTKLEKTGTCQYVVTWAPEVTAENVRVILHLQRRQVEVQYRAATRRDEKTEGGESHSMSKEQSSQLMSVDPQCIMTREVVAQKLAGWTDNTHTATAGTPKKLLISFPSPDHIKEMVKEGYLPDNALERVLAGDFEGFSRTQMCLVSGRNRTECAFAEGQEVELEEKPLPSDSSPVTSVELPRLSQEDRGL

SEQ ID NO: 253 - protein, 300 aa, Toxoplasma gondii
MKSGSCPFTFSPTLSHPLEIAWRARPLQWPEIERQPEPAAPCGALYPASRVLSFSPTMRAIRSVVGLPVMGAAVFLGLLSGELPNSSVLPVPEVASTPFLLSVAADGDGGKNYAEVAKVEALTNMISTPIELFVKDVWQQLFHKSGKPVWENMLFKFGSMIRHRAAHKATLVIMWELRHFLYGTAKVNPSAWKKLETKFETYLREWWMTVPEDPWAALHAGAWKSLLKLYNEDLEPLLRGSPKLKDLESILFDSKLATIRRWTDEAHIEVMKGRTSNMVPRLEALSAKMAVKQKAMQGKQ

SEQ ID NO: 254 - protein, 505 aa, Toxoplasma gondii
MYRNHSGIRLACRLFEVGALVLALENVSGIHRFVAGIEWNEGKEDFQYTTSPWVIPPDGLVSRRLAEEPPRKRLRKTNKSDRDSDSAQGSRTTSPGSLGGFGATGGRVAAPRIRSGVVASEAIRGTIWRRPGEVEGTLKLRRTRPQYSQTDGDGLQGNRLSSTGERSGISHGAQSLAMRPRTMGQTMKSLESSWDSDPLEGTSRDWLYVTTSETTASPGLTGFGGIGKKLAPLYVRDRKFDLLQFVNLTRSKKQKLLMSSKSPSLRKLLMNDMAQEWALGILQIVLQGRQRALQASHTTRTTEPASGTDGTSKSSEDEATRASEGNASVNQTSPAASYPRRPSSDEGQDSGRRKCSKRSPSRLVQNAPLFLKDDSHSLKDTLDLVKNKNRELTEKGRVHATPLRVVLLNSIMMKKLEKVLPVVESMDRALMARQTSSEAATVDDSSTSISHGMQGSTSSGAAAVQGPSTSVPGASGGLGPSGGKRKPDDEDDFDCSRAKRKNDQM

SEQ ID NO: 255 - protein, 413 aa, Toxoplasma gondii
MHSRNCVGGSFYDGAVCCSPPSRAFGNMHNLVLVLLAFLSSWEDNETRRGDVVEQQNPFRLAIHGKTERDRDGNCTQHGVRSNDFRFVDEGDMSAEVGRGLALQKHVRVPLQASIARRLSDRESEKRSQGSDNGNGTTPPLPPRRTPSPRPSGASGVVQQGAAGVGTPTMLGTGGQHLSDQGATGSVAPSVQSSSSSAVSVEGALPLIQFFGSRSSSPEVPLCHACHTVEAAVGVLQSIRHRRRAGAREAAERIAALESQHALLVSSSTQGEHSQGARPSDILVSHRALQRARREATRQEETLRGEEASLEAFIRVASEKREREGQRSLEVLRQRVENQTAELAVLRVEAALERQREMVELERRRGDLLALALVAEDDEEYLRLSAEEEAVQRQIEQLAEETRRPRRGRRKPA

SEQ ID NO: 256 - protein, 501 aa, Toxoplasma gondii
MERIVVLVSATFLYAVVGRASMASAEMASRTKRLYILISFHCVLSEILSGHAAAEATSKPARQPEGAGRSASPSPSLSHASGVVVGARRRRLAEGSPGEEPDPVRELLDLEEELENLHALRFKERLAFRQCVRHWGTFDAYCREHSRWKSKMAADPERMRDAFERKQARKQTACNVWAALLDAAREKIEAMDRERKQMQSRLTKEQTSLYLAAKAARGRAQIGGDSSHTAVGEAAVGASTRPPATGESPTPGDSGSLDALDNELARLRQVISLALGKWHRSRRALKDHLERRVPSTPPGVPSPERDRAGEARAVWEAQHLQLEQDAKQAREAVDKFRERLRELNAQKAAHEKAHGVSPGRRGCENAPVRFSRLGITVDAREAAIPWFQRPNFLTLSHRWSGAPPDPAARPPPRYRYTVFTAEVQHVSRPTLKPRSKHSRLRVADPTRETGAETKASTSTSGLAGPSEFQNERVHCALYGTDESVLDSSESLAKPCFVKWHG

SEQ ID NO: 257 - protein, 542 aa, Toxoplasma gondii [sequence omitted]

SEQ ID NO: 258 - protein, 315 aa, Toxoplasma gondii
MKRFWLCALLSLLEFSWGCNSLGPSLPSFQVAEGAFFGRLRNWFGKNAEQKPEVPVAPVADDDAGSEEESSSHYGVKTLTASTTTTTTTTTTTTVTSTKPEGVWEEEYDSMEVPYTPLPPLRGIGLLGGAIFVSLAFNLGKLPLLMGGIGVVQYINSVVQRMHARRAADAALRRFEDRRELVRARRRRRWIQTFYSHNALQQDRATRKGETQNEESNATLANSSTGKGDGGTAGSEAPPRGIHADAASERTWNTGGKKGSLHDSGLHAEGSDKRTNPSETREVPKTRLRKPTERNTKAQVKKKTPRENLPEFDRN

SEQ ID NO: 259 - protein, 1904 aa, Toxoplasma gondii
MKVRSVLSVGFWAAACVAFQTNPDLDNLCHDNSRNYEFRLLDSVFLTREGLWTSLRIVGTEAAAHSPTSTKEEQDPGSSNSPGEDTSGTQLPQGSTQCDWRKCGTREQVEKTIKEIEEEWGDESAFVTRKLQRRMSTPCRLKKHPCPKQRLTWEREIREEFRRVAPRHLERAATLRKALEQRPPSMSGSLGTQSTGGTLPQATPEDTSVSRMSATPGNAVEVELIGFAVGNDDTDIPVFRTPGPPGTTSAPSEPQAGIPATLGGKPAILILPTTSDASTGGRSISQSGTNLTQQASFQQPGGTASGPSTSSSVSTSQTALPPGNVRGAAGLGTSTPSTTNLHQASSKNSTVDPGASSSSGVSGVAQAFPGVLPGSVMHQALQRSGLLSQPPPSERPAASKRRRKRRGGEGDLASQGVGRTGVNQPVAVDPYDNTPSPKLRFSPLRTAEGAAGATKPPHLLASLPSSDPGMFSSTGSSPTGSSRLPSPQGSSSSTSLSLGTAHRNSQTTFPLKREPLPPGTLVEPVVPLVPFAANKNGRLETVLIPSAAVVATGGSSFPQSGTDATQQVGSQQPRRTASGPPTSSFVSASQTALPPGNVRGAAGPGAPPPPATHPHLAYSKRSTVDPEPSLSRSSRGVPQAFPNLQQQPQGNVVHQPLQQQPQGNVVHQPLQQQPQGSLVHQPLQQQPQGTVVHQPLQLQPQGSVVHQPLQQQTQGSLVHQPLQQQPQGNVAHQPLQQQPQGSVVHQPLQQQPQGSLVHQPLQMQPQGNVVHQPLQQQQQGSLVHHRPQHQPQGNVVHQPLQQQPQGSVVHQPLQQQPQGSLVHHRPQHQPQGNVVYQPLQQQPQGNVVHQPLQQQPQGSLVHQPLQHQAQGSVVYQPLQQQPQGNVVHQPLQQQPQGSVVYQPLQHQPQGALVHHRPQHQPQGNVVHQPLQQQPQGNFVHQPLQQQQQGSLVHHLHRRPQHQPQGNVVYQPLQQQPQGSVVHQPLQQQPQGSLVHQPLQQQPQGNVVYQPLQLQPQGSVVHQPLQQHPQGSLVHQPLQQHLQGSRVHQPLQQQPQGSVVHQPLQHQAQGSVVHQPLQQQPQGSLVHQPLQQQELLPPGVQPETSVSWKPALASADKGQQRSSGKMLMTLDIPGSSRRASERAYYAPSRDGALLFDQLFPEFPFEGTSMNHPQHYAGHDTANVGDSSQPKTAYSTGEVAGPASSFDFLSPTGWKRTIRSIETPHPGHGSQQPGGGGTVLPSYPQLKDFDLTLLSTPMPAPQWDTSTNAPSENVAAKTQAVPTRGDESGSVTSPYDQLFREAAAFNESMRSDEAPKSYLTSTSMHFQSAAPSSQNRPGSLQNKPSESGRTSGVSAVGHKAAAPHVKPSDREQNPFQLFVEPLPSAPKPTSAFAWPEAGTSFEPVTSAESMTVSGGSGKKQAKRSTSPVTASLEQSPFETVSVSSATELQAPSISEYGSPRTHLSSTPAVKGPSAGPVSSTSNEFGSLLAAALRDAGWSDGMTEDEATDFVLDSIKNLEELQVANEWDAASTETRPAAEGGTQHASFNLVSTLLGPDATPTPPGSRSTPPGGPTKKPSAMGRQKPSSRSTSDSKVEGRSSTRDSSLVAPSTSIGAAVRERSKTSSPGSSSPQSKQLTEESFSLGTKEDDSASMVEGDESQVQSSKATASATRRRAWQGQRLNIFGIQPETPGTQPVLQFMRESNRGSVSTAKSPDTPVTSAPGGSQGDSGNDGVGLVAGSSVLPSAVQGKSYASISGIPSHRESLSSSIQDVQPGGVRGAGRRTPNVRTPVSASPTTVFPFASEGLLKKTSKRQTPGLEGYTPSAKTRRETGTVLPSSLGEWQGLTLRTPMKSTSPGASEMQPLSSLVASTSRGALQPALPGSMSPSSSARPQSLRAPSRGSSSYSE

SEQ ID NO: 260 - protein, 865 aa, Toxoplasma gondii
MRPLRVAVALFWAMVAVVGFWASPDSRLTVRGPQFADAATRGVVKSLKRAMNQGWRNGAHSICAILGCDYEHVKAHLTHKPTFFHSFKAVCAQLDEFEEEVTHAKMREEDLTPSQREYRWLLLSKGAALINDALGTQFEVPASYVPHNAKNRHYIPGQRGEGDEKEKLKTRMRGLQVVVPLPTLEEIQKDGMDRLAAVREKHMAQIKELEDARHRKFLLLQEEHDRQTDQLVSELRLKHTEEMDTIRRELAEERRLFEQSVKVWDAVNRLLTDAHVGIETLTDRVHTMSQHVFKLNVFYEKLHSFQQTAKENPTGAAPYSALSYAFQSEAAVDQAMHQIVAIYQEASAGVARVQEILNQADGVMATAPTRDDAAWFQQRQRGYKDRLESFVNLLSDLSVRLEDYMQTAEERKLVTLFLGDEVRTQILALLQERTTEWSTRLATLRERTQGIETAANKFFESSTQLDRTTGEVVSAVLQNPEAFLVQVSTYATESGTLRSAAGVIEEDLKAVVKALQDLGREMTGLTEGVASAQLPPAVLDFLGLPGLFNALQVDMQVKAKGQQLLQLIKGRLSQTGEITRKLEMLKSEVKNIRSPAVREQAEWALTEASTKLQDVLRTKAEVELEIQQINLQLQQVQGTVTQLDQRIAHERVVAQRAAAGGSAAAGLRGGSLALGGSATGSMVGLGGSVSGLGTDSRAAIADLEQKRQNEKEKIQELRHNLSSKQRESVSLDNEARRLEVEVANKQRELAEEQQRVLRVATLAQALTTGASPSIGMSMASMRGGLGLTGGLAGSSAALMTQGIMGSRAAGLLGGSTAGLAGASMGGLAGGSMGGLGGAGMGGYGGGSMGGLGGRSTDGQLGRGTR

SEQ ID NO: 261 - protein, 637 aa, Toxoplasma gondii
MRHIFPDDSATSMRALVWGLGARVLWFFLAGVLAATVDIAGADGIGQGMPDSGFNHVDAEAQPTVFIREEHDDSASSELVEDDGTYSVARRFRLMVMADHKKDGRACERDMVLQAADITRLRVGGSRTSFSAGLVPLVGLPLLAAAGLKDYILGVNAPVDELRLPGARALTPHDVVDGVVSVGPGPPPRPDGETPRIVPFGGTQDKPFWKSKTFIGSGVALVAAIIAGLASSYRASKQERSRRGLLGGEQTAVWDLSDCILLVDVGQAQSRKSIFGTFVPGSARLIVDYRRQRARLLYEERPPLVGNLLFRLRRKSLNRFEDFQLNTPHCYFRPDFQPLAQKERTEVSTKKEDRHAPLPLTSGNLFFRELLDSKGKKTEGIAIHFVKNPGWVAPKEALPLAAAARSAASDLDFTLLMRRAAARNLVCSESVKGGSGGISMCWKSSPPTGSLLLWHEEVLQHSCRVVAAFRGSVNHSVWANFATQQLSIGSDAPSTRSDNVRSVLSKCLLLERNPPTYGVALKRATISCPDPATVPCGSILFRQKTDVGVLEGHSGASTSSRKPTEVASTVLQGKEEPGLVGAGAATQMDYRGNKETSKVIQSSVEFFTVFIVDFQRKPSDWPVLLEMRKKDAARTRT

SEQ ID NO: 262 - protein, 526 aa, Toxoplasma gondii
MEVRHRSVQLFWVVGLLGFLIYVVSLHGSPVNAAVVAESESEAGDTALVLHDTEVMSSGGTSRPQKLVKRVQGFLRRYSAPIRVTVSAIIIFLLGYYAFQYGLRRRPQDGSRRGRQPPDEDRQRGSSPETAPERGTGESDSSGSRSPERFPLGSPPASPDQADDGDGSKKYRVDASSLLGTRSDLTRPSGSSDEASQVHGRQGLDVSASRSPPSPASGGKPVEGPLHSTPATGSPSETVLVPADTQSPCCGAKGSLPKETSPTRDIGTHVPGKRSPPSPSPLQGPRLASFFVGSESGPEGDVVIIHSGGPSSSSGSSGLGDSSVSPSDGDSPTPSAPARGMQQEGPVGGSSSPEQGGRQAQAPISTTTASSPQTGVPPGKAAPTSRSDGKPPPGRTGVDKVGGPSRGRGSPSRSPGTRLSLSKTPRGPVASPTGGLRGRGGSHAASAGRGPLPGPPGKPEQRPGVLGPRTKPFTPKPSWVPPYGTPSSRRVGSRTREPPQSQEQHPQAPSGEGTRDLDGRDQDDSR

SEQ ID NO: 263 - protein, 683 aa, Toxoplasma gondii
MSAQGQQGVRSTVAAGKNRFWQPAPITVLLVLSSSFLFAFAANTPQNSSTTGQSTPSDDHGVSTEHIHDAVTVDAAEHAGEDEMTACSPEAARVIEARVATLKAETEAAVAEVRRTEAMQRELFGRLNAKVRAMNDRLDELSDAQKSLAKRLETTGQLLIADREEQAKRFTTDVETYIIESGLKKAVFQQREIAAKLQTLAESNQKSKQALDALLQHVDDEKEQTKQWISTVVRDLEKYVEARTQTTLESLQRDAQEHANFMQQQLNDMKLDHLLLLQAVSSAETQLNERGIAGVDISQLDESASFERMMTTFEKVLKEQLKGKFVLPIFVVTQCPDSMERVAFMNTYLVPSKRNFRAVFQALGHTPQASAVVIRIESVMVEAWMEVNGKVTGMQYLTPPAHEALTVTTKDRFGFEFLRRVRELETGDFKADPHGRSVVIAFVGNRKGRIGGLPLTDVTEFNKFQALRTLATMHSSPIKETNNLWQIMKTEVDIVATFAAMPRVEVGGSSLRIYQGIAPEPRLPASPFCRNAFTLIRIEVAKSPRGKQEYVYPKASLLKKVFDILVSTNTSQDSGGDGSFAVIRANVSNAGWLQSKLYATADRMAVEIHRPVPGTAPPSFSSEDVAGEHRANSMAAVVDQIRKQMTDVVLPNIDPEDSTSRRQVLVHICEIGVTCNSDRHPEA

SEQ ID NO: 264 - protein, 378 aa, Toxoplasma gondii
MRHQERFDLRTGVLLCIGLVGWSGFVVQHCACSDGVFSVQSPSAPQHDILWDARKTQDELRAFNGESSGELAKGAGIRATEGEVFAGGRAAAGVISAEIPAEEGGEAAANPTSEREIEAPAAEDEAEAEISDASGGVAVTSPAAEEERLSARSASRPSGRRTGPDGVPSTRGLVFTAGGSILAAAVMMLLSRLSRQRSIQVWTVWREERQSLGLSVASDALVVASALVALLGGKRVVKGVMRKREATRRRRRDEIPGVEMPAKRKRRRSEAEGARATEGVKVSELVEDETPSHVSAPTEPGRTAIAATAVTGAAALAGSVALVLGSRRWFRYYHQVEEESRRLVAAGALFTGALFAAYKLFKQVRAKLAARRKKSTKA

SEQ ID NO: 265 - protein, 378 aa, Toxoplasma gondii
MYPLTVYSILAVVGLSLVCRGIATEQVVAAAAKSNSEETVSTGIGESAEASPVNRPRPKPPSGDAKRANSVAVANTIIPRYGEASVDDTQRRGLARVTPRPRLRKSQRRSSSLSRRQRLLYKVGAVIIAVVGAAIAFKTWYSKRQYELRERAFCYTRGRADVAQALVDGLLTERHKVNILINRARQEESEAKGTAEHRELVKVREALEDFDVLLEKQRQNAEAQWSELSAAAAEIGNKIDVRTLVRTDPDKAQASEEGRLYQAKHFWQQLQPEEEALRGQLLPDVVRLEGEVREARDRDLPSLSMLYQQLEQANRRRVVSTVDDQLERLNRQLPHMVGMDPDYAEEHILYTQLPLRGPAYVRMSEDVLRQVQAEPKQT

SEQ ID NO: 266 - protein, 452 aa, Toxoplasma gondii
MHSIVYVVVSVLAVLGRVDGQPLGSRKAKPGAGSAPGPSVLPSSLPHIIMQSPTKNPRKQRKHSMASGDAGAKTATVAEEAAKAVGVRGDTPGDQASARGPDEKEKRETAARTKQNKSTATANKPGETKDPSTPLAGAEGRKPEFSNGQENVVDESDTRGWRDGSRSLIGTENPGKAKTRRLTRPACRRLRYAIGLAIGTVLALLSFYGYRRYRDAEIRAERNRNASAYFYLTGRRNAAVSLAQQLRHEMDRVSEAIRFHEHEQERYERARFDEDAKAAMETTAALEDVLEYFTEKRKEVETLSVRLAAAADMVGADITRQDMRRLTPEQQLQIVRQGRFDEARSLLESTSREANLLRELYVPGIVEAEEEVERAEPGSEELFRRRRDLREKKETRLGSAVDHHLARVVREIPFSVGIPEEQAAQLRAPPGIEPVPEHVLVAMQAIERAQRT

SEQ ID NO: 267 - protein, 218 aa, Toxoplasma gondii
MYTERSSLSAAVVMEKEGVTPSQCYAIPPEREDAMTLVTQMFWRWTIAFLALIYVVATQANASRPATVRKQSNDADGEGEVDTGVAGRQTSMPTTHIGGLAGRGHRGKQTRKQYIHLDALNEDVEPEIKEPSLRPLSQKATRRAKWSRLLLELLPAAVFVSLLITMMSRARPVTRVHETVTNFLYRQGVDVSRQLQELRDERQREIEAEFVDIPPDLE

SEQ ID NO: 268 - protein, 1086 aa, Toxoplasma gondii
MAILRLSFVFSLSLLIALYSVWQHMLHARASKPAVLRKLPGASELLRSLSGSSISAWRRVRAVFHETLVLTDVDDTLWSSGAWRLGGKTLGGVDEDLSRGQTYPGIGALYFLLSAGPHVTAAPVNKFLPTCPVPLVSPLFETCQVGDARRSLAGATGRVTDTWVFGGGERAKELQDSRRKPAEKRPLLPPRVGLLTARASSAAMRSFTRSPSFYAAVTAALIHGARQIYGPGVDDWGRVRFENNMELLRDVIGGQHSRGRGKVSGFKEALERFPKQTPVFVGDSGERDVEAAAGMALFAQEKLAAVFVHVVFSNWENENPDEIEQAIAAPRATPFNLRFNNRRIPALQLAYDVQANLHPSDPKPESFAALSDTHLYSAGMRVASVMKPLMIAYGHQSRRQRAKPTERHDRRTNKDEEGIGDIVALPIFFLKFRDLTVKRSMSVRRQTTSNPFRKLYSHLSTGLKNSVSKVVDLWAEEEQLRSYTDLRTVPADELGVSSDPGVPFIPYRTALGAGISAFILEMITFQDLINLAVSSIRDFRSLGPPQSCAQQQGLEDLYFDLRYMLEVTGEALQSVHVENRAIFEDGVAAMRTFHTKAVDACIPSGPAEPWTVGEEIGACLALFRTPRAAASPPRDPTDSLPEAAGLGDIPHAVLPLARVVCTFVDQLKHWRSAGADETEVLSLEFSVALNEAVDMSNRPFGIGGQPVTSLANLSGDSTSREVPRPSGTLRMESLPMSPLRDADVASVFPRSLRSRPTSGTVNLSLPIPPGSPGNSSFPQVSLTGQPGDEADARPSGRGNESNFVSSSGFSPLSATSPASDPAPMSPDRAHLYWTKEAERQNVERRSSGAIATSTQAPAASRDLPDSLQIEGTVDSPSSFQSRGASADRQRPQGRIEDGAFASPFLPGLSTTAGPSGQGRTSVDLVRSGALSSRLNAASGAALGDVISAAPSDCPFGGLRKLLATMRPICEHQKKLLGDASPCALMSHLLYEEGLMHIFATVTAWYEDGAREPLYITKMHLTLDPAEAKLETLRKRESDNFAHLGMGVLKRGRGHSTYDIDRLQANHREFARSYPGFKNLSCNPFEA

SEQ ID NO: 269 - protein, 921 aa, Toxoplasma gondii
MESNRRRAPCPPASGVSPGSILCLFLLSLLPCALGASQKNSAELLDSLACVGSPPETAENATASLGSWEQVPCLDAASVSVFTSRKEVQAGNILLFLDIDDTVIASGGWNEVMGNSLGGVDDRYPRGSEYPGFSAVLFLLALGPHARNLKSGQLTEFAPPSKAMVVTARPNLPVFRPPNLMRHLTSILTRGARQIMGDNAPEWGVGSQNVMKPASVLRGTYGRGENKLSFMTKVLTEGRPVNESRIDENTKVMFVGDSAERDLEVAIGLSAMVPDKVAAHLLHVVYRHNSGDPTQMHASHTVQTGEKFDEDGVLSKAAVTLQEIISGAARTVAAATRALTEKDEREKHRQTPRAFTESQPTNKKISFQEALGNTTRFGIRVGHALVDAIALVYDVYVTSDDEEGPRSCAELSASQAFEVGVLTARKIRLILDLYRHRWLHTYSTFRTREEQEAAGASVSSRMLPIFFVKCGTVKLRVAHEAPRQAPLDVLLSEMTGARDRVTVRFRSVDTLHAGSELDAETVRSNMLDTLGIPVVPYVTSISAVAQAYVLGIVDLTDVLVVVRKTYEMLRAQGPLAQPARLLSLLDHFHDLEALRAMLFPGGKGALPASAPVRVRATVDYLDELGKVQKAFIKRAAYLRAVPTRTEMCIREMERNAESHYDRSLKRQRGAAGKSAPFTRSQFSAFVSAFAELVCKFDVELSSVQFAGGAEVHGLSVYLSRLVRQAVAATETTPFSSAQKKKAPPESPVSKAVAELAATNAGTEKEKKDPKNMGRGKTACTLSDDVRVTFATMYKAFCADVARDVCHLLETRLVTSGVLSDFIFLAQERGRKYQGPLRLPHLGRVVFIDEHGLDDFEVSHQKPLTDVIGSMGAKLDEAIMEQASAGFRFAKWPGLDSWNQWTQVAASLQLIVDCGLLNRGTQ

SEQ ID NO: 270 - protein, 966 aa, Toxoplasma gondii
MRFPPASCHSASRKEEKPSRDAEMQPRLIRTVLATPGSAPNSAPLRPRIRRPSFSFFPRFSNSFASARCLLFFSLLLFVALPPAFAAVRSNTGTSREAGEVDNAQPAADPEVSRAPPALAQPKVSFRGWKHGLSNRITPIVQVEDVLVSSGGIRRHGDAVYGEDARLRLGEPYPGTAALVNLLSRGPFPAGKTPRSSMTRPMVTAPLFVTLPFLLSAFVPACRPGECRRNHAQRRRVEGEGAEAAEAEDKTEDQAREAEVARTREVELELVQLIVKKDLNDAVNKTTREASSTWQAGAWWSDLPPSVDPSKTTPQQAATHVVQLLQGAAHALGPSNSFVYFFSTSTPRGLLDACASTFLDRNIGVFLHVPSLSAEDTVSLPHEAFVFPLATLGRSRPTPIPAVVLTYDVTARQTVTVDRPTPSLGDVSPELLGKLATQLQPRLLRVLKFFGQEPRAHGPLPVIFVRFRNVEIQQIVDPWHGHPSRYLQLQREGKAPASNNFARLTPVPPEEASGKGHAFDPEKHLQHAVPIMTYRTTVSAAAQAHVMNLISSADFAELAILTVKDLRGRGPLFQPATHEYVSALKSDWKVYVTLAKTPNLIEDKQLAETHELILRANEDFSAERMHCIKKYVLTMSQEDPLFDFTKTFCYNFPEVRYPSSAGGSEFVANAVTAGLALRELFNFTVWPSRSRQENEDEAQASGLSAASQHVRGVRLPSPHPPMRKEDRPASRAEEARRAVLERPLSGSLLQASQLEGQTSGDADENAESRLAKNQEVVEEGARSVDSEKEGQGLEAGSHGQSEHAEVGGREETHSEEGKGAAKAVREEENLNKHQHAGTVATFHGTIPEAFAQKMQENFGPRWISLLQLLGSVSLTNDYLRVLSWLASEADSDAMTLPARRLLVRRDAEVSLSLSAALRHHVAVFYENQVEGNLSHPVVHKHERQYKVAEEGLRRFLRDLVSYSSKK

SEQ ID NO: 271 - protein, 186 aa, Toxoplasma gondii
MMLIALVCMLVHRLDLGAAVSQDGRDLFVGLPKGAPLGPTFIGLTTPRPPLSSLSALQTFGADQRLDRPGDSPGYYVEAKQFYRVPPTRSSATRNKGTSALKVAAALALLAVLGTEVADYVDRQHEGEVTDLEYDRRMQTTRTALGVTRLASLVLATFGGVRFMLDKASKWMKARKVEDSEKSERR

SEQ ID NO: 272 - protein, 330 aa, Toxoplasma gondii
MNTGCLFLPATRHAAIQTICVVALARQVADPDALVFERDFLEFIRILSSTQTVFSSFGCPRSHVALLAQSVERVREANAVGLFSEFARRLGFPTSGDDAGCSCAFFVFTGRAMVWRVSIGCAVLATVLVAGHEPVASAPYKAYGIPAESTDTTSGDDVEEAFRKRSRGNVLKDAAKEEKKLPLFFIDVEDNKGQGRNSEKGATDDDVAVDKTKRSSPSAPCTRLAGKEKKYPCDRYVVKGKMSFLEAIGAFFLASVIHAAVSEQLRARSTGGDIWRPRLAGSVMQAALAATTLWMALRRRLPTFYLLQRRESSEEKKKAKENSTRAASAV

SEQ ID NO: 273 - protein, 219 aa, Toxoplasma gondii
MTRGFAFCLLFLALFGLFSVAPHSIEAGETPEETEAVVAATEQGAAEVDEATDEHEEDDDDDHRADFESLLQMMSKDMHMDLANNNMAGVAKVLKELTDHIDAAHKHDPEAHEHKHPLLKKILTKRTHDKMVTTLQKIYSNVPREEINDQLQAVMSLLEHVKQDPNMSPKQLLEKTAHQLGMPLTPDMYEDMQKHMGWAAKLFQYIAPGGLDEEKAEEL

SEQ ID NO: 274 - protein, 203 aa, Toxoplasma gondii
MWLPVYVPLLLVFGVSLSLPQGSLGTDSSSLRGVDADTEKRINVGKKHLQTLRNLETRCHDSLQALVVIDAGSSSTRTNVFLAKTRSCPNKGRSIDPDSIQLIGAGKRFAGLRVVLEEWLDTYAGKDWESRPVDARLLFQYVPQMHEGAKKLMQLLEEDTVAILDSQLNEKQKVQVKALGIPSMLCSTAGVRDFHEWYRDALF

SEQ ID NO: 275 - protein, 333 aa, Toxoplasma gondii
MWLPVHVPLLLVFGVSLSLPHGSLGTDSSSLRGVDADTEKRINVGKTHLQTLRNLETRCHDSLQALVVIDAGSSSTRTNVFLAKTRSCPNRGRSIDPDSIRLIREGKRFTGLRVVLEEWLDTYAGKDWESRPVDARLLFQYVPQMHEGAKKLMQLLEEDTVAILDSQLNEEQKVQVKALGIPVMLCSTAGVRDFHEWYRDALFVLLRHLINNPSPAHGYKFFTNPFWTRPITGAEEGLFAFITLNHLSRRLGEDPARCMIDEYGVKHCRNDLAGVVEVGGASAQIVFPLQEGTVLPSSVRAVNLQRERLLPERYPSADVVSVSFMQLGRPVRR

SEQ ID NO: 276 - protein, 439 aa, Toxoplasma gondii
MTATPAGTLVRLYSSLVSGQHKSADGDCNFAFSPYAVSAVLAGLYFGARGTSREQLENHYFDGRSAADAAACLNEAIPAVSQKEEGVDPDIQSSVVLQAANRLYASKELMEAFLPQFREFRETLEKALHTEALLANFKTNSNGEREKINEWVCSVTKRKIVDLLPPAAVTPETTLLLVGTLYFKGPWLKPFVPCECSSLSKFYRQGPSGATISQEGIRFMESTQVCSGALRYGFKHTDRPGFGLTLLEVPYIDIQSSMVFFMPDKPTDLAELEMMWREQPDLLNDLVQGMADSSGTELQDVELTIRLPYLKVSGDTISLTSALESLGVTDVFGSSADLSGINGGRNLFVSDVFHRCLVEIDEEGTDAAAGAAAGVACVSLPFVREHKVINIDRSFLFQTRKLKCVQGLRAGNSPAMRKDDDILFVGRVVDVGVLQSGGE

SEQ ID NO: 277 - protein, 318 aa, Toxoplasma gondii
MGKNPLLFLAGVLVCSFSVAVFASPETKVCSCPRNLELNCGGDHVTYANHCIRECHGVGLLHDGPCADQEDQGSSVNEPSEVADTTEQPSITPSGEEDRPPKDAPKERKRLRGCACTRELRLNCGVDGVTYSNHCVRKCERVKLLHEGPCRGGPGRTLFSQQDDESENDALEEEEQRLQRTQSSHQHDDAENGARAEHEQRLKGCPCPLNLMLNCGVDGVTYDNHCLRRCRRVELKHEGPCEADEQKQLPVQHGDNEIDVPERRIEDLKDCACPLILTPNCGTDRKTYPNNCVRECAGVKLLHEGPCEGDTEEIWDDQ

SEQ ID NO: 278 - protein, 87 aa, Toxoplasma gondii
MPLPQAPEELEQAPASHPEEAEQEVPERKTDAGSEPEKDPETNLQASETQPQEQVRSQPGRSDGKCTDKRDEVDLDVLEAEMLEKAP

SEQ ID NO: 279 - protein, 383 aa, Toxoplasma gondii
MDVRYQTRGAVAAVYVLFRTVVGAVLGLHCLKIVSAEVGLTHGIMSTEFEVELRGHNWVIDSGACLLGQPRNLVVDPVLDSEFMTPQKLLTDRTGPELCSWLEKIHRQHMEQKPAWLAAYQKFEKRFFLLRLLGMVGKPITFFPEFTVRIIVKHFSLWGDDRWGNAQPWIAATFEYAHPEGAGGELFLHIEKVFSMEFSGRVAKLVHILLNPSATFNQYVELHRRKSSGVPGDSGVSGIRRTLYERDLNISHFPTADTSQISHSLAPDILTLRFAKQDFWMEDGSCYILSRFVATSSIRGKTLCKIVSDYGHRESWMPFVGSRKKTVALAVTAADFFNTRRPSLVAHIKEGVKLEALDKTPVVLELVTDPVILRSYVEAARKA

SEQ ID NO: 280 - protein, 224 aa, Toxoplasma gondii
MATTHLNKSVIAGGSIKTIKALKKYWNSPVSDIDDNSSEAKYTMLQMAILLNKKNVVEYLISQKDVDLTTRATDGTTALMTAVGKNVPVDWIRAMLERGAADNINVEDNEGHTALDRCEKDSEVYKLLVQHGAQPRPSPPPTPPPEPDVAGGAGSTDTNAAGQNGASKPVDGITGVGGMSPGLDEHPGIWATMCGCGGRQGKNGTEVVEVVDAGKAELNPAQAS

SEQ ID NO: 281 - protein, 553 aa, Toxoplasma gondii
MTTQTTTKGSSRISRCTVALVFALSACATDALNIGNHAHQTRLASGKTSAKGDANPWAKILERYNVPLVHGSGVYVDLGNTKILSKKKYREPGGKCPNYGKYIKTYQPTTNPEIWPNDFLKPVPYANTPQDTMPLGGGFAMPMHQISPVSLKDLKDEAEGLKTATGVSSYAVEHAKNIRDDLGHCIWWARMTSAHDTSSSATNSKEDYYRYAFVWDPKKEMCHIMYLNMQEMTGAGTYCKRGDSGPNLTWYCFHPEKSIEKNLVWGSAYARLDHASACPEHGLKNVHWGQWNGRSCQKMAVRKRISVGSATECAMELFNNSPSDNPTQYVGDEGRGWDKILDDVVGVLIPAGSTKKDQPHTRGVGINWANFYKKPSGSYCEMYDGVPNCLTSAPEQYAFVSLGDPNPDNAQLPPCSSATEGVVIPSHCSCPEGETSGSSSGVKCEDGKWVEGHVSCTCSLDEDTSVNIWLIAGPCIAAGVLLLGGLIYWMAQRNKREPAVEKPQIVDETREHAVRTRQNQADLLQEAEPSFWGEADNYGTSVILDSANIDKDF

SEQ ID NO: 282 - protein, 569 aa, Toxoplasma gondii
MICSIMGGLRSLRAARPYSHQSNTETKHMGLVGVASLLVLVADCTIFASGLSSSTRSRESQTLSASTSGNPFQANVEMKTFMERFNLTHHHQSGIYVDLGQDKEVDGTLYREPAGLCPIWGKHIELQQPDRPPYRNNFLEDVPTEKEYKQSGNPLPGGFNLNFVTPSGQRISPFPMELLEKNSNIKASTDLGRCAEFAFKTVAMDKNNKATKYRYPFVYDSKKRLCHILYVSMQLMEGKKYCSVKGEPPDLTWYCFKPRKSVTENHHLIYGSAYVGENPDAFISKCPNQALRGYRFGVWKKGRCLDYTELTDTVIERVESKAQCWVKTFENDGVASDQPHTYPLTSQASWNDWWPLHQSDQPHSGGVGRNYGFYYVDTTGEGKCALSDQVPDCLVSDSAAVSYTAAGSLSEETPNFIIPSNPSVTPPTPETALQCTADKFPDSFGACDVQACKRQKTSCVGGQIQSTSVDCTADEQNECGSNTALIAGLAVGGVLLLALLGGGCYFAKRLDRNKGVQAAHHEHEFQSDRGARKKRPSDLMQEAEPSFWDEAEENIEQDGETHVMVEGDY

SEQ ID NO: 283 - protein, 714 aa, Toxoplasma gondii
MCPRVSVDAVTVLGTALLLCLEGTRLSSIVPPSSVPFALPAQCLNANQRLQQGVMARAWSATQSDDDESPAPIFPESDCTYPADNNFEKIITTAHLTTFLENASQGFSYKGMTHSSEAAAQIHKDLSCAIQADSRFASFCNSSDKYSYEENAFVNVSECAAFLAHVFVHTNSFTQFEETSNNRECRESEKYPCGPSTASYHGRGPLMIRGNDDYGRLGEYLFDDAEKLLLHPRLIEPQGISGWVAALWKWMEQRPYGLNCPETFVGSGKASCHDAILNQDVSPEVTMEALTDNDREKLTKGVSGFGLTINILAGEAVACCPSALKDALAAVPKPVLLPSAAVPGVIGVAESEAATRARADLLLKLAERGGLGAGALTPEELKKILAPNGARQGGAAQTLEPSEELESPDSGDADEESRPGEQKPNPHAALGAEQRQQQLFDQIMSAPPPPADGIPVQPRGDGFLQTQALALPSTLTRFVVPSKGIFPSGSSASQNPLSSAAATSAFLSFLAHLLYPHPTPSGTENTVPLPSGTVPPTPFPLPGDANRLCTTRGVLSARAAESNAANTDAAGAATAADTFCLSVVRGCPVMFPPSAVEINADQGDEDTVNLVKAAASGNAAAVIGPDGEKCNFVCVDASNNSAQSATNGAVSTDAHAAEDDALAAKSHAEAVANLKTEEFELKSFEYLPKSGVVCGYTCVSHHDETEGGTVFEGA

SEQ ID NO: 284 - protein, 877 aa, Toxoplasma gondii
MKPSSLRILLVAWTIISDAELNHFSSQAPLSWPRCVVVSAADDAQRDRGDTTAASSSRDEELEAAGPADEAKKAAGENARECAGTCNEPPDGSVHVRSSDGSEYLDEQPGDGAGQIVEQPRSDEAEGSESQASVGGRYYEQEASDGKRHDEEEPPDRRGYVEKAAVSDDGDAVRPTVVEGEDQELLLKPIGKGKACERVIVSRIRDGGVKRGKKMGFNAVGINMPMWSCYGMSVSEAGSGFPRDWMASLSRRNILNVVNEEALLRKAKNRIGIELAWESGEGGEKPYMKCEEGGLYVPVIVTNVEDQEPYRVELSPTKFWSAASSRTGRLYVIPEQEASVTEGDKEDEKSVYIIPMEALEGHVFLPHGYLKGHYSEMPNELNHAREFEVNKLSVDDFLTRGQRVTLVCTAPGEPARIVPTVDAAPRTLQVSRRKDKREGEIRGQTPPKENAAADAAIQEADGNKLSRDRVTPQGLTEQESRTVGKTEETDTAASRSAELTGATRGLVLMFLTEEDGLGFELPLPVLVDRVLFMVKQTQEAAPLHLLAYLTVRPCKRPIHDPIFGQSYEPVQETTVKNRMGGGGEGSGKESGGFFGFFKQQTQKPKDFEAQESREDMSKRCRPKRVLPVELIGTEALQSPTLLNAMLEQIESRLKSDTQCIVAAAPATPKSDSPNRPRLRARLVCPSLEHLFILLREKDASDREYNAFKRTKNRQMIKGAVVGLFGLFLAYRGLVGLTRNPMMARELFAHVIGREHVGNQPYHFFPSERQLYRFVGLRSLGRALQFRRYNEAMGNAGVRAQVGISLWTVSLLALTALLAIRLGRGTRHFVRNRKRVSNIKGELQRRPIIHEEQAPVPELEEAEDECSTVDVTYLSFLY

SEQ ID NO: 285 - protein, 290 aa, Toxoplasma gondii
MSSHDLRLCRPRRQSKGSRQSPAFSAGRLCSSWGSLCVCRRVPRTKLGGSPAPRTAGIHRDSKCCATAMMPFPKRSLSLVCLLFCVVTAAGTLPRQPVADAFRLENQGVQDSHANSDAMQPSLGSATNHKATGTTSFVSVNENEEGMSQKAIIVFVVAISAMVICIGVVLVMWWMSSEREKKRRHVARDAERAPGLFFSEDEGPMSSDEKSAPKKPAGGNSPNTRDAGESISRERQIIEEDLGKVLVVDPVSGVMRSRQKWQRNGNSVPDKRMLAGTERTCRTGQQKFKK

SEQ ID NO: 286 - protein, 698 aa, Toxoplasma gondii
MSFTHAPLLDTDACLEFLNALEYGKAHPVHELQDCATAEYVWGALHEIYPAWFDESLHPSKFPNAQEALSQILYYLDEFHENKYSGDFSVITGHLDAFLKGDPSLILKTHEFILLAAVNGDSQQIIAKIMAMSQPTQEIIQAIIQQYADADNGSSNDTPTNFSRMASEAAAARREPSIADDLGLGRSSSAVGGHLAPVLQKVQDELSQIKAELRKTKNALTESESQRETLSDKLQLAEKEREEEKTKRMVLEQQLSAKKDVLVKDFTEQIEDSDKQRAKLKEELENEKKERKKADEKNRAVVAELKEEMDLLKQEARRVSTLEVQVQNYKTKLTEMAALKEKMTQLELQNKAYMDRIVEGEADSVGALGLRKQIDSYKERVADVEERLSSMTAEKEALSNLKEEVEKQLSAAEKKLEVKELEVAQLEAKIEAKDFEISSLNDKIKELDKNKGRDIAEELANMAKKNKADGVDTAARIAELSNEVDDLKRVKQRLEKNAAAYVAQIAFLQKELTVGCASAADAQKLQDLVEKTAKQEEEIKQLRESKDDMAKQMMEALSKHEKGSGGDETSAAKVAMLETQLEFEKKQASMREDIVRAKVEKEMENVHSTLKNQLQLRERESNFYRKAVEENAESSKKEMKLLSSVLYDLGLRFHRLQAYCDQLKNENEAIQLRVRLHQQSNASMADSIATDSVTPREA

SEQ ID NO: 287 - protein, 351 aa, Toxoplasma gondii
MFGELCVELAFPFLRQAVSVMFSRASLGRPGVPRLPGRPVCLLLFASLCSCLVQKCTFLPVSAFRRSEGNLSRGLSAEQHIRNKSGRRQLSEIDGGNHFDVEPASFLGLLGESPEDADSSSTKAEDSDSEGGTSPAATEDQNGNESDSQQSESSGAVEKRTAAKEAPEAQPEKQEEPSKNEAQEAKGTAAAASRQDDTVIGEGKNPEELTDDDFKQMSTSQGLSILFSQGKGMMQEVQHTLDGVNAVVSITELMGKVREDIRKDVEALNHTVTEEYQNIEQLRQLQDAQTAVLRSQLNYLIPLNRQEAAALPEMPGEVLQSGSSSLSFYSLFGSVCAAVVSVLLSAAHVSS

SEQ ID NO: 288 - protein, 330 aa, Toxoplasma gondii
MKLAAVSSAAFAAAFFPAVVNARKVGNPAAQPSVLVNEPVALAQLSTFLELVEVPCNSVHVQGVMTPNQMVKVTGAGWDNGVLEFYVTRPTKTGGDTSRSHLASIMCYSKDIDGVPSDKAGKCFLKNFSGEDSSEIDEKEVSLPIKSHNDAFMFVCSSNDGSALQCDVFALDNTNSSDGWKVNTVDLGVSVSPDLAFGLTADGVKVKKLYASSGLTAINDDPSLGCKAPPHSPPAGEEPSLPSPENSGSATPAEESPSESESVPSLPLSQIPSEVPLSQESPVPPQDGENPDSPQNEDNSMQEVENSASQSDIEAQRQAENGRLPSDDEA

SEQ ID NO: 289 - protein, 376 aa, Toxoplasma gondii
MHTKMTDGAKLYRRSMTTATTTGFFLLACWFLPSSCIQGSEALSTTATTQPISNVTRYPEQHTVARSAADVAKALAEKVAREAMKNAYNDVFRNWTGIAHPDFHNGDAETCKIVLSFDVAKKKNAMGSVTKILSVTVNNARGQLTVKYLERPNVRNATNVRRASSWVRRKLALETADEVVSVTETIDVPQACIADNHSRYFVVTRRKNVIDTRVFAVVIELELHPGPYLVPRDISRIAELDRILKEHERETFTEGKWVTLPGCMMLIRVRETLKRAPRLTIDAYRGSVQFREDELKSLGSQALPQGCTWDGPSAVGVVTRHDRSADANLWDVLLFMADAPSHVQFEYTLPKEADVERNSDLSSGFASGPGEQDDNI

SEQ ID NO: 290 - protein, 456 aa, Toxoplasma gondii
MGQALFLTVLLPVLFGVGPEAYGEASHSHSPASGRYIQQMLDQRCQEIAAELCQGGLRKMCVPSSRIVARNAVGITHQNTLEWRCFDTASLLESNQENNGVNCVDDCGHTIPCPGGVHRQNSNHATRHEILSKLVEEGVQRFCSPYQASANKYCNDKFPGTIARRSKGFGNNVEVAWRCYEKASLLYSVYAECASNCGTTWYCPGGRRGTSTELDKRHYTEEEGIRQAIGSVDSPCSEVEVCLPKDENPPVCLDESGQISRTGGGPPSQPPEMQQPADRSDERGGGKEQSPGGEAQPDHPTKGGNIDLPEKSTSPEKTPKTEIHGDSTKATLEEGQQLTLTFISTKLDVAVGSCHSLVANFLDGFLKFQTGSNSAFDVVEVEEPAGPAVLTIGLGHKGRLAVVLDYTRLNAALGSAAYVVEDSGCSSSEEVSFQGVGSGATLVVTTLGESPTAVSA

SEQ ID NO: 291 - protein, 198 aa, Toxoplasma gondii
MALSSLNNIRPFSGLLGCGLLFGALVVVVACVFSVPVEAGVLRKVAGAGSLQASIGEHDFFNDYDQDEEYRKRQQELQNQSPEEVEEAKRKYHEELRRKAEEDAETKRKQEAVIQELKEVAKKRGLREAAEREEKRIDEQQANYEQRQQELRDMDSAMEERLMQQRKKDQEERELARKNSDKVMEELKEKLARRRKSM

SEQ ID NO: 292 - protein, 204 aa, Toxoplasma gondii
MQLKKLSVVSITLLGLFKFVNGVSEGVVVPVRFGSETARADLLNQVSETVFSLVETTEDDKSAASIVRGAFRSALKEILVAVKGEVQQTCEELADLAARKIHEAEERGEGRLDKEEAVDDESDFSFLDSPKTSEASIRPHGFLQERKFVDTLKTLAKGALKTFVEPMKAALVDGIRPMLPKIKEVAIDVFRQACEHAEEKLQDA

SEQ ID NO: 293 - protein, 2182 aa, Toxoplasma gondii
MAILRSGIAVATLCVALGFTSQRGVVAETCPARFTAWTYCGGQNAMQERHNVACANIVESRECEKPQSCGDFTEWVPSVANCREGQMQQRHREGCENHVERRMCTSPECVGKWTEWTYCNSKGIQQRHNASCHVVEIRGCGDVPEGCGEFGPWSPPLDDFNNCKHGVVYRRKREGCDLEEVRMCPKFDCSACSPNADCNKADSVCTCREGYEGDGLTCEPVNPCKNHNCSEHAVCFADGLQAKCRCEKGYDGKEGAGTQDDPCIDRDECATNTHQCPAHSTCRNTEGSYDCDCKTGYAMSETGSCEDVNECATENSCPENSSCVNTAGSFECVCNEGFRMNAETQQCEDIDECAEEGGCSANATCTNSVGSYSCSCPEGYKGEGTRDSPCNKIDYCGEGLHDCGEHATCRNEAVGFTCICDAGYTGLGKVSSPCVDIDECDREHPTHDCDSNATCTNTEGSFTCACNTGYTGEGRGADTCTEIDECADGTANCAAEATCTNTPGSFKCTCLEGYSGDGFTCSDNDECQQEPAPCHQSATCQNTPGSFTCACNAGFRGDGHTCGDIDECAEDPNACGAHAVCRNTVGSFSCNCEEGYGNLDEHRACHDINECEAEPERIPPNATCVNTDGSFEWSCNAGYEHVGSQCQKINFCARGFCSPHASCQEVSNGTSYECTCQPGYVGDGVGPEGCADRDECQTENHCSTDENGGICTNTEGSYTCSCKEGYRQLADGTCEDIDECASGHECHESATCHNTAGSYTCSCNPGFSGDGHECADINECETNAHDCGSHTTCENTVGSFVCNCKEGFVHSDEKTCRDVDECAENKHDCSVHATCNNTEGSFECSCKAGFEGNGKECSDIQFCSAGRSDCAANADCAENEAGTDYACSCHAGYRGSGHTSKGAADGCVDIDECTEGVDTCPRQGGRCVNTPGSYRCECEEGYTYTTKEDGTVECVDINECGVSEMNTCASKANGGVCTNTMGSYTCSCLPGYTPSDDGRVCTDIDECATENGGCSEHSQCRNLPGSYECVCDAGYEKVEGSEHLCQDIDECAAGTATIPNNSNCVNTAGSYEFACKPGFEHKDNACSKIDYCGRGGCNSLATCEETADGTDYVCTCPKGFVTQNEGRGADGCTDVDECAENGCAAYGSEGVICENTPGSFNCSCANGYLLNNGVCEEIDECAGSSSNTCADEGGICTNTPGSYTCSCKPGYDQQGHDCVDINECTTQEPCGDNADCENTSGSYICKCKAGFEMRDNQCVDIDECATNTNECHNHRGRCINTHGSYTCECIAGFIGDGKICINKNECQSGDFECGPNSHCVDTEGSYKCDCNSGYKQDPENPDSCIDRDECEIEGACDENADCTNLPGSFSCTCRAGYRQEGELCVKMNLCADDENGGCSPHADCEHLDKIVCTCRPGYEGDGITCTDIDECALNTDNCDSHATCENTDGSYHCACGSGFTGDGFTCEDINECETGEHECDSNATCENIVGSYSCHCPTGFAGDGRSCSPVEVVPGQESCNHWSAFTRCDPETHLSSRYCVDLPDKVESITCEVGSLPQPPTVAPGEGGEEDGNACGPWGPWSPCPGEGNNMSTRRREDTESEACVNQVETMECPTQAGQACGNYGAFSDCGVPLRGFAMAFPENCPELVAFAACDAPAPPQEDRCHSFSAWSKCTHIPGTTLYEQTRSCDGMDLTESRFCTPDDEVGSDVSTDVASECGSLGEFGECVNGLQERSYSDCPDHKEVRQCSDESCSAFGEWSPCGEPQQGLRIRKRRACDNVHCACVEAEVCGDATPEIEEEEGEHFPPEEGEVLPPYEEGPGEGELLPPEEEIPEGEHVPEEEIPEGEHVPEEEIPEGEHIPEELPEGEHVPEEEIPEGEHVPEEEIPEGEHIPEELPEGEHVPEEEIPEGEHVPEEEIPEGEHIPEELPEGEHVPEEFPEGEHIPEELPEGEHIPEEFPEGEHIPEELPEGEHVPEEEIPEGEHIPEEFPEGEHVPEEEIPEGEHIPEEEFPEGEHVPEEEIPEGEHVPEEELPGGELIPEEEIPEGEHIPEELPEGEHVPEEEIPEGEHVPEEEIPEGEHVPEEEIPEGEHAPEEETPAPEETEKEEEEGVPVAAIAGGVVGGVLLIAGGAGAAVYASQGGVEAAEDEVMFESEEDGTQAGENRESETVIEIEDDAWADMD

SEQ ID NO: 294 - protein, 468 aa, Toxoplasma gondii
MVGVFQLCLLTCLLCLLKGSDAIQLRQHRNGLGVEQSFVSEETDIVGGRISSLQAELDSYCHNRYKQLCDGGNKKFCDKTGVARYGTGIQSQQTAEWRCYFAEVLKPSGRKVQCVDDCGNYFPCLGVVDPNDTFHATAHNQILNFIKDGVEKHCSPFQMAGNNYCQGVLADTVARKDTGTASQKAKAWRCYKKDSLTYEARSICVDNCGGEIECPGGRSETSGELLSQHYTREKELQKVIESQSAPCHDACVATPINPPICADTESLLQSTKRSRAQRFIDDACQKLFNCHCKKDKKFCTTVVARKDRGRAGSQNDAEWRCYSLEELDFQKTNPSCIDECGNELPCQGAVPEESTHHITWTKLPSKIDEATQKFCTERQRAANDYCASEFADSLARYGPGAGDQTSQFRCIKKAAMRADAEGQCADSCKGTETCGGGRSRLDGPLSVDDVLNAHEGISEAMKSASTEC

SEQ ID NO: 295 - protein, 968 aa, Toxoplasma gondii
MSEAAYSAERGWDPETMTCKCPNDAPACSAEQATYNLINHSSVALGQGAICAAATGTVSGIARHFKRSTLDLCGDLSKLSPLSWEQLPLPPYMADDVILDDEVIRSGHYLCTKSYHHVFCRSSLITTSTTTPEPKWDWPARQDCVPGEWTSWSKCSMDCYVGSGALPVKSRSRSVLIDRRGTGNVCVLEDHTLCKVGSEVPYCEDLCWITDWGDWSGCEQKVLQIGQAAVRARTKLRHIFMGTGGVCSSDHIQYDYSGCKSGMDSSGGREDDSAHSMVEQKSRVTDAGCKKSSGWSACSLPCQQPGANAVTQQFQLGLPETVTASTTSYCASRSRACVEKKPPCVLDVAPDCSLVKPRYDSPEEALYCHELCNNALTRCREQAALQFQTQWECIMAFINSSGVTGRCQIQKGAVSKTTLRPPVCFLSRTRQVDASKSLSFLTTDKTSGRGSCMCAVTNSVPCSPEEVALSFDDWAKQLGSTVCPFGQLGAFFNSPNSKGSADSFVYFGASDLGRVHCPISKSSDLGSRFPTFTEFESPESMNNFCENGLPFWQEKREPLVDCRQVIPKNASTTDCPGRCHKAVVNCMVSNDSLDNCINEALSAGDFAENCELQSSVKLGKGLMFCKRIRTDCEYSEWSEWSECSRTCRSGDDEESVRVRGRKLLVAAEHGGSCDADIEDSHGGSLSDVQLCDWLPPCDALADTETYVIMPKPEPKLADWSATRTTTTTVIPGLQNENKILCTIVDMADFSKSHRGYDTETESCKCPYNARVCSRTEAVNSRDNWDELMQTVCESNGQGQILAQGMETFSCSDRVFRSFRGTLGQTPEAHCKSEDATYIFCEDGAIDNDLIFTEVMMSIITGVVMGIAVVYWAIQYSGDVQKVLGLAGRYVELTNLLHEVSQEPQAHEEEKAEEGEGPDEDAEPEAAVEGNNEFDCNPRAKEENGEESEQDASDSESGSDDDDDIVSEE

SEQ ID NO: 296 - protein, 2924 aa, Toxoplasma gondii
MGVLRVRSFPLQQRTMVFRATREPFRLPLVPAFIALFLLKGVTCQLQLGTSTLQKNMWTTVKFDEPMIDPVVFVSPPEVPTNSFALVLIGGVTASGFRARVYFPSCEYSPSGGTLYAVRWLAVEATSAGYYDSSNRQTIDWTAHAVTLASSGTIPAGYVWSQSFSAWEDRPGTPGVLIGVQNHREMISAMYSSSEYLNPLVINSNSGGTLTFSFLRQISHRIGFTLKVGIFQYDARRGAVINGVNLVAQRYDLKVNEVLPVADVVAGGTTPATFAVQWVTPTEAPLALVVKPKLLPDGSYSESLVAVEDCRKGATYEPHAFDVTHAFTGNPASTAHRINGGPNCFRPSASVPTWLTEPCKLACESLWTANSDDYWNCDDVNACFETDFRSAETLMALPQIDESIAEVLVTSCNFATRTADLIKQYEYAVNLKVDDIAIGTMWSTSSHCGGDKMEVEIVGAFYEKLGVSILTGSTCEVQDVSREVEALCKAEGGIGCSISGAQIYELIMNYPGVCFALEDAELQIFFNCTFASTSPFDCELYESKGFDQENGDCMCPNALAACTREEATFKSGWLQNLNKSYQYMLHGQIRYVAKSSVFQAFYEAPETSSAGDNTLCARMNTIVVCKNPTPVSAVVGNRGPNCYVIEHGSQYCHLPCLTAWDAFLAAKDLPQQSDYQAEFERFWLSFDFPAIPPHTSQSLLEQLQRCRFATRPATAPLQQYEDEIDVQLPDYGAVIIPLGCDKLHHREVVQALVGSASSIMLGVHEPGCRYEDATETVQRECKAAVSARKTTCEIDSSLFTSKDILCNTSTIKLIIRGTCIPGPYLPTDYTCALYPTTGVVSRDGRSCTCPNSAYPCTYEEGQLTASRWKNEVNTGATVSLANSVVWTAPPGTSEYTYTHTDAYDYVCSTDEHHFVLCKDLTPSALPLTEREPHCLNSFSVKPDASTVDDRDCQDQCASLFATRCRQSFYKWLCVAQGLPECYIPNTDSFTCQIDTNPSAYNYSYGSCGCSGAYPPCSRNEANATRLDWITAFRALSHKKGVVVARGKQALWTENPDRWRYENGMLQGGGCLNNSWFVGVFCGAHLSVTPPARGDVLPICSSAAKVENPDTPHPACRVLCAQVLNECKKVFSTTEGASAYASVFDCFKARGKGTTLDNCTYELGPENRATGVAELHTGWTVASASWSRVLFDVEFADPPVVFLGIPRDTQPFYTPSVRLVTKTSFEVKLYRNNCGLDDTRSSSAPVSWMAIPEGAYLTDFVENPVRVMKLPMTTRTPTVLTFSLPGLKEPEEMVALAQVQDLTPTSVSTDRVAVVISNLKTNSLELSLVVDESVNFSTVAVGILISGKQNPDLAAGLSPLLNRYHLQTFRIPAAAYSATSILGEGLYLSGGIMPHVFAAAIQTRSRTKELDESDRVVISRRATTTPSTWSALLWKKTCDAKDMFEAVENPSDLIIAGIYVEARKDEPSAILGNRHDLCLSFIGQSFESGVVATCMGACRSALPASVQLHCQDECALNIFAPSVHTKCMSDCESLLVAQYEECAGQCTATGTASCQRKCKQFLGNKCDSTASSDVAACLEFVTPPSVFEQCTLLVEYSVSEGGASDGLEIEEETTPSQTYENCIIVDMRDGRFTAFTGWDSRVASCKCPNDFRACTSETVNTQNHWRTELLASAGLCKEQPDGRFNAVTQQLWSTTGDLCALAADEQQPPISWTSNMLPAYVDQDVVLDNSTIRSGDYQCREIWHYVVCPAAATSTTTQEPPVPPFTATLKTAIVGEWGEWSACTGTCFSQWWTPKRTRTRLVLAELSHSQIPSVSETATCLDLPPCGTVCWEREWTEWSECKLFTIVMGQGLEYFRQQIKPIFDFVEEACGLDEHERYERCGEEQNNGETPATSTLQTDSLLETRSLTVSRGTAARALSRVSMDPALEPPSFASLHGTRSHVPASIDAKIIERRKGIMSRRRSVPPSGYLEETAEQVARGGESEQSEKASQNGSRRHRASRKQKRGLESIYSDASVRGSGESTLHGTGTNAYRDQIEWTSKSSSRSAILDSGARGAEAGTSLLQKARRARRGAGRFRKSRSQARNQTPDKSCSVVSEWSGCDSPCLPHKGSTPRRYRLAVPGQNEANYCTVPLSGKEHLCTDLPQCAHPNFDCAKVTASRLTDEDIAACKAVCVEVVKTCETMMSAVFSLYTSLEQCALVQFQEYEQFPGQCHIPEEYTSTRRPTKCFPSRTRRRVASGELPFIFQVSTASGTSPSATSDAASSVAESFVSTGTASAPSSRVMNALAFEASASQTSIDSCECYDPADEPCTAQEARDSLFDSLYLFLTHPLCAESPAAEGALFTMSEPNQTADAASYFALRGLGRMHCPVPMYKSSTEVKGVLTPKRVTFSEFKTKEDLNEFCHKGLSNWRQNVPPEIIGSASFPNCMLVTPREGAEPQDCALLCSETMSSCSAASLSFVELSQCVQDKLTESDFYSKCSAPEVLAPGEGIILCKKKVSTCDYTEWSEWSTCTATCFNWDEGVIPLRVRSRDFASSSAESRVLCRLESQNDAIQTEKCDWMPVCPEAESEEEDDATGGVEPRGEPIVPPWSPERPTDENNQAMGSEDIVPGTVECYVTNMGTIMTSYYRGYNQEYHGCNCPGGRRPCTRAEAVASLDLWAKDSGGLCDQDMATMISAAEGEAFFCATGSFGKIDTSLSESSCASSEYQYVLCEGHPYEGIANLTTWVICLLLGVGGGICFVLSCVQYSSDIQKLLGLAGSYPVLVQNVTELQERESHKLRRQGNISATSEHSDAHAPSLSDSGWDMDGNQSAGSAFPEEEPWQFEDHDEEPLLSTRKYSRNSGSAEIPEPSEIGQTSPTQQRVPRASLAAQRSTCQLSSRLGQANSPEQSLERRSLKLRDSHADVELQRTLRKEMKGNQVWDKTV

SEQ ID NO: 297 - protein, 668 aa, Toxoplasma gondii
MVVSCLCTAMSSALSQRNCILISCRLGRQRSRPPDAMKVYAPVFTCRRQFLYEKYTRRRCTTLGGLVALCVIFTAEAISRSQHPYGTSRSDLSPPATVDSTSYGMSILEAGGPSDEVAIPSDRLQTFRNASLDFDRAIRFPNQASVAESRQLRLMQMGECQNVYWGKKELISRITGKWKSALHPSCHESWFTYTSWSRTKTWRECAQALDNSYLYFSWVRRHNEADGACIWVKPSRRDVSKSDVEDCLVDVNPQKEVAVTGIVGSHHGCTTCEVGEWSETTCDSWCNDGVKGRFRELTGHTNSAHCSTSADANCDVCPNLWEVQRCSTAVECAQGIKPRVRFCPNEGREYTAEGWRACAERCQRKFNATNGDTANRDTFYKAECFRYSFNNDTSACILNPLHACPDAESASDVLWISGDVLSMPSADYTTVTWQEWQSWSSCSEVDPATGWKKRTRRPKTWGYRPDNVLSPLQWISVTPCASNVTLTRSELDLAMNPSAMCWVYSDFADWSTVSCEPRCGADRKKTRARAVRQMPVVQPDGRISESCASTEVSLEARQQTKDCPGFVSCGTGCVFGEWTAWSDCRCTAEGSTARTIRARELVSGSKESCTGLEEERKCEKVCEESIFSNGVTYAVAGGIGLVVVIGLGFIGRKFYRALPAERTRDNYL

SEQ ID NO: 298 - protein, 351 aa, Toxoplasma gondii
MDALKTVFNRRIALPVVVAAALLHNSAEALQSPGLRRQLVNSHSFAEVETTGYSCFEKGKEYVGFSLTEFAKVGDAALCQQRCNQHPQCGFFTFYSNENRCVLQSRKPSQENNNANAVSGPKRCPLCLVDNYDFRGETNMHKSGAPGLNTLLACQQGCAAEPKCKAFLFEKRPRTCHFKTSDNYLKSFHPDTSYIAGPKTCTDEHWCIMKDIGYKGTDSKATKANSAAECQQMCLNDERCDFFTWQQAGKHCWFKAGASTASTKYNRAGDYSAPKHCGLPTTCVKERTKYAGETVATFPKSEVGTFESCQMKCWKTSKCVFMHFNNDGCTLSGINATAQTDANSKAGDITC

SEQ ID NO: 299 - protein, 351 aa, Toxoplasma gondii
METVTTLFNRKIALSFVVAAALLHNSAEALQSPGLRRQLVNVHSFAEVETTGYSCLEKDKEYVGFSLTEFTEVGDAGLCQQRCNQHPHCSFFTFYSNGNRCVLQSRKPSQEKNNADAVSGPKRCPLCLVDSFDFRGEANLHHKGAPGLNTLLACQQGCAAEPRCKGFLFEKRPRTCHFKTNDNYLKALDPDTSYIAGPKTCTDEHWCIMKDIGYRGTDSKETRANSAAECQQMCLNDERCDFFTWQQAGKYCWFKAGASTASTKYNRAGDYSAPKHCGLPTTCVKERTKYAGETVATFPKSEVGTFESCQMKCWKTSKCVFMHFNNDGCTLSGINATAQTDANSKAGDITC

SEQ ID NO: 300 - protein, 603 aa, Toxoplasma gondii
  misc_feature (317)..(560): Xaa can be any naturally occurring amino acid
MDALKTLLNKGITLAVVVAAVLLQIRAVALQYPGLRNQVVNAHSFAEVETTGYSCLEKDKEYVGFSLTEFTEVGDAGLCQQRCNQHPHCSFFTFYSNGNRCVLQSRKPSQEKNNADAVSGPKRCPLCLVDSFDFRGEANLHHKGAPGLNTLLACQQGCAAEPRCKGFLFEKRPRTCHFKTNDNYLKALDPDTSYIAGPKTCTDEHWCIMKDIGYRGTDSKETRANSAAECQQMCLNDERCDFFTWQQAGKYCWFKAGASTASTKYNRAGDYSAPKHCGLPTTCVKERTKYAGETVATFPKSEVGTFESCQMKCWKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFRKPVASICHSPRTKKGDQTVSHEIVRPVNTCRRVTPERGDSE

SEQ ID NO: 301 - protein, 769 aa, Toxoplasma gondii
MRLQREAVFGLMFACGMWMWPSEVAGGGWSIVDALRKRYDTSRGGDANGVDTSGVEDVIQSESAIGAAEGCTNQLDICFLIDSSGSIGIQNFRLVKQFLHTFLMVLPIGPEEVNNAVVTYSTDVHLQWDLQSPNAVDKQLAAHAVLDMPYKKGSTNTSDGLKACKQILFTGSRPGREHVPKLVIGMTDGESDSDFRTVRAAKEIRELGGIVTVLAVGHYVKHSECRSMCGCSGTSDDDSPCPLYLRADWGQLATAIKPMLKEVCKTLPQDAICSDWSAWSPCSVSCGDGSQIRTRTEVSAPQPGTPTCPDCPAPMGRTCVEQGGLEEIRECSAGVCAVDAGCGVWGEWSAWSASCGNATRKRERTRYNDPPPQGAGRRCENQDPPVLQEQTEEATLAPCITIPPTPPEWAAWSDCTVTCGGGNRHRVRNALPPGLGSQNGESDESLVSKLWPGTDLRQEEACNTSPCPINATCGQFEEWSTCSVSCGGGLKTRSRNPWNEDQQHGGLSCEQQHPGGRTETITCNPQACPVDERPGEWAEWGECSVTCGDGVRERRRGKSLVEAKFGGRTIDQQNEALPEDLKIKNVEYEPCSYPACGASCTYVWSDWNKCVCPMGYQARHAAVKFDYRNKPCDLPTFETKACSCGETNPVPSEGTTPGAPGATGPEQPNQRPLPEGSDENETPTNEEGEQSKKESGSGIAGAIAGGVIGGLILLGAAGGASYHYYLSSSVGSPSAEIEYEADDGATKVVMEEEKETLVPVDDDSDMWME

SEQ ID NO: 302 - protein, 383 aa, Toxoplasma gondii
MRGGTSALLHALTFSGAVWMCTPAEALPIQKSVQLGSFDKVVPSREVVSESLAPSFAVTETHSSVQSPSKQETQLCAISSEGKPCRNRQLHTDNGYFIGASCPKSACCSKTMCGPGGCGEFCSSNWIFCSSSLIYHPDKSYGGDCSCEKQGHRCDKNAECVENLDAGGGVHCKCKDGFVGTGLTCSEDPCSKRGNAKCGPNGTCIVVDSVSYTCTCGDGETLVNLPEGGQGCKRTGCHAFRENCSPGRCIDDASHENGYTCECPTGYSREVTSKAEESCVEGVEVTLAEKCEKEFGISASSCKCDNGYSGSASATSHHGKGESGSEGSLSEKMNIVFKCPSGYHPRYHAHTVTCEKIKHFALDGAGNHDTTTYVARRRYPASL

SEQ ID NO: 303 - protein, 580 aa, Toxoplasma gondii
MRASLPVHLVVCTQLSAVWFGVAKAHGGHRLEPHVPGFLQGFTDITPAGDDVSANVTSSEPAKLDLSCVHSDNKGSRAPTIGEPVPDVSLEQCAAQCKAVDGCTHFTYNDDSKMCHVKEGKPDLYDLTGGKTASRSCDRSCFEQHVSYEGAPDVMTAMVTSQSADCQAACAADPSCEIFTYNEHDQKCTFKGRGFSAFKERGVLGVTSGPKQFCDEGGKLTQEEMEDQISGCIQLSDVGSMTADLEEPMEADSVGACMERCRCDGRCTHFTFNDNTRMCYLKGDKMQLYSSPGDRTGPKSCDSSCFSNGVSYVDDPATDVETVFEISHPIYCQVICAANPLCTVFQWYASEAKCVVKRKGFYKHRKTGVTGVTVGPREFCDFGGSIRDREEADAVGSDDGLNAEATMANSPDFHDEVECVHTGNIGSKAQTIGEVKRASSLSECRARCQAEKECSHYTYNVKSGLCYPKRGKPQFYKYLGDMTGSRTCDTSCLRRGVDYSQGPEVGKPWYSTLPTDCQVACDAEDACLVFTWDSATSRCYLIGSGFSAHRRNDVDGVVSGPYTFCDNGENLQVLEAKDTE

SEQ ID NO: 304 - protein, 181 aa, Toxoplasma gondii
MLRPTVRSSLLSLGLTVILYLALTGSADALASHLRSRHMEAGRRTMDTQNDVESAGRQSEPMEAADRQAEHPGAPTQSEMKEFQEEIKEGVEETKHEGDPEMTRLMVTEKQESKNFSKMAKSQSFSTRIEELGGSISFLTETGVTMIELPKTVSEHDMDQLLHDILAAGGVVGLDSEVKLA

SEQ ID NO: 305 - protein, 349 aa, Toxoplasma gondii
MRLFRCCAAAVVAAESLLWLKNGSPFFAFLPGNGEIADNCSGNPCGGTAAGTCINTPSGYDCRCEPGYVLGVENDQVTCMMPSGVPMANFVQLSEKPAACSSNPCGPEAAGTCNETNSGYICRCNQGYRISLDGTGNVTCIVRQESGCEENGCGPPDAVQSCRRLTGTAGRLCVCKENFIATIDASAHITCKRVPPHYRKPPFEFGKGGHPVDSEPSKRQREDEGESREPESDSTEPGRDQERRTPLEESQEPEGSTPDSQQSRGGSGSDSTESEEQGKEREEGSGHAGAIAGGVIGGLLLLSAAGAGVAYMRKSGSGGGEEIEYERGIEAAEASEVEVLVDLDSKTWD

SEQ ID NO: 306 - protein, 340 aa, Toxoplasma gondii
MGGWESKDACESGGTAFCGTVANSAGCIALSKEFYCTCLPGFQPEGRRMNSSCVDIDECARGIGLCFSKIENSECVNTPGSFECRCNEYRTLKNNVCEDINECLDNRGGCAEHTDCINNDGAAVTCRCLPGYTGNDGKPGRACKDINECEEPDHCPENSVCVNTPGSYRCECKTGFAKDAEGMCTGKDFCVTGENGCDPNFATCTPVVGSYACACKDGFQGSGRKGECKPLPGSEYKACELLGLHCGRYQGCASDNAGSYRCAALTKVQQVKVLLSEGPGTETPLWLWCCVALAAVIFVGAVVYGVRYFLKKWKKTNESEDDALLSGYGYDYGAAHSFRG

SEQ ID NO: 307 - protein, 684 aa, Toxoplasma gondii
MKANRIWCFFAWRMVVRASFLKEMDSIFVSAIRQNVQHTHSALLAKLKEPPDPDDENSWLCRISKKYDACGSREYSDKGLKWTFCPEDFCCSKTACFYGSCGSWCHDNWALCSSSIIYHDEYSYGKCNCKRFQENCDVNAICVHANREDGGAYCQCKEGYWGDGKSCKIDFCQLQPCGAGTCTRTDEGYKCDCPETHKLIVVEDKETCKAKPDFCAEEPCGPPSMVENCVNTDDSYECVCKQGYEVRNGRCEEIDLCADKPCGPDEGVHECVTERQPKLRYRCTCKAGFDLTTLPDGVSQKCLKNFCYEEPCGTRDLVESCKSKAYGYSCLCAAGAMVQVINGKEKCIKADLCRNDPCGPETAVIQCYSHGTSYRCLCKAGYTEVFVNGKSSCQKGDPCTLNMCGGNEAVQECTTDGTAYGCTCKPGYSIAIKHGQKFCNPEEECASHCGSAAAVKSCEILDSGGYQCTCNPGYVMRYSDYVKGCVEGNQCSLNPCGEQEAVQRCIPEGDTYDCECNPGFVKRVLPDGNFICADPASCVGNPCGSSDAVDACIAGTSTYTCRCKDGYTPQSIGSKLQCLPESTDQTDFDSKHKPEDNKGRYSKGTIALVVVGCVALLGIIAGGISYARNRGGERDDEDLAPPPRSTRERRLSSMGEGFENASWASSVSMIPSAPAPPPSGGIWS

SEQ ID NO: 308 - protein, 300 aa, Toxoplasma gondii
MRVSFNVPLHRTGFVLVCVIGSLCWCIAPAPECVFPATGLGPAAWNHPGSLAQMRAESKGVLSVTGICDRNPCGPHGNCIPNLSTYTYTCSCEGGYVEAAVSGKPTCQRKDPCDTSPCGTKEAVKECRPNGQYYACICQAGYQVVSTNTGSRCQRIKSTTTPCSSQPCGGPEAVEACLVTGPTTYSCTCASGYETITTEQGERCEKTDPCLSNPCGASKYVQSCTATNTGYTCECVKGAKKTGSDSAPMCVAGESDMTQWYVAGGIGGCLCLFAVVYLTSSRQSPNSNDALYAHDFEGMY

SEQ ID NO: 309 - protein, 999 aa, Toxoplasma gondii
MVPLSRMAMVSVAYFILGALVYGSANVFGEMQPRQLAKSSTDDPTIHDEGHGAAAPSTPRAGTELMTPHPLASRAKAVTSAIIQESKSTLFNTGHVTTTEHAPKNPGLLGKPVKQTEALQLASPEKGVTTMEPKAASQHADRSGNPAVKKSTSGAQQAAAQSGKVLTKLTPIEKNPAPLHRQPMTRATPVGPKPADPAGKAVKKAATGIPKPAAPGGKAVKVTPVARKPVAPKAAAPDGKAVKKATVVVPKPAAPSGKAVKKPVVSVPKPATLGGKAVKKPAAGVPKPAAPDGKAVRKPVVGVPKPAAPDGKAAKKPASGVPKPADPAGKAVKKAATGIPKPAAPGGKAVKVTPVARKPVAPKAAAPDGKAVKKATVVVPKPAAPSGKAVKKPVVSVPKPATLDGKAVRKPVVGVPKPAAPDGKAVKKPVVGVPKPAAPDDTGINKATLVTRKPEAPDVKVVKKATVVVPKPEAPDIKVMTDQTPTTPPSPPVRARAASATTIVTAPAPVPTRPVLTTTSTAATVTTIKTETPRAASRLQQDLNAFCTTQFQKLCSETIDGGRYCGVSGAVARFGPGGHDSDSQWRCYEESIMNTTTKGVQCMDDCGNQMQCVGAVSVKTVATPPLRALSAFISQRRWIYCSSFQRSADALCNFKRTGNVARYDPGRTRWMCFNPVDISLEGQSYCANNCGGFTPCAGGLSPGEIPTRTVYIIQQSDTAEAFAALHPCRHDEICIPSTVYPPACVKAHKIIAIQQLSKQQEAMDNYCQTEMDQMCRVGKWTTYCYQLWLSRMVSTEEDEEPKWRCYPFALLNFSDLSTCIDGCSNRVPCHGAPSPTSTLTTEFSKLKTIAENIAFCSPFQKAANDHCNKRYGEGWVARQDVTTDDWACFQTTKLPTYRWTGCVDNCGNTSLCAAGVPEQLHSAAAEAFVHPDPALERVVESVPSPCLTGESCTPTAMNPPYCSETRPNPQPAPLRDHTIRNALDCSKGAPLARRNPTSK

SEQ ID NO: 310 - protein, 608 aa, Toxoplasma gondii
MYPIAPSFAMVGSVGSIRRTSRCPSKTASCFRLYVFPLVPPTNMAKAKTVGVRLIGVTTCVAFAASLQVAVTGALGAGPAYRVAQRPGSLHFARMHDRFVNKDREAEEHKVAALERNTTPENISSQMDSNKTTAPSPEPGTSKRAQLKTTSAASATRPLVSQLQKDVDYYCAKRFEQQCAKGVLGKTYCTDGLVVGRYVSQGSKLEAGWHCFKGAEIAHSQRQVKCVDNCGNLMKCFGDVNSSQTAKVAMPGMDEWIDKRKWTYCSPYQQAADALCNLKHHGDVARYDHVRQRWMCLDLNDVALDGISYCADNCGGPTSCVGGLLPGELPQRSVRIVRHRDMESAFEAIQPCPNAGDICVASTVNPPACLPQVQTLVLQRLPAQQRALDTMCQDAMDEECRKGKQTEDCFGLWLARYELESSPGGAGAWRCYPESRLDFTQLSSCIDGCGNPISCRGQPAEVSPAFIDLPALDKVAGDMSYCSAYQRAGNAYCAQKHGPRWVARQNCNTYKWACFNLDNLPPNGWVGCAGHCGEFIWCPSAGTGDAVSDSVQDEDLESVILAVPDPCLAGEKCEPTAQEPAYCSVSRPNPHAKVKKLSVFEDRRLRGY

SEQ ID NO: 311 - protein, 654 aa, Toxoplasma gondii
MKLECFGLAALSAALFAGKAEAVAANCFKADTDYFGYDVDKIFVGAATESAEKCQEACRNREDCFYFTYIPERKQCYLKDNQAPNGTVTNPLAISGPKFCYPTGTCFEYMTDYVGYDVQKIEDQSVSQADDCQRLCASNDQCFFWTFIPSKHNCYLKHNGATVGRTPHSEAISGPKSCTGGSPNDQGVPCYEPDTDYFGYDIKIFDNNLVGTAAECYGLCLSFAECKFWTWVPALRNCYLKSEYAPLGRVHAPGTISGPRDCNGSNLPPFVPPPPIYPPTHPHPPPSPYPPYPGHTSTTTPATPPAESCYKAHVDFPTGTLKQIVTDDAYACQKLCQAEAACFFFTYKADILECALKGSFAANAPIPRRHALSGSKYCADKMPPEFQPLHNHVPTPPLPPHHAIPPAYPGPNPMPVPPTPGFEPSCAELNVEYVSDILSVLGADSPKECQTLCKLTASCNFFTYRSDLYRCYLSKSKGTPSSRLNAVAGPKECPGEGSAVPPTASTCFLQNKMFVGTPLSSIEAKSAEQCQAKCAGDPQCYYFSFQVMSSNCHLFRQVNGAKEEGTCVSGPKTCADKPTDPCFKEGFYFGQVLKRHNAVASAKECQTLCATFPHSCVGFTYESASQKCFLMSQTDGLELSDGFVSGLRQCPATP

SEQ ID NO: 312 - protein, 470 aa, Toxoplasma gondii
MSHENAFHPSRMQSFSLRCRPSSLYHAAGSDEEPAAVSTPAAGRTSGVVQAVQRREGKAFAAGQPVRCRALLTRRSSRLLLAGRLHLRSHHALTSIAAVFLMFAAYCPSHIDDLGKSGMFSAKWADAFKLHSSNTESALLQTHSHLMKTDPILPSGSEWICREAYNDEGCGTGHNASLGTTEAYCQEEDCCLASTEKCTRIPGLCAVDSFLLSQYSWGKCNSSQCARCGPNATCGYIASTTTVRGGVYCTCKSPFVGTGASCVVEACKVRNPCGQGTCVPTSEAGKSYKCDCKPGYTEVSTGTSFSTCVDICKQYGCGSEGVQTCIGGIDSHKCVCKQGYRLSEDTARQRCVKNDPCTINPCGPSSAVEKCESQENGIEYKCTCKVGHVVRYVNGTQVCLEEGKPCSPPACSVDPPATTATSTSKPTNQSSGNDGEGVNAGAIAGGVIGGVVGIGICGAGAFFFMKKSQH

SEQ ID NO: 313 - protein, 717 aa, Toxoplasma gondii
MCLLSSLFSPSSVSASLVSVSPFLRSLLPQSFVCLLSYPALDLIHSVSASELDTALVSVPTSKAVSFTEFDIQQPPSDNSWLCRFSFWDGPCVDRQHNGIGPWRFCPSGSCCSKVKCAYGSCGGSWCAAWNSGLCVFHNGDYESDRCTCEKYGGQCSKNGSCKRLDTPEGGAFCYCNPGYVGDGRTCESDPCYGSPCAPGTCSRMGNSYVCGCPPGYTQDTSRGHARCVEKADSCRAQPCGSDTVAYDCVSFDSGAYECICKDGYASNGTKCEKQDWCKDNPCGDANAVYDCISHETGYTCQCQKGYIQVVTDEGQQKCAKNPCSYDPCGTSDLVKECINKSDGTYGCVCADIAEITTHEESNQITCARKDPCLGNPCGAAEAVQQCFVDGPTYGCVCASGYTVVPDATGAKKCVFGDPCQLGSCGPDEAVDSCSTNGQAYTCQCTPEAILSTSANGIQSCVMRDECEENCGATEGVTRCEKISENKWDCLCKAGYMLKYVKGKKMCHKADACSVNPCGTAQAVADCQVDVGGDGYTCVCNSGYELRTQSDNTQLCAPPNSCIGDPCGKAEAVSMCLPTKDGYTCKCNANYTLQTMYGKPRCVPGPSSYDSDEEETSSSSSTTSEEEGTSTVMIAGCVVGGVVLLGAVAYMGRRGNDEEEDEQPRPPAGGPQGPYMGQQGYGQGQNLMPPGMDPAMGRNSMMARQQYAMDTRNSFWG

SEQ ID NO: 314 - protein, 759 aa, Toxoplasma gondii
MAGPYRYSGLDRFSLPCLSPASALRVVGSSETKAHLVKMRGARDALLSLSRISLLAALAGLACCRAMVVLSSAFATTVVEKHPGSLHPESGEAPATASSLVQIEAAQHTSLVSSAAARTVFQPPSEESWLCRLSTNNGPCSKNSSDPEIGQWRFCPPGRCCSMSKCGPAGCSIGWCEGWGNPLCWIKDDTYSDGKCTCEKYRDRCSPNADCLEYNVERGGAYCVCKDGYYGDGKVCEFDPCSGNPCNPGSCRRHGTSYSCACPDTYAVTSTSSGERCEVKRNFCLGEPCGSSEVAADCVSFDSGEYECICKSSYVSDGKGCVKFDPCEYNPCGTSEAVKSCTHVNGDEYKCECHEGYNLTNDSDGNMVCAKDPCYGNPCGLPHLVASCARRTPDSTSSATYTCLCTAAGHLQVDPVTGAQSCTQGDPCASNPCGSDAVVDFCISEDDTYRCVCKTGYASVEINGRKQCKRGDPCELKVCGEDHLVESCSTNNKLYSCDCTSLAIKGLNDEKKPVCISREECESVCGPLKGVKQCNQKMGVLECVCDMGYILSTQNGKKQCVQGDACLNQPCGTPESTLACTANGSHYSCSCNEGYELRMRPDGTQVCASAGDCTGSPCGASTSIGVCTPGVDSYTCTCVSPFELQQTADGKPTCGEAFTTTTTQAVKDDSGSDNSSYTGLATGAVIMVLALGAALWFSNSQEEQTMGSGGMGGMDDPMQGPMGPMGMGGPMGPGGPMGPMGPPGPRQSYAAYPSGSMWS

SEQ ID NO: 315 - protein, 351 aa, Toxoplasma gondii
MDALKTVFNRRIALPVVVAAALLHNSAEALQSPGLRRQLVNAHSFAEVESTGYSCLEKGKEYVGFSLTEFTEVGDAALCQQRCNQHPQCGFFTFYSNGNRCVLQSRKPSQEKNNANAVSGPKRCPLCLVDSFDFRGEKNMHDNGVPGIKTVVECQMGCAAEPKCKGFLFQHKTKQCHFKTSDNYLKSLHPDNEYVAGPKTCTGEHWCIMKDIGYEAMYTRRSQTNSAEECQNKCLNDEQCQYFTWQVSNKHCWLKHGPTIANSKYNRQGDHSAPKHCGLPTTCVKERTKYAGETVATFPKSEVGTFESCQMKCWKTSKCVFMHFNNDGCTLSGINATAQTDANSKAGDITC

SEQ ID NO: 316 - protein, 407 aa, Toxoplasma gondii
MKTRSFNQAELKRERVDVRKCEKNDTVSCAGVSFCSEGLELRRQDMDMTPFVEDNAEAHVCYEPDVEYVDHTNLAIEGGHVHSPSSCQDLCQRYQDCYFWTWNSVKKDCYLKNSTALFSRQKNYDTRNKISGPKWCMMPHPLRCYEVDVSYEGYDIIKNPLTNIRSVLDCHRACVELEDCRYWTWTADSMECQLKSANALRAWRRSFDTIGKISGMKNCGVCTELGTDYYGHDVRRVETKSIVSSEQCRDLCIKDANCFFWTWASDWKNCYLKGPDALEAWRRDNSTRSLVSGSKFCPMDRDLRLASLSQSPFMYPAFYIHNPPPCYEIGVDYAGHDLETVDDEKVLSVQDCQQQCQTREGCVYFTFDTVSKVCYLKGGGALHDWTKNETTEKLISGPKDCSCSGLH

SEQ ID NO: 317 - protein, 1161 aa, Toxoplasma gondii
MFVVDLSLSGNMRSLTHGKSIHRSSIVVVTHCSHRLSLSPLNRPALFPSHSDRYTVPWRCRPSSWRLWITFVCLSTLHMFGLSSAVKRDGEVPTANLRASLSPDSSKENAMLLSAIGGIGPTESRLQHIPFSTTRYLPIRSHVLQSTVERIESPEALNEVPTKVERNEFTEKGDKTEQVLTAQADHKSLLEGRSESTSTAPDDDFDFLFEDDTPKKPKSRVNKGTSSDETSPGDRSSGEGSSDSDSLLSVVHRTKGNATQANKNQTRITHPKSKAQHQKKVTKKQGIPGSDSLGTSSADFDFDIDSSSNTQADDSQRQSLGDSSALDLFGSDTGDTGDIFGFSNSSSDGGNAAANDGGLFSSSGMGPTGASDETSANPLGSILGGVLNPFAQQQSITPMTDKADEWSKENMKAFEEKMPKKMRDDGSPDSWYKQAVPQESVADLNRMRENRRIAEENRAAAPLSAVYTKATKTVPAINYLGAGYDHVRGNPVGDPSSMGDPGIRPPVLRFTYAQNEDGVSNDLTVLQPLGGYVRQYVACRQSETISELSNLSDYQNELSVDASLQGGDPIGLNSFSASTGYRDFAKEVSKKDTRTYMLKNYCMRYEAGVAQSNHFKWNVTIAFAAGVSQLPDVFDAHNPECACSAEQWRQDQNAEACTKTNVPIWISFIEQFGTHFLVRLFAGGKMTYQVTAKRSEVEKMRNMGIDVKTQLKMQLGGVSGGAGQGTSSKKNQSSSEYQMNVQKETLVIGGRPPGNVSDPAALAAWADTVEELPMPVKFEVQPLYHLLPVEKQEAFKQAVTFYSKSVGLTPQDLSALTGVTRNLPKQLTQATQVAWSGPPPGFAKCPEGQVVILGFAMHLNFKEPGTDNFRIISCPPGREKCDGVGTASSETDEGRIYILCGEEPINEIQQVVAESPAHAGASVLEASCPDETVVVGGFGISVRGGSDGLDSFSIESCTTGQTICTKAPTRGSEKNFLWMMCVDKQYPGLRELVNVAELGSHGNANKRAVNSDGNVDVKCPANSSIVLGYVMEAHTNLQFVRDKFLQCPENASECKMTGKGVDHGMLWLFDRHALFGWIICKTVNEPAMHVATDVGKAKGNGKKRKGKKGKNKTNAPNEVEEGQQLGADSPSQVSVPADADSGPTSKTMSSLKLAPVKLLDL

SEQ ID NO: 318 - protein, 351 aa, Toxoplasma gondii
MDALKTLLNKGITLAVVVAAVLLQIRAVALQSPGLRNQVVNAHSFAEVETTGYSCLEKDKEYVGFSLTEFTEVGDAGLCQQRCNQHPHCSFFTFYSNGNRCVLQSRKPSQEKNNADAVSGPKRCPLCLVDNYDFRGEANVHHKGAPGLNTLLECQQGCAAEPRCKGFLFEKRPRTCHFKTNDNYLKALDPDTSYIAGPKTCTDEHWCIMKDIGYRGTDSKETRANSAAECQQMCLNDERCDFFTWQQAGKYCWFKAGASTASTKYNRAGDYSAPKHCGLPTTCVKERTKYAGETVATFPKSEVGTFESCQMKCWKTSKCVFMHFNNDGCTLSGINATAQTDANSKAGDITC

SEQ ID NO: 319 - protein, 293 aa, Toxoplasma gondii
MARVRTLADLRTEDEADEHTPLYNAETGSRDSDSTSSGGAAPRSMPIRFLELLFPHFSLRSVVLAISIVDWIFYIVTVCLDTELPLIPAANILVHFGANYPPLIKQGQVWRLLLPVFLHANFFHVFFNVFFQLRMGFTIERRYGLLKFTGLYFASAIYGNLLSATAFFCNSLKVGASTAGFGLIGIQICEMALTWHRMRHRDRMLTNMVSFVLLMVLLMFTLNGGSIDQMGHLGGLLCGFSIGMLYNKELNDKPVWYPWASAAAIGILLALPAACFPILYAVDRHCHRDLSYI

SEQ ID NO: 320 - protein, 534 aa, Toxoplasma gondii
MEVSRSHRWPLGSSPHSSSPALCWSCVSRFSRSICRRGGRFPPLYFSRSSFLLRVLPLVLYSLVSGPSPVSLSFSPSAFSCFSPPFPLTVAAESPSDAAGDASSSLPDGEPLDSTSETAASESEKRSEDKTQLTEEQMKEKARKAAEAAAAATAKALELGVSVPPLVTASAGGSDILSTHSAASDAADAADRTASGFAADPDKSAVVRADDMRYQSNPENSTDGEHASSEEEEKPIPVDGGDCIIFAAEEGDRDSCSCPEGFVLCNWQDVQMIQRRLARIERAARAAAVRVLLLHLDKLPAEELETAPASRSPSAKESNSASEADAKVGGELRGSSSASGDQATDDSRKEEGATDEAETRLEAMLPTDLAEFVKQTAKAAMSLHAPGWVKTLCDDDARTGFKSYGVQIDYEVEAICKDEGTKDAPAVDFIYELNTYVPLSRLRKLQEKDSSWTPRHCLVADFYLCKRLPHKRKKVNCEMSGWSEWSPECVNGTQMRKNRITRSGQHGGRACVWDGKQPVHAEVTELRSCNQPSS

SEQ ID NO: 321 - protein, 761 aa, Toxoplasma gondii
MGSSHAIVACAALIVLLSTNARGLRVRKDKDVLLATSFLSHHGEYQNPTGTYNLIKEIRRVEAEIEDEVETLNRDRRLHRGHNKYADDDIRQGLKGEQDMGASENIPVAELEPQDLDREAKYPVRMLIVDKRSDDDDEETKTSFVETALHSDLAQRVVKELNGHVDVLRESGVVLVDLPAQTTDKQLQELIETARAQGTIVEPDHLVQSVNTSSKGSNDPLLDRLWGMDALNVKEAWDIITTGEPNMGGRRPLVCVLDTGIDYNHPDLRDNMEVNQAERDGTLGVDDDNNGEVDDIYGANMLSKENDPADDHSHGTHVAGTIGAHGNNGIGVAGVAWAPRLLPCKFLAYTGRGYSSDAVRCIDYCVKRGADIVNHSWGGSWPSEALREAVVRTANNGLIHIFAAGNDGVDIDQTAFYPAAFSTEADGLITVANVKGDPDHGGKRIIELDRSSNYGIQRVQVACPGMWILSTVPTSGSSQEPYAEKSGTSMAAPALSGIVALMLAVNPGLSTRQVREGLRQCSVQQPLLQGKVEWGSMPDAKRCVEYALTTHAEGRHKSFIREPSTETSTPPPPPPAQPTPQPQPHPPPQPETPPCAPSPPPPTPPCAPSPSPPTPPPGSPHKPEPQTPVYPEVPRSTRSPPPSPPPTESAPEAPPSDTPSCRVPPCSSSPRSGSQPKPPQDNTTTPKMPSLSSPPTEHSTAQPPKHENDAREQEPPTDEDDFSSVKGKKLGAYESDGSPRASSCAGAGVLGVFFMVVGLTV

SEQ ID NO: 322 - protein, 2340 aa, Toxoplasma gondii
MVSARKFLTSFNREQGGENSLCFSPFFSPLFRSSVAEAETRPDSSSDPVNDGDSTSGGETPDPLPTLAEVRAALASTVAQSRTFPRRLAAKNGEQVEDGDEELAERKRVRKPPRDTSAYSVFSVPALKLEGVAIADQEEAVGSFAVSVGCGFFHDPPAIPGVAHQLEHLIFLGAEGEEAATSWDEFVSQRGGTHNAHTTAELTTFFVAAPTDTLPELLDRLLLHLFHPLLAAEQFASEVMAVQFEHEKNQPDVARVLLELAMAVTPSLASPASSATQDEVPTSFYRPEVARKFGTGDFDTLCKTPLEQGLDVLKALREFHGKCYKPENMTIAVRMGRRSVPIIVEGAVDASGQSLRIPAEVEAAAEREAEKRSVYTPKEIGEMVVRILSKYVQANSPETEAHADKTKTPHNKGNSFSASSSSDLTPQRTPSDASSSASPSVSSAPASSQAKRRNEVLKTVRLHAGERQKEASQVASLLEAAVGEDAYRSRPNATAEDSSPTDGESDASGKLYRVFRQHGWGKRLLVVWERRTNWTVRGYDEVFQPTALLEYLLEYPGEAALLNRLKAQGLIADAEYVDYTTSQKAFVALLFELTDEGEEKFEDVVSATLAYAEQLRTSVTETYILDFFDEFARVANRSWTYKDPEDAVSAVIAAAEKLAVLPQRPDMVIAGGEFVSLPGDRTLLVDVLKEELESFGRARASAIVVLPEDTARGSAEVVHAFRPYGVQFSVSALPSLAQAEKVGERISRTDAAEKMELLHAELASEDLISHSMIESSAFPLPPVLACNVAATVALTPRRVPEICQSLSPVQFPIKGGRSDSELRESSELPLGPRSESLEDAEVEEERKKLEASGPPCVLVTEESFSVFWKNAEPFNKPIVRGYFKLRVSAEDATAQNTLYGKIFATLAGERARTALASFQGCGVDLLMSFTNGALVLEIQAFSELFAPVLARLIEVLKESQDNVKQSDFNKIFNTLKVQLSDFSTVTPFELALDVALSVVRRNRFSQLDLRSAVTDASSQFEDFKVFLEKVLTKNALDVFIMGDIDYEEARKLAEDFRAALSKQPLPFSESAGSEILNLADDIEIRFSNPIPEDATNAYVSLYVTHPPPDMMEMVVYSLIGEVISSPFFDTIRTHWMDGYVAAAAVREVPPAMTLATIVQGSQRKPDELERHVCAFLAEMEENIGSSMTTEAFLERLRWLSSSKFHRSATSFSDYFGEVTSQIASRNFCFIREQLARLATEKFLSCPAILKSYMNSLVDRANRKRITVKIEGNSSSSETASHQREIRAPSSTLPNRCGLPGLSPSASPSAEVRQAPSLSTQTSALRPRPLSEKRETTQSSEPEAPETSSQDGQRSVKANSPKPLNAAGSVGTAGKVEGKSRKVASRVDTPGNERRTYASLFGTQNVLRSSRIQSDFSSPIFSLGDDADALSLIQVEARVSTSNSKPKAVLGARRGDGQSPTVASPSGAAPKRPAPPAGPRDKSGEASETTGTEGMEVTEIASDVEGQAEEGDVPIEFLPLARQITPHILERCAADQNAAGAKRIVVDNFFTDPVEARRSILENLEAKLSSTSSLFSLSPSSHPSPPLWLAYSRSESCSIRTSTISRAEEVCGAWRESAPEAVLIVSPEQPPAGMPSLPPTLGDAEPPAAAVPLSPSGAETGVPLVPESPGSPAAAGRQAATKAPTESEASAATEGDHPRVGTSAEARTRQLPTAEQQTLEQRKALLEARLRRLEMQTIAQRAQLLKQRLDAMKQYGTRPTTIFNTWLGPHKRGFLQSVGGGTGASSGAFPVSAVSGRSSTATRTQAASDLHGSRRLPSALHQAADPLAFKRTLETLKWREQGLLQRQAELRTQLRKVNAFGSTAGDSTAPNLGLAEDKNLRLVENVTVASGASLGSRDQTAIAHQTDVLPPPRASIPTVPTLTPAPSPVAFAALPQIHQQLPGVDVGAEIPRPVTPVSTDISASASAFVPGSVQASLSQSPAASVKGAGAPPLPLAHQPFASLPPAPQLPQEPRVQEANVGSPSPPTVVPGVPTVGATAPTVGEGATTLGAGAPAVASPAPTVGAAPQAVTYTAPTMGAGAPTVASLAPTVGAAPQAVTYTAPTTGAGAPAVASLAPTVGAAPQAVTYTAPTIGAGAPAVASPAPTVGAAPQAVTYTAPTIGAGAPAVASLAPTVGAAPQAVTYTAPTIGAGAPAVASPAPTVGAAPQAVTYTAPTIGAGAPAVASLAPAVGAAPQAVTYTAPTIGAGAPAVASPAPTVGAAPQAVTYTAPTMGAGAPAAVASLARGPSFDYQAGVVSRAVGGASQPQAEQAASYVSDPASVARVSSASILPHAAVPVVHA

SEQ ID NO: 323 - protein, 376 aa, Toxoplasma gondii
MADEEVQALVVDNGSGNVKAGVAGDDAPRAVFPSIVGKPKNPGIMVGMEEKDCYVGDEAQSKRGILTLKYPIEHGIVTNWDDMEKIWHHTFYNELRVAPEEHPVLLTEAPLNPKANRERMTQIMFETFNVPAMYVAIQAVLSLYSSGRTTGIVLDSGDGVSHTVPIYEGYALPHAIMRLDLAGRDLTEYMMKILHERGYGFTTSAEKEIVRDIKEKLCYIALDFDEEMKAAEDSSDIEKSYELPDGNIITVGNERFRCPEALFQPSFLGKEAAGVHRTTFDSIMKCDVDIRKDLYGNVVLSGGTTMYEGIGERLTKELTSLAPSTMKIKVVAPPERKYSVWIGGSILSSLSTFQQMWITKEEYDESGPSIVHRKCF

SEQ ID NO: 324 - protein, 256 aa, Toxoplasma gondii
MSPLGFGAFLSPLLLFCVSPHLRTGVSRSFSSFLKPQKLQRFVSREYPRRRCLPSLHFTSRCFSTRLSSRKMAVKVLVPVAHDSEEIEAVSIIDTLRRAGAEVVVASVEDTEIVRMSRGVCVKADKLISAVENETYDCIAIPGGMPGAERCRDSAALTAMLKTHKAQGKLIAAICASPAVVLQTHGLLQGEKAVAYPCFMDQFPADMRGEGRVCVSNKIVTSVGPSSAIEFALKLIEVLYNKEQAKKIAAQLLYAY

SEQ ID NO: 325 - protein, 475 aa, Toxoplasma gondii
MFRLLVPTYYSYSVPLRFPFCKIYRYSTSNKMVAIKDITARQILDSRGNPTVEVDLLTDGGCFRAAVPSGASTGIYEALELRDKDQTKFMGKGVMKAVENIHKIIKPALIGKDPCDQKGIDKLMVEELDGTKNEWGWCKSKLGANAILAVSMACCRAGAAAKGMPLYKYIATLAGNPTDKMVMPVPFFNVINGGSHAGNKVAMQEFMIAPVGASTIQEAIQIGAEVYQHLKVVIKKKYGLDATNVGDEGGFAPNISGATEALDLLMEAIKVSGHEGKVKIAADVAASEFFLQDDKVYDLDFKTPNNDKSQRKTGEELRNLYKDLCQKYPFVSIEDPFDQDDFHSYAQLTNEVGEKVQIVGDDLLVTNPTRIEKAVQEKACNGLLLKVNQIGTVSESIEACQLAQKNKWGVMVSHRSGETEDSFIADLVVGLRTGQIKTGAPCRSERLCKYNQLMRIEESLGSDCQYAGAGFRHPN

SEQ ID NO: 326 - protein, 433 aa, Toxoplasma gondii
MLCIVERIAMPTRGVNPSAANGKLPPRTRSATGCRVYIHPMVKFISLLFAVFYARFFLLFCVRIQSTFPTMSGYGLPISQEVAKELAENARKIAAPGKGILAADESTGTIKKRFDSIGVENTEANRAFYRDLLFSTKGLGQYISGAILFEETLYQKSPSGVPMVDLLKAEGIIPGIKVDKGLETLPLTDDEKATMGLDGLSERCKKYYEAGARFAKWRAVLSIDPAKGKPTNLSITEVAHGLARYAAICQANRLVPIVEPEILTDGSHDITVCAEVTERVLAAVFKALNDHHVLLEGALLKPNMVTHGSDCPKPASHEEIAFYTVRSLKRTVPPALPGVMFLSGGQSEEDASLNLNEMNKMGPHPFQLSFSYGRALQASCLKAWKGVPENKAKAQQVLMERARANGEAQLGKYGGGAGGAAAASSLFEKRYVY

SEQ ID NO: 327 - protein, 489 aa, Toxoplasma gondii
MALLTTVRDSCFYFPQKTASRHVFLACVTALLQRSDPTFFCEQSTSMQPEADSAWQPDAGTVSLLTRVKDLRVAIAPVLWKSAEAHEHRHHPSACCGPVERNLLQYTARPAPPPFPDLAPSLLWPRARLRTKKIAGRSYTTPDCRHFAKMVCKLGINGFGRIGRLVFRAAMERGDVEVLAINDPFMSLDYMVYLLRYDSVHGHYPGEVSHKDGKLIVGGKAVTVFNEKEPTAIPWGQAGVHYICESTGIFLTKEKAQAHLTNGAKKVIMSAPPKDDTPMFVMGVNNDQYKSSDVIVSNASCTTNCLAPLAKIVHDKFGIVEGLMTTVHAMTANQLTVDGPSKGGKDWRAGRSAGVNIIPASTGAAKAVGKIIPSLNGKLTGMAFRVPVPDVSVVDLTCKLAKPAKYEDIVAAVKEAATSGPMKGIISYTDEEVVSSDFVHCKFSSVFDINAGIMLNDTFVKLVSWYDNEWGYSNRLVELAHYMSVQDGA

SEQ ID NO: 328 - protein, 116 aa, Toxoplasma gondii
MPKCMIFCPVAATPAQQDALLKDAEKAVADALGKPLSYVMVGYSQTGQMRFGGSSDPCAFIRVASIGGITSSTNCKIAAALSAACERHLGVPKNRIYTTFTNKSPSEWAMGDRTFG

SEQ ID NO: 329 - protein, 471 aa, Toxoplasma gondii
MRAGFSFALLAVGLLATAVVYSAAEEEAVTVLTASNFDDTLKNNEIVLVKFYAPWCGHCKRMAPEYEKAAKTLKEKGSKIVLAKVDATSETDIADKQGVREYPTLTLFRKEKPEKYTGGRTAEAIVEWIEKMTGPAVTEVEGSAEDKVTKEAPIAFVAELASKDSDMAKLFEEVANESRQLGRFLAKYGASDEKIYSLRYEEGTEAFTGKTKDELKKFVDTESFPLLGPINAENFRKYIDRDLDLVWLCGTEKDFDEAKTAVREAAKKLRDTRSFVWLDTDQFKGHAENALGITEFPGLVFQSKKGRFVLPEATTSLKDAAKISQFFDDVEAGKIDRSLKSEPVPEKQDEAVKVVVGKNFEEMVIQKDKDVMLEIYAPWCGYCKSFEPIYKEFAEKYKDVDHLVVAKMDGTANETPLEEFSWSSFPSIFFVKAGEKTPMKFEGSRTVEGLTEFVNKHGSKPLKKDDKGEEL

SEQ ID NO: 330 - protein, 645 aa, Toxoplasma gondii
MAEKALTRATTPTGSWRRPEPVDRADPENRRDSLHAGAPYASEGQGGRKTESGRSPESLSLFSRQFLAESRTPQSSWSRSRPSSSAPASSLRPSPSSDPSPRASSSSSCPACSCGLSSCLSTDSPGSRTSASGVPDKFKRSCAYSGKPPPSKKRRLLPAAQLASPTCTLKGHVYRCPLERKHSLPTPSVFLEKDGSLSSSALRILSRLHVKYVPSEDPHKVTSGSSGFVRTASFSASVKSGQLGGRASPPQTKTGLNPLISLLCCLPLLEPSSRPSCFFFLSPSALLTPSSSRASSSSSSKPPYPSDRVRPGGLTGDAFKLSRLQLLYDSLPLCCQPLACSSSLVSRFSSLDQSFGVPSASPAFVPINTWAFFLSLLATVTSSPLPCVSPSSVSPSSSSFESSDGFSSLSRSASPRFKRALVFVFEFIPTLCCSACCEADHAESLRRRGAEPTANAVECRGSQGSSETSRIENVQREDDAGGCRHGAGEGERRTEEKEGEHRLEAGSTEQTRQQGREPESNDDAGMPVSDEQRGDPQRPTGRVEREERRAANENDGFWARICGVENSQFIRVCRERFSRVVMLLPPIPEASHIMGCEEIKGEQSGREETHSQENIEADAELAWTTWIEQGGRVAELTNPAFDRPF

SEQ ID NO: 331 - protein, 182 aa, Toxoplasma gondii
MKIQSIVTKTTKAALTAAIDTLLAKGADAPAVSSFHEKGGAVPVLCVFIVRAYFVGSYLVIVPLLCFPNFPLLERLAQHCSSGTLLKGEDTLCRDPKASSCHLHLRLRFLEVVAVCFVLPRKQADLRLPLYRFQAGVRRPCLHAPRALNEAPLKFDVALFVQFVLHIKAFCCESHDSCCRPT

SEQ ID NO: 332 - protein, 216 aa, Toxoplasma gondii
MKVASGSAIVGLLLGAAVPVVYAGPHGGHRPQKKGGYTTTTTLPPNPMDVRTECFQVPYSVEKTCYKDEHISRPYTCPSSYSEEVCSTQLAESRDVCTQLVKKEVQYQCPKATKQTLCSQIPVTLNKTCKKQVTNKVPSSCPKILTVPECEIQSRPSQDVCYESEAYTQEYDCWGSELHRECEVDMRVVDTQCNRIVDSPVLYEYEDTVVERVCST

SEQ ID NO: 333 - protein, 952 aa, Toxoplasma gondii
MHPSGGQFVPTPQRHGPDLTKSWGLINRDFALRTREWAVSQRSLVFPVAVAAVRGETAPIAGRASQCPRLLVPFSWVLFLEQRPELSLTKVVFLLWNLYFVSLSPLRPFTGSLHPRPVVKMVNFSVEQMREIMGNPKNIRNMSVIAHVDHGKSTLTDSLVSKAGIISAKAAGDARFTDTRADEQERCITIKSTGISMYFEHDMEDGKGAQPYLINLIDSPGHVDFSSEVTAALRVTDGALVVVDTIEGVCVQTETVLRQALAERIRPVLHVNKVDRALLELQMDGEEIYQTFSRTIENVNVIISTYNDELMGDVQVYPEKGTVSFGSGLHGWAFTVERFSKIYAKKFDVPKEKMMERLWGNNFYNAKEKKWTKTQSENTRRAFCQFIMDPICTLFTSIMNDEKEKYTKMLGSLGIELKGDDRDLTGKALLKRVMQLWLPAGDTLLEMVVRHLPSPFAAQKYRVENLYEGPMDDEAAQGIRNCDPNAPLMMYVSKMVPTSDKGRFYAFGRVFSGTVATGQKVRIQGPRYVPGEKTDLYIKSIQRTVIMMGKYVEHVQDVPCGNTCCLVGVDQYLLKSGTLTTLDTAHNIADMKYSVSPVVRVAVKPKDNKELPKLVEGLKKLSKSDPLVVCTTEESGEHIIAGCGELHVEICLKDLRDEYAQIDFTVSDPVVSYRETVSAPSHMTCLSKSPNKHNRLYMVAEPFPDGLADAIEAGQVNARDDPKERANALAEKFDFDKNAALKIWCFGPETTGANMLIDTTQGVQYLNEIKEHCNSAFQWASKEGVLCEENMRGIRFNLTDVTMHADAIHRGAGQIMPTCRRVLYACQLASAPRLQEPMFLVDITCPQDAVGGIYSTLNTRRGHVFHEEQRSGTPLVEIKAYLPVAESFGFTTALRAATSGQAFPQCVFDHWSTLNGDPLEKGSKMEELVHNIRTRKNLKPEIPPFENYYDKL

SEQ ID NO: 334 - protein, 689 aa, Toxoplasma gondii
MFFLSTSVIPGAAVFSVRFARNPTPCLLPRNSLPVHLRHTALTPRFLEHSNLAFGFFRRSISTGCSRTLRIKSTPVGVLFSAKMASRTPFQDAALSIVKGAACIALSLKTARTTQNVKFSKDNRCSITLGPIEVEPTAAEEALLKTLTKQKIEENCPFRVFTIPRDLATRMYQESYLDEFGIPANVKEVRLVVLPEWNINANMYPVLKSTGQIADIQFESVKFNEEKKQLCLSLHVVPGPDEQSPALAEEEKLGPEEIPSRAQVLPPSGVEGDDFGEGDDDQTITPWDVQAAEGGIDYNKLLRKFGCSSITPELISRIEALTGKRAHHLLRRGIFFSHRDLNLLLDSLEKRQARLASGKREDGPGSEGLSGPGFYLYTGRGPSSEALHIGHLVPFMFTKYLQDVFDVPLVIQLTDDEKFLFKDSLTLEETHRLAFENAKDIIACGFDPDKTFIFSDLSYIQHLYPVILEIQKKVTYNQVRGLFGFVESDNVGKSAFPAVQAAPSFPTAFPMIFGGKKDVRCLIPQAIDQDPYFRMTRDVAPRLGLLKPALIHSRFIPALQGFKTKMSGSVETSSIYVSDTPEQIKNKINKYAFSGGQPTEAEQRVKGADLDIDIPFQYLTFILNDDDQLKEIGEKYQKGEMLTGEVKAILIKELQALVLGHQERRAKVTDDMVRQFMDPFRPCFKKYAQ

SEQ ID NO: 335 - protein, 475 aa, Toxoplasma gondii
MERGQMLEPKETAKALSATSSGYYSDHVDQNEQVRLLNRLANAEGSSQVKQDAVLANPPDWKTLEKAGVLPAGLSAVLSKINPLCLDEFAEMLAADPDLVRALVALVRLEGNLHTVQYVLTVLCEVVRDDSSKYEALCSAVADSEVFEAFRQLLEVANLDSYTADRAAFLLSGLMCRARSGTFSDSQVEYLVQGLLHGRAANKFLLSEGGRLDAFVNLLKIDGYRPMIWDCRGFPELVLRNLSLTLPASVLYKAMFCVWLLTFHDAFLPQLNEKGIVVAVCVVLKESRVEKVIRVGLGVLHNLLKCDASVETVIEQNVAQVLALLEFEKWRDGDMYDDIRLATSHLEQKIRQFNNFDRYCHELDKGQLTFSVLHSEKFWRENVMAFENDEFRAIKKLVKLLDTSTDKTTLAVACYDLGEFARLHPAGKKVCQQLKVKDRVMLMISDKDREVAGEALLCIQKLMLNNWQDVAELGK

SEQ ID NO: 336 - protein, 616 aa, Toxoplasma gondii
MAPRGEAAAPEGDAEMGIIYKVSGPLVLAEQMSGTKMYELVRVGWQRLVGEIIRLEGDKAFIQVYEETAGLCVGDPVLKTGKPLSVELGPGLLDNIFDGIQRPLERIAQVAQSVFVPKGVDVPALDHKKLWEYNPVANVQVGDILTGGDIIGTVHENNLFLEHRIMIPPKIQGKVSWIAPAGSYTVKDTIMTLEYRGEQIPIQMAHDWPVREPRPCLEKLSGNTPLLTGQRVLDSLFPTVQGGTCAIPGAFGCGKTCISQALSKYSNSQVIIYVGCGERGNEMAEVLTEFPELTTVVNGQEEGIMQRTCLVANTSNMPVAAREASIYTGITLGEYFRDMGYHVAMMADSTSRWAEALREISGRLAEMPADSGYPAYLGARLASFYERASRVRCVGSPEREGSVTIVGAVSPPGGDFSDPVTTSTMSIVQVFWGLDKKLAQRKHFPSVNWTTSFSKYIRALEPFFDSYDAEFSSLRQKISDILQQEAELTDIVQLVGKDSLSEDQKLILEVARIIREDFLQQNAFSDYDYMCPLYKTVGMMRTICHFYDQCLRVMQETSGSEHKIGWGTIYNTMRPTISRITSMKFLPPTTTEAQAKQHFKQLSDEITSGLRGLVEK

SEQ ID NO: 337 - protein, 505 aa, Toxoplasma gondii
MAAQAAKADAALAHAAAASRDYRVAPRLDYRTVAGVEGPLVILDDVKFPMYNEIVNIHLGDGSVREGQVLEVRGKRAVVQVFEGTSGIDTRQCHAEFTGDVLKMPISEEMLGRAFNGSGKPIDRGPRVLAEEFLDINGCPINPQCRVYPKEMIQTGISAIDVMNSVVRGQKIPLFSAAGLPHNEIGAQICRQASLVAGKDVKDHSNENFAVVFGAMGVNMETARFFRQDFEENGSMERVALFLNLANDPTIERIITPRLALTTAEYLAYEREMHVFVILTDMTAYADALREVSAAREEVPGRRGYPGYMYTDLSTIYERAGRVEGRNGSITQFPILTMPNDDITHPVPDLTGYITEGQVFVDRGLHNRQIYPPINVLPSLSRLMKSGIGRGMTREDHPQVSDQLYANYAIGQDTRAMKAVVGEEALSPDDLLYLEFTDKFENRLLSQGPYENRTIFQSLDIAWELLRIFPEDMLKKIKEEELRKYYPRDKYLEEQERNDKRVPPS

SEQ ID NO: 338 - protein, 404 aa, Toxoplasma gondii
MLGSSEGGARGCPYWIVACNTDETHSAEQIFSSLKHAVLGSRNALCDEACLLDIPHLKFGTFDDLIRSVDILQKQDAYVESVIRRIERQAVEIDPDCELKVVWQRHSLTVDQYIRRFQWDDAKFPRLRAIPENLDALVQSVTKTDDEVRAKVAVWQEVRQQMANSASGKKTGPATYFQRDLIDVLSPDTVRDDDFLVTEHLTTAVVVVPRGQEREWEQSYESLDAFVVPRSSRKFNVAEDADGNALWRVILFTSHLQAFRQAAQAKKFVVRDFHYSPQAYKETVLARSRVEAEKTKQETFLSRVCFAAFSDIFVAWMHLKVMRTFCEAVLRFGVPPEYAAFVLRPVSEAKEKKLRHELDKLFSPKGGFGNSYFSGKDDPGSDDEDFYPYIWLALQPFGSHRASA

SEQ ID NO: 339 - protein, 396 aa, Toxoplasma gondii
MELSFFNVDDGYLEGICRGLRSAFLTEEDYKKLSAADSLEDLRSALEETDYGPFMQDEPLPLAVPTLSQKCREKMASEFRYMRSQASGPLGKFMDFIATEKMIDNVVGLIQGALNRKSSHELLARVDPMGYFQEMAAIANMDLTTSYEELYRALLIDTPVGKYFQAFLTESGSQAAAHSAEHGGRSLAEVASIVSETDIELMRNSLKKGWLEDFYAFVQSLGGTTKEVMTHILKREADYRVLRLVVNSLSSNQQQQMDRQALYPSFGYLYPEGTDGLRKAWNDTTVRAALAPFSSYLNLYEQCKSFYVGQEGQGNEAAINMASTSKFKSLEDLLYSETATMCELAFEQQFHYGIYYAWVKLKEQEIRNIVWIADMILMKRKEYISDQIVPLFPPRV

SEQ ID NO: 340 - protein, 345 aa, Toxoplasma gondii
MLSFEFSSGVYMRNNSSAALQETGVWHNAWRARSKLPTAFFIDISSFSVGSFFSSHSLANNTSSTPPFVCKKRFVTAPIYLRFPRYHEEEFAIFFPTLSSSPAPAPLGKMAMDDAEAQRQIQQMVKFILNEARDKAQEIEARSLEDFNIEKLKLVQQMKDKIRQEYEKKAKKLETQRAIDRSTAVNKARLRRISAQDQVLSEVYSQAMTQLSAVSRDRAKYQKLLEDLIVQGLLRLLESEVIVRCREMDKALVEAVLPNAVKRYSEIMRTEAGLHKTVTATLDKSGRYLPPPPSADNDGMSCCGGVVLMTRDGRITCDNTFDARLRMVIVECAPAIRHTLFPSHQ

SEQ ID NO: 341 - protein, 195 aa, Toxoplasma gondii
MHQFRCLARIKKHYCGGDTVENHSDKNKELQLEQIFAPATVCGLSRLRPAAGCSKVVLVSKILLVLAKMAPVLGRVQGTDLKVAVIGDEDTVAGFLMAGIGMRDGLGRTNFFIVDSKTKRQDVEDAFRTMTERPDIGIVLINQHVADDIRYMVDLHTKIIPTILEIPSKDKPYDPSKDSVMQRIKFFFGGELPTS

SEQ ID NO: 342 - protein, 131 aa, Toxoplasma gondii
MAAAKGSNALIQQLLEAEEEADTIVNKAKENRVKMLKDARFSAEEELKVFRAKEEERFKAEYEQTAGQEDSLVSSLEAKTKGEIEGIKKDYMENKDKLIEFIHRKVMDVDLSLDTETIAVLRTCDKRGVAP

SEQ ID NO: 343 - protein, 157 aa, Toxoplasma gondii
MFWSAFLQCDPNSTFFGFMGITAAMVFSNLGAAYGTAKSGVGISSMGVMRPDLVMRSIIPVVMAGILGIYGLIISIVINGSMDTPDTYSSYAGYGHLAAGLTVGLSAMAAGLAIGIVGDAGVRANAQQPKLLRHDAYPHFRRGSWTLRSYHWTCRRY

SEQ ID NO: 344 - protein, 162 aa, Toxoplasma gondii
MERASAAAATRSPIFASALTKRKPLLLLLGFAVVLTFFTCGVPTTSLRLRGPKFTLQDMKKAIKDAKDGVKGVEDAKKKHQKAEDSAKKASGSKKDKLQKEADEKKETLQSKIKDMKQKCEELRQVKEGTKNNKGLSDKEKKDFSKEGEKADEVLKRCGTVV

SEQ ID NO: 345 - protein, 571 aa, Toxoplasma gondii
MRTSVALFFAAAGGISLVCAPQVSLAAPVQGTLGPDVADTAGEPVVLQVARGADSLPDSRGNIDEEGITEVATTGVPPQTQSSGRSFGQRVMSWFTSARNAIRRPRTDEQGAVPGPSQPIPSGTDSTPEGWETVQSGDVPPGEPEPKAPTRSPRQRARDMFGRVGRFFGGARRFVGRGWRRFTTGMAGVTDRVRGRLALRSSFEFRNEEAVGQSELASLASSMTVTAPEGEALEVAREAGLRSGASINLVSATTGEQVTVSLRAPLGIGEYTAVFSGFISGIDSELAVKAFLGKTTESMSVAETEARILKIVSLKDPVDAMHRLRLLAPIETLVYRGDGDSADQSEGRPVVLVPKASSSLVDVINFLRSGDASAFDDRAKKIVLLGATVQLIQLLAALHTRKVVHGKLEPKSVLLFSHGLLYLSDLGRARRHGERFTTSRPSRYGAPEVLEHPETPYTYSRDGYSLGIILFELWCGRLPFDLGTPGVDSSEKLENSHPATLYQTVRNLDQRLSFDVCPSDMPESVKTLIRKFLTRRRWTRLVPQAALRDANFRRTMQLLQETVQGNGETQL

SEQ ID NO: 346 - protein, 572 aa, Toxoplasma gondii
MEKMEGRKSFRVLGTPLPVAALAAILLLGCMYTRAAGTPDDSLFPLSEDTSVDPRESFSAEDVLNAFVSPESVESLFASIVAEQVVATSGNLTESAPRDRDSAPERRSDGGTLRGHPEDAGELLRLLLADSEDMELWKANFFRHLTHSMRHIVRDSVLVSEKAFPSEQADEAGRDPGDLKKALKETGEDVFWESRPASSNAAVALIKRKMEKQAGKTGEGAGHTWEPEVSLRFRYLSLKDAKKLMGTFLVNTKVEGFPTPKGMPLPAKEFENATEPVPAHFDARTAFPACKDVVGHVRDQGDCGSCWAFASTEAFNDRLCIRSQGKGLMPLSAQHTTSCCNAIHCASFGCNGGQPGMAWRWFERKGVVTGGDFDALGKGTTCWPYEVPFCAHHAKAPFPDCDATLVPRKTPKCRKDCEEQAYADNVHPFDQDTHKATSAYSLRSRDDVKRDMMTHGPVSGAFMVYEDFLSYKSGVYKHVSGLPVGGHAIKIIGWGTENGEEYWHAVNSWNTYWGDGGQFKIAMGQCGIDGEMVAGEAAWQETEGVVNGEEELPGQHASGARVGAHAEEEREM

SEQ ID NO: 347 - protein, 537 aa, Toxoplasma gondii
MIPRTCDDPRRDSCCPLFSVDCCPPHPSPSSVFQSDGKHELPASEIPHSFRAVPEGTFAARSPRSHGAGQPQGECPSDATTSAASDTSSQAPHDVPVFTDSLLSSSTSEWPHQGPRSDAVESLEHAYISGTVSSDEPVSEEPLSSDEEYLPSVDFTKNASCEMSPGDLPESLNSVSEPVSKLHSGPSRHATVIRRAPQSARDGFSVMRKDASLRQPAIPPMAPVRLLPSRRCQWLRALPVVFLMVLIAYILAVFVMYHALPLLQLNIPQSMKFASTYNRGLFELLGVGILTFLFLVSYWLAVVTPPGSIPNTDEWSYSAPEIFDIEGLPSVVETKKTGARRHCKWCRRMKPDRAHHCRVCRQCVLKMDHHCPWIYNCVGWRNHKYFMLSLIYGSLDSLLIAICMFETVKRVVASDKDQFEKMFMVLFAETLDIFLCTLITGFFFFHTHLVCNGMTTIEFCEKQFMRPRTPMQESLWNKGCWRNFTDAFGSNPLIWLLPIDNRPGDGVHFITEDTRLLHTPVLRRIRTFEPIIESSVD

SEQ ID NO: 348 - protein, 399 aa, Toxoplasma gondii
MRTSVALFFAALGSISLPCTLHVSLAAPMQGTLGPDVPENTGEPPVLSSSSSDVPLRGAEGGSTQEGAVEGPLPQEWRQPPPKPPRRRLVESMPSHSSSSIRRGGESIVTGPENVANDEGGSPSDDLKIVQPEDVPPGGPGPKAPGVGTRMRNWATRSPRQQAQRARDMFGRMGRFVGGARRAVGRGWRRFTTGMAGVTDRVRGRLALRSSFEFRNEEAVGQSELASLASSMTVTAPEGEALEVAREAGLRSGASINLVSATTGEQVTVSLSAPLGIGEYTAVFSGFISGIDSELAVKAFLGKTTESMSVAETEASILKIVSLKDPVDAMRRLRLLAPIETLAYRRDGDSADQSEGRPVSWFPRPRPRWWMSSIFCAQVMPQHSMIERRKLSAWARLCS

SEQ ID NO: 349 - protein, 96 aa, Toxoplasma gondii
MVSEATDKVTGEKIAVLVDHTSTKGSRKDMDKQWHYVPCAVLFGKVKNSITACNLQRFLVPFYFARIPERPITQEARQGARKAGSLMPCRCCLDSG

SEQ ID NO: 350 - protein, 519 aa, Toxoplasma gondii
MTDCPFAAIRGSSGRISRSHVAFLVILAVSVTSNPTLAFHRGSLQGTATRDDLPTQAQYLSAIGAHETLVRAQRRAAFQKTPGKNSGRPHSLLQDVAEERENSSTAVGSIPHFSALPESEWDYKQHGKDWGGMCATGMQQSPVDLHIEGLQEPEYRNLTNVYMNAFAGTQPSRTLKPWKRGDFFYTYPHQFTKVEVYKTSKVFQVRVPEDQMTPLGALFSTDTTEMYTAQHIFFHSPSEHTFQGEANRREIEMQIWHYSNDLLSYESSTSLNHTSLPFLALFAQSSLNLPDVEEALKRDHSSGSDPSLPSSHWRVISLTFMSEELDQTSLAELKSLPSERMLSTLLSAERISSQAGQSEKVELAHPLNLQSVMMMLQLTNTEFFAYDGSTTMPDCKENVRWYVARQPLPVATETMLRFYKMLNPHQLRSRDENDGNFRMLQNVEDNMRNEGNVFLVQGFPLQVLIANSLGFDTMAKMSKEGAQMFQGWFSAAGEHTFGHSGSALAFATAALVFLNTVGI

SEQ ID NO: 351 - protein, 176 aa, Toxoplasma gondii
MWADYLSEFASLHEDAERILAGGDPSEGVEVRQQKLDALMKKMKRCFSSLEMNVRSLQPRERQPLEASLMNCRRQFTDIERRTLLLREGSRGSGQPSASKSRQNTLEKLKKGSSQLEESLRLAAEAEGVGESALCSLYVQRETLSRTMTRTKDVQRNMDEADTIVTKMSKWWNGIW

SEQ ID NO: 352 - protein, 277 aa, Toxoplasma gondii
MRTSVALFFAALGSISLPCTLHVSLAAPMQGTLGPDVPENIGEPPVLPSSSSDVPLRGAEGGSTQEGAVEGPLPQEWRQPPPKPPRRRLVESMPSHSSSSIRRGGESIVTGPENVANDEGGSPSDDLKIVQPEDVPPGGPGPKAPGVGTRMRNWVMRVPNIELQPPRQVVGRMGRFVGGARRAVGRGWRRFTTGDASAFDDQAKKIVRLGATVQLIQLLAALHTRKVVHRMLEPKSVLLFSHGLLYLSDLGRARRHGERFTTSRPSRIPGTLLEQVD

SEQ ID NO: 353 - protein, 332 aa, Toxoplasma gondii
MRTSVALFFAALGSISLPCTLHVSLAAPMQGTLGPDVPENIGEPPVLPSSSSDVPLRGAEGGSTQEGAVEGPLPQEWRQPPPKPPRRRLVESMPSHSSSSIRRGGDSNVLLPEAEGGSTQEGAVEGPLPQEWRQPPPKPPRRRLVEAMRSNSSSSIRRGGESIVPGPENVANDEGGSPSDDLKIVQPEDVPPGGPGPKAPGVGTRMRNWVMRVPNIELQPPRQVVGRMGRFVGGARRAVGRGWRRFTTGDASAFDDRAKKIVRLGATVQLIQLLAALHTRKVVHGKLEPKSVLLFSHGLLYLSDLGRARRHGERFTTFRPSRIPGTLLEQVD

SEQ ID NO: 354 - protein, 264 aa, Toxoplasma gondii
MFPRVALFPVPTCDLFLVGRSRLSRAAKLHLTRQLVVSVAWLHRHGVAHNDLKLENVFPSEEGKAVIGDLGFGVQIGTSARLKYTAAYLDPHAAEECLNNQVETVANEGTGAWALGTLVFVIWCRSYPVVSREQACLSTRDLRDRLVTMAKTTKPTPSSHHCQELPSPVKDLIAGFLQWSREARRLPGDDVDEFLAATLLLQSQKQRPPQRVCDTDNCHIQITATVIPKTNHWFTILTTGKSGRPIDFLIYEIGRGLTGIRGQE

SEQ ID NO: 355 - protein, 122 aa, Toxoplasma gondii
MFTWTQESQQQALVDEKSSCLHRRMHEHYEIFSLRLWRQTYPFRLDSVSAATAQEVKQFTITCAQKTTPQPDIHSCTGVPVEVRKIFTGFLHRFVEDRRLPGEVAEEFLAATHAGGIEGPDQ

SEQ ID NO: 356 - protein, 248 aa, Toxoplasma gondii
STQKGAVEGPLPQEWRQPPPKPPRRHLVESMRSNSSSSIGRGGESIVPGPENVANDGGGSPSDDLKIVQPEDVPPGGPGPKAPGVGTRMRNWATISPRQQAQRARDMFGRMGRFVGGARRAVGRGWRRFTTGMAGVTDRSEGRPVVLVPKASSSLVDVINFLRSGDASAFDDRAKKIVRLGATVQLIQLLAALHTRKVVHGKLEPKSVLLFSHGLLYLSDLGRARRQGERFTTSRPSRIPGTLLEQVD

SEQ ID NO: 357 - protein, 489 aa, Toxoplasma gondii
MSILGKHTATVGDRYKVRLTPEYGPGGGYGHCRDYLLQSESCWRGDLTSGVRGVLTKKGTRARTTKRHDLVAVTSGEHYWNQGLVYHEEQTAPPVAASSSFMQSTTSLATPADLNAPVDTQGQLDINSVLKNRPPAEAQLSPREIAAKTHFEAMFAKGLQLTVESIFTGETFTLTKPARFLGWGSTAIVFGLHRVKVGGASAPQQLAAKINVRSLQELQHLSSSQKKTALEDIQERFLREESSARNALQHVTPETALEHGVLFPVDVCRISKLFSGFCAGISYVILPVLALFPVFTCDLQQVVKSGLSRAAKLYITRLLLQAVAWLHANGVAHNDLKLENVLLSAEGKAVIADFGFAVKLGTASAIQFTAPYLDPQTAEAVPQEKTKTTASEERDAWALATLLFLLWCGSFPYVSDEQADLPTSDLLKLLVTLGKTEKPAPNFHLCKDLPPAVGHLVTAFLQWNSDNRSRPGDVLDDFLAATVSEGASA

SEQ ID NO: 358 - protein, 204 aa, Toxoplasma gondii
MSILGKHTATVGDRYKVVKSGLSRAAKLYITRQLLQAVAWLHANGVAHNDLKLENVLLSAEGKAVIADFGFAVKLGTASAIQFTAPYLDPQTAEAVLQKKTKTTASEERDAWALATLLFLLWCGSFPYVSDEQADLPTSDLLKLLVTLGKTEKPAPNFHLCKDLPPAVGHLVTAFLQWNSDNRSRPGDVLDDFLAATVSEGASA

SEQ ID NO: 359 - protein, 568 aa, Toxoplasma gondii
MRRLLLSPVGFVIVLATLLECHPPDRCVAHHGSSTDESNVWSPRGAQFVPGASEAAVKNQVGIPDSALLWPSQDATETGLRPTEQVEARSSFPAAKQYLSEAAPARGDLPPRATGLLRRRGARVRTVKAHEIGVETPKTYGWDHRVVDSEKQTTAPVADSSGFIQIPSSRATPTTLNAPIDLQGRRDIRNIVRNRPPADSDLSRSEIAAKNGFERRFVRGLQLKVESLFSGGVFTLTGPAQFLGIGSTAIVYSLNKVQADTASAPERVAVKISINNLQRLRSLSVFDRQELLDKTPERFVSSEGAVRNLLPGVTPETALEHGILLPLDICRVTNLPSGFRAGPDYKMFPRVALFPVLTCDLFLVGRSRLSRAAKLHLTRQLVVSVAWLHRHGVAHNDLKLENVFLSEEGKAVIGDFGFAAEVGTSTKLRSTPAFLDPQTAEEYLQRKTETVVTEERDAWALGTIIFVIWCGSYPFFSFEEAVLPPAVLWQNVVFMSKTTRPAPPLQHCKGMPSPVKALITGFLQWNSDDRRRPRDVVEGFLAATASEPATSSATAAEGSVRPRASRSQ

SEQ ID NO: 360 - protein, 541 aa, Toxoplasma gondii
MKNTLLSPVGFFTALAVLIECHLCDRCVAHHGSSTDGSGLRPPQEVDSAPRTPSIAVKELATFPGDDIQTSSQELPGYELWTREQSGASVRVGFPQNAESFLTQREARDEIANAHELVAVTPEGDAWNHSGVVPEEQTVTPASGSFIQRQAAHAPPSTRLTPVDRRGRSHTVSAVRRRVTVEDVMRPDQSAAMHAVLSAFGGGLVLKAKNKWGRTRYTLQGPATFLGMGAEGIVVRLNQVKSDRERSVTPVAVKLCLIRAAVFSGLTWWRKRRTRTELMKLFLSNENSVKRALPDLDPAEMLEHGLVVPHHAELVSGMPTWFAAGDSFFVLPVVSVSPLFTCDLETVVQNPLTFWAKMYITRQLLKSIAWMHQKGISHNDLKLENVLLSADGRVAIGDFGFSSPFGASLPIRGTHLYMDPDSSEAFFEQRENEITPHRDAWATGVLLFYLWCGVFPFGLQNVANASPPQVMRVTVMHARTTRPPPNFRLCRRIPREVRNLVTGFLQWNEEARRLPSDVADAFLAATDDGGREARRIRTHQF

SEQ ID NO: 361 - protein, 199 aa, Toxoplasma gondii
HVLRKLHLTRQLVVSVAWLHRHGVAHNDLKLENVFLSEEGKAVIGDFGFAAEVGTSTKLRSTPAFLDPQTAEEYLQRKTETVVTEERDAWALGTIIFVIWCGSYPFFSFEEAVLPPAVLWQNVVFMSKTTRPAPPLQHCKGMPSPVKALITGFLQWNSDDRRRPRDVVEGFLAATASEPATSSATAAEGSVRPRASRSQ

SEQ ID NO: 362 - protein, 697 aa, Toxoplasma gondii
MRRSRSKYHVGTFVTGSAVQRLTLVGMYSAVWVTSAHSSPVNSATVSPSFFFLHSKPPHGSPPNERTTGESSGSNASIELMEMQPTQPESLSPTAMAARRPNVPPLPEASGLPSRLPPWQETPFSPGKGDTQDSAQVSTPSGTPRVQPISSPKREALFRMSPPPVPKRSLRRTLSQYFRARKHSGVPNPRASAQLPTADREQAVNRPHRASRLMKSSPSSASHQAHGAAPHRRRAATSPQPRTRRDPAGPVGRTLRNWISDRLSRAYRHVRSRLRTGYARLLRQLHSMTEKIPTPPVQLPGQECVNVLGAHVARQVADWRQQMGRTSLEFAVDAAFPRDKDISFKSYISRKSVTLRMGKVLGGGARSIVVEVTRVDTGDRWALKAFLVPRDVIGSPGTPPPWDAISEEAHAIKLLPHTVPAVVYRNLRFLVPADVLIYEGDGMEKLWNRRGTGSNFYTTYLLFPIAQGSLLDAVRAMFRDARRGNAEVSDGEAARTLAANVSFSIQIIRLTALLHSHGVVHGDFQTKSFFLCQDGSLFLGRVRSLTRVGAPYRSPSSATDSPRCTPPEVLSPPENAAFTFSLNAWELGCILYQLWCEGLPFGLSPTPETPGKIVLPPVITSPYLQTKKRSGLAGTSTRPVKHLVFTGCVKNMPVEMRQLIRRLLQEDPHKRLLPTEILRDPVFQKLEEQSRPPDAQA

SEQ ID NO: 363 - protein, 114 aa, Toxoplasma gondii
MWLWFPCCQFIHVAAQHEEKQCSGSAVHSGRTRVAAHFVRLKTTRTCCKTEDGLSAVIPLVTQCAYQPGKPSNSGGYFLVLEILPDRCLFFSLTTSNTLTGNSSSVLEINELLN

SEQ ID NO: 364 - protein, 494 aa, Toxoplasma gondii
MTVAVNAMVTYGELERIFCTCTSHYFCSTVPQSGAVTSEGELQNETGPEGAQEGRGMEGDDPTVLSDTARAPGDRSNAQNRGEKSDVNLHASVVVPRETDNHGEFSVTLYPPRPAEEDKQSMEQSERPESEAVLQAKDDDEVSEDNAVLSERQEWQRIETVGREWLKSQVAAFVPPDVTPWPDPDSSVDRLFAKKFPSGKLLILEPDEPGGTYEVLYRGPVLGRGTRGIAFKGTMVATGEHFAVKLQFVRKSLFRRRSSLLRDLVKYLQQEFAVRNMLVAAYGEENVQKKGMVLPLTVRRRHAFGDFITTPFSFTMFWNFLVFYPLMKCTLGNLLVGPHWPREARLFVAKRLIEIAAALQRAGVLHRDIFESKILLQEGSGDIFFADFGDASGKHMQSGIAWIELQLAESSRLGHLVYYVYTGKTFTKFWKFRCTDNVLFHNDVNVKDVPLADKLIRNAIKALITCNKDKRILPQEITASIPFFRDEPEFYESK

SEQ ID NO: 365 - protein, 346 aa, Toxoplasma gondii
MRFPVASLFAAGWLGLAVSAEEPTWESLEERGRELVKQHVSAVSGYTHLFERELHMVNAATAVLPLGSVLEVWGGKRLVRGRNVAVTEGAVLFDVTDNESKHEYTAKLFSVANKSVVKALSAVWKSFKEKNVENVLVERFGSDENVLKSGFLVPVGGGSIVNVPPVLQPAGKWSDTSFLGALILYPRVAQTLDALLWSGATLEKAAKFFLIRRLIRSVGDLHRSELCHGNLHPTNIVILAESGDIALTSFGDSCFQSLFVLSDAMGVGGAKQDTVRLGNIAHAIYTGKYPSDDLDKCNDNPDFPKADDTDVNDVVIRAAIMRLLCCGECPMQKPADMVVASPLFSS

SEQ ID NO: 366 - protein, 1781 aa, Toxoplasma gondii
MTGGAAAPRSSSGASRTPLSLRFSLTLLCSLVALLTLSVSLSTPASHTYVFAVVAADTGVSSVPGHERGASKAGPDATVKSKRRRERSKKSDGNVSAKGGPEESEMQDQSTTDVDFETTPPVARDAKTQSKRDATTRGKKGKRSRRKRGEKSKKGNREAGAKGDSEASLTEGESKADIGGETTAQVERDATTKGKKSKRRRSRSRRKRGEKSKKGNREAGAKGDSEASLTEGESKADIGGETTAQVERDATRKGKKSKRSRSRSRRKRGEKSKKGNREAEAKGDSEASLTEGESKADIGGETTAQVEREATRKGKKSKRRRSRSRRKRGEKSKKGNREAEAKGDSEASLTEGESKADIGGETTAQVERDATRKGKKSKRRRSRSRRKRGEKSKKGNREAEAKGDSEASLTEGESKADIGGETTAQVERDATRKGKKSKRRRSRSRRKRGEKSKKGNREAGAKGDSEASLTEGESKADIGGETTAQVERDPTRKGKKSKRSRSRSRRKRGEKSKKGNREAEAKGDSEASLTEGESKADIGGETTAQVERDATTKGKKSKRSRSKGKRGEKSKEADLQEGAKGDSEASLTEGESKADIGGETTAQVERDATTKGKKSKRSRSKGKRGEKTMKRDTQLAGKGEPQTAAIVDALLQMESGSLTEREAVAKDPKEGNADAIVGTDSIEARVAVSAERTEEGGKPAEAVSAADASKSAEQGRQKSTKRGKKRHRRNRKRSKSKKSHTGSSAPTTAGVSAPTGSLPLSSETPTSAEKEATEFLLSSGFPAISAVLASRGSKLDAAKKSKGAPGSTSVVDSESVVSGRERQTHDEFLPPVDVASVLRRANTGDESLFDPDEADNTSAATKAFEVTDDEPKAEKPSETETQLQELMATVPQLDELLQKLPKLEELATRVPQLERLSESEAQREASNEHGRHSAELRATGPSLDEPMRGPRFGALQATESKPVPTSLANVLISSLVFPPRLSLLFAQPASGATQKKATVGEQTSPADSPQTKGALPPTAELPKERAAANSNVETTAKSQGDSEAEKLLKELRELEKGMQSQTVGDISSTRGETESDNSRTRPESDIKYRGMSGSFSGSGPASSRHMKHRVSIRGSFGEADVVLLHQKPQRGDETAERTSSFSATADNSVSGPRRRGFGPVPRSIFGSAFSDLEAELQGDVAEFGDAAGIEESFGFFGERRGGGDRSRRSRERRSEDRSRRRRKGSKGHREAGSSAATPGSRHLRQVDRRSGLARAEDVDPEESSEESRGSREEHSMKKLPARERSSRSAGPSLSRRRSRLDHELEQRRAKEAMEAAETFDERGGYGSGGHNWLTPGPPLVVSGESWPRRGLLYPEPALLLEDSRAVQMMENAAKELAHSRQTPVLPGDRGRVAAAGGAFERLFPRGALFTLQPTHGQPFEPKTLKRGRFLKAGGGTLLFEVWEGRTRWALRLHLTELSERERTGLVSRFPVDRVSGAGVSAWQRTADGVCAEAEELELHAVRILMQQNEQPRDLFCRERIALPVAVGEVSSLPKVTQLRDGEHVTNIGGLYPLAACDMRELAEQYVMPEEVKLEAVRQMVAAVGRLHSRGVVHLDLKLEHFLLDNHGKVYLGDLSTSEKITGVNVEPTSCEFGSLESLSPEHLACWARQQRKFTPSMATDSWSLGVAIVQLWCGEAPFRVPDALWSNGPVAVAQYLDQLLRRTDGEIDFSGCPGGDITNPELKRIVTGLLTYDRVKRWLPLDVLFTSPLMIDPAVARNASSPSVSPLTSGKRSSKNRKRNN

SEQ ID NO: 367 - protein, 538 aa, Toxoplasma gondii
MAGPRSPLRFVLLLSLLALKVFVDSPSVLPALAGESAADLSTSIDDDDFDSSSGVAVPSLTTEQEVHRTQEALDPEVVDLGKPSPYAEEESGILAASASRLNFSPMMALKSFFHMGGETGAPGHRSRIDVVKNAAMDHVHRLLQMLRESSEDEEERLLFADRREKKVITVNEWYTTTVAATMLGRRPTDEDAILVSAPATSRPNVRIKAVFDGHAGEATSQYCAKHAAKHLGKLSEFTFAEVKKACLSLDAEIIRKLGPKHVAGSTGIIVAIERLSAPVVENVVGREIVPRAHEETFVPLEKLIQEEEEAEHPELVGRYPRVPDVQQKTIPAGSFLVTAINIGDSRATLIHSDGGLTRLSKDHKPNHPTEASRIEKAGGSVETFDVPRVDGVLALSRAFGDSDFKMNPNLPPEEQKVIAVPDVRQFYALSSDLLLLACDGVYEPSGMDWAYVRDLTVAEMQRSKGDLEEVAARVMDYAYDMNSQDNISVMLVAFHNQEVEHPTAVYKVVSGQGVVLSETRRPSDAEDDSVEGDTVSLF

SEQ ID NO: 368 - protein, 479 aa, Toxoplasma gondii
MFSCECHFCCANPNKSLPVIEQVTAYTCAKATAAMASLRVLALACLPLFAVLHADAKTLLGKVKRATGMGVGEGPSVAKKPKYTATVPGFTPPSGDQRMNEFMAVDTSGEFMRHLYIEEGRTVCASATSRNRRPTSESPHSDDVVVVEGMLRGRPETRVHAMFDGFQGRHSAMWLAQNVMNYLNDLRDVNEEEITRQFERMDGDLRAANLPGGSSALIIFVRYEKKPTEARVVGRQIVPEGAKEFTSVAEALGGPLMPVVAMNFRRDPRAAKGIYTIHVASLGNSRCVLKSGRTAIHLSTPHTASSHKERHRVQAAGGVFTTVNGELLLGGVVPMTRAFGSFDFKKGGQGKLQQDLVSAVPDVTTFFAYPGDDIVAGTAGAFAHFRSHAAIAAAIALYPVSPETVLDAAKAMVVNAKRRKVTKNISTFVRHLPESRTRSQKMLEGTSGENGEEDFSIDRTNELTQALQAGFFSFLLYYP

SEQ ID NO: 369 - protein, 320 aa, Toxoplasma gondii
MTGGAAAPRSSSGASRTPLSLRFSLTLLCSLVALLTLSVSLSTPASHTYVFAVVAADTGVSSVPGHERGASKAGPDAAVKSKKRRERSKKSDGNVSAKGGPEESEMQDQSTTDVDFETTPPVARDAMTQSKRDATTRGKKSKSKRSRSRRKRGEKSKKGNREAGAKGDSEASLTEGESKADIGGETTAQVERDATTKGKKSKRSRSRSRRKRGEKSKKGNREAGAKGDSEASLTEGESKADIGGETTAQVERDATTKGKKSKRRRSRSRRKRGEKSKKGNREAGAKGDSEASLTEGESKADIGGETTAQVERDATTKGKK

SEQ ID NO: 370 - protein, 1320 aa, Toxoplasma gondii
GAKGDSEASLTEGESKADIGGETTAQVERDATTKGKNSKRSRSKGKRGEKSKEADLQAGAKGDSEASLTEGESKADIGGETTAQVERDATTKGKKSKRSRSKGKRGEKSKEADLQEGAKGDSEASLTEGESKADIGGETTAQVERDATTKGKKSKRSRSKGKRGEKTMKRDTQLAGKGEPQTAAIVDALLQMESGSLTEREAVAKDPKEGNADAIVGTDSIDARVAVSAERTEEGGKPAEAVSVADASKSAEQGRQKSTKRGKKRHRRNRKRSKSKKSHTGSSAPTTAGVSAPTGSLPLSSETPTSAEKEATEFLLSSGFPAISAVLASRGSKLDAAKKSKGAPGSTSVVDSESVVSGRERQTHDEFLPPVDVASVLRRANTGDESLFDPDEADNTSAATKAFEVTDDEPKAEKPSETETQLQELMATVPQLDELLQKLPKLEELATRVPQLERLSESEAQREASNEHGRHSAELRATGPSLDEPMRGPRFGALQATESKPVPTSLANVLISSLVFPPRLSLLFAQPASGATQKKATVGEQTSPADSPQTKGALPPTAELPKERAAANSNVETTAKSQGDSEAEKLLKELRELEKGMQSQTVGDISSTRGETESDNSRTRPESDIKYRGMSGSFSGSGPASSRHMKHRVSIRGSFGEADVVLLHQKPQRGNETAERTSSFSATADNSVSGPRRRGFGPVPRSIFGSAFSDLEAELQGDVAEFGDAAGIEESFGFFGERRGGGDRSRRSRERRSEDRSRRRRKGSKGHREAGSSAAAPGSRHLRQVDRRSGLARAEDVDPEESSEESRGSREEHSMKKLPARERSSRSAGPSLSRRRSRLDHELEQRRAKEAMEAAETFDERGGYGSGGHNWLTPGPPLVVSGESWPRRGLLYPEPALLLEDSRAVQMMENAAKELAHSRQTPVLPGDRGRVAAAGGAFERLFPRGALFTLQPTHGQPFEPKTLKRGRFLKAGGGTLLFEVWEGRTRWALRLHLTELSERERTGLVSRFPVDRVSGAGVSAWQRTADGVCAEAEELELHAVRILMQQNEQPRDLFCRERIALPVAVGEVSSLPKVTQLRDGEHVTNIGGLYPLAACDMRELAEQYVMPEEVKLEAVRQMVAAVGRLHSRGVVHLDLKLEHFLLDNHGKVYLGDLSTSEKITGVNVEPTSCEFGSLESLSPEHLACWARQQRKFTPSMATDSWSLGVAIVQLWCGEAPFRVPDALWSNGPVAVAQYLDQLLRRTDGEIDFSGCPGGDITNPELKRIVTGLLTYDRVKRWLPLDVLFTSPLMIDPAVARNASSPSISPLTPGKRSSKNRKRNN

SEQ ID NO: 371 - protein, 219 aa, Toxoplasma gondii
MAAKDEYYDYLYKIVLIGDSGVGKSNMLSRFTRDEFNLESKSTIGVEFATKSVYLDEGKVIKAQIWDTAGQERYRAITSAYYRGAVGALLVYDITKRQSFENVERWLKELRDHADPNIVILLVGNKSDLKHLRAVSVEEATKFANREHLAFIETSALDATNVEQAFHQILAEIYLLRQKKQIEDNPQSTTQPGRGQKIHLDEERTDSQIRQSRRGCCSA

SEQ ID NO: 372 - protein, 332 aa, Toxoplasma gondii
MATDARRLATGLVLLTCLVWRAGAFQPSPPTSRANELTSGIPGEAPENTAEERGIGDISDYPHSVVDDAADISGGTVPEGPGSPASTSGSGGVFNRLFSRFRQVSGSTQGTGVADEPQQGPRPSLRERLAQHFRRLRVLFGRLMPRWGFGFGRHVGRWWPRRWPDPLFPCMEPGDEFIRSRLSQTEYRTRFYRRGMVEGYEVEVKAVTAAIWPQNTAREVASLLDRRKRTLRVVGAFGRSVRSVLYLAQDVESQERMAIEVFTLTSGNTVSDLARVHDNLFAMTGLVSESPQQARDICRLLLPTDAVTVPTQPPFEELNPGQSNYPVANYSS

SEQ ID NO: 373 - protein, 222 aa, Toxoplasma gondii
MFPRVALFPVLTCDLFLVGRSRLSRAAKLHLTRQLVVSVAWLHRHGVAHNDLKPENVFLSEEGKAVIGDFGFAAEVGTSTELRSTPAFLDPQTAEEYLQRKTETVVTEERDAWALGTIIFVIWCGSYPFFSFEEAVLPPAVLWQNVVFMSKTTRPAPPLQHCKGMPSPVKALITGFLQWNSDDRRRPRDVVEGFLAATASEPATSSATAAEGSVRPRASRSQ

SEQ ID NO: 374 - protein, 456 aa, Toxoplasma gondii
MRRLLLSPVGFVIVLATLLECHPPDRCVAHHGSSTDESNVWSPRGAQFVPGASEAAVKNQVGIPDSALLWPSQDATETGLRPTEQVEARSSFPAAKQYLSEAAPARGDLPPRATGLLRRRGARVRTVKAHEIVVETPKTYGWDHRVVDSEEQTTVPVADSSGFIQIPSSRATPTTLNAPIDLQGRRDIRNIVRNRPPADSDLSPSEIAAKNGFERRFVQGLQLKVESLFSGGVFTLTGPAQFLGIGSTAIVYSLNKVQADTASAPERVAAKISVRNLNSLRDASASERQQVLDQAPERFVSSEGAVRNLLPGVTPETALEQGILLPLDICRVTNMPSNFRAGPDYNVFPRVALFPVLTCDLFLVVESGLSRAAKLHLTRQLVVSVAWLHRNGVAHNDLKLENVFLSEEGKAVIGDFGFAAEVGTSTRLQSTPTFLDPQTAEESLQRKTETVVTEER

SEQ ID NO: 375 - protein, 351 aa, Toxoplasma gondii
VRGLQLKVESLFSGGVFTLTGPAQFLGIGSTAIVYSLNKVQADTASAPERVAVKISINNLQRLRSLSVFDRQELLDKTPERFVSSEGAVRNLLPGVTPETALEHGILLPLDICRVTNLPSGFRAGPDYKMFPRVALFPVLTCDLFLVGRSRLSRAAKLHLTRQLVVSVAWLHRHGVAHNDLKLENVFLSEEGKAVIGDFGFAAEVGTSTKLRSTPAFLDPQTAEEYLQRKTETVVTEERDAWALGTIIFVIWCGSYPFFSFEEAVLPPAVLWQNVVFMSKTTRPAPPLQHCKGMPSPVKALITGFLQWNSDDRRRPRDVVEGFLAATASEPATSSATAAEGSVRPRASRSQ

SEQ ID NO: 376 - protein, 110 aa, Toxoplasma gondii
MQSTTSLATPADLNAPVDTQGQLDINSVLKNRPPAEAQLSPREIAAKTHFEAMFAKGLQLTVESIFTGETFTLTKPARFLGWGSTAIVFGLHRVKAGGASAPQQLAAKIN

SEQ ID NO: 377 - protein, 354 aa, Toxoplasma gondii
GWDHRVVDSEKQTTAPVADSSGFIQIPSSRATPTTLNAPIDLQGRRDIRNIVRNRPPADSDLSRSEIAAKNGFERRFVRGLQLKVESLFSGGVFTLTGPAQFLGIGSTAIVYSLNKVQADTASAPERVAVKISINNLQRLRSLSVFDRQELLDKTPERFVSSEGAVRNLLPGVTPETALEHGILLPLDICRVTNLPSGFRAGPDYKMFPRVALFPVLTCDLFLVGRSRLSRAAKLHLTRQLVVSVAWLHRHGVAHNDLKLENVFLSEEGKAVIGDFGFAAEVGTSTKLRSTPAFLDPQTAEEYLQRKTETVVTEERDAWALGTIIFVIWCGSYPFFSFEEAVLPPAVLWQNVVF

SEQ ID NO: 378 - protein, 538 aa, Toxoplasma gondii
MATDARRLATGLVLLTCLVWRAGAFQPSPPTARANELTSGIPGEAPENTAEERGIGDISDYPHSVVDDAADISGGTVPEGPGSPASTSGSGGVFNRLFSRFRQVSGSTQGRGVADEPQQGPRPSLRERLAQHFRRLRVLFGRLMPRWGFGFGRHVGRWWPRRWPDPLFPCMEPGDEFIRSRLSQTEYRTRFYRRGMVEGYEVEVKAVTAAIWPQNTAREVASLLDRRKRTLRVVGAFGRSVRSVLYLAQDVETQERMAIEVFTLTSGNTVSDLARVHDNLFAMTGLLSESPQQARDICRLLLPTDAVTVPSQPPFEELNPGQSNYPVANYFLLMPPPIMSLEPLHRIVDHEEFLTGDIGRVVRMVLTAELIRIAANIQIRGLVHGRITSENLFIMPDGRLMLGDVSALRKVGTRGPVSSVPVTYAPREFLSNTETAAFTHALDAWQLGLVIHRIWCLILPFGLVTPRMKRSGRRPSMRVPGLDVLSVEACTPMPDAVEMLVRHFLNFNTRKRLLPLTAMGTPEFRQLQLDISTSLSSK

SEQ ID NO: 379 - protein, 538 aa, Toxoplasma gondii
MATDARRLATGLVLLTCLVWRAGAFQPSPPTARANELTSGIPGEAPENTAEERGIGDISDYPHSVVDDAADISGGTVPEGPGSPASTSGSGGVFNRLFSRFRQVSGSTQGRGVADEPQQGPRPSLRERLAQHFRRLRVLFGRLMPRWGFGFGRHVGRWWPRRWPDPLFPCMEPGDEFIRYLVRAKKDRIGFYRRGMVEGYEVEVKAVTAAIWPQNTAREVASLLDRRKRTLRVVGAFGRSVRSVLYLAQDVETQEHIAAEVFTLTGESRGLDLQRVHDNLFLSAAFLAESPVLSRDRRRLLLPYDAVTVPSQPPFEELNPGQSNYPVANYFLLMPPPMMSLETLHRIVDHEEFLTGDIGRVVRMVLTAELIRIAANIQIRGLVHGRITSETLFIMPDGRLMLGDVSALRKVGTRGPVSSVPVTYAPREFLSNTETAAFTHALDAWQLGLVIHRIWCLILPFGLVTPRMKRSGRRPSMRVPGLDVLSVEACTPMPDAVEMLVRHFLNFNTRKRLLPLTAMGTPEFRQLQLDISTSLSSK

SEQ ID NO: 380 - protein, 525 aa, Toxoplasma gondii
MSSSRLVLVSKMVDSCARLACFCIGLFFCLAVWQHQAGHAYSATHHHAVNSDNKSFNDSAPHWTLNQVLRDGTVQSESPSYLQHSSLPSNISPALELAALGQDPVRRRPQPVQVARTGTTTTGRVQLGRQVARVTPEELATMVEPSLKDLLNRSTLPQTPFVIETLRVFATPEGDTSLPYTMERILGAGAASIVIQAVQETVPQEPARRRRSWFSRLRKSHAPADTRPRVALRFPVVDVRKKQQELPEVPEAELLSQLAEEQLRLEIHKVALVSSAAGTEGNFDSEWGFALPFRVGRLSNEGLVLAMDGSGKAILNFVTVSPAMMCDLHTLRSSSRTPAMDEFVVMRVLQLAANLERLQLTHLDITDENVLVGRDGQLFLGGFQHVRAKDGGISCGKIPSVTFTDPRLAHCAVNNPGSYAAVNPAVDAWMAGMMLLRWFCGDVFFNRRSSLAEPRQAVQVLAQLQADFIAANDYMVSFPAFTQWDRCRHHVNERFQFIIQSLLDVNPYKRGAPSAQLTAYFPVTG

SEQ ID NO: 381 - protein, 568 aa, Toxoplasma gondii
MRRLLLSPVGFVIVLATLLECHPPDRCVAHHGSSTDESNVWSPRGAQFVPGASEAAVKNQVGIPDSALLWPSQDATETGLRPTEQVEARSSFPAAKQYLSEAAPARGDLPPRATGLLRRRGARVRTVKAHEIVVETPKTYGWDHRVVDSEEQTTVPVADSSGFIQIPSSRATPTTLNAPIDLQGRRDIRNIVRNRPPADSDLSPSEIAAKNGFERRFVQGLQLKVESLFSGGVFTLTGPAQFLGIGSTAIVYSLNKVQADTASAPERVAAKISVRNLNSLRDASASERQQVLDQAPERFVSSEGAVRNLLPGVTPETALEQGILLPLDICRVTNMPSNFRAGPDWNVFPRVALFPVLTCDLFLVVESGLSRAAKLHLTRQLVVSVAWLHRNGVAHNDLKLENVFLSEEGKAVIGDFGFAAEVGTSTRLQSTPTFLDPQTAEESLQRKTETVVTEERDAWALGTMIFLIWCGSYPFFSFEEAVLPLAALLQNVVFKSKTTRPAPPLQHCKGMPSPVKALITGFLQWNSDDRRRPRDVVEGFLAATASEPATSSATAAEGSVRPRASRSQ

SEQ ID NO: 382 - protein, 510 aa, Toxoplasma gondii
MKNSLLSPVGFFVVVAVLIGCCPPGRCLAHYGSSSINESQWTDRETQMLAAAVKPHAGYTDSGPRTSSREMNDTGSWATERSGALPRFRTTGEQLSEGASVREDLAPGIRGVLTKKGARARTTKRHELVSVTSEEHYWNQGIADHKGQTAPPVAASSSFMQSPSSLATPVVLNAPVDFHGQGDITAAVRSRPLVTAGLSRHQIEAKNDLNKVQADTASAPERVAAKISVRNLNSLRDASASERQQVLDQTPERFVSSEGAVRNLLPGVTPETALEHGILLPLDICRVTNLPSGFRAGPDYKMFPRVALFPVLTCDLFLVGRSRLSRAAKLHLTRQLVVSVAWLHRHGVAHNDLKLENVFPSEEGKAVIGDLGFGVQIGTSARLKYTAAYLDPHAAEECLNNQVETVANEGTGAWALGTLVFVIWCRSYPVVSREQACLSTRDLRDRLVTMAKTTKPTPSFHHCQELPSPVKDLIAGFLQWSREARRLPGDVVDEFLAATVSEAATSSASV

SEQ ID NO: 383 - protein, 552 aa, Toxoplasma gondii
MRLDAVYYLAQMASHRIPRCQATFRHFICWFLIFAAFAVSDFSNVHGSFLPDPHFLCHHRTLRFRRGYVPQLSPCPHASTHHVKSGSFSSKISFLEEAAQPPSPISSPESKTELLLSLSVGHYGKWMTDEDERGRRKVAASVSRLLRSERPKSISDRVQFLLDETVAPDTVFVVESLEGVPTAGVQVQAFRRGSPLASGSYNVLSEATPVPVPLPTSLLVRPKRGEVSQQSARMMNVVVAAVKGSEGHAAQVEEGKTGKAGVSSEPVAVRIALSARSSCEVEAEDECLSLARRYSNLMSKLPPFSSRDLLEKFGMVVPQLVGQLRGRPSLLRKQGDTSLLNFVQIMPLMACDLNQFRITDPDAVKFVVKRMIQLLALFGAAGLVHQDIKAENFLVSRQGRLYLADFDAVVRENDTIQCNKKLSLLFSPPEVLRCFFNTPEEKIALTQVVDSWSLGMAAWEVLCMSEPFDGMRFSEDDLYNMKVIAALPEGGDDTRALDWNRCRGRPPAPLRKAVECLLDRNAATRCKALDLFKSSPLFAEERPVPPEPSSSD

SEQ ID NO: 384 - protein, 749 aa, Toxoplasma gondii
MVHGQMHYVSWVKDGCRQFAPDNLQPHGLDLEVLRSFFILQMNPHAVAEIAPGDRAEWTRATIYRQCRAAAPSPGGSPVSTGISSVSNSRFPRSILSPRSAALSTLKLPFSFLRLPWRKFEVNAPTRGAVEASSVKSHGETSAASSLAGLGATDEDGDAEEAVGLVDEELMGEEKLIPLEQRMVLARQLLEGSEAYNESFSSDEDWFDSARVSSPLGFPAKTTLELGFPTNRTAREPADLHGSEGSDEFEDHGPASTLVPTVKSPHRQGGVKSAVDSSVDSIQHHGPSPKSSPTTPAAASPSHAAGGARTQNTRQEAGSREGRTQRRLAGQEGAARKTGRPVLTVHTGGNAPPVVTDARFKMPSTTLKSLVTPQDPGEWTAEKEEFERSYPLHTPIQVRSTRTNEKFSVQLEDVLGAGGYGVVFSARDLRTGQGIALKVFRIRPDQRREESKEDVILRRRVQSELAIWEYVPRGIEPKQWSEMSHLVIPFDVIEVVTPCATPPMDQTRYASEWVVMDLFAGDVARMPKIMAADPSVKLEVTEQVFLANMYLHDMGLVHSDIKLPNYFISIDGRIFLGDHSLASPTGENVPCMWGTLRYLPPENMKCISDGRKRIMTTERKDVWALGVVLYKLWCNQQYPYEMGELWSKDLFVRTARAHVDELDLTLCDGHVTISILSLLRTMLTPNASRRPTLREIYKFHPVFKQRKSMILQKKTLVSILKEVDHKKGENPGAGGGAQAGSDIGSTEED

SEQ ID NO: 385 - protein, 611 aa, Toxoplasma gondii
MNLLLLNEPSLRLPRIFTVSLCAILSWGHAAFPLFFAECGLATRNLHDTGASSWDTDTRHIASTFNSSRGSADHSFAQRAEAVSDKSVAYWKGRIVEDGDVEVEDKIVHVAQEIVGGGDSLSAVDPTELTDVARILAATERPKVVANADAFKEKRFAIFSAGLRTSSSGPKANTFRFLAPDRTEKFAFPGRRSADPQAVSRQLVPPANLVTRGSGETVKLKGIELTGAARGLFVTKVSAVVRQEADGSSTKNPLSSSLQTRSTQRRPWYQMLDGFVAEVDKVYEEEVEARLAWELRIWRHLPSSRAEQLAAEEHILIPGALLSHSGRGSPSSRRKDAARFSRELEGKWNDLLSEKVFNVFIWYPAGYRDTLESSMMHSDQITEPWFSSTPRDVMESITVQMILAVANLNSYGLVHTHLRSSSFVFTPEGIVLLSDLNRVVRQGEFMDCVADREASLNDLTASPEERVCVHEHGYKGRDAKKKEELVGPLEAHPTVDAWRLAVILYKLWCLESMYERSSYHQFVARQDLQRVPDSESNITFLRQNPFPMSACRKDMPSSLQRLLRQMFEPDPANRITSAEAVKNSSFFHDKKRAVLRKKQERLIQKSQPADG

SEQ ID NO: 386 - protein, 548 aa, Toxoplasma gondii
MEKILWAASVFIAAQLDSSFTVHVYAKESTVLSELVESGTRLRPEEEGSFLTSPRSDEETLVQGAGPRGPEEKAQAAIDEAEVEPFATNSNTGTFSSFPPELHAFSPFGVIVREPKDMFFTVFSRLGGRVKERDFVGELIQRLARAVFPLFRRLHFWGESPGTQHAQQSGGGVEWGHKAVVRVLRIMRDRPVPPVYEDSRRRVMLKTGVGVLREHSPLVMNSLSGNRKVTITVKDYIPVAGWGLCVGVVHPESNQEFLLLNFVSLADAAWGKWFEWRLRKIAEPLQWLGLRNPSEAYSQDRLMLPLDLLEISNSSRYFVRAPFVVPNLFVLMPRPATSLSDLVSFMSTTKNIGQTLAVRLSLTLQTIRVVAGFNNRGFIDADIRPASFFVNAKGLVFLGIFTRTTIAKRGRRASGRRQFDVATAPELVFREKVFFRRDEKTNAWALGITLYYIWCNRFPFGILDGDSAPPPELFQPVPPEFGVCVHNMPDPVKVLVAELLDRQRRARPTANTAMQREIFRHLQDLLSASKLSALPRTVPVVALLKGIK

SEQ ID NO: 387 - protein, 535 aa, Toxoplasma gondii
MATRSFLFVFLALSSLGGLCSEYATQRPLEPYRGETERPLPERLGQKMYISVVQHKTLSFSRSSGGPFRRQNPQTWPNFVQLTSTSGVPHRRRERVADADEPTTSTGNRRDRAFPLRSWLRHAIRRLGVGANNRRQGVQHKEVLPSTEVASIVTLLQQLQQEIGRCRLQQRTNAHLEDTVTILFFRRGSTRVLLSDGGRHTRNIRYDGEILGSGPWSLVLRVMDVDENQEYALKVARLRASLSGAAGYRQLLRQGLLHHRFTPPVSPHHALWCLQLMVAIDLLKLPRIPRFVREPSSRLTIANRFLLLPLAYTDLLAVLRALFTRQDVSESPGGFLARLHMTAQVVKALASYHSQGFVHGDLKPQKFLVMANGSLVLGGFTEVRTPGALRSGDVFTESYLPPEHLDRNSVYSFESDTWQLGLTIYQIWCLLLPFGLMTPFVAEGPERRVFEEVVQHPGVQPSFNDPDCFSNVPEYIEMMVHHMLQFHPEDRPRPADILISDNFQRLQDHIQRLERSQEEEESVHGSPAGTLSRNP

SEQ ID NO: 388 - protein, 1122 aa, Toxoplasma gondii
MAGYQPSAAWPVASFPSASLPLTSFSSFVARVARQFLLFCLISIFASAWSVLATDATGEEGEAVDDGSADASNDAEVWLRRQDYSSSGLHIPQAIAEHDREGESPLFDSERITRTQSQQRWVSELGRQPSQVSESLPYGGMKAGSFGGYETFRPDKLEAVWDRGTAATELHRSGGARASVNPAAAAAGSAGGSTDVYRDEKGEGKRTERDGRNREESARVSREGEIQFSTGWEAEADPEPAWRVETRRSEQGNASQWTEEKPQHSSSNGTQKATASSRWGASPHSDASLRPPQESSWPSLLPPAGRPQPPAPSPTHLPSLLPGTPWPSTPFALDPRARLLNYRNEGHALRDVYDEEEGELSDTESLHRAHRLSLEGPRYGFRAGSYAPRRRENDAGDLYGEVSATIELPETNPSAVYPNQHGEGLPDFASAPRTNVHLPPQLGRSGVDPDQVRAAQLRLANLAGHTGHTPGDGSSSYGASRDEVPARRDQVQGRGGPSLLPGALRAGFDPSAGLVSLQYPGVSAFRRPGVLGAASSQGPAKSLLVEGAPQQRQFGASGFAQTPSLLSSSPFLDAFMHNRGGLNLGAQLFATQQVLSGPAGMWGSAGSSEGEADKWWREQDGWVWPELPSLSATDLEAGVKDISGHAQMVRVEAHLVRSQVNAGNALGLYIHQGKRYELLDVEGRLAPMTAIRGKVLGFGAYGVVVELVDVSASGAHRRSSPSSTDATAGEFGGTAVNSGSPSASNSGNKVSTSGNKVSSSGTTAANVEAEPGQLSSAEREGEPAAKVDGDAASEAGGPPREHTERSSRIPGKRASGAVEKSGGSGIEPRGDSARVSRSVTYAAKIMYWAKAKTSAKPEEVRQTLEGFVHEELEAFKLLRETGISDSDLFQKHGLVVPQSVRRVAKLPTLLRASPALFPDTPLFFHNQLIMFPALKCSLDMLAQDRFTREGLRVLVRSLVRLVAGLHALGFSHNDVKPQNFLVGGDGGLFLGDFAYLAPIDEVQDCNKGFTVDYSSPELMACALKNGRMSMGPERDSWAVGVSAYRLACRNRFPFLLDRKFNAKSDPRLIATHIANLKETDLETSRCGTEDRVVMSIVLRLLHPDLSKRATVDQLVHEPFFQD

SEQ ID NO: 389 - protein, 435 aa, Toxoplasma gondii
MLLSISAGTGDTLSSRSQLYRELQNQAMNPAAASQRPNFAAGLGVILTKGRQYRVRLPSEEDLNLLRTMLTARGRLIPPSGQPSLSMRLRPIGIGGTEKHVSFLGVAGVHEGFILLKMRDKQDGGNVPDHIYWQPLFYTNPHSEKESVDPQFLKHGLVQRVQKQISLIPPGYEGRSEHLCSHYGVMFPGGTYVLAADNAPLQFDVESDQSGSRAVLNLFIQFSPAEIPLSVLSYKNLSPTLAAFLVKQMILNTAMLHSMGVVHNGISSAAFFLSGSELTGTTPPARLLYLVNFGAARFYTGKPEPFEEAGHVMYYDPETASVFTKVAALRPNVVYGQARDSWSLGRVMFQLLCGGSQHPFGHLGPPASPLVTAKRISMLARDRPALRLSTCFPPTSAPEMQDLMSIMANFLKFDANERPTPLEIVRRYPQLFTPL

SEQ ID NO: 390 - protein, 975 aa, Toxoplasma gondii
MKSQVLPGGGVGALPVFPVKPLGLVVLCFLLLLLVSEVLFLWRLQQLENDASRPSLDSLSPSTETSTKPPPSSPLEADLSASLVDAKDLLRLLSNISTVTREKTIVSENSTRVADDPGAVHSDLDTHIVSSVSSLTARPSVSDTPRLRSLQSPKAPLPPPAPSHSEASSISPSSSLTGKEEEMSLHHTPSTPPRPSSSSPAHGHRSPDSPHSPAGTTSLVSASGEVQASAVHAISTADPLEANRRTQPEERGSEKKRTSANEKRGRRDREAVSVAPAAVEDEEEVEEVEAFHDPFSEDDVALLRVPDLLVSQNATAFRMQFLSEDERRRVAKQKPLAVQGAPSRAKKKRAPDTSASASFSPPASHAYGSLRWKDVSFPASATVTHIPGHTGSFAEVYEPFLKGEDPRLLPHYLLGGSLGLTGAYGAFAAEGAYPRFSAGSTERRLKTDLASPDGAATLGHRSPARVSRHRSAERSRSSLRAGQRAAGVDGNSVDPQQQEAKGEEAARRELQRDADHVENAKGKEAENEARPTARITRSVVGNALLTREVRESSENLANLVNALDSGGSPAGEHRGALQTEDKEGGSNVPEATTPRLRLADLPKVLFSKPSRSLVKAARALERSVSSKEKQKLAGIIPFDVPVVVRSLATQKRRTVIFDGVLGAGGQGVVLLARDVDHPGLEMAVKIFRIKKKNRGASALHEIARLQRRLRWETAILKHAPRDVSSYVWSQLAHLVMPLDIVEPVEKWEHSDAEMRYWHQWLIFESFAGDVTRLKKLHSGSGQARLDASKQIFMACMRLHDTGMVHSDIKLANYFISSEGRIFLGDYSLSRPIGDVSPCVEGTLRFLPPENMKCIRDGEKNLVLSSKKDTWAVGVALYKLWCRNFFPFDLDSLSSEHAVDRVAEVSRDELNFYPCAPDMPVAVMDLIQQMLDPNIETRPTLRDLFVSHPVFSQLRKVTLQYTLADFREEQANQKGI

SEQ ID NO: 391 - protein, 694 aa, Toxoplasma gondii
MAEQKVCHKKMTQFAAQSMVSSLSSPPRVLRVIQLLLLQITLVTFAVDAQVEPRRLLRQARKPFEAHLRGQNRFYPHLERRNPPRGQQRYVPPRNQQILRHGQFSPDDGAMHFKPPANRVQSPYNFVKAGQAPTSTPYRVYVPLKERRGLAVPVNSREEDKLINKRDGLRTFRKERNVPTSASSQPKEEWADPQMIRPLDAKVLNEGKQFIARAVMAVQGKGVSPSFLTLQTLSQHAGGDEKRNHLHRRYEEAEGESDESVIWDTAALIQWMKPSRSYNIRATDALGIKNASGAQQESSWPLSTSSFLEIARKFNNWTRASGFLNTVRRFWPSGTVAKVADDAGLKHNIIWHKLLGVGGIGGVLLLEDKDEPVGSPLKKFAGKILYQLSDPSMNLSQSKEYFYQARNEEIGVASLFKHAALSLHDCPVTATDRMQFLFQRGFVLPQKAFWFEGTTQIPRFQDIVEASPRVVGSPGGEIMRLDRYIIAYPIVGPDLEDLDPRKFSLSAVTYIIYKLTKLMATMQEMNLVHTDIKAENFLARDDGELFAADLSMSIKMDPATLIPCLQGTMLYLDPNGAECAYRRGYQSPRAKRDAYALGVTFYKLICHDGPFHLGRLEKEAMEQTKTCPGNNPLLLMLSGISRFTRKDWVERKCPLADTSLLTIVKLLLDPREDRRWTPLDLVRKTAFFDQAPGI

SEQ ID NO: 392 - protein, 489 aa, Toxoplasma gondii
MSILGKHTATVGDRYKVRLTPEYGPGGGYGHCRDYLLQSESCWRGDLTSGVRGVLTKKGTRARTTKRHDLVAVTSGEHYWNQGLVYHEEQTAPPVAASNSFMQSTTSLATPADLNAPVDTQGQLDINSVLKNRPPAEAQLSPREIAAKTHFEAMFAKGLQLTVESIFTGETFTLTKPARFLGWGSTAIVFGLHRVKVGGASAPQQLAAKINVRSLQELQHLSSSQKKTALEDIQERFLREESSARNALQHVTPETALEHGVLFPVDVCRISKLFSGFCAGISYVILPVLALFPVFTCDLQQVVKSGLSRAAKLYITRLLLQAVAWLHANGVAHNDLKLENVLLSAEGKAVIADFGFAVKLGTASAIQFTAPYLDPQTAEAVPQEKTKTTASEERDAWALATLLFLLWCGSFPYVSDEQADLPTSDLLKLLVTLGKTEKPAPNFHLCKDLPPAVGHLVTAFLQWNSDNRSRPGDVLDDFLAATVSEGASA

SEQ ID NO: 393 - protein, 470 aa, Toxoplasma gondii
MRDSSRFGRTVFSRIFNVIAHFENMSFFSLLHLHSHQSVENATPSTSPVAEPNANAKDHPPRAGDTGYLLPKPDSGKSSSTHSGWCLSPHRDARDHIFSHSCISSAASVKIPRRTKSTNPVDPNSNPSPSTPPPEGLCAKRSHSEGGSAAARSKAHGWGHRERHASRRHTTQHLNPVKAGQPGAYGADGGTHEKNMREKGEESAPQCRSSRWHLGESQREHSLASVFHSVMVAMKSLPATFQREWSLVRKIYRQSGRVKHAQRLERAREAKLQKFGLSRRASSRKPLPSLVSMQQVVPTAECASALIKEVRRNLEKSMRDFQHASPALSFRRERLFPPGREFVVRSLARNPPFTTMALVAGRLLGGGSEAMVFAAEEIELPEKRDVFIGADDASRETSGEYLPRLLAIKIYLCEANLLDQPVKAAEEAEAVEWLQMAFWRLVPSCVDVLLSRQLGVAAPSWRYEWRTEST

SEQ ID NO: 394 - protein, 531 aa, Toxoplasma gondii
MRAQVALCLSLFLFATGVFGIKLQITSRQKKVGRLPADTQPEESALETGFSDSRAKRGFSQASPDGRRQSAGRSPSRRSDWISEISASPLETPSSATSTGRSGTYAVDRTQQRRPVWNRFRAVQTHFARLAWRLCRPFICPSVRRRFRHTEHGPIPAVNFRMGLETGQAALADYCGMLRLTEREACTETAQQVSDLLISTQVMPPDRNLVFESLFNPGSRVNLTRGELLGCGGTSNVYSMTQEDGTKVAVKILSSYAQMTNLASVLSAGASAMKIMRREAGISELLGNQDLDDILYNDRLLVPSDVLRLPGKNDWFFPEQSTVIYNFFLAFPIAAGTLEDVVPLLDTTQKSFAARVSATVQMVKVVAGLHRKGLVHGDLKPSNFLVSNSGIVLLGDFSYAYVRGQMSTFPIITWAFFSPENIRMATQFSQVRVELTHDSWMLAFTIYFLWCGRLPWGIAIEEGDYRKIVAILDQNTPETLNFHNCNGIPAGIQQLIRLLLAKDPSRRWTPEKAIAELNIFKLNRSEYAAQT

SEQ ID NO: 395 - protein, 632 aa, Toxoplasma gondii
MAAVCRDLLPYFTSWRILLCCYSVGLFMHMSRSLLPNTMVWASANSPRRLSHSTPSVFRSYTEIDNTAPVGSIHSPTESNVEPTAGRNKRALATASEEQLPTSHRSRRGAATSILSGLRSVYNASSRPAVDSRNRAKDPDRFVMRRAVVHSIEEVTERSDHHDLRGEDSAQTDSVNAPDDELVSELLHLGEYPHHIESLSDPEAVKILAHLVATTNTHDIVSQSRKKKLVEAFNMYLPDGDRFFVESLSDASESKEFVRGPLLGVGGNGLVFEAQDSDGHVYALKLLLVRMSTFLEAVGDLSHDAWRREEDWAFARALRKEMKVLRLFPPDKSPEQLYEEGFVLPLFQGILAGKPRMTPLTEEFGATSVVVGFHKVACSVGQLFSAHRLPDGVKLELTKQMVDRVARLHSYGILHGDVKWENFFLDDNGRVFLGDFEQAQSLGHRRTGPCGPRGGGTPSLHEPARAACYFSEPDRRLDLLESRDSWCLGVVSYKLWCHRLPFGLHLNRADMEGFMNQVATIERDRLVPDFDDCRGSEQTPEDVKELIAALLYHDRYRRETPLSLIEKSHLFRRPPSERNDVSVELRAHESDAADVLRPAAPLPEERLHAPETKFFKPRKHWWRSYLQACSIQ

SEQ ID NO: 396 - protein, 746 aa, Toxoplasma gondii
MASPRRFPCSTMARLCVLLLFFTLCLTTASSLAASDAKLASGAPASDNETQERSQANTASPSLTLALSPSDNSEAETENAGEHSNSSQQATVAPATESVLMSDSVGSDPLAAKTTSEETTVEALNSEATTSEDPLAGRAFSESLDASVKSDTASGESAEVADSLESQEASHLVGADVLIGKERPTDSEVSSATSSPESSAVSSEPERGEDAVALASPSGEDVGQASGDLGPLAPRVSLPSPLEVQGRNRDKQAVGTSLEAAQREAPVDAGAIRDLHHLRPPAPSRGRAAGDGNGNKPIGGKQSGAAPVPPGSPANQQADTNPANETSTGPGAGAGAANDDSGEQSATEDKSDSCGSSCRRGRSERRHRRGLQILTDIASSTWNAIKAVPTAVLSGARKMRLIARGKLPLSWRRFLSKVPRVDVNAVPEFRRLKEQMRREDRMVMLVETPSKELRALVKSAMRALGLSRVRPGITHATDPSPGDDANAQMLEEPLVVKARVFDERDGTRVGLEVNGQLWAAPKNAFILPAYGAWISDLGDWKPRANEGERRRRKKKLFMAFMVMPRTRGDVRDYLCKRSLPVDVKYAAAEMLYAVQKLHREGFLHRDIKLTNFFVGYDGHVLLADFDGVWPIGVPADADKYLVYTRGYLAPEIDPHDQVILNTAKSDVYALGVCLKQLAKRYPKTADVDKLHDLSDKMTEANPRRRFTLEEALGHSFFDGVDFETLEQLKHPAPFPGDFQNRATFYR

SEQ ID NO: 397 - protein, 553 aa, Toxoplasma gondii
MMFPAVAAPRRRLPGERLQRSQNPVETSWLSFRILATRGPCVTFTFLFLTVAFLGLSWVSVAVAAHAEHPEDSATNFLFSFAENSLANREPPEDSAARPSSRSGGAERRRLDSLIPGFLKRRRIFKQLRPVDEFQLREFQEASSKVKAQFFSAGHSRVTFVDRPSAALLSFLHLEEEDVPYGVVIKAIPYDAFDFYESVAEPYIHRMFDDPRKFPYVVPVLAALRSTSKRVLYLVLPLYRELPETVDEEARSVDFVLLLAEMAMAVCQLHERNLAHRDLKEDNFLVSPEGHIVVSDLATLDITDNKSFLIGTSGYMPPETRSSYLLRKGYTRSRYGEKTDVYSLGVAFRHLAFMLEGLGVQVPHRTQLAKLIKKMTSADPEKRPLIGEVMEDPFFASVDFRLVRQRAGKHPFKKLPGADLLVERQRARLEAREKADAAAKAADNAEVPAAKSPAGKTGGAGTLSGDRDRAGSGEKPAERAEEEKGRGRGAQTHEGNHDRTDDTGREELREGPGDQKPSGEENRGGGQPPGQREEQREGTGLEEGFNKEDAQES

SEQ ID NO: 398 - protein, 640 aa, Toxoplasma gondii
MPEQDLASGFLLRFQNARPVCLSVGSFVSFRTVQPRKMRDRGWRCVWHRMAGVGALFGIFGVLCTVEAGATVAAPQVETGPLLSVRAPRSPLHLRDVDAPEVTHASSEGSPQFESSLSQQRLRRPADRGEAHNGEEPRKDAATQTVRGYGGQSTEPPPASIVPVSSEAPQDGAEQRQASSAAESLAGLDPDAGDTGLRSQEMDEEGSGAAQDMERAHAAQPTVSTWDDAHLVQVSTSHPDMFPVDGSFSKKQEGRRERRLAVRGDDSFARGHNRDRDASNGRSILRRAPGWAKIAALATGLLVSAFGYSSYKHGGPRVALRIHKLHLKRKLPISWRRYLNNLPVLDERLFPEFEDILPWLRRGARLVKRVPHVSEALADFIGLDEETRRTGIVIKVKSSTDAEARRLVYEVNAHANMVPDNPFFLPIIGAYQGASKRAVYMILPRARADVADYVRARPYDVDVRLAAAEMVYSNYILHTHGFLHRDIKAHNYFVTFDGHVVLADFEGVGVLQQRTPVVGTRGYFAPELSRATDHTEKSDVFALGQTLKRLVKYMRPTVRVPHLRELWALTKRMTAKDPEERPTLKQVMEDPYFDGIDFERLEAKDQGVPFRGDFSIDDPDAGGKMYIPPSKEQDHEQENE

SEQ ID NO: 399 - protein, 624 aa, Toxoplasma gondii
MYQLLRIRSLFIFVSILVLQTVTVAALDDGAESLDPQPTAGEGAKELGNRTTSRRKDAVALKTDGTLSEAEAKRPVEERSPQSTYDFSSAASAFQKWADGMTPKKKEPDNLLVVKGDRKPKAPRIAEDNGTDDIAVDEGNEIEEVILPPLTTFLEREHYSAVAQMLNGMHERYEHYLSATVLEETRAFLDKVKDLRSNHIERFNKVIGNNEFAFLRPLRYSRLPHPSSDVLRNLHPEHNAVAEKHWKRAWGNHYASGEVLKIKRLDMINYGYASATYAVKRIFPYTLDPDDRQSRTLDQDGALKVFVVKRNRIEVDLVEELLLHQTRAWRFFPPERAEQLAETEGLLIPVSLLKLVNDDDEEIGQKEDRINELLGPKGDILNAFLLYPRAYACSLKFFLISWGRTDLLIKTAPMKAMISISIQMVYAVASLNSYGLVHGHIRPSSFVMTTDGKVLLTDFHTVVEEGSKLSCSHKRVRAMADLNASPEELECSHHGPGQTFEASFALDAWRLGVSLYKLWCRESWREPKPGETWTERLTTRQVAFVKAQQRGRTSRSGLDLQHCRADTPSFILRLIQQFLEPNPETRLTPIDAVKGTSLFRHMERRLKVVQDIRETMLRKRSEEL

SEQ ID NO: 400 - protein, 776 aa, Toxoplasma gondii
MGRAISFVLLLSALLPEGRGSVGAAALGSLSLAPTATPQTLLELSASSVTPEETGAAPLATPGDDSRKRKEDQAAGELLLSWLQVAGTSPYFPAAGPQTRRPVASSYQSRPRNPSHQPPPRGRRGPVRRSPQPDSVPYNLRRRPQAVGVQPGSAATRGRLQERGGLRQLGSNLRHRPLARHMPPEYSVLPDQFSAPLFTSGGNARWLGVDPQEGSDSVPASLTDPVSGPLSEEPSIAGRDQRPCQPVASPPRSYAPQPLGTSSPTFPGSSPLVSKQVGSDTPPATTHTSQTPSKGKKPPAPRPWVEPSVLSSVKRSELTLGQRDLADLVGGSPPQTTPTIQKASPPITDVSTDPPELGVSPQRVLRPRRMPETLPARILPPQHISQQVKQWRAFVQISPAISAASASSAQSPESQAMSESIDRMVPPQASYSVAAPDGTVRQFMRGAFLGAGATGIVTELIEKTSGRYFAAKFFFKEVASMEGASPAAFQAAQQRLQKESNGNELLRTTAAQVRDLWQKGFVASLGTYKLSARSGDGNQLLGTNLVDPEYTGLDGHQLMVLSDFLLLPLMGPRLDSLPHTALSDNAQKYLFHTLVTVVGSLHKSGLVHGNIRTTNVLINKLTGEAGLADFSLLMQTGSDVTDTMSFHPTQSEPERVHSLFGLGTQLPASEDFDSWNLGQLLFSLLCGFDKLPWALGQVFARFSAESPWEMAAEKFYRQFIKEVKREKFDAFCPGMTGTKLQLISIVKLLLDPTHETRWTARKLVDEHPFFQVVEDA

SEQ ID NO: 401 - protein, 541 aa, Toxoplasma gondii
MKNTLLSPVGFFTALAVLIECHLSDRCVAHHGSSTDGSGLRPPQEVDSAPRTPSIAVKELATFPGDDIQTSSQELPGYELWTREQSGASVRVGFPQNAESFLTQREARDEIANAHELVAVTPEGDAWNHSGVVPEEQTVTPASGSFIQRQAAHAPPSTRLTPVDRRGRSHTVSAVRRRVTVEDVMRPDQSAAMHAVLSAFGGGLVLKAKNKWGRTRYTLQGPATFLGMGAEGIVVRLNQVKSDRERSVTPVAVKLCLIRAAVFSGLTWWRKRRTRTELMKLFLSNENSVKRALPDLDPAEMLEHGLVVPHHAELVSGMPTWFAAGDSFFVLPVVSVSPLFTCDLETVVQNPLTFWAKMYITRQLLKSIAWMHQKGISHNDLKLENVLLSADGRVAIGDFGFSSPFGASLPIRGTHLYMDPDSSEAFFEQRENEITPHRDAWATGVLLFYLWCGVFPFGLQNVANAGPPQVMRVTVMHARTTRPPPNFRLCRRIPREVRNLVTGFLQWNEEARRLPSDVADAFLAATDDGGREARRIRTHQF

SEQ ID NO: 402 - protein, 588 aa, Toxoplasma gondii
MSKPFFPQVWVSCTGGVLNLRRHWLRVGNMSRAFAPTVLFVLLNVGGSLWVPRTLPVSAFQDAVAPHHPCIGRPCDQVASVVAVPPANNLGFKREPSVGSPGHFSFLQAVGGVGGPPYAGDGSPLLASRLDWQFLQQWHTDEDENARDGFVAALSRVTRLSQILEDCNMEMVLLLDRVFSRSPRITLSAVEPRTHRRRTLKLKIRSVAGTGGYNIVVKAFVIKSWFFRLGHWLGSLGRQRNTARAPGGETGQQTGTSGRRSSRSRGQSGREEGRREPQMVSLRIRVGGAPDCQVANEMQAAEVVQKCVSEADRIMHVFPEDVTPDVLVSRFRFAVPLYSGRIRHRSALLGQSRGYALLNYMDVLPPMLCDLFAAQSVVQPSMTRAIAKQLLELVAHLQALGVVHSDLKPENVLVDEAGNLFLADFDKAHKVGSRVRCSSLPHSLFADPQTVICRETTPDQEVTLAFSQDAWALGMLMYDTFCRNWPFMGMDYNNDSDTSNTIVLAGLLDRAAAVDTRAPIDWIGCDNPRVESEIKDLISRLLDIDPENRLDVLSFYMHSDFFNEGRNEANRSPPQRGAPILPLRESIV

SEQ ID NO: 403 - protein, 525 aa, Toxoplasma gondii
MTPSTCCFGVLFQSFRGNSASASEESCLGGGHPDGTTATVFRPKTFQALGLATDSDSEPEGRGGYQRLTESTRRKKKATGRIASLFGRGRGKGDEEASGDEGASGGKEQPLGPPSGIPRRRRFWQKEHVEPEDAVVRAFRRFLKYRVLDVETIEGAPSQLDRSSWTPSPPFFQPGEGSSKAVEYFVKQQTPALTDEMHKLLEVVDPVMPPGRPLQMSSPSSKRTTHFERGPMLRTDFFALTVDHQPFNMRIFPLPGGFEGEQKVEQYKKVMLNEQKVLSIFGVADGKKVSNAYHCYLPVEEVFFGKGQQVISLGPSLKMPSVVFLYPSASATLGQVAEAIKLAAQQQGTALVAQAAQLHITLQLIKLVAITTSKGILLRRLSLENFLLRGDGVVFLSGFSELVNEKEIFYETEDGTLVTQPPTRTSRGRRFTPADNSCDLGLVIFSLWCNGSPPEREPSGWVNLDFSSCESEVPVLVQQIICGLCRAHGYPPQNAFQTLGSHEFKQLRQLYRDVEQRAEVHLLVE

SEQ ID NO: 404 - protein, 490 aa, Toxoplasma gondii
MRHVFNSSAWRVDLSGSANVGRVAEEFDRQEGPDALIGQPTHADNQESLSNLCHTQNDTSTEPAGPVSNTSRRKAFRWRVHHVNTRVFSTLHRYLRCTPLCSRAKYDIRKNGLAFAQLDEHRGRSDIMAVLRWVDVEACVYKQDKGAIAAAVAVDSLVSNGSHFTLDVLDKECQPLRMVRGRYLGVGGNGIVFEASTAHSGELDSLALKLLFLDRTFLQSPQSDISKALAVSKRMEMRIRLLLRSVTSAQLYFRDRFAVPLFCGRIRGLPDLFDIGSRGAGCSIVVLYKRLYCSLADLLSACASLSYQARLFLTKQMIEVVHNLHCKGLVHRDIKDSNFFLDEQGNIYLGDFGLSVPNGSTEALVYTPKLTDPSDVGIVLAGWDRRRAIFAQVTEAADLWALGMTLYKLWTGVYPFGLSSKHFRRTKDVTMYIQQLSEDKSLPDLFRQRRDAGGQQVHPEVQRIIRGLLCFDRTQRLRLSEVVRTSQVLS

SEQ ID NO: 405 - protein, 206 aa, Toxoplasma gondii
MNYLGLCVTREKKGCTTGNVYMFTPLLQGDIRRVAVQHPSQCISGELVLKEMAASLKVLHDAGLVHGDVKEQNFFVGRDGHVVIADFGALGYPGCSLEAGTLGYIAPERLVNDNANSFASDIWALGVTFKNVLTALRATVRADREVLDGLSNRMTASDPAARPSVDDVLLDPCLSAPPSLASHDVAPFTPDAFGYYCLTGATNTSD

SEQ ID NO: 406 - protein, 510 aa, Toxoplasma gondii
MRFSAVLYMLSTCAVCGASLGLTSDEVDTVANTDAAGPAEQNDRFRKLGEKLRSSSDKNETDQATSESEDAHLWSSGSEGASGAPDELTSVTSMPFEEDIGYSQADLTGYSASTSQQSESWAKRAVRKGAAPFLEASESSSASPGVLGLGWSFVRSVWDDLKDLQSSNSSRDKQKEGDEAVNETGQNESFSWMSLWKWWSFYANLPELVETDYEEMKDVVRSMESSKEPVTRQVYMGSAKLAEDLRVPHALLTGGFTVKMCPGSRSKPWKALTEIFLRKKLLPPNSPFFVPLVATAKGKEAATLQFFPPTRGSLRAIATQAPEKLNVVLVMAEMVAAVEALHGLGILHGALSLDAFYVSREGHVQLSDFDSAIVDNVFRPISEMAEPVRDGYRALSRKLNISLLHTKAADVFSLGKAFEALADLTDLENGDRLMLEVLVERMTQADSEKRPSLNDIARDKFFDRVDFDSVRARTNPCVYSCRWRREKMSANDAATTASDADEDSDDDDLP

SEQ ID NO: 407 - protein, 377 aa, Toxoplasma gondii
MANTSVRRRQLLSSVLLLQWLTTVLGVAWGPNPIDGSKHGQFPSLRRTEGVSQSGSGHRGSVYRIPLADMTFWSWMSYLKELPDIDESRNPILKRLLSGSFLRRDGSTTVNVRVPARELVRLLSLTPEQQREGVSAKVRLINLLDPKYSVYEPYLYREILPKRSPLLLPSLGEYRGAFLTYIFHPLSKGLVGDMLETGRSHPDVQVLAANMVAALKSLHNLGLLHRSIELNSFSVLPDGTVVLGGLDTAAPIGTETRLWVGFFGQETAPEIDRNFLADLALTQGRHTVKSDVYSLGVAFRNLVQLLGNGNLGPEDRGAVRQDHLELLDKLSQKMIEEEPGNRPTIEEIMKDPLFEGLNFEDIEEGKARPFRYKQNRL

SEQ ID NO: 408 - protein, 159 aa, Toxoplasma gondii
MNDTGSWATERSGALPRFRTTGEQLSEGASVREDLAPGIRGVLTKKGARARTTKRHELVSVTSEEHYWNQGIADHKGQTAPPVAASSSFMQSPSSLATPVVLNAPVDFHGQGDITAAVRSRPLVTAGLSRHQIEAKNEFDRRFAEGFQLTAESIFTGET

SEQ ID NO: 409 - protein, 1363 aa, Toxoplasma gondii
MKQGTTRPRVGLTGAVLLLVVWTVAILIDCSSGSRVLFDRRPILARLRRATSFVDSTSGQNASPRPTKTDKIRKPRNDSRNYRYIELPNELRALLVSDPECDEAAASMRVGVGSMSDPPKIPGLAHFTEHMLFQGSKRFPGTHDFFDFVHNHGGYTNAFTSKFSTVFSFSIGPGFLEPGLDRLADLFSAPLLKSENLLKEVNAVHSEYIIDLTDDGRRKHHLIRQTAKGGPFSNFTVGNLESLMERTKQQGIDPVKAMREFHNKWYSSNLMTLAVVGRESLDVLESHVRKHFGNVPNGRVTPPVFEECSEAFIPLDPNELGTETLVVPEADLHDATFVFYLPPQAKNWRSKPLQFISEMLEHEGPTSLSSKLKREGLITSLVTDYWSPELCTVLQVNVRLTEGGRSKESVYKIGHALFTFLRNLGVSRPERWRVTEMAKIRQLGFTFADMPDPYALTVRAVEGLNYYTPEEVIAGDRLIYHFDPDIIQQYVQKFLVPDNVRLFIFDKKLAADVDREEYWFKIKHGVEPIMDSVFKKWKEITSAPANTVQSMMRMEGMALPAPNRFLPNNVAILPRPPGSGQGAEKSAFPEPLVFAGDHICANKCAVFHKQDTTFHSPKAVVELQIYYTGSHEDGVRERILTALYVQSLRFALRERFADTHRAGMSLGLGSGVAVGSTTLPTVKRQRVLTLSAAGFSDKLDYVLRAFAKSLAATEGASDEKPIPSPMELGVTMSHGVRHLMHSRVTAPSNVLASVQSSRVYTTAVRLPGGGRAARRTLTHDQITTMHRKPASMDVTLMRTPVSSLGIRIVGGRAEREATPVVAGGGKPLLEKRFFRLAFDQLRTDLRVATLNRTPLAQANDAVLELIMHPHVPVHKMYAALFEMEKNHPTLDAIFEEVADWGVKLWNEAAVEGLVQGNITSESATQLVGDVISLLPLKNIVAANTIAKPTISSFSSLRRASSVAPQSSSKQDSVPSSDMPTSTETLSMPSSAESQTPESTDRASFPMESTTGPAPYSVELSTGRTPYPDDLPTSSTPYPDDLPTSSTPYSDDLPTSSTPYPDDLPTSSTPYSDYLPTSSTPYPDDLPTSSTPYPDDLPTSGTPYPDDLPTRSTPAADDLPASSTPYPDDLPTSGTPYPDDFPTSSTPYPDDLPTSSTPYPDDLPTRSTPAADDLPTSRTPYPDDLPIRSTPSPIVLSAGRAPSVVVSPIERTSSPALLPTERTPLTERIAQALRPVGEAAAVRRLLVLRRSSIHRMPYSPFQYSSTWFHPSSNSRRQMMLRMALRRQLGALTRQAQPDTEGKPSTVFVFRRLAPMPRRLNIEQGPSFLQRQGEYAASGSAPHSDCTNGACAKGACSGTGCQKRL

SEQ ID NO: 410 - protein, 354 aa, Toxoplasma gondii
MPRRLNIEQGPSFLQRQGEYAASGSAPHSDCTNGACAKGACSGTGCQKTPVKPSGGPCKGDACTGSSCNSLECQRSSSSKSDHPCTGDECPVPCRGPGCSAPASHPSPCTEAECGKNSCPGCKQEEEKLVQLRSIRKNLNPNDKKNQAYLLIEVGALPNIHDRAVLYMVSRWMSQRFFNKLRTEQQLGYLTAMHSSRLEDRFYYRFFITSTYDPAEVADRIVEFINAERSKIPTQEEFATLKQAAIDVWKQKPKNIFEEFRKNRRQVVLGDRLFDINERMVAELERVTPEEIQSFKEKTMFNASWLLMEVYSQREKPQMLPQANGASGESKLDPWVDIDPELLSNITVPDMESD

SEQ ID NO: 411 - protein, 1645 aa, Toxoplasma gondii
MKQGTTRPRVGLTGAVLLLVVWTVAILIDCSSGSRVLFDRRPILARLRRATSFVDSTSGQNASPRPTKTDKIRKPRNDSRNYRYIELPNELRALLVSDPECDEAAASMRVGVGSMSDPPKIPGLAHFTEHMLFQGSKRFPGTHDFFDFVHNHGGYTNAFTSKFSTVFSFSIGPGFLEPGLDRLADLFSAPLLKSENLLKEVNAVHSEYIIDLTDDGRRKHHLIRQTAKGGPFSNFTVGNLESLMERTKQQGIDPVKAMREFHNKWYSSNLMTLAVVGRESLDVLESHVRKHFGNVPNGRVTPPVFEECSEAFIPLDPNELGTETLVVPEADLHDATFVFYLPPQAKNWRSKPLQFISEMLEHEGPTSLSSKLKREGLITSLVTDYWSPELCTVLQVNVRLTEGGRSKESVYKIGHALFTFLRNLGVSRPERWRVTEMAKIRQLGFAFADMPDPYALTVRAVEGLNYYTPEEVIAGDRLIYHFDPDIIQQYVQKFLVPDNVRLFIFDKKLAADVDREEYWFKIKHGVEPIMDSAFKKWKEITSAPANTVQSMMRMEGMALPAPNRFLPNNVAILPRPPGSGQGAEKSAFPEPLVFAGDHICANKCAVFHKQDTTFHSPKAVVELQIYYTGSHEDGVRERILTALYVQSLRFALRERFADTHRAGMSLGLGSGVAVGSTTLPTVKRQRVLTLSAAGFSDKLDYVLRAFAKSLAATEGASDEKPIPSPMELGVTMSHGVRHLMHSRVTAPSNVLASVQSSRVYTTAVRLPGGGRAARRTLTHDQITTMHRKPASMDVTLMRTPVSSLGIRIVGGRAEREATSVVAGGGKPLLEKRFFRLAFDQLRTDLRVATLNRTPLAQANDAVLELIMHPHVPVHKMYAALFEMEKNHPTLDAIFEEVADWGVKLWNEAAVEGLVQGNITSESATQLVGDVISLLPLKNIVAANTIAKPTISSFSSLRRASSVAPQSSSKQDSVPSSDMPTSTETLSMPSSAESQTPESTDRASFPMESTTGPAPYSVELSTGRTPYPDDLPTSSTPYPDDLPTSSTPYPDDLPTSSTPYPDDLPTSSTPYPDDLPTSSTPYPDDLPTRSTPAADDLPASSTPYPDDLPTSGTPYPDDLPTSSTPYPDDLPTSSTPYPDDLPTRSTPAADDLPTSRTPYPDDLPIRSTPSPIVLSAGRAPSVVVSPIERTSSPALLPTERTPLTERIAQALRPVGEAAAVRRLLVLRRSSIHRMPYSPFQYSSTWFHPSSNSRRQMMLRMALRRQLGALTRQAQPDTEGKPSTVFVFRRLAPMPRRLNIEQGPSFLQRQGEYAASGSAPHSDCTNGACAKGACSGTGCQKTPVKPSGGPCKGDACTGSSCNSLECQRSSSSKSDHPCTGDECPVPCRGPGCSAPASHPSPCTETECGKNSCPGCKQEEEKLVQLRSIRKNLNPNDKKNQAYLLIEVGALPNIHDRAVLYMVSRWMSQRFFNKLRTEQQLGYLTAMHSSRLEDRFYYRFFITSTYDPAEVADRIVEFINAERSKIPTQEEFATLKQAAIDVWKQKPKNIFEEFRKNRRQVVLGDRLFDINERMVAELERVTPEEIQSFKEKTMFNAPWLLMEVYSQREKPQMLPQANGASGESKLDPWVDIDPELLSNITVPDMESD

SEQ ID NO: 412 - protein, 784 aa, Toxoplasma gondii
MARSSRAAPSGAFAHGVAKASFTWISGMKTPFGCVFFFCLIALWGFSAALRTSDIGVDALSVSSRAAANGSEGGVAQSEQERASDEQRNDSEAHDSVASSESSDAERKDDPPDNKSTSETPEAKLAGRDASNPPASSKSPTPSPAPTPAVSTSTTPAKSSADTSKDPKNKLSSARKEKRIGKKFKRHDEFLADAVIDKLDSMRSVQVSGALLRRIWKEHQRVGDDMRDLLREYILALERELYTQQAEVFGVEQLKMDDVIHHEHSSEARKREVELEMQALAEQHNFMKKLFGHIQANVEAKNTSALVNRIEELDKPIDIIDAIDKRSGSDVLHCLKVIGKSIRYMQESVKKFSRELKTLERLDAERPSGEAERIRETLGFVMDPLSGPLSSMDYESLSWIPSKGQALLHVDKAYHDRMQHDYDSFLMDNDDADFDHSHHYDPFDYNDPFDFDDEDDDDDDVPRKKRTHGHPEKQLHFKRNQGSWKHDFRLPWEKEEAHPWYKGSSKPSRAHSHRQSVSVYASPTEPVEDHEEDSSMNHEDSAVFPGLFFLELGSKRTVGTAADNTPYAKQKSFVQRAQHSVQDIREHRDVDREDGVEGEQPLSFLETRSSAEEGGGSDEMRSESEGQGSAANGTEGESDKAEEAGKTAGGSAEKDKDASEAEGAEEASSEKTDGQGGNDQPSESESAGGAATHGESSTPEEGEGSEKAEEKGGHDKPEENDSSEKAEEKGGHDKPEENDSSEKAEEKGGHDKPEENDSSEKAEEKGGHDKPEENDSSEKAEEKG

SEQ ID NO: 413 - protein, 291 aa, Toxoplasma gondii
MKHFCLKTPASTKASRFTSGFCRNKFPPAAAPSYQSVSLTKQAFEGIMRGCEEFRDKPSCDMMEKATQRLKESGTPVIYDCHWLSEGPEVSGEVLSDGTQPGDNEEKEVGKEEAAQTQGGRSICVNRLEAPTAEKLLWGTIIAEKERKLQELQISRNLTPDKVCVRPRELANAMLNPDKPFYALGDQVEASHCCFVKCRPGASFMGISRVITCHEEGVFDPQVACIAKGTLSSQQQAFMKEVQDYADVVEAAPELAAAGLETGGALATASTQGVAVAAFALIGVSAIVKTF

SEQ ID NO: 414 - protein, 1158 aa, Toxoplasma gondii
MARSSRAAPSGAFAHGVAKASFTWISGMKTPFGCVFFFCLIALWGFSAALRTSDIGVDALSVSSRAAANGSEGGVAQSEQERASDEQRNDSEAHDSVASSESSDAERKDDPPDNKSTSETPEAKLAGRDASNPPASSKSPTPSPAPTPAVSTSTTPAKSSADTSKDPKNKLSSARKEKRIGKKFKRHDEFLADAVIDKLDSMRSVQVSGALLRRIWKEHQRVGDDMRDLLREYILALERELYTQQAEVFGVEQLKMDDVIHHEHSSEARKREVELEMQALAEQHNFMKKLFGHIQANVEAKNTSALVNRIEELDKPIDIIDAIDKRSGSDVLHCLKVIGKSIRYMQESVKKFSRELKTLERLDAERPSGEAERIRETLGFVMDPLSGPLSSMDYESLSWIPSKGQALLHVDKAYHDRMQHDYDSFLMDNDDADFDHSHHYDPFDYNDPFDFDDEDDDDDDVPRKKRTHGHPEKQLHFKRNQGSWKHDFRLPWEKEEAHPWYKGSSKPSRAHSHRQSVSVYASPTEPVEDHEEDSSMNHEDSAVFPGLFFLELGSKRTVGTAADNTPYAKQKSFVQRAQHSVQDIREHRDVDREDGVEGEQPLSFLETRSSAEEGGGSDEMRSESEGQGSAANGTEGESDKAEEAGKTAGGSAEKDKDASEAEGAEEASSEKTDGQGGNDQPSESESAGGAATHGESSTPEEGEGSEKAEEKGGHDKPEENDSSEKAEEKGGHDKPEENDSSEKAEEKGGHDKPEENDSSEKAEEKGGHDKPEENDSSEKAEEKGGHDKPEENDSSEKAEEKGGHDKSEENDSSEKAEETGSHDKPEENDSSEKAEATSHTRSEDHPRCIEIMDPQECVKTKNCFHDDVYRQCFFNCTAIVEADKCKEHQNCRYETLLPKDACVNQGYQSVSLTKQAFEGIMRGCEEFRDKPSCDMMEKATQRLKESGTPVIYDCHWLSEGPEVSGEVLSDGTQPGDNEEKEVGKEEAAQTQGGRSICVNRLEAPTAEKLLWGTIIAEKERKLQELQISRNLTPDKVCVRPRELANAMLNPDKPFYALGDQVEVKCRPGASFMGISRVITCHEEGVFDPQVACIAKGTLSSQQQAFMKEVQDYADVVEAAPELAAAGLETGGALATASTQGVAVAAFALIGVSAIVKTF

SEQ ID NO: 415 - protein, 835 aa, Toxoplasma gondii
MPEVNCLGAEPAFCNPSKCIFNLRLRGASPLVSIFVLTLLVAAPKLSPQWATATTVLKDQGFHAAIHHLGNNREGRRPESSSWGFSDQSPSAPRFAAIPKSVELSSFLQTDASPSSGGIWAGVKKYVELGTSGERHVAQDDNEKKTTNGDTAQGDMPSQEGATAAEAQPQEAKESEDAFSHETTGKVETETENKSEVYRHMAQEELRSARADLVKQTNGTPEEYEETGSFPSLCGSWQTVPSSPHFSSNKEFTRYSQQNASLLEGESDTADPLPYPTCQWLPRRGIHISERRTYGFKPNVVSIERLEFHSEEGCLPKHLAKVWRYSGYWDPQSAAKDPQTKSEEIPAKLSWSRVNIKMEVNALSRSQHLAPPDARSGEPTPVEAECLGDGDRMWIPPVRHMHLDLRDTCTRPHGNFLYSQPVPPEFIITPQEIPVSHEVLAHRLKRRLRARMSILQRKHTNSPDVPRDVSLKSEAEEAIASKWTDAVDQRFATRWRDYLVQQNLWIEKVCQWHLLRESCLVPPPLAGPTPPEHHKDKGDGKKEHESQCYIPSVRHSLTRENGIDYLDVPLFPFTEDAEHVRLRKVGGCNPHLQVDLRQNKDASKLAEEQERHSADEELASVAVTSKSIHPHNHASSPGVNQGAAGGTAIPVPSVTDAKNVNTHERAENAPDAVAPEMLAQNVPTDEAGQQDAAKLGSQDEATIKPVAQQDIPVEKATSTDATESVETPVEKIGENSQEEPAAVEQPSSVEGQTEPDQQPSDEEAQKDGAENETPESTGETAETPAAEIPEQEAESAAPAVDASSSDAAGPAATEAPDQETGEANEEASSATEDSS

SEQ ID NO: 416 - protein, 1479 aa, Toxoplasma gondii
MTKRAGLPLGRAFLVLILLSAADSLFFSSFPRSALQLFSSVLFTDAAEPDSDATPGLRPQPSPRTFRPTGYQRIEVKTVDEELPEDLKVYTASTRGSSSRTFEVRNAGGRQEGFTLSVLTAGGPLPHGSWSWSGTPPEVQTTGGSQISFGWVPDTETPSLPERNLLQLKRMLRDEGLIEAVQLRAAEKGCPVAVLHNLRQLPVNFREVLHEEYESRSNPAKMYEVANSYVQQRGSDAARWSVSQSVELSLLEMHATSTTDPRGSSAVPSFLETGPQVRVAMTDAVPSGIRVYATPPAPRPVPVQSNQTEKERSPTSKRLVGMQLGLYLICKLAALFGHPTLFLNPYYTEQQLLEAVAQALGIAPPHRGDFENEGNEAQATANQHNGSADQLLAAIEIFRLGPNPYTIGHVLTLMIAYLDYESFFGASPSKPFHSWVSLAASAGNNTGFAMLDEMCDNHRGPKRRGQKHWYQTGGARKHKNRDMLPLHRQLCDALELVLNGVQQIQIDLMDELGKYKTGVEPLVDPATNSARIHTRTCRGLSPVCDYEATILAPVRALEPHEQQDSLRTKKAFNLVTGYGSGHVGQITGSIAEPFSHSWRTRWGKVVADPTAYGEIFERTLWFDDRELMAKSSGALFRQYDRIAKDSMSFGVFMNVENGLLKKDMRSKLEAYISQRKSFVEKRQQSRFAKLRKKIPENDPYALRAAIFLALNSRTFCAQPTSFLSSFRTFLTNQYHKLSQGRNLPRSQRSLMAFMRTGQVKFFQEWCSFDPLAVNALFLFRFAVSGTDPAALHDRQHTRVSRNKKTMRILNSKWTPAVLKKLMRKVNHKHMAREAKALLLRSLDPTVLSSIVTAFDFITHTQANLEVNQNAFMYHEVRAREVSRQSAAEKGSHRLHERGLVRETDDMIKRWAEHGIPGDIKRRLARGEKLPEGMSFGGIPIPNLTNWDAQLNSKWLEAYNAYLRHPYGRAALNARDPVALLVKDSRDRLQAEAEGTIFLGRIAKRVHQSKNLLRRAGRALKTFFLSLLRENERSEYAVWFGVKVDMRQVIQTCRQINSVAEVVKNDRLYDFITDGWMELVKDVVAGYTKASVRVPGFDTISAANEQLRKEGVAAATARNQGFLSIHYDYANLPEEERKKEFQRSMCMEQCEALWKLVMAFVMPNLQNPKKLKGYEKDFSGAKEIEKLNSPHHVNAFRFSLSVQIDFFDNMLDKTSKKNLKAMKFGASTWFTYAMKLAGQVNSEMGNPNLGTALYMQAAYYGNYIRKWMEQRRKSRKQAIIGVLTLGMMGLYALLNVADIVQHMEDIGGAPPVSCVTNEILGVTCAPQAIAKATTSAARVATQDFLKVGLFAGMAPYLMLPMAVVSVWNILKSEIKVLLQFEMALKHTFTRLKRWLAAPFKNWWAKRGRLKDALFRRASQTYRKTEQETKQPPRPRNLHNPSSWGDTELDSLGVPPEPFVQDFEIKYTTPVFPMSAPLIKA

SEQ ID NO: 417 - protein, 1958 aa, Toxoplasma gondii
MTTSPRVAKWALRVLALVFLHHVTVCTVCEAKALHVIRPHRNFAGLDVQQSSVADLQDEGKGISFAQTYRERDIWFGMLYFEYVITASTTMTLAFKSMAKYIYTAPFLTKLFASNRWLKYSTLDFPQKQQIIRKIARRASSKSLFSRALPGDRVADLFADMYLRRVTSRLSRTPGFRKPQYLKMKEDLTQLIKATNAPTEAMEVVLGNNTQNMFTWIDSVRQNPFATVKNVVVHAFENGLKGVSGMVEWELNQGCFAIAQQTRHILPFGSLFPGGILGKIMQKLMRSYIMFFHPVLANFKGLLALFLGVLCKVRLPQLINAVFGAIFRAKRRAGRYIHKFFFKTISLRKDITGKILVDDLVRGSGAVMITLLFQLHGVDIDAISRRGGAVESGVLAGQGVWTLSDGLFVGLKDFGQLFRAYFERYVNLTSAIHTYCAKQTTNFFTETELDEFYNGENVDRIPPRERLLAWCDKNKSYLAIIEKDFIGLATNFLNHMIKCLKMDFKYFEGYLANIMSIFYEMTFATLESDIVSAINANQGRAPHTLELEAILKRRQQANNPPKEAEMPRTMFRKPWMRAAIRKLAHGYFSSAAGFALKTLLQQIKPANAEKLLDKAFTRVKEGSKLIRSSLTVILGRFFNSQALIVRAHDQTVRMRMYEFINQCQNPEDPNHRDVCGNNVTTNIDEVKFVSKSLLALNLGILVSPRDLLLSQVIETDPAKDSIDPTEFFAEWEAWLQAKGYKPHQKGKEYLLFAEDINQKANIIAFVEALRHTLRDRLRFGRFDQEGADNLRLFDVNGRSAIFRPRDPQSMWDRIKEVRPDPLDAPATFEVLDYNEGILRFSSKPGIPFEGRLEYADDRRELRSIQQDPQAIKELLVSQIMQIKPRLSAEMTATLMMVLHRYTTSFHRHSFATFLQNLSPKMFFDGVLAFADQHQQQAEATLHLDRRLYSFPMTFQTFKDIVFNSLNTMVLRMHSLDTADSLSVFLVGLVHYAYQKIQKNRTGRTLVMQHFLRGLVHVMRSVDAERFREDFPECQFLIEPNGTIDEVVAIKCALYRFVKLRSLELPRAIAPDVEESRMTEARARTYLNGFVEYLDRLRSERTSWASFLNFKGFLETAELYRETVGAYSYEELERQIKTEPITDLDVLEQLRALMDPSLGRIVAPKKDEGTAQVIRKIWGNLGEFSSGTRQRVRSALSQMRSRLVSVMGSTTLPKAMRLFNVMNSSQFFGALEFAEFRAFPDTRTPPEDILKASDLALFGRVLLVLETTPLYLDNPKQMSDIVMQMRSIPFISPECQELFREIEEMVRHMSHEDVRVAVGWLLTFNIGKGLTGSTVALGLLALAGVPFANSQISHQDKIGILRTLDADTLRFIKKHLLMPMVFRHMASLSDGEAMNLLRFVPKATLLVAYPASIRYLPLSEPVNVVDAVDKLIASKAIDAVQQHLGQVRQLPGEASHDAVCRTMINNIKVELGLSTEDAMKFWTRSHMFFDKRLPAACILLIHLKAMREQNIRETTVAALVDMLYYNGTALNDHLAFIAKKGANELERQKQIDRVGSLLTMVYVAVVSGSLQVDASFMGYSGETKNLTFHSRRSSRGTEVPLLTACIQATTHIMGPPKEKPEIFQASLSSYFLGEWFRFVETSRLEEYAAAYRRGGGFQNISRETLKNISSVYNYYDIGDYFISIRQRSLYPQNEIVKTASMALIQDEATIDDYGMAMLTVDMGHRVRKAKIKCYEDALKDYVEYVDKSRSAQEMFKIDCVHNYFIDMGSLGYSAASITPEQKDQIIASLDRVFAGKCEDMYTALIGSQPDIHKLKQQAWAFATLAHNSLNSATRLGSIVNMLHNLITDIAAGTPWNNVVDGIAAERANKIWERLGDVSHRTPIYTAIDRPYLFNPFAFLLDFLLYVKTNKAHKLRMPKMLLMKRAAVLKELPFKKKTTPPGMTEYKERAAALKDAFFAP

SEQ ID NO: 418 - protein, 984 aa, Toxoplasma gondii
MAIKNTLTGSGLLVLLTLACGTTVQSSPPTPAPRMYPNMNERPLSAESRLTPGTYRSELHIDLKSPQKTASQSSLAPTGDNNSKVESIIAGSDTTPRSAEGTSESPPVPQLGTPPRPAPRRSKGEGERQPPTAAPRTSRSVDTGSGSDASTEQQAGGQKVVTPIPASKGIYPSLDELRRSQESNVDAGSGTSTNEGGGTSEGPQVPQSGIPPRTGRRRAKARNRKRHPTPASRESSSEDENQPPTTASRPSNGEGESQPPTAAPRTSRSVDTGSGSDASTEQQAGGQKVVTPIPASKGIYPNLDELRQTQEGEESAPQPADVTWFSMSVPMGVVDRRVSRALKEQFFQFLQHLSADYPKQVQTVYEFLGWVADKLPENEEEVQMFIDALNTTEAMVGKAARWIFKAIPERERETIYSSFYQMFRDKLPKKFFETAEGMNPDVGQYFSAEEPVAVTPEIPAKSEEDSEAAETPTPLRRQANVAAQVLHPLPAKGVTRREWIPWPKMQNAISKAHGPLTRVPEWTPVTGSCALGDGYTDIDVTKATTDVLFRITLLILQQIRRKKTERGKLEDDQALVALCSAAGAFVDAWQHQQQALILEDPGTPKAHAQLIERLRNAGKYFMKSYDETTGESDHQQWKKNKAEVSKLGKSALMKSCVKYIKASGDVATRPFDSGTAKYPSRSLYGGIANTLETPFADSEAVAKAVHDYAKEHKKPEKLVGLCGALQISGYFKKCFSDAGRLSSVSFFHQHVDGASVLVRTLARERPIGRHALSQAICDPNISAQYFEGAFRLFSSTVSQEWEKENLFAQLASWTGKEMVLAPSLEEQAAVPPAQPAYETVYGDEEDRIYRIHVSGRHSSPQEVLYVGGIPSTVKPQQVHVLGPTVSDESRRVIHPVRHRSRTAPSSEAASAAAESSDEDPLPAENATAFLGVTPQEEESDAYKHTLDFDAVSPRKNKNKENRISAPLKQSDTLIEESTSKTSEL

SEQ ID NO: 419 - protein, 1702 aa, Toxoplasma gondii
MAEFTWRPLLMSLPKMIAFFHILLFSGALAAAAGSPAADLVASVQTVSNERKDLYARDTQPTARTGIDIGVSFTQQASGNARTFEIRQHGSGPPRPAPRRAAAVADDIFGSEDFSPPPMNVAGAPLRDMGVHFLECQATDGKIECTGQGAGARPPFFRGGVDPTEIHEIVQSRTVGPADYDEERPEQTPDYLSPTDVVTLQRFVSSANASNSPLLEDPVQVCLSRRKPTYTCHLLHEFAATSVIVEESGNLVCEDKAPLTVAEKRKINDAVKAGRTPQATGGQSSRPPNPTVSPSKAGAAPQNAASRQPVSFVEQENSEASMPTANTEQASATTEDTKIASAATDSGDYGEAAAGESAQEGDRPPPYNPDADEAGVPRAVQEAYEEARPLQEATIDKFKQDAAAAAEAADHFAQVSAFNAMQSALTKISAGYHLRAGSHVVLSACKRLVEAVAANPPGPGTVIPLEELRMQLVATLTQDFALAQAFIDYAIHIVHSAIETLTPQMVANALLELSGIEELINHTARVKSRLAARGQDSPANVRKEIVQESFRQLKVELFQEIVTRVCELMDDPESFLKTVPIIVGTTPTAPLRTGGHLGADYIIHLRNDLCDVTASDAQIFPSAPADEGLQGFPRHNLGERLVGWMDVMARTKTARKEVFKIIDFTKAKDVLLFASETWKARYATLQAPAAPAPSFYGITTSGCRNVNDIMKSKFFDMYLHQSGFMKLQRHGNDNSRQRFMHRVTLLQNDGILPQLPLEADYELMELNAAMQKNFVAANKSIFSRRAARHSKYGYLDLCDVACYQKIDRLHNDVMTNVFFSLDTTLMKIVAKVHRSYGIAKAFFQLGARQQHIADPNLGMWARRLFVHWASHNEVKQMQGQKVVKVNYENLRHGEFTLDTVRMRDALVRYTNMLKADPITRDLMSLVIHTWIHIRGVRNAAMGFKNSQKLNESMNASAIGAVFAKLWYESDISVVAPHQELKPFGAPLASMALQIGFFLHTVVEEYKMSLLEKAGAQIKSWFVGMFQKNKRRTVPRTWKAVVAATNRAPKVNLKAYQGALLVIKTLAKMFRERFLYRFYMQGQGSKVDFNTPTLLIHALVASWMDPSLDRLELSSRTIPNAKKLFWYYVWVNENGPSNAATRIVLTGCKKYTFLLPGVVRSVTSSTSEVVEAGSNILKIDKIILKRSSLEAYMNHLQATYDDPLTIVQVALDLAARCEGYSAAKDQPAQAMRGPARVRRATGESTTFTIRGGGVQGGTMSFVEAEADDERKEDSEDNTVDLSEQDQDSSFVQLKKLFNRRGSSAAGQAVQTDAQPLPKAVQTDAQPLPKVRRGGPDVDASAVILGSRFMLDLWCSKYRKMLVEKLSGISTKDATVMQQEISKVFSAVSSIKIAIPDYKDLWDFSLRCDWMDGYPDAEKMRAARAEMVTYAMAKASTGKRLKRMLQKVRSWIRKKAFAAARKLKSLKNRISTAFGRGKPPKAKVPDWAVVNAGMGMWTGKVFSTHLTFNEDEMSCNGPHEPIRVMSWKQNHFTTFASSSTNAERNYVLVKKGDDSHCWATREALVHKGWSGIPVYQYAEPAGFWLQEVSPSNQPFVVNWDGYLTTSDNLTLQDIDINASSDSLKSHAVMRIVDSNGKTIYQGPPTGVVQTQGGVVTLGSIRNLVSGVHSTGDSVEVRVTASGPQLTSVADLDTQFKEIPDLVLR

SEQ ID NO: 420 - protein, 1738 aa, Toxoplasma gondii
MGGRATTSGARSLALPLLALFKPSFVLLFFLSSAVSSGLAGSRIADGVLLPAGQDRSRSAPPQIKPGVGHFGEGSHGLNISRTFLANSASTSLHSSSTGPSRSAAARLSSVHSVAPSSTPLSPSSLLRGSKASRSAFPSFSSLRKEKLSTSSAEKQGIVDNSFEDEGLEGRARKPRAPPAVDESLIDLSGHSDTPEMSPSAGVNDVLAPARILNPKQFARQLVAKVHTAFVQRDQRIAEDQKDGKENVEKERRHGSSALLGVDEQLKQADHGDVAADDGETGEIDVNEAEALIPDEESVGRSVFLQDAREFEDDDGEQDDDADDVSSSHDIRARDAHTFAFVQNTDQTEKEEAEGSSQEDDDMVGSNEETGSKSKSEGGDASEKEEKSEKGDTSERGDKSEKEDTTEKEEKSENGDTSERGDKSENGDTSEKEDQSGKGDTSQQGDKSEKEEKSEAADKSEADTSKNSSSAKAGVSEKFKSAAQPRSHLVHITTGYLPKIRAYRATVNPSHSRRRKKKKEGESEDTESKAHEKHREGEALPEPRDSEKESESKAEAAASHNEPGNEGDEAPGDSGDQERQAGGDSVPSHPGDNAVNESRSGDNRGEAGETREAENDAAVGHSDETGTGETPSAEGHHGEESGAETAVPSDPREEMGRAEARSANSPEENTAEATGGGASPYREEAETIVQPYTDARQGGNNDASAASPVARHDYTEGSQASPASRPDDNARATGSDSSPVYREHAWSGEAPAGEGQQEYTGGAGYAAPVSHHDQTEASPARSVTTPEWSAQATGSEPQPGEDTARDQDHVDNASADRQNAEAEGNEAKSEGSPENNAQETHETGSEPQPGEDTARDQDHVDNASADRQNAEAEGNEAKSEGSPENNAQETHETGSEPQPGEDTARDQDHVDNASADRQNAEAEGNEAKSEGSPENNAQETHETGSEPQPGEGTARDQEHVDNASADRQNAEAEGNEAKSEGSPENNAQETHETGSEPQPGEGTARDQDHVDNASADRQNAEAEGNEAKSEGSPENNAQETHETGSEPQPGEGTARDQDHVDNASADRQNAEAEGNEAKSEGSPENNAQETHETGSEPQPGEGTARDQDHVDNASADRQNAEAEGNEAKSVTGPDGGAQANGGESAITQHKQASAGDSEGRQDYRNGAGYASPVARHDHAEASLVRSATTLEGRAQNTGTPASAQREETKPRPAAVEDVSKNKEPEIEEEPIHLQHTGTNANIGHTNATSANHQPTTEAEGGSADAHHGGDEQKEGEHERAPGEGGHEAAGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHEREPGEGGHEAEGGSADAHHGGDEQKEGEHERAPGEGGHEAEGGSADAHHGGDEQKEGEHERAPGEGGHEAEGGSADAHHGGDEQKEGEHERVPGEGGHEAEGGSADAHHGGDEQKEGEHERAPGEGGHEAEGGSADAHHGGDEQKEGEHERAPGEGGHEAEGGSADAHHGGDEQKEGEHERAPREGGHEAEGGSADAHHGGDEQKEGEHERAPGEGGHEAEGGSADAHHGGDEQKEGEHEREPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEA

SEQ ID NO: 421 - protein, 733 aa, Toxoplasma gondii
EGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADSHHGGDEQKERGGEGSAEEQERGSGGAWEAAVHPHEQGRVTEAEGESSRVEEEHEAGGAPVHAHLGNEGGNEVGLSLGDQKQGSGGESSSSQAGHAKTEERKSGYSHHGPETEEDTAFSHSGGGTGDERETRRSNSEQRKERTEEGGARDQPQNEKKTEEQHAQKQEEQYKRDIALSKHQEAEENRRHADVLLQHHHLGQGGPRGRTAVTSHSHMHVQDVTQHHQLQEATQMAGKLTRHLQIQNSLKLREMFLKRKEVGHLNLLKHFQDLMQAVVSRIYSKLKGAKRSLKRMYSHSRSIIKRFLHETDHKVVRPEELPSAVLTPPDEGNVLGKTTNGIVMDCPTDCNPAACDNKPVEPAQCFKYEAVAGGGGFRRCEPFADPLTATCGKGFTRCAMAAPTRGKHYQMFASPPDHPLPQPLLIQGSNLHACLRLLPVHQATRCSPESAETVEAALKDTQAVAQQPPPHVLEQAVLFENIQVPMPGSYKLCMLQYWRPPDSKPTDNVFIMGIDEIGTLDVLQQPDAETLKHVQGLHKKDSQMH

SEQ ID NO: 422 - protein, 2265 aa, Toxoplasma gondii
MGGRATTSGARSLALPLLALFKPSFVLLFFLSSAVSSGLAGSRIADGVLLPAGQDRSRSAPPQIKPGVGHFGEGSHGLNISRTFLANSASTSLHSSSTGPSRSAAARLSSVHSVAPSSTPLSPSSLLRGSKASRSAFPSFSSLRKEKLSTSSAEKQGIVDNSFEDEGLEGRARKPRAPPAVDESLIDLSGHSDTPEMSPSAGVNDVLAPARILNPKQFARQLVAKVHTAFVQRDQRIAEDQKDGKENVEKERRQGSSALLGVDEQLKQADHGDVAADDGETGEIDVNEAEALIPDEESVGRSVFLQDAREFEDDDGKQDDDADDVSSSHDIRARDAHTFAFVQNTDQTEKEEAEGSSQEDDDMVGSNEETGSKSKSEGGDASEKEEKSEKGDTSERGDKSEKEDTTEKEEKSENGDTSERGDKSENGDTSEKEDQSGKGDTSQQGDKSEKEEKSEAADKSEADTSKNSSSAKAGVSEKFKSAAQPRSHLVHITTGYLPKIRAYRATVNPSHSRRRKKKKEGGSEDTESKAHEKHREGEALPEPRDSEKESESKAEAAASHNEPGNEGDEAPGDSGDQERQAGGDSVPSHPGDNAVNESRSGDNRGEAGETREAENDAAVGHSEDTGTGETPSAEGHHGEESGAETVVPSDPREEMGMAEARSANSPEENTAEATGGGASPYREEAETIVQPYTDARQGGNNDASAASPVARHDYTEGSQASPASRPDDNARATGSDSSPVYREHAWSGEAPAGEGQQEYTGGAGYAAPVSHHDQTEASPARSVTTPEWSAQATGSEPQPGEGTARDQEHVDNASADRQNAEAEGNEAKSEGSPENNAQETHETGSEPQPGEGTARDQEHVDNASADRQNAEAEGNEAKSEGSPENNAQETHETGSEPQPGEGTARDQDHVDNASADRQNAEAEGNEAKSEGSPENNAQETHETGSEPQPGEGTARDQEHVDNASADRQNAEAEGNEAKSEGSPENNAQETHETGSEPQPGEGTARDQEHVDNASADRQNAEAEGNEAKSEGSPENNAQETHETGSEPQPGEGTARDQDHVDNASADRQNAEAEGNEAKSVTGPDGGAQANGGESAVTQHKQASAGDSEGRQDYRNGAGYASPVARHDHAEASLARSATTLEGRAQNTGTPASAQREETKPRPAAVEDVSKNKEPEIEEEPIHLQHTGTNANIGHTNATSANHQPTTEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPSEGGHEAESGSADAHHGGDEQKEGEHERAPGEGGHEAEGGSADAHHGGDEQKEGEHARAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKEGEHERAPGEGGHEAEGGSADAHHGGDEQKERGGEGSAEEQERGSGVAWEAAVHPHEQGRVTEAEGESSRVEEEHEAGGAPVHAHLGNEGGNEVGLSLGDQKQGSGGESSSSQAGHAKTEERKSGYSHHGPETEEDTAFSHSGGGTGDERETRRSNSEQRKERTEEGGARDQPQNEKKTEEQHAQKQEEQHKRDIALSKHQEAEENRRHADVLLQHHHLGQGGPRGRTAVTSHSHMHVQDVTQHHQLQEATQMAGKLTRHLQIQNSLKLREMFLKRKEVGHLNLLKHFQDLMQAVVSRIYSKLKGAKRSLKRMYSHSRSIIKRFLHETDHKVVRPEELPSAVLTPPDEGNVLGKTTNGIVMDCPTDCNPAACDNKPVEPAQCFKYEAVAGGGGFRRCEPFADPLTATCGKGFTRCAMAAPTRGKHYQMFASPPDHPLPQPLLIQGSNLHACLRLLPVHQATRCSPESAETVEAALKDTQAVAQQPPPHVLEQAVLFENIQVPMPGSYKLCMLQYWRPPDSKPTDNVFIMGIDEIGTLDVLQQPDAETLKHVQGLHKKDSQMH

SEQ ID NO: 423 - protein, 2980 aa, Toxoplasma gondii
MVATTLHSLPSRYLYTLLMSFLFVCGALALHESPDGLPEAPDRPQNAESGDGPPTLVLTLDPEYAGKSEEFAFTAEYFPPTESSKNEDGAQQSFVETPNRRLPGTFDPMSSSDVRSEVQLRVTTQQMERGLLAEIVVLQEGQMVSGFRASLQTKEQAALLHRLADLTNDPNIHFRVEWRGRGDGTGGLYIRTAVHLLATAYKPSVHFKLNLHQTGARGARETIKLLSSVPIDDLNAPGVDIGTLKQLIVDHAEPENILTGPGSFSIKRMFKESDPKNANTQEATLVPWLLRLLDLASPVTIVGDLTRNREFSTVLPQGPANWNDLLLLYTGMGDAANRGQNAPDFAQREPGYRPGSIFLSPDGFRGAAHLGDHQPDRLKQFWRQGGETGLNPGDIEHYYSPLFGRSYDTSNNPLLILDMYGNPVYSEGGVPKFIVGPGENDLTKLPDHVSGMVLPSVSARFLFPDKRSFTEFINPARPWNDISKGWKALMAKHKMKFNYREPGLVGVSVNGNWYGLTSEFIQTYPTLLHLLGSLAQSTPGFSLEDVTLHFDDKLPPKLPTLFVLDDAHDRQIPWCAFEFVIPLSPRGTVNIKSLLAKGKSAAESPKGCNFREKGFHFTTVHRWGFVESRNPLSIQWHGVLDYTGSKQECALLGNVLKDAHLAGRQIAVSFHAEHKATVIPVIETFGPDGELLKSKPQKPVTATVQFGDDLPGLLYDFHKPFQKKKVPTVVYPFLQGQGQGSRDALNGGVLGEEYYHRPRKTKITMRPEIPILNTHDTFVDGSGPHPNVPHFVIPLTAGPQQHLAPLKALRQWLRKEYPGSQLPFKLDRMSDEDLLGIADHLVFRFPDGTEATLRSIFGPEVFSPNWATMNPDAYQKLMDVLTRPKKVYLAKNFRIVVTDVDGQQIPFDIQIEPGDTWAKTLDDFFKAHPNLKPANVKLVLYDDKDTALRQFDINLDMYASPYTEAVDQQHMKGLQITLETPAPIVSCYQADPARPGQCLAVDMKRIFCGRVNPAKMVSRAWNEECTAAWIARADLGEVEDRYLMGPDDVRARSIRDLLTSAKNALKQRNPEKAKHLNIPVADVTESEELNRKMRERTELAMKSGKTLEDLDRLRHLKFEIRTLQRQGELQWAKLVGATITTTEKGKPAERHIRLDPKKFFLNDKLWKVFKELAAQVPGLKFENVFNFSFEVMNKEAREQWKKEQTTVTKEAKKQMRSQKTVVDVIFVGPDGSALFRDIGVELRQLSDEALGRLSKGDKRGLINQLAKRYDIPRQYFIRRGGFPSAAVNGTKWVITAMLGLVGGAGKKGLASLLKDPHAFVTHLQSAGGFSPTDTVKLVFDNGSVLDVPLSQLPDQDLGSLAEIYFPWKKTAGQAQEEKKKAVESKVAEGSGIMRKLEVTVMQPSLWPEVFGAWLSDLHEMDLFDDGPILLQVRPEGAQKGQVIRCSVKTLGELYQALNKPEIIRSKCPGMADLKKPFTFELSIRTPAEQYYKLYNRSRSPEDQRRTAAVLLKLKDHIRNLPDDGQVIFEYRKIKRTLTPQELQQLKALIEGLQPNENTDDVLTKILRLLGISDQDIAKSGRLRFGIKQAPTSSEQQMLREGSITAVVEDFQGGRRKATVRISIPEEEPLRLGASAQNYQVHMSLFSKNAQHLNTPCGSKSGAEVAKATWGQLCRWCNLKLADLPGLGHPTLYIRIISNEKTQTVRGGQPVTTNVDGHPVVYDIRMPGDPRSASGMPKSVFWNLVERPGSNELGPVWHQSIPKADGGLRKDYSYFDPNPGAWDPTLFGPSSGTFPQNTRAGIDIVTNPEAMETGDAYAPPIRFGFGFRNWNDRDAVKPQFNNMVSGIAPQERDLYKVYIQIPKGDGNYYPCSGVDINLFMQLTKEQIARACGIHPSLLEAPFGVYLLKETPTYARAQPSFPLFFVDGEGQEHPSLGHWTDAPAKFFSPHLRGASPNSLIQLEFAPGVTCNLTQQELMSLHTWEALLKRCNIDAGKERPATITTRIVPMFSTPNVTVKVPNELLQPLLRQHRGISPDQLFRQKPLEEVVALLLSNAHLGLYHVGLKYIDGTDQPYSECPEHLRQLPPSQIPGLQHIYIVPASEGEGDFPGVFRGGTLGDMMKGMNLSPQTTYGDFVRTVKKKINSPEGLTIPGVRQHVGGSGRPAQQIIDFDFAGPESPPGAAGKPGWEATWRPATVGAFPDNMPIGDIDREMHHPFLVFTTGHPPKYDLNGLAAYGGQPFREETTHLDASLRNLVEWMKDSLGISDPNGILAEIVIDTIRCPFPLSAAQLISATIGHLLHHCQVNDLEMSHSIYVTPTPVPGYTATPKRNGPQIVINGHNYGAPGTAPRDFGQLFNLPGRPGARPLNQDLEVSFSPLPGKPPVRGVLPGDVLPLLQSISDKHGQPGVAVVLNFLRQLHALAELPPGATLNIDTKLIPSQSPQQLYAPDQVPQPGPWIAGPTGGGRFPGGGVVVNESGGRRGPGGSAAVKFMPSTLRLPLLRQPSVELPRNSMLRGSIGGVGGLPRTEFVVPILPSQKSMPIEQVLKFFGIAPAAVQTLDVQEKPEQGAILIESGTVTFVPLKGPTFTVSMKKINATDKNTLATLLKAAGRSIIDLVGASDGTQPLVLKIVVDHGAVSPTKVTTPVGTPSHARSAMEGLTIWNLLPPLIDVHSVKTITIRVQAAKAFQQAAKAAAAAEGTEGDSAGEPLSRPKNVEPAVRTKFKNKIPELPAAFKPRQRTVSEINGAPNPKLVIFVEQDGQKTIRFTFPSRVNDVVIGQSTVSVVLDALLPNPGTWHRTFWGALSPDGTSCKPTMEFQYPHWLQTKMAELPVPNHSSCLLIREVSLNIKQRPNFFIKPYIFHSPLVIFALQGKQRIPIFEEQVDPAVTSQPLTALLEQLGIPKTQLDTILQCSSTNIDAPGECPSDSSTTVDPETVIPDAVATQSAFLVVTGKQKQAPGSFLQVLWRRQRRRNSIQKRITSH

SEQ ID NO: 424 - protein, 422 aa, Toxoplasma gondii
MLSVFPESARKMESVNRPRFPPFFCPPSLGVSGATVLLPFVGVLLFSSLFSSATTVASIPNPAGAWSPYLSSMSVWPANDEDGSTSVSSDTALDISPFADDEKDSLPVAASLSPSLFRAQRWQTPHNNRRTPLAHSSLPVHDDGLGASWVALTEDRNEGSGAEEEGENKEGESDKAESEEEKSSVSENDSKNEEKTESKDSETGDEAAARSEDRDEQDGETNKPGKQAQAAPEEGENASASSEKLSCPRACLIASKSGGKTGTDGHEKTNEVRADQKGGEGASTTQHEEGQETEQGSEEANSSSSSAPAQSHETPVAEHAPCPHAEEHNATNGSNSAEAASEDSNPHEAVKHTDAHGQTQASDQAQGHDQEEASQSSETPAEENAEEPKQAEEQANASQSSETPAEENAEEPKQQRSSDASQ

SEQ ID NO: 425 - protein, 1159 aa, Toxoplasma gondii
TDGHEKTNEVRADQKGGEGASTTQHEEGQETEQGSEEANSSSSSAPAQSHETPVAEHAPCPHAEEHNATNGSNSAEAASEDSNPHEAVKHTDAHGQTQASDQAQGHDQEEASQSSETPAEENAEEPKQAEEQANASQSSETPAEENAEEPKQAEEQANASQSSETPAEENAEEPKQAEEQANASQSSETPAEENAEEPKQAEEQANASQSSETPAEENAEEPKQAEEQANASQSSQTPAEENAQEPKQAEERANASQSSETPAEENAQEPKQGEEQANASQSSATPAEENAEEPKQAEEQANASQSSETPAEENAQEPKQAEERENASQSSETPAEENAQEPKQAEEQANASQSSETPAEENAEEPKQGEEQANASQSSETPAEENAQVPKQAEEQANASQSSETPAEENAEEPKQGEEQANASQSSETPAEENAEEPKQAEEQANASQSSETPAEENAEEPKQGEEQANASQSSETPAGENAEEPKQTEEPEEASQSTHSPAEEQSPEQAQGQERENASQPSESPAEESTPEQAEEKGTEAAEEPAQEQPAETQEGSDAEADAEGGSGANGEAQPQEESGENKDVPAADQEAPGLDEQGRDEVGTGAPEAAAASAAGASHENEAHGADQQDDSVESAGPAADEQQKDATGEVGELHGAETQTPQLAAEAETAGAEQEAGRADSVSDGCYVTRRQEVEAEAKKLLEVCERNDNFTKVDQQFCDELFKRIDGPFTVGEVSAFLRAADTANNISRNFRFCRATPTSSPPRVRDGDSVIHAAIAASKPRVVEILLQYGAFPNIEAFPRSPDAANRMGMRPLHYVARYPTLENYESLFLLLKYGSPVNVRDVGGRTPLMIAARSSHPFSKLFARALIDRNADVTARDKAGLSALHYAAASNSCKLVKLLINRGADVMSQDIRGNTPLHYAAAFNADKSMNTLLNLAGNAIKVNVPNKNGKAPIHLAAAPSSFDVVPAKIVPALSLELLLEKHADPVARDAHGNTPLMDAVLGGYLEIAKRLLQIARVPLHDKNMDGKTALDLAQEAAERTGDDVLAYLTAVSSKPSCPFIPRVANSIHVLSDTQFGSLMRVGDTVTYECHHGFRLLGHATLTCMSRDGSPEFIPDPPVCIPMEQGAASSLYSAPLGLATALLVYLIPFFLTQF

SEQ ID NO: 426 - protein, 1493 aa, Toxoplasma gondii
MLSVFPESARKMESVNRPRFPPFFCPPSLGVSGATVLLPFVGVLLFSSLFSSATTVASIPNPAGAWSPYLSSMSVWPANDEDGSTSVSSDTALDISPFADDEKDSLPVAASLSPSLFRAQRWQTPHNNRRTPLAHSSLPVHDDGLGASWVALTEDRNEGSGAEEEGENKEGESDKAESEEEKSSVSENDSKNEEKTESKDSETGDEAAARSEDRDEQDGETNKPGKQAQAAPEEGENASASSEKLSCPRACLIASKSGGKTGTDGHEKTNEVRADQKGGEGASTTQHEEGQETEQGSEEANSSSSSAPAQSHETPVAEHAPCPHAEEHNATNGSNSAEAASEDSNPHEAVKHTDAHGQTQASDQAQGHDQEEASQSSETPAEENAEEPKQAEEQANASQSSETPAEENAEEPKQAEEQANASQSSETPAEENAEEPKQAEEQANASQSSETPAEENAEEPKQAEEQANASQSSETPAEENAEEPKQAEEQANASQSSQTPAEENAQEPKQAEEQANASQSSETPAEENAEEPKQAEEQANASQSSETPAEENAEEPKQAEEQANASQSSETPAEENTEEPKQAEERANASQSSETPAEENAQEPKQGEEQANASQSSATPAEENAEEPKQAEEQANASQSSETPAEENAQEPKQAEERENASQSSETPAEENAQEPKQAEEQANASQSSETPAEENAEEPKQGEEQANASQSSETPAEENAQVPKQAEEQANASQSSETPAEENAEEPKQGEEQANASQSSETPAEENAEEPKQAEEQANASQSSETPAEENAEEPKQGEEQANASQSSETPAGENAEEPKQTEEPEEASQSTHSPAEEQSPEQAQGQERENASQPSESPAEESTPEQAEEKGTEAAEEPAQEQPAETQEGSDAEADAEGGSGANGEAQPQEESGENKDVPAADQEAPGLDEQGRDEVGTGAPEAAAASAAGASHENEAHGADQQDDSVESAGPAADEQQKDATGEVGELHGAETQTPQLAAEAETAGAEQEAGRADSVSDGCYVTRRQEVEAEAKKLLEVCERNDNFTKVDQQFCDELFKRIDGPFTVGEVSAFLRAADTANNISRNFRFCRATPTSSPPRVRDGDSVIHAAIAASKPRVVEILLQYGAFPNIEAFPRSPDAANRMGMRPLHYVARYPTLENYESLFLLLKYGSPVNVRDVGGRTPLMIAARSSHPFSKLFARALIDRNADVTARDKAGLSALHYAAASNSCKLVKLLINRGADVMSQDIRGNTPLHYAAAFNADKSMNTLLNLAGNAIKVNVPNKNGKAPIHLAAAPSSFDVVPAKIVPALSLELLLEKHADPVARDAHGNTPLMDAVLGGYLEIAKRLLQIARVPLHDKNMDGKTALDLAQEAAERTGDDVLAYLTAVSSKPSCPFIPRVANSIHVLSDTQFGSLMRVGDTVTYECHHGFRLLGHATLTCMSRDGSPEFIPDPPVCIPMEQGAASSLYSAPLGLATALLVYLIPFFLTQF

SEQ ID NO: 427 - protein, 1167 aa, Toxoplasma gondii
MSSNLAFLSLSLAESTASLGKSLEETRTRLTEKLKLVAGMALGFDQFAMHQTATGPGLSVEGKQTEQMSRKSAEDTRASSLSSDPDDGRAAQLAGQKGHVTPCIAGLIATSNPFLFTHMLALGAAYLGYDKYFGDGTSELLPFYGTRTLLSTLSPLDTPRLLDSMAAADRLSPKRSILSRFSRRKRSLDAPAPEPSGWDQKRKSRLPLGSLRLVLDILDRHLEALTTYVQQQIEIFRQAGVPLEASVTMTHNLNRLHVTRCQSRNNQMVIPCRWKDTTFFEELSNETNPGLTDEEQLEKRVKFHKLENAFNTVTGLGALEAMLDEDSVLLGGPAEESVARLYSDFHLGAAMNNWYFYDALNINKMLSRFQKVGTKVLKQYGLENLMNLATSHQAGSTASWDRTDIDTKLAKHHHYGSALRVRLYIMALLPQFTPHREGILSPVDFIREAFAGERSYAMSTARLKPLLSDDLVILGVPKGFSFLWLFEFLLEEDSPNALVAKRRALKRIPNWTKRLFSHSRSIPMLFRQFYKALNAGVFAKARRRTLDRSKTLLSRQLPEGWRDIVMDAFAFTAHSAALMQVVNYHSLFRDRTLNDLQEASYLATPPAFSIEDQSVMKRCDEQIYEWSRFGFSPDVLEADLHNETFKGKWENLRLETMPTPDTHQWWRRLHRAILDSLEIYQAHERHLKGMSDNLYTLVEDTIKNLQDGSSRDDTIFFGRIARGARESVGQKMWRGVKTFFLDLVRDVPGSDHAVWFGVGFNFPRIFQILRKMKEIALHAAGDQGSAILLDEAFVELVQETVAVRAQTYRRQPPTTLRNIGVIGLRPDYANLDTEQRSMEYQLSMCADHCVSLWVQILGFIYPYVLNPSLLTDYEKSFGTGHAIKKLDDPSYVNSFRYIFANDASLNFFEHNTPQDTRKALVSLKSGQAFMYANMMRFAGIAFEQLSMPYLAVSLQRQAPFMGQMVKDWVAKRSRSRKLAIVSVLSLGLIFAYTLLSALDIAQFLTDSGMKAIEDCSWNPIMQQMACVVVAGSGSLVAPTFAALSDVFKVGLYSGIGSTLIAASVVGNAYMIIRSQSRTILRTEMAIKNVAVKLWKQMRKYFSWVTRFTKRRKAILSTMMARATALAKNKKPRSETAATMTRSGDSVMDMLLQGVSPATPQRAQDGSR

SEQ ID NO: 428 - protein, 218 aa, Toxoplasma gondii
QQTRHILPFGSLFPGGILGKIMQKLMRSYIMFFHPVLANFKGLLALFLGVLCKVRLPQLINAVFGAIFRAKRRAGRYIHKFFFKTISLRKDITGKILVDDLVRGSGAVMITLLFQLHGVDIDAISRRGGAVESGVLAGQGVWTLSDGLFVGLKDFGQLFRAYFERYVNLTSAIHTYCAKQTTNFFTETELDEFYNGENVDRIPPRERLLAWLQIPMAA

SEQ ID NO: 429 - protein, 446 aa, Toxoplasma gondii
MACRQLLCSVQNLLFYFLPDIYCTDFDTMEQRLPIILLVLSVFFSSTPSAALSSHNGVPAYPSYAQASLSSNGEPRHRGIRGSFLMPVKPHANADDFASDDNYETLPSFVEAPVRDPRQVPGRGEAALGTEETPGQQPPVALGSAEGEGTSTNESASENSEDDTFHDALQELPEDGLEVPPPNAQELPPPNSQELPPPNSQELPPPNSQELPPPNAQELLPPTEQDLPPPTEQELPPPVGEGQGLQVPGEHGPQGPPDDDQQLLLEPTEEQQEGPQEPLPPPPPPTQGEQPEGQQPQGPVRQNFFRRALGAARSRFGGARRHVSGVFRRVRGGLNRIVGGVRSGFRRAREGVVGGVRRLTSAASQGLRRAGEGLRRGFTRVRGALRGRGRAADGASSVRERFGAASGRVRDAFSAGLTRLRRRGRTSGEEGRPLLGEGREQDDGSQ

SEQ ID NO: 430 - protein, 586 aa, Toxoplasma gondii
MGRPRWPLPSMFFLSLLCVSEKRFSVSGLHLRFRESPQWDSLLPLQDRRAVQPSSRWDSSLTLEAHAPQRIDTSDAGDDDLFLDATQQVYRGDPVLETSSLPPAALPVRPVSSKTEDGFSGSREEESDGGVPTGSDQGEVWRSSSLVDVSSPGDRGGEEQESSAQAKGEADTKDEAEKSEDQSQSSTADPNTPTAQGTDASESGEDSGSDTMGDSEVTDIPVDPLNSGPETASSGETGQRIGAESGAQPSAEASQDSAAASETIPAADATSPTDLPGTLAGATVADDSRQEATTDGLEKSPGEPKEVDVFNPPLATKSDVAPLSVSTIRAQAAPDTEANIGAEVATGNEGAPEVEEATEDVAGTGADMSTGTDAATEDVAGTGADMSIGTDAATEDVAGTGADMIPGAEPGTENEASTGAEGATEADEQVPLKTEAQGSAGSSPTQGHASHSVEETGRFSVIPFEFGSSPRLRRWTTQFLIRGKDLFNLMQKSNIAKQAEKGAKNLRSSMEILHNTTSFFNAFRAQQRSKEAQSKNVQLSVTSVPTDQPEEQNATTQEGSTASPEEAAREAAEAIGTPVSTEDAPN

SEQ ID NO: 431 - protein, 236 aa, Toxoplasma gondii
MARVLPCVFLVAYLSCFLLAGELTHTTALSVAPKAQLFSTDEGPVSESASKLDAELEEKAIQEAKEAQEDEVDDIPTDRNAPPTNGDPTDQPDVQLNAVDIDGFPTPEVPLPVELDAEKLQEDEFNREEEADNTVPNILVGPAQTPEPVAIPVTSLLAPAPGTVTTASPQEGVEAKEEPPAATGVPSAPSSPARRRAFFRSRGTRTITVNVRHFFPNGVPIVVVRPQRRSFLLRRF

SEQ ID NO: 432 - protein, 400 aa, Toxoplasma gondii
MKRTELCIAALVAVGAFAFTSPNAVAKSFERSLGHLDASSFLSSPLNSDVELGRSTFPAQSLSFTEGTNETNPPTSRPPGWKYEGSDLQRRVAARREEHKKRQEEWEQRKASRRSALTPSAPDPDGDGDPATSFPSQRRLLDRCLQQFREQLVDLENLCKGSPEPDDCRSTVQEILGKQSFGALHTTVISFSIFVNRDPRRLSFPVLDATDLRLTVKLKHLLDRIPGCAALSLPVYIGLVSSDVFKSEEFTRKVNRCSEDFGRSAREEPSRAGRAAAAVIRFMGLTPERQTFYQPFMFVTTQAAMLLSMVLKHPFLSILVNMACVAGSLCRKGIREVLLRALREADFLTEDVPLDSAPQELVDHLKVYLKLLFLRKYRRLRRQAANVAAQVVYANSLRLL

SEQ ID NO: 433 - protein, 1061 aa, Toxoplasma gondii
MYSSPQSEEASLVNSRGIRDESGPNGFSIGSATDTALKAGSPTGKSWKQLSLNLGRRVWDALDPTWSCAEKRRRLDPETLRKLKSTYWLSRIVFLRALGFVYFFAFLIAFNQSQGLIGSDGILPASDYVAMVKDSFADAEAWQRVKAFPSLFLLFPATDFWLHAIPFVGMILSLFMTIQGASNGFLLFLLWILYQTVNSVGQAWFSVGWEAQLLELGFLAIWMAPFWSFSRLPPSWPTPKICVWGNRWLVFRVMLGSGLIKLRTDRAWKDLTALDYHYETQPLPNPLSWYFQNQSHGVHAAQVVITHIVECVISFLVILPFRQCRLFAGIVQIAFQVGILLSGNLAFLNYLTIVSAIMCLDDHFLTCLFPSAILSRLPELVRGCAGYWSLPQIQAWPFPQLFPGEEHGKGKGRQANDRPEAEASLLDKDAGRDETLPFNAATDDSLDSPRSCCCWYRPYFPRIVRSLKIPSRVRKQVKEEIKENWGKMLAEVVASVAMLTCMAFVTNPATSAVWMVIAVFFLAIILSASSTFFTNTLVSNAFTELVLLIVTLWSCIAIYQHGPAVWSVWLTTCLFTVLIAFAYTTLTNAALIFKIHVEVLIFLLIAALSVPVVANLISPDQVMDSDLGNPFSVVNTHGAFGYIGKERYELIIQGTNASSPTQTLYWQNYEFKCKPGDLYRRPCWAAPYHYRLDWLMWLASMGDKETVKDMHPWLSNFLSRLLQNSKSVTGLLAHNPFQNSDPPTALRVLRIQYRFTKGPVFGGGPWWEVVPETRELFVAPSQVPGAAAHLRKQLLILRRREEKQRLEQRRKEEAEIRRKEEEAFKRRRERAMKEEERRKREAEEAEKRRIAEQARQAEDEKRIREQAEAARKAEEEAVRKQIEEEKKRHEEEEKERQAEEERERREQQEEEEKRRAEDEKRRKEKEQATLLARQRSEEALKEAEKKARKDAEEEERKRKEDALQEEKRQKEEKEAEEKRRKQAEARREAARAAAEKESEKARQLQEQEAKRKALEEQERRKARERQRSASSQVAVYTAQPHDGGGVPLRHAPLLTRKKQAL

SEQ ID NO: 434 - protein, 333 aa, Toxoplasma gondii
MLKTTPAFFLFLTWMFPRCDGFVLTHKNGTTDAYDSAVLSFLLTTEGVREGAAKSSGTEIPSTLACPSSSPLKTAKDKHDASLLGLVSSVPDSSILKPEFVGAGAALVAVTRSVKWTQLKQSLKALVDTGVKCKVNCKHNNKKLSKNTDFKDQQEFPQTSARILPTSDREPLIAGPQKVTEEDLQVLLFEIAHDCKMSAPQAAITKPLTILLAGIPGAHISKRPFEAAIPHFILQKEDTVDLLLTVDRSWCGKGLSHLVRYHVGYMSFNLEVNGRRLADDDTFEDDRLYRQVVLTTKFTAKSLGGTLKQVRSLTDIHKKTGKHGENRPHSSPF

SEQ ID NO: 435 - protein, 707 aa, Toxoplasma gondii
MKVTTKGLAFALALLFCTRCATARYMSFEEAQKASEAAKRQIATLPSPDSTLSNPGSKHRNRGGSPAAGQPSQSTLQPEQAAAEVGLGAGGSTQGQGRTGGSAGAREERRSPSPQSAYPATSSASLRGYQTQLSPSHLPPRSSGPGGWFPTESIFTPWSSPPQPLTQRKPSLSGVVVTEFQEPQEQYGAASSLASSPKRYVSGASSSALSGKAVPTPASLGQENPLFPVQSATLDSGIQSPAQERRGSPQRQIAMSTENPADSGASQLASSVSSYVAVQTPHVKRSERIRRVRLSEEGLEEVQQLKAAAAQLLVAVPDYEAMRAVLQEAVLSEQRVATRKRKRKQPPGAVESAVDEVFPPNERVMMINANGVPIALYNRGHLGSGHFGAVIKASLDDGTLYAAKVPYSQIVPNADATSAELEAEISSARAELVKTIRQELDVRDKLVAKGLTLTETAEQYGLPLCQMTLTLPENKATVVRRGSRLVVVSKEVMLLPLIDGSPSNSLVQSQPPFLFQRAVAREAIIALAKLHELGFAHGDVKLNNMMIDVHGFGHMLDMGSVRPVDSCVSEEDKYYLRLWAPELAKSQHTSQQTCLKRGALDVWALGLAIFEFVCFNRLPYSLSNLPSSLWSRVEHLSRLRLSDFSAKDCNESDPAVMGIVAQFLNPNPEERPELPKFVSSYTFFRQAPGVTSHLTRIPTTELSSHRM

SEQ ID NO: 436 - protein, 608 aa, Toxoplasma gondii
MELVLCFVIITISGVIRESSALLLRSPTSNDVFGELVASAERAQPLATRLTKRISRLNFNDREDDFWEDHGDASWNNSYTLVNGRTTLGSENRRRPASHSLIERPYYRDGRLSPVLGVQERRGRSVHSYHEEPVSFFDQRAFDEYTFRRRSQLHRQRARAGLRSRIKQNVRRLWRSARGAVGGWGRRVRRKIGDLFVGHLMPQLRRLRFWDQGLPPVVPPLIGNEPGQASVALVAERMEAGLREKALTEKNPTEAQQAVGTYLINSAENTWFISSPGGRYILLKKRGFLGGGGFGLVYHVEHPTTGQPFALKIFVQRVMNNEVGDKISDLIEDEFGVMKYFPPEWTPARMYSELRFMVPLLKLRVLGKPEFQDVRNHLRIYSVCALFPKAQGDLEEAVVLLADMDRTNAYNIRMSCTIQMVKLLARFHAFELVHGDVKLQNFLVDKSGLLLLSDFTQILRTNERRYPPVVTVIYMSPEIATCMITRLRNAIPYTPQIDSWMLGISLYRLWCGNFPFGMTLDATALQVAGIVIRSSASSLDFASCHDIPEQFREMIVGFLRKTPGVRLSPQQALEQFSLLNWKGPSPASDTASESEPVSTEEAALLQKE

SEQ ID NO: 437 - protein, 554 aa, Toxoplasma gondii
MFSVQRPPLTRTVVRMGLATLLPKTACLAVLNVALVFLLFQVQDGTGITLDPSKLDSKPTSLDSQQHVADKRWPATVGHYKYLAGATESTRDVSLLEERAQHRVNAQETNQRRTIFQRLLNLLRRRERDGEVSGSAADSSSRPRLSVRQRLAQLWRKAKSFFTRGIPRYFSQGRNRLRSLRAQRRRSELFFEKADSGCVIGKRILAHMQEQIGQPQALGNSERLDRILTVAAWPPDVPERFVSVTTGETRTLVRGAPLGSGGFATVYEATDVETNEELAVKVFMSEKEPTDETMRDLQRESFCYRNFSLAKTAKDAQERCRFMVPSDVVMLEGQPASTEVVIGLTTRWVPNYFLLMMRAETDMSKVISWVFGDASVNNSELGLVVRMYLSSQAIRLVANVQAQGIVHTDIKPANFLLLKDGRLFLGDFGTYRINNSVGPAIGTPGYEPPERPFQTTDITYTFTTDAWQLGITLYCIWCKERPTPADGIWDYLHFADCPSTPELVQDLIRNLLNREPQKRMLPLQALETAAFNEMDSVVKRAAQNFEQQEHLHTE

SEQ ID NO: 438 - protein, 433 aa, Toxoplasma gondii
MENCASVRSSSCLIWLAAAFFVSALGHVQQGAGVVRPRHWQNSEAAVSVRPPGGASPRPFHSPIEPVAFIDGEHVEDKHGGSWLEQEAAEEVTPLLNSHTETPTQSPSAFRRLLRRLRFWRRGRTGGSDGGGEPPQTPRPSLPTRLFQHLRRAAAAIPAAASRFFGRFRRGRLPVFPPDEFPEDVDTNPIYFRGTDPGDVVIEELFNRIPQANVRTTSEYMQSAADSLVSTSLWNTGQPFRVESELGERPRTLVRGTVLGQEDPYAYLEATDQETGESFEVHVPYFTERPPSNAIKQMKEEVLRLRLLRGIKNQKQAKVHLRFIFPFDLVKDPQKKKMIRVRLDERDMWVLSRFFLYPRMQSNLQTFGEVLLSHSSTHKSLVHHARLQLTLQVIRLLASLHHYGLVHTYLRPVDIVLDQRGGVFLTGFEHLVR

SEQ ID NO: 439 - protein, 382 aa, Toxoplasma gondii
  misc_feature (127)..(127): Xaa can be any naturally occurring amino acid
MGHPTSFGQPSCLVWLAAAFLVLGLCLVQQGAGRQRPHQWKSSEAALSVSPAGDIVDKYSRDSTEGENTVSEGEAEGSRGGSWLEQEGVELRSPSQDSQTGTSTASPTGFRRLLKRLRFWRRGSTRXNRYLRFLAPFDLVTIPGKPLVQKAKSRNEVGWVKNLLFLLPPTHVDMETFVDEIGRFPQEDRPLADAARLYLTVQAVRLVAHLQDEGVVHGKIMPDSFCLKREGGLYLRDFGSLVRAGAKVVVPAEYDEYTPPEGRAAARSRFGSGATTMTYAFDAWTLGSVIFLIWCSRAPDTKSGYEYSVEFFFSRCRRVPENVKLLVYKLINPSVEARLLALQAIETPEYREMEEQLSAASRLYSGDGTLTGGDDDMPPLET

SEQ ID NO: 440 - protein, 461 aa, Toxoplasma gondii
MSGGRVPRVPASSTTTSASEGIFRRLVRRLRRGRGTADGAGVADETHQEPRPPLRKRLAQHFRRLRGFFGRLTPRWLSGLGRRAQRWWRGRQRPLLDPSFHGLEAGDSFMRDLLKREKELIGYCREEALKEPAAMVEAVTATVWPQNAETTVDSLLSQGERKLKLVQPLRVGDRSVVFLVRDVERLEYFALKVFTMGAENSRSELERLHEATFAAARLLGESPEEARDRRRLLLPSDVVAVQSQPPFAQLSPGQSDYAVANYLLLMPAASGGEGILARHILTAQLIRLAANLQSKGLVHGRFTPDNLFLMPYGPVMLGDVSALWKVGTRGPASSVPVTYAPREFLNANTATFTHALNAWQLGLSIYRVWCLFLPFGLVTPGIKGSWKRPSLLVPGTDSLSFFPCAPVPDFVETLIRRFLNFDRRRRLLPLEAMETPEFLQLQNEISRRLSTGQPTAAPSVA

SEQ ID NO: 441 - protein, 549 aa, Toxoplasma gondii
MATKLARLATWLVLVGCLLWRAGAVQLSPPNSRTNDLASGTPHVARGDTEAQSGTGDDSDFPQAVAEEVADMSGGRVPRVPASSTTTSASEGIFRRLVRRLRRGRGTADGAGVADETHQEPRPPLRKRLAQHFRRLRGFFGRLTPRWLSGLGRRAQRWWRGRQRPLLDPSFHGLEAGDSFMRDLLKREKELIGYCREEALKEPAAMVEAVTATVWPQNAETTVDSLLSQGERKLKLVQPLRVGDRSVVFLVRDVERLEYFALKVFTMGAENSRSELERLHEATFAAARLLGESPEEARDRRRLLLPSDVVAVQSQPPFAQLSPGQSDYAVANYLLLMPAASVDLELLFSTLNFVYVFRGGEGILARHILTAQLIRLAANLQSKGLVHGRFTPDNLFLMPYGPVMLGDVSALWKVGTRGPASSVPVTYAPREFLNANTATFTHALNAWQLGLSIYRVWCLVLPFGLVTPGIKGSWKRPSLLVPGTDSLSFFPCAPVPDFVETLIRRFLNFDRRRRLLPLEAMETPEFLQLQNEISRRLSTGQPTAAPSVA

SEQ ID NO: 442 - protein, 549 aa, Toxoplasma gondii
MATKLARLATWLVLVGCLLWRAGAVQLSPPNSRTNDLASGTPHVARGDTEAQSGTGDDSDFPQGVVEEVADMSGGRVPRVPASSTTTSASEGIFRRLVRRLRRGRGTADGAGVADETHQGPRPPLRKRLAQHFRRLRGFFGRLTPRWLSGLGRRAQRWWRGRQRPLLDPSFHGLEAGDSFMRDLLKREEELIGYCREEALKEPAAMVEAVMATVWPQNAETTVDSLLSQGERKLKLVEPLRVGDRSVVFLVRDVERLEDFALKVFTMGAENSRSELERLHEATFAAARLLGESPEEARDRRRLLLPSDAVAVQSQPPFAQLSPGQSDYAVANYFFLMPAASVDLELLFRTLDFVYVFRGEEGILARHLLTAQLIRLAANLQSKGLVHGRFTPENLFIMPDGRLMMGDVSTLRKVGTRGPASSVPVTYAPREFLNANTATFTHALNAWQLGLSIYRVWCLVLPFGLVTPGIKRTWKRPSLRVPGTDSLLFDSCIPVPDFVQTLTRRFLNFDRRRRLLPLEAMETPEFLQLQNEISSSLSTGQPTAAPSVA

SEQ ID NO: 443 - protein, 480 aa, Toxoplasma gondii
MRSSVGQSRLPLKFFLAPFSVKNSVFALFFVFALVCVSGLSWEDAEDGAAWDSVSNDSDDSFAKGSDFGEVKLGSAGQRQLLSQLQNELGGEFEDADVSMLQRDHGIHGEEAGLFRKAVPGLDDPAEDDEADGESASDEAEADSDVLADDEEGTSLIENASEEDTDNSEADSQQEDDSVGEDSFLQQEGEDSEEERAVEDPYAAAEPSYLEEDNTVDDSAAEDYAPASFVQIGSGERKIRAHMHLDSRQVAPERFAHAFNQDHVRLLDQTAVEDELLDEAAPGGGASAVVSPIDENPAEMESTISEGEAGSAVAAPEQGIQPEAEFATASEEPRPLEPVDPEMAAQQPQLPQEAMPTENADLLGNQPRMRNALEPSAKVLEPETLEGSPALVPPAETEEGTAAQIAEEMSKQDQGMQEARPQEVLTRHTWQDMERTEDLRKNDVPAAVANSGSQIITAASSVALAGLLVAGQLLFSVGMY

SEQ ID NO: 444 - protein, 91 aa, Toxoplasma gondii
MGHPTSFGQPSCLVWLAAAFLVLGLCLVQQGAGIQRPHQWKSSEAALSVSPAGDIVDKYSHDSTEGENTVSEGEAEGSRGGSWLEQEGVEL

SEQ ID NO: 445 - protein, 575 aa, Toxoplasma gondii
MGHPTSFGQPSCLVWLAAAFLVLGLCLVQQGAGIQRPHQWKSSEAALSVSPAGDIVDKYSHDSTEGENTVSEGEAEGSRGGSWLEQEGVELRPPLLDSQTGTSTASPTGFRRFLRHLRFWRRGSTRGSDDAAEVSRRTRVPLHTRLLQHLRRVGRFFRHGIPAAAGRFFRRVWPERPQPVFTEGDPPDLETNSLYYRDKVPGEVIIREVLGKVAGFGPTSGHGVFAAYENAFSEMLWAEGGAVTVISELGRPGRQLVRGNLINIVDGGLLFQATDQATGEPMTVLVGSTWNKPSGKDLDKLRHQALAIGLFQKVKNPYLANRYLRFLAPFDLVTIPGKPLVQKAKSHNEVGWVINLLLLLPAIEIDMGRFVEELYELPTEDRPLADAARLYLTVQAVRLVAHLQDEGVVHGKILPDSFCLKREGGLYLRDFGSLVRAGTKVVAENAQGFSPPEVRGSRGGLLFGPRKTQMTHGMDAWGLGATIFFIWCFKAPTTGPEEEYSIEFLFSLCRRAPENVKLLVYKLINPSVEARLLALQATETPEYREMEEQLSAASRLYSGDGTLTGGDDDMPPPET

SEQ ID NO: 446 - protein, 587 aa, Toxoplasma gondii
MPKILARTVDALVTCERLFCVLHICNMENCASVRSSSCLIWLAAAFFVSALGHVQQGAGVVRPRHWQNSEAAVSVRPPGGASPRHFHSPIEPVAFIDGEHVEDKHGGSWLEQEAAEEVTPLLNSHTETPTQSPSAFRRLLRRLRFWRRGRTGGSDGGGEPPQTPRPSLPTRLFQHLRRAAAAIPAAASRFFRRFRRVQEPVFPPDEFPEDVDTNPMYFRGTDPGDVVIEELFNRIPETSVWNENERVLSNANHLVSTALWRNEQSFRVESELGERPRTLVRGPVLRDDGSYICLEATDQETGEPLEVHVPYFTERPPSNAIKQLSEQVLRLRLLRGIKNQRQAKAYLRFIFPIDLVKDPKKRKMIRVRLDERDMWVLSRFFLYPRMQSNLHILGDVLLSHSSTHKSLVHHARLQLTLQLIRLAASLQHYGLVHADFQVRNILLDQRGGVFLTGFEHLVRDGASAVSPIGRGFAPPETTAERMLPYRQHHPTLMTFPFDTWTLGLAIYWIWCADLPNTEDAELGGIEWIYRRCKNIPQPVRALLEGFLRYSKEDRLLPLQAMETSEYEQLRTELSAVLPLYQTDGEPA

SEQ ID NO: 447 - protein, 575 aa, Toxoplasma gondii
MFSVLRNRNMRHGPSIGSSSCLIWLAAAFFVSALGHVQQGAGVVRPRHWQNSEAAVSVRSPGGASPRPFHSPIEPVAFIDGEHDEDKHEGSWLEQEAAEDVTPLPDSHTEAQTQSPSAFRRLTRRLRFWRRGVTGGSDAGEEAPQTPRPSLRTRILQYLRRVGTFFRRDIPAAALRFFRRFRRVRQPVFPPDEFPEDVDTNPIYFRGTDPGDVVIEELFNRIPQANVRTTSEYMQSAADSLVSTSLWNTGQPFRVESELGERPRTLVRGTVLGQEDPYAYLEATDQETGESFEVHVPYFTERPPSNAIKQMKEEVLRLRLLRGIKNQKQAKVHLRFIFPFDLVKDPQKKKMIRVRLDERDMWVLSRFFLYPRMQSNLQTFGEVLLSHSSTHKSLVHHARLQLTLQVIRLLASLHHYGLVHTYLRPVDIVLDQRGGVFLTGFEHLVRDGARVVSSVSRGFEPPELEARRATISYHRDRRTLMTFSFDAWALGLVIYWIWCADLPITKDAALGGSEWIFRSCKNIPQPVRALLEGFLRYPKEDRLLPLQAMETPEYEQLRTELSAVLPLYQTDGEPA

SEQ ID NO: 448 - protein, 353 aa, Toxoplasma gondii
MTHPNPLQTRFSRSASLVSRMPLVRLFFTIAAPLLFSPSPCPFLPLKTHCLAIQLGKPQGSPPASQKEAIRDTGVSHQKGEPSDSSSEPKPQGTVAETPGAASAAAAEVGRPSRSSAGPGKKKRGPSLFTEETMGPSKRHPCLKTLAAAVERFQAQHLTGRDAAKAFVDAIQECGIQVVASDYDRTAISVHSGGSARRDDLSVLGALTPDFKLLGEELTRRNIPIYFVTFSDKGENRGDRIAAGPLVEATLKASNANFEAQGVFGYYPPFYSEPEDYAPLGLSAPMPTDKSFHIQQVSKASGVPEDKILLLDDDRANCVNFCRSGGAAIHVSGHEGFDFGAVRVVVKPSLIMQ

SEQ ID NO: 449 - protein, 102 aa, Toxoplasma gondii
MGHPTSFGQPSCLVWLAAAFLVLGLCLVQQGAGIQRPHQWKSSEAALSVSPAGDIVDKYSHDSTEGENTVSEGEAEGSRGGSWLEQEGVELTSRLLDSQAGS

SEQ ID NO: 450 - protein, 1010 aa, Toxoplasma gondii
MKPPRETSRGGMEGKVGFGASIRDRWFFQNFSDGLSNGEKSWWRRSVVHFLQMADPTWSCRETRRALEPGMLEKMKSTYWLTRIVFIRALSFVYFVAFLVAFNQAQGLIGSDGILPAQTHADSIREVLAEEDTWTKIKAFPSLFLFLPANDFWIHCLPFLGILVSLVTGVLGGSNGFVMLFLWILYQSVNSIGQEWYAFGWESELLEIGFLSIWLCPFWSFSRLPASWPTPKICVWGNRWLLFRLMLGAGLIKLRNDNLWTDLTALDYHYETMPIPNPFSWYMHNQSHTAHAFQVIVNHVVECVFPFLLLIPFRQCRLVGGVTQILFQGAIIFSGNFSFLNHLSILPALMTLDDNFVSCLFPSKTLERLQPLLQGCLGAWSLPKHQAWPVDSCSEHTNEHQGVGSVKDPEAAALLNDGGSQLEWSVDTDDDSNQASARTCCCWYSPRILQFFRSIPRTIFPSRARNRMKRDMEESWKSMLLELVVSIGVLVLMAVATSSESPSLLSVLAIIFLCLALATSSHFYTKTATSNVFTELVLLVVSLWSAVSLYKYGPLPSCLWLTIVLFTILLAFSYKTISNAVLVYKIHVELLLLLLIISLSVPVVANLLSPNQLMNASMANPFDILNTYGAFGTVTTERWELIVQGTDDPTPDENSTWINYEFKCKPGDVNRRPCLISPYHYRLDWLMWFVPMDIPEIVGVRHPWFPRFLGKLLQNSPSVTGLLADNPFKNKDPPTAVRVLKTLYRFTKRPFWGSGPWWEIVPNTTSVFVAPGDVPDADQHLEQMIVLKRVQEQKAQEELLRKELKEEQRKARERAEAEKMVAEEERKKLLEQRTQEELETKRRIQEEKELREKQAEEMRKQEEEQRKKQEAEEKARAAAEEARKRKEVEIARAQEEQEAERQREAAEEEKRKKEAQRTAEEEAAKLRKEEARKRDEEAAKLAEQRESLRRKEQKEKQAMLAKKRAEAAEKEQERNSQLSDQSRASADGGVPLRAAALFNRKKAAIFRLNQ

SEQ ID NO: 451 - protein, 1063 aa, Toxoplasma gondii
MLRHFGGGFMPWRHLDISSLHWVDSARFGSHCKRYNQESATERLREGDAWNPSTVLAVNPSVSTMSNGAVADSAGDSGQQTPEETRGSRDTFVFGPFKEWLKHHCSLSKKDHALTAEDLKVMEGTYWLARIVFFRTLGFVYFTAFLIAHMQGPGLFGQDGLLRLEDTPPCKSSGQDSRELWTRFAAEPSLFHFFSCTDASLLFITSSGLVLSAVLILTGGVTVPVLLWLWLSYMTIQAAGQRFYTFTWDTLLLEVGFWAMPLTLVCFLRPFLPLTSAPSPSNTTPDGPGARPSTLKSATMSQSAGGGGVSGAQLDPGHPKEGADGRGSTSAAAELSSTDGVRENPSGPESDSSSSGKRSTLRGQQMLRWPRAALQLLLRCCHSLVSPGAPFLPPTWPTPWISVWGYRWLLFRLMLGAGLIKLRADTAWTNLTAMQWHYETQPLPNPVAWFVHMLPMSMHKFEVLMNHFAELVLPFAVLSPWRQLRLFSGCFQLLFQVAIIITGNLAFINWLTIVFIVFLFDDRFLMWLFPTSTLNKLRPLLQGCPGNWSFPSSDSVTKDTSTSVSKSESEKSPREPQACSEQRPLLRNDVKLRETSEAEEAHCPPSSSSATTAAVSRALPWRLLTGPKWTGRALRRMLATWGCWRIPLFLFIAAVLVTSDGILLLLLGKAATAPSLSTTLVWESAGLLLLILTSVVALGGLAGAAGVPWSLLGAAVSAFSPRFTVENQHPLTNLASVERSETAENASLPTHPQDSERRGTVLRRPRQTEEDVGGHEGGVVESRRQSKSVVDADEGRDEAKLLWKRTQDVGALAFEVLVAGVVLANLLFMHFHLGPTFAGLDLLTGLLCVLLFAFAHRHCSNSFLVLRVMTEVGLLIVLVWRSIPVVENLLSPHQIMNDTYDSFRLVNSYGLFGFMTKQREELVIQGTYEPDPPSAPANPAWQTYEFYCKPGDIDRRPCFVSPYYYRLDWLMWFAAFNADLQAPYWLLRLVKKMLANDPKTSALLAHNPFRGKRPPTFIRILRYDYHFAYKGKEQDMYEQGKWWQRKYLSEFLPPVSAALFRKI

SEQ ID NO: 452 - protein, 1254 aa, Toxoplasma gondii
MGWVPPCAAPAHSQAAANLRVESLGSRSFPDGSTKKRRREERTDRFRNLHFRTLLYSCSSFSCSRNAPANGHKTSSPGHPEESLRPTPLFVKRARFCFYLLFLFSVLASNFFSHRADECTRFCNVFAQALHVKLDNPELSRQTLPASLRWQQVKTKNGEEVNAAESASWKGFADVQLAPFRPDEKPSRERTVHEHRDTVHGLSGRDTLGIDSFRGTDLRGNRLFVRLPRPALHSPFLFPSFSFPAATQPAESSVFFGADGIPSFSEIHSEQSEDAEEPESQDSSSSRNQDEAPKPTEHASQEKAHESQGEPTEDSGAAESASEHPSPSNSIPAEEESSATATQEKPTEGPSAPQTLASPLGGDTASSSGTEQTERRSGSPVEEQGKDSTRTASLGSVSYSSTTTTTGTPSAFNVKEALLAPVPTGAVAGPLAGREARAQRGASADSGERGAAGAKEAAGEAQGPSEVSEEKAEPKQKEATEGGKTGGDKDGQERGSAAGKEDSAPTTEKPLSKAEMERAAAEFVKKEGGMGSLEKKLAESGPQLTEEQTKTFVDTQEVAQNVRKLIGLKAGSNLHLENQKLIKADCDLATFGPEYCAARDNPNALSLLWSLEHRKNTIYFVIAMITLAFGIAVQTCIRLLERKISEGRDEFSKEVMETAFRQIATISIVNVILWGTMQSNVAEVLDELVFGDVMPPLRDSDTVLENVSPMLEVLFEELFFVSVILLVWYVVFVILFQCMIRQIIEWMRKIDEEEDIPLIARDAETQSHRWCGAVLGRSALDKANFIAHRYEFTDNVQSMSIPGVDPSGYYFMEYLRASLLKMAIEMIRLPNSTLFFLMIMDICLRPTFSFRLGQEVGLISGLSATCLVGMLLVWAYTARIEKQLLPRHVPHYLVMRYHMEVGGDTSSEYLKEFAPPYKLQKQKNAWPGVCSTFLRGTTLPNKHQQLFCFWANGPNIVLRAVEASFFCQLLVLAWWVQLFRSHPATWLNFCWWGNVVVVLCAGSQFALLKSVVYTVLLALNSGMLVDPELLEKVWDLQRAENVRRTAELIDALRVQSTLFAISEGGDMFWRQLLIRSKGASRQAQEQRLSLWAALDEEHQGEISRAKIFKFLTSQGLPIKSESGVNDFLHVFDRNHKGGVNEDEFFVMVMVVKQMLMEPLDRDAVRELFEGRYGIPWTSPVGIDLANLSKILAELRLTLSEGKKRYLLDFIGGKRGTTAVSPDHFVSQLQAMEEQALNPIQSESLRGPPIPGERV

SEQ ID NO: 453 - protein, 1257 aa, Toxoplasma gondii
MVSLCLPSPLLGLQGPCPSRKKPTRSNGKLQSQPCARWKPVDLTTPQSRLLCHSLPTVPSSISPSQSSASSRLSVNPSCLAFSPAVCFLDANRRASWSPCFSLKCSFRNSRRPFLCMALCIVHLWLFSALSFREIVYVSDSAHHNKANPTCLSSWSLAAPVDARQPVNAALTKEAQIDLYEPRNTLGGLGKSGRGSGFSLKTGDAFKDVAPDDSGVALLSHESQQSSAAHELNMHHDIQPDPSSTEFSNGRSAPVSFLLSRAFHLSRQPGHLSLHDSLSRLSLFPSKGSSISFSSMSSPSLSALPSSSADSPLSSGLTPPLSLSTESVPAAEESPSSGASSSSSPCEFSPSRDFAFLEAGQATSGKNSLPRACAYAGCKAGFFTPRPANDPNTCYTLSECSQCRVHPESHADLCSQVEERNGLLLLMKSSLGLMPNPTMPFRYKPLSAKDIARLRDSKGKGSAGGGGDGAEGEYDDAGGEEYGEDGASGEGEGADDWEGSDEGFLQLHSLETRTKGESEPTGNARGSSQPLRRQGRLPSSVSGTEEIFHPSDFRLASFLEQAQEVRHGQRTAGETATGFAASLSPLPFSSASGASFDLSVSSAPSHSQSPFSFLGEKVSSWDNEYGDQGDDYGFGDQASMLGEYDDNEGSDEDYDEGGEQPRGATGAKSGKAVFLKFDETRVYRIVPNSLLGDVGRCATDSKNYMRLQITVALQPRRFRMSVAKAKKLMGLRARKPIPRSFHEGDEGEDGGYDDADGGYDDEQGFLELENERREGRPVQGDGTGELGTESREQEGNWHELSGLTEGRDTSEDARERQRGKDRGENGRHTGVVSLSDTAAELGYEGKSEPDLQDGREQDLKFRFSSTRVADLEGEANQPLSFVQVEDDDYGDDEDDDGEGRGLGKKMKGFFGGVKRVFSRKKHGEDDDEEGGYDDDNPPDDEGEASPSKKGKRRGSFMNKVRGLVSSKSPQEKRFKKETKKARRGIKRVSRVAVDIAFHSPAVKKCRKSLSWSATFPAAKILQTSFFILARQGEVGGQLSAFINSGFSVTLKCKMKGGCMMNEVPVSCALVSCVKAKHVSTEALEEGKKRAAALAEHNLKLAQTSLVMSPADRAARAAEYERKIQEKQQEIEAGNLTQQQMLTAQQQQFLLQQQLAAISSSQSPLDPMQAKLLAAVQGGEDASSSTSGVTMQEASSGVTDSHTQRLIQHMIAFDSRRGGRGSRMSGGAIAALVILGLLGILVGGIAVFKYRGGRRRRR

SEQ ID NO: 454 - protein, 1490 aa, Toxoplasma gondii
MRIFHLLLLGWAVCLALGLRVDLAAAETETDGFGRRRRKKEQEHYGDNIEMTTLPTKKGGTAPAVPSSPAEAAKWPFNSSCMYSEVEIYRPGIKEYLHARTYDPLAPIAGNQQENLKALQELLTADFMTQGVASVLLAVEQVAGFVDFQQPPLSEGRLFCSEAKDELCHRIRDALRSGQPCKVIAPVLNCSQLNKKDMEAFLEAFEAEAAILPSSPDNECGKAYAEAVSLYHLVIVDTPLSFSETPMESEEMKEKLNLLFAENTRGGPTPAKEGVVYETVDLQAPNDSGDAPGKPEQVPKPSLLSINSSIWPADIYANSEADREASMVELKKLKNRFLGKPLGPPETTTLEAFPYEPEATRTLHYSAARRLFFIGARSPLVALLYNLLFQAWYRWDELFTGEGAARPFPRISTLLRAGSQERYSRLDALCGVALKKVKPRPKTPSTLPILPREKMFRKTRVVGEAKFSCDILYRAATALDLGESAAVVDFNERMESLNDEKKRRSVLLEHNASGSANFRRVCLSFRKSVDGVTELTDLLSCSFSDTVLPSALSASTSSALPPNLREVSEFDSVVLLETKAAAAPAVDESEDEDSPQEQEDRARRNFNWLRLRAAPHLEAGLLGDVLSLDYGTWWISLLFVDERSLGEVEAKRKKLKATCAKAAKSKKSTADDGVCTATWNKRWWDKNCSKNLTRFLCTPVLDVLALDGQLTFVTSRALKALAANDLQVKKPGQSAKGRPFASLAGSRATQKMLFARNAYAPAIFGALQFFSTSTMANAELLGGLDHPGIWDINFASSLFTGKGKRGWLFSRLTGSLLRRLGTRLAEKAYQPYMMQLLHQKLRPETRKKMFQAIQVIVHPLALKHLNQMAPLYSDSKGNLNKEGGFAEEIDNTLREWSEYGMNEKLIDRLEKGQNLSASDFAGVNILTMPIPSRERMDSLVAERLNGALKRLQENPENVETSRAACDFLSHASNSIYVTNDSRYLLNKFGPENLLFLGKIVKRSETLEKPQGFFARSWAGVEKTLKGILRLPPYMVRHFVFAAVKVREDLVSEVVREMAAIYNRFSNFFKDEIAFRKAVSELSIAYEDLLRQRIREPFAVPTHSLLDNIHPDYAQMDGQSRNQEFQASALSHIFSQAWSLFFSVSMNNYINPEPLAKIEAEYSTDAWKKSVDDHLAVNSFRMIFMGSDMPLKLYDQLIPNEQKRMLKRAKFGVSTMFAYQTLLTGRLYEAQNLPNLGMFLQAQGPYFGPMIVRWQQRRRTDRLIEIVSWLTLGAFCFAAVGAAMQQTTQVVEQIVQNQSSLAPELSGCPPMGICMDGTIGDPIASPPATAASAVFQSIALVGVGMMLGPAVAIWKIAVSHFKVLARFEMAIGNAFRRMGQWFRKKWRGRWFANKQNAEIEKEMQRHTKKMKEEQKKMIDRKAPNLIDQAVPATAPELDLVPDGPEPVLGASTSGSGGGFFEIASAYRRRPRFDRLASIRRHDALLARFDKL

SEQ ID NO: 455 - protein, 157 aa, Toxoplasma gondii
MDLEALSSVSPPRGIVEDHSQISVERVNCVAELVIDAKRGGREREAVEQVPPPAERQAGGCDGGQVQMVQQKHPGGLKFLYISDLLCTYGEWQDFSDTTSQRTVPDCSGAFEQNGHDRHEEPMDLRMSPLYYSDGDPGKAMSWQVLTRKPGTENDVN

SEQ ID NO: 456 - protein, 194 aa, Toxoplasma gondii
MNFFMSTDGSVSLGAFGAVKKDGFRGVLATHEEFAPPDVFVVLSEVMLTCAPDAWGLGATAFWTWWNKAPETGDTVGHSILPLFKTSEDGPQPVQFLVHQFLKRFARDRPLALQALGLLSNKRWQKSCPLLCRSTVMVERQQEETVLPPRGTSQGVEGIGGKGCDGLVSRGATGMPLEFYDVFDAEANASWEMN

SEQ ID NO: 457 - protein, 631 aa, Toxoplasma gondii
MHDPDFKVPLNVVVSIYRRGSIKCVPVSSLLPITLPGCTSEKHAYLAAYFLPKFLNITSAEQPPAAARMQLPAGSYILFGWSVRQRGCTKMKNTLLSPVGFFTALAVLIECHLCDRCVAHHGSSTDGSGLRPPQEVDSAPRTPSIAVKELATFPGDDIQTSSQELPGYELWTREQSGASVRVGFPQNAESFLTQREARDEIANAHELVAVTPEGDAWNHSGVVPEEQTVTPASGSFIQRQAAHAPPSTRLTPVDRRGRSHTVSAVRRRVTVEDVMRPDQSAAMHAVLSAFGGGLVLKAKNKWGRTRYTLQGPATFLGMGAEGIVVRLNQVKSDRERSVTPVAVKLCLIRAAVFSGLTWWRKRRTRTELMKLFLSNENSVKRALPDLDPAEMLEHGLVVPHHAELVSGMPTWFAAGDSFFVLPVVSVSPLFTCDLETVVQNPLTFLGEDVHYPPVAKEYCVDASKGISHNDLKLENVLLSADGRVAIGDFVFQAPFGASLPIRGTHLYMDPDSSEAFFEQRENEITPHRDAWATGVLLFYLWCGVFPFGLQNVANASPPQVMRVTVMHARTTRPPPNFRLCRRIPREVRNLVTGFLQWNEEARRLPSDVADAFLAATDDGGREARRIRTHQF

SEQ ID NO: 458 - protein, 131 aa, Toxoplasma gondii
MTLKIRMICLAAVGVLIGGVAITTVFKPVSPECTVHSFSIGLISADALRIRASHSSSKGEEGDGEKHKDKSSEEGAGDRDREEERDGEGEGSEKGPQPSPSGKPLQRRDAGYWKKNSDSGKHERVKGRKRK

SEQ ID NO: 459 - protein, 363 aa, Toxoplasma gondii
MCCMLVGLKHWEYCLSLGSAAVWYAIVSFCCAVWQLAAVFVHVDFSGDITEPIVRDDDGTRQVVLGLMSISHAGAAALNFAVVLLTGLAVGLRSPKLCRLSSTVILTQGIYNSLFLVGVWSIFDCSQHGAKTHSAGLHPDAWFGALLAWPAAVILASLATVQSAGNSGFEGRQRIASPRLHKPDDGHVSDAWARVGTWTVGLTLGQGVLLLSGVCFLMAAKTLRSFWNLHFVESYEAQQIGWAFMLEGLILCCLAATAFVGTVLTSTFSLLVALFCCIGLGPIATIVAVWWNVLLYRWKVEPGVFVGMQFSIIEQYVCVFCCWAACRTLTGFIAAKTKGRFGIDIPKDDSPESEALVPSASPA

SEQ ID NO: 460 - protein, 114 aa, Toxoplasma gondii
MWVDGIHLSLLAVGMPTPVRFRSMCSSPHSCCFVENSEQREIQSLFSGHQLLLLGSCFCDAAESTVAGRRSYQRHTTRPGWVTGAVQQTSNGWRLDVSRQQMPQWKRGHIRGRP

SEQ ID NO: 461 - protein, 233 aa, Toxoplasma gondii
MAVQTAVDDPEAPAEDQPLLGGSLKKPSTYRQCCCCALGTAVTLWAVFLIAFSVFLVLDFNIRGAAFTSGAVLGLVTATLLLCAAGQQNAFIAFVSFYLQIMVYLLWALQMALAAVSLWKVTHSSASVAGREDFPRVTLSQYAVMTDTVSDQSGTRPVQVYRQVEVSFALYEATLCAFYAVQLLLAHFVLSMLWSFYRVLQAGGTGFEKRTAEEIEEDALSAQFPSFAEDTPR

SEQ ID NO: 462 - protein, 479 aa, Toxoplasma gondii
MATVPMVSLSAARFTLSFLFFQLCLSRLFRPEGRNELEGPKDVDADVIRALDLASVFAFAEAVNNPPPLEGASVSPENATDPPETGGSRRWRTARYVLRRPFTHIRRVSSAVRRYISRGTSSLASSFAWKRRLRKLIRGMAKDLKQNRVRDAQQKPGSDAVASFVKTPHALLTSLGTPPAELANAVGLLLPVQHPVPMKSKVTGKSLLVSHAATVGVSSYGSVLLRCEGSGESASYFLEAFPVLRGSREASVSVRKQYLAAIKELRAASGVAQVGVVVDLLLLKRVRNTWCPRPHESHFAFPNVFLKRAVEGETLREVLLHIASTAATDTPGTGPAHDARVSLTEQVHKLARSAAELGSRGGKINIDTFFVTLDGIVHLQPVSLVESPPVHRGSAGLESPIAAELEEGEEKPSPEKRMTDDLALAIVLAQIWCPQRRFDDVAYELLLLHRFEREVTEEFFERCADPPEAVQVLVTMLAF

SEQ ID NO: 463 - protein, 226 aa, Toxoplasma gondii
MDLWGRDISRVEALKDEIFSLLQQREKQRGPGGSASSSGRSSALLRGKFYQFCQDVEHLERVMKASEAERSSDMSSADWRRRREQMSRLLAEKSELQLSFSRAFSSTEDDLCGLPESGAVWVDVSGGARALKTREENIIAEQDEQLCFLAGTVSNLKSIGHAVGDEVDVHRKLLDDLDVDVVRAQTRLEKNKELLKKIVDRQSTACLLFTALALLVVLIFLVVATA

SEQ ID NO: 464 - protein, 823 aa, Toxoplasma gondii
MSAHTETMTLGIPLSPTGELVDAVPHATAATEHLHEHAIVMIIASISFIYLLSAVLAGLVGLLPKFRPPITVVLFLAGMSLQPLLEWMQNRVLLQGIRLIGNVDPYLIFFALLPMCLYESSAFVNYHMFKQVLPSSLLLAIPGVAVNIGLVGVFLRYGVSRVYDWPAALMTASIVSATDPVAVIACLRALGAPEKLSSLIDGESLLNDGSAVVFFEVFRSIVIGTYTGVGSSVVLFSQLSFGALGYGLAVAIVLYLWLLTVREFEIVQVTGTIAAVFTVFFTADHFLHVSGVLAVVTLGIFMAAKGSTALQRSIQKLHHESVELLSTLSVQAIFVCGGVIASRLLIQYADTWQEWVELLLLFAVLQTARFAVVFGSWPFITWMGLPLSWKECFIISYGGLRGVICLALGLVVEADPLISPTLREHVGICVAGTVIFTLLINGTTAELAYTRLRLYPISKYRREYLDSVLASIDVSFNRKKNELKDYWLFRGTDVVQAANEALPQFSKGHLDVNGNLHIPTKSFREVLRNPPSCENWNVQAQVTGLAKLESRDFGVPSQLGDWTHGLVSTIKNVKQLTSRQQRSPESRDDQHNPEEVTLVDKEAGQLEKEVHVLHIMFSAMREFYSGMYKRSNIGGTACLLLTSTVDKCHSHLDAQLHDMTTNKKSRKNANNTNVFSFEWEVLLASLRTRYGLWKCLNAMPCDAFDLLKSYLISIIETLYAVVEAHEFVNQSNRKEMEELISQATLMPSDDVVTSAKELLEKLRNTFPVAFSQCLVIIAAHMLLNAKQKVLDEEIERGLVFPEDADKLNEALIEQRMMLERIIR

SEQ ID NO: 465 - protein, 1300 aa, Toxoplasma gondii
MARRRPSAIATCFRMILAFFLSFTFSSGADSLLAPSTTQARRLQARSGDNALSNGGRLPNGEHNQFRALRRGDQKVEKDAFGAVNAEQRTAVSGSKFEREKWTPISFTEKGLFDVINPTIAGDEKDELNWSTHQRIEGRGTEPTRSDSQQRDQAKPRALERREEAGQPPRDEHQDTDVEQAPLIKEDESDSPSVEEPRAQPPENKEDAITKPWDADWNPWKFLDENPLPIYRDDWDEEEDNRDDADHDPGFAEPPNSPPAGGVPKREDDNAPDYPGDDTASSPPYDMRPNPEDHSRTQPGEYGGGVDDEGELPDEDTAKGMPRSSTPPPNEESIPAVPTESEWSGSGVYEGIAITVNARWIDTRTIGEGGIQLQHQPTVFPAPPVLRKVGLKSKWKHTIKIFVRTTGAKFVPARRQVFVPLDETPTSSSTLLPWWANWSISAVKAASATTSSVAAFLFGTGRAVDGGEGISEGKGPTITSIKNMLKQYKRFKRKHPGKPGELVIDLCKDEEDASSAARTPSPSSASESSSDGGVWESLESPAPAPMPSLTSSSPSGSSPFVVKQSPEGDLKTESEGPARLTTPSEKRPAKAKPQNTKKKTKRRKRTVANAYNILQTQEGLALVNKIRDTMAEIFSSPSTSVQVLTSTGHLVITLPSEGVDRYKLKGFLQTVQETFGDNIQQWSFSEIVQLRSEVPEPHIPPRAQMAAKMESLSGKSTKTSKKLNGRSLPASMSETTSKKTPFEASMPTDSALESKLYGMHMITATHAWIHGEAGDGTVVAVVDSGISRHHDLDCNLWQNPHEQQDGRDDDGNGLIDDNHGYDFQENKSEPEDENGHGTHVAGIIGACVNGGGVVGGAPKTQLMALRFIDKGGQGSMANSIRALNYAIDHEVQVINNSWGGPQSTTVLRRLVHMSAVARNGKGILLINAAGNESSNNDVNPSYPANWDQDNTISVAAIDINGDLADFSNYGKSSVDMAAPGVKIYSTKPGGDYQHMSGTSMATPHVSAVAALVFGAFLRNGYDAPAAEVKDIIRITASPVEQLQGVTRWGSIPHARDAVLMARMGGMFLQAKCEDMVFELDAGSAHVVDLHLMPYRQGNYTADLTFDVFTEDGYRLDQIKVPVKLAISAEPRQGNSDSLAAAAFSSVVSTFAAHPTEGFEELCRLQAKIHVVQEMSTAMIVIICLGVIAAISVLVLVYCCSRNGQRRSDAAKRRRESVRDSAGEERRNQLTETHRARKHADTSAEANKEFLNCSSRAEDDANDRSETHTNPTDPLCRKEHVFLPATTLEQFALSTPNENES

SEQ ID NO: 466 - protein, 243 aa, Toxoplasma gondii
MAQYKSRPLAAVLLLITVGSLLTASESVQLSEGMKRLSMRGRSPSPKTGRFESGDEGTSTMSPSVAARQQELGLLRPEERLIAGQAKAAALQTVHQLGAVVLTPEQAKAALLDEILRATQNLDLKKYENLNTEQQKAYEQVQKDLSLLSPETKALLIENHRKEKSLLEQAKRLFRKRHYHVTRQAALAGQILNEQRDASGALQSGAVKAAIRKANEQYNVAEEDKNFNEEQHAAQLKKVGAMP

SEQ ID NO: 467 - DNA, 3262 bp, Toxoplasma gondii
tttcggaaaccagcccttgcatgttgcgtcacttgttcgattagccttcgcatatccttttcgtcactgtgcggtgcagtcattccaccgtgaagggcgtacactttcaataagacacatcttctgaatgccagaaggagcctctggtttccctgtgcattagttagcgaattccgtatctgtccggcaaggcttaccctgtcatcattcgacagaagatccgaatcggacacgatcgccttgagaagtgcatgtttctcctcaagagtcaaccgcgcaggctgcaagaaaaccaaaccttgcatttgttcccggggttgatacggcgaattcaactcactggcatcatgcttttctccttcgcaagagccgctagacagcttgacattactgaactgtgtgtgttagaccagcactgggacttgtgggtctaggggcacgtacgcatttctccatttttcagttctttcatgactgtggtggatcgctgacgatccgctagagacccacccaaagtggcacagaggtaattgtctttggaggccatcgccatcatcaaagcatcaacgccctttctcagactgcaaccacgttatataagtggtgcgctgagagattatcacttgtgttagaaactcacttcgtgatatgatgaagggatgcgcaagtgagaccggccttcatccacgtatttgcgaaaactagttcctaaaagtaacatggagcttttgcctgtcatgctgctcaaatgtttgtgtacccgcttgcggctcaaagctttgtgtagtcgctcccgagtgccactggttttttccgcttgaagttcactctcagctgccttccgtctcgcatctgcctccaaacgtgagagtaactgctggaggaggagctttctggtgctgagttccttcactcgttcgtccagtttttcattggtcgttcttagaagctgtagctggatcgagaggggattataccaccggggccatggtggagactggtcttcgtggcatcgtacctgctcccgcgaatcctgtccttgggatgacaacgcttcgagcttcccactaatgtgcccccactggttgccgatggttcccacgctagccataatatcgattcaattttactcgctagcagagtggtcaattagatttgcgccgttggtatatgcggagatttgattctgccactggccgatgcgccttcgctaaccactgcgtatggcaaaaccagtggctgttcaaaatgattcagtgtacatacacctgataggaccactactcccaatgtcgttttacttgttccgttaagctgagactcatgctctgcgtgcgttttggttttaaggtggtttttgccgccgatctacgcgagagacacattcgcgcgggaatttgactcgagccatacgttttacgcagaggcaaagcaacatccttgttccatctcgtttaggttcccaccagcaattttggtctccattttttaccttcccgggtacaggcccctgacggatattttcgggcgaacgccctcgtaatttgaaccggacaggaccaaagaaaatgtgtaacgatttcgtggcgaaaagcattctccctctttgtcggatggtaaatagaggaatctatagggtcctcgtccaaatcgatcgttcggcctgttgtcatacgagaaagaggttccctagcgcgcgatctctgtaaaaacgttttcgacggaattgaatcttctttccagatgactggtgtagcatgtggctcgtctctgccctttcgtaggcttgcattttgctgtttgtgttagtcgatcattcaacgggcgtctctgtagtgttttttctggggtgacgactgacatgccctctggtcgctgtcagtaccacatccccttgagaggcgtgtgctcaactaaggggtttgttacagactgtcagttccggtgacacaagtgaaccgtgaagaaattcatcctatatcttgtcagtgccagacgcctttctcccattttccctcccacgcttttttgcgtctgtttagcggttcttcatcgatgtggaaccttgtcaaacgtgtaatccttcgctggccgtcaagggacccctgtggaccgcagtgaggtgcatcgtctctctggagctgattgatgccaagtagcatcaggaaagaggtttgatttttgcccccgatcttccgtggtccgttgtcgtccacatgcatgcacaccctacggaggcgtgtaaagtggcggcagcgacgcacacaaatgcttctgctcttctgagttgggtctccaggaaggctctggaaggaacgcacacagaaaataccttcgtcgagagagctaggaaatcgtttgtcccttttcattaaatgagtgactgatgaattgagatcagtgaaatgcagtctactatgaagactgcttctgcgcatcagcttcagctaatccttcaggaatacatgactgattgtgttgtggaatcacagggatccgtgcgctgtggatacacttttgctctaattgatgagaggaggcagtagctgctcctcaagcacgagcacgtgttctccacaatcctgccgtacacatcttctcaccatctgctcaatctacggagcgcctttcgtagcgtccatgacggaaattcgcggggctgaatccacccgctcagctgactggcacaaagtgcatgtggcggccgcttcgatgcggaacccttgtttgaaaattggtcatcagagaagtccctatgttgctactcgagtgcctcgggctgagggtggaacgcagtcatggcatggtagtccggtttcccgccgtccatgggaagacaatagtgttcctaagagctgcgggatcggcctacacggactggacagtgtgatgtgccgacaagggatgctagaagaaattccagcacagtcagccgaccatcaaaattcggagactgtacctccagatctgaacgtgtgcatgatggtacatgtggaaaaaacctctggcaattctgtccactctatctcgccaacaactcgggaagggcactctgagtatcttgaagtttgtccacccagcagagagcccggaacaacgaaacccgcaactaatgacgcgatcggttccagtgacccgttgacagcccttcagcagcgtttcccgagcgctgacaatgaagctgctgatgtgctcaggaagtgcgcccgccaaagtctggatacaacgtggagaaggtctaattcgtgccgatccacagtga

SEQ ID NO: 468 - DNA, 1849 bp, Toxoplasma gondii
gaaagaaaagtcccgtgaaaaacgccatcaggattcctctcaggagccacgcggtccgaacgactgtcagttagccctttatttggacggatatttagcaaagcaccgagaatacgttttcttgacccaagcagatgatatctttcctgctggttgagcaaagctaagcgctgcaggaactctgcagaggttgcatgtcgaccttttgcagagagagagtcggcaacggaagggcctgcagccgcaggcttaggcaaaggagacgaggagtgagacagccagctgttcctggttaggtcagagaacaagacagaggatagtggagacaaaagagcctgacacctcaagaaagacaaaaggaaataaaacaaccacgcggtagccggacaccctcctggtgggggagaaaaacggacccgaatcgtcatcgtcgtccgtccatagtgtctcactcctgggaggcaactctccggctggaacagaggctaagttgggcgcatgaaagaaaccccattttggaaaagacgaagctcgtcgaagtgtcgggtcgcccacgtgtcaaccccctcacaacaaatcaaaaggaaaagcaggagagggccgccacacaaggtaaatcggacccgaagcttggttgaaaggaggggcgaagcgacaccaggcgatcagtgcgtatagtggatcggatgtgacgggaatggatttggaaggaaaggagtcttggttgcagaaagtactcttgcaggcgtcgatagtgtgttcatggctgactttggagtctcggtggtgaaacgtctttactctttccgcggtgaaacacagtgttgcaacgattgagaaacaaagcaggaacctgacaacatttgggctgtacaccgcggaagtacatgcatgtagcggcgggtcagaacaactggataacagacaatttttgcggaacctacgaacgagacaaagagcctctcccgatcatgtttgctctatcaggagatggtctcagaggaaacgaaaggtctgctactaacaatagcccttacgatgcgtgagaatgagactcttgccctgcaagacaaggtttactcctgaagtaaaacaaggaataaccggccacgcgcatgcaaaatcgacacccaactccaaggcaacaacgcactgcggccgaaaaacggtactcgaaccggtagacacacgctagccttttgacgtgagctaggcgcaccttgaccatctgattcaaagtttgggtggagattttctaccacctctcgccatcgatattttgtggcattctaacggaaagactaagaacgcctgctccggcaccccccactaacggaacacgcctcgacagaggcgcgtcgctaccgacgctatcgcttccgcagctgttcactctgccggcaagtcacggtgaacagcaattaagagatttgaatgcgacacccactccaacttaggaaagatatgtgaatgcgctacttgttttctgcagttaagccatctgctgcataaacgctgcctaaaattctggcgttgctgtcaagtcaaaggctctctagggtgacggcaccatcctcaggtggacaacaggtatttcggcgtctcctcaaacagtctagtacacgcttctccggtcactctctatcaaaaagttctgggttggaatcgtgtacttgtgagccactcacttgttagaatccagtgcacatgcttgaaagaaagcgttgcgttgtattccagcccctgagcgttaagtctgagtgtgactacagaagctagactgagtcgaactgagggagagtaattttttgtctgtgtgtgcctctgtatttcacacaggtagacatta

SEQ ID NO: 469 - DNA, 4139 bp, Toxoplasma gondii
aatccgcgaaactcttttcagcagcaagacggtgcacaaagcgatgccagactcgcttttcttcaagagccgcgccgacactctcgcctccgccagcagcgacggggtcgtcgcggtcggatcccatccagtcgcggtgtgcctggggcatcgttggaattcgcccgtctgcatgcgcagcctcgcgccgctcttcgcgcgtcatctgcatgtcagcctctagatctgagccaatcgctgcggactctgaacttccgcgtcgacgccgcaggtcgtctgccgcggctcgacgcgtgagccatgcggcgaggtaggccggcgcattgaaggaggcggcaatcgtgagggcgtctcgactgacgaagaggagagtagacaccatagggaacttccgagaggtcgccttcaccgcgttttcaacagcgccgaccgctgaagctcctcgcccagcaactccgtggcatggcgacggagaagacgcggacggcgaggcgtttgcggcgccgaacagctgggcaaagatgatatcctttcgaatgcaaagatacatgttggctgcggtggtcgacaagaacttgaaaagttccgccgtcgcttccgggagcagcaactcgcggcctagggtcgctgcactgttcgcgacaaagtaggtccccgcgtagacaccaaagacgatacgaaaatcgcgtcctgagagcacatgcagaggcctcaccgccaagtcccgaaggcccgagcctatggcgtcccacaggcggcgcctgcccgcggcaccctggacgatggagcgatcgatcaccgtcacaaagggagacaccccgaaagaggcgagacatgctgcggccgcgtccacgcccaactgctgagagactcgcgaagaaaacaacgcagaggtcctcgcagaagtcgccggctcgacttccgaagaagaaggtgaggaggagggagaaggagaagacgcctgctgcgtggctgcacagagggctggagggagagggatagcgctaaggggggaccaggagaaccgggaagacgacagagaagaaaaaaaagtggaagaaagagaggaaaacggtttaggctttggggcgcgatgcgccgctgggaacggcgaagcagtgaacctgttgttctccattgtagcagtcggtctgtaagtcgggagatgaatcgtctaaacggtgggcgaagacaagtgcaagtgtgaagtttcgtttacagagtctgtgtgtttcgcttgtttctcccgaaactcttctctgcagagagaaaaggcgagacaggggtgctgtggtgcatgactacgcaagaaaaaagtcaccacgagagtctgtacaaaatctcactgccgttcgcaccagcgtgcttctggaacggcaccttctggctgtctctcccctctcttcctcgcgtccgcctttccaccagtttaccgcagtattctcagagccgttgaatcctttgtttctccctgtcgtctccacgtctccctttgtcctggactttctcccccttgcgtcgttctccccgctgccccgcttctccccgtgccctttccctcggatttaccctccggtgtccgggcctctggggacgagtcttttagcagacttcaggtcgaagcgcagaaaagagtcacgaggaagaggctcaaatgctcagaaacgcaagagacgtgaagtgcaggaaggacgacaaccctgccgctactgcgtatttcaaagaagcatcgactcaagaggcgcttcaagcaagctcagtttgagcaactgaaactctgagtcctccgcagtgcgagaaaggccgcctgctcagttcccgggctaagggcaggagaagttctttttcaaagtgcgcactaacgaaaagaaaagccacatgccagcgattgggttgccacacaaaaaccaagctacgggagggacaccgaagcgtgattaggtctccaatctttcgccttgaacggacgggcttttgatggagaaaaaaataaactgacagttgatgagagagacgaagaaatgcgaggcctttaacaggcctcgggggacctgaacaacgtcgaaagaagcctacgggagctagtcgacccaccccaagtctcgttgtttgttcatggagtttgccagcacgggaaagcgctccctttccgagtttgaacaaaaatctgaacttcgagggggcaggcgctctggaaaaacgctttttttactcgccttcgacttccctggttgctgcctgacgacccgcgggagaaaggctgccgaggagggcgggggtttgaggccacccaggcacgatgaaaacagaaattgacagatactgcatctggacaaaaaccaagttgaaacgtctactttttgtggagttttatgcgaagtgtgtgtactgacacgacgcactttccacgcctgcgggggagccaggaacgctgtctcatcgagtgacccgcggaaacgaagcggaaatacatggctgcaaaaatgtcaaattgagcttcgattccggagcaccctaccccacgttttgctggattttctgcctttaagaggcgagttcagcggcaactccaccgtgggtggcgcagaggacgccgtctcactgtccctgcagagagacacgcgaggtttgaggtgactttgctaggtgtgggctcggaactcggagaaaagagtggagatgcgcagaaatgagacgcttcctgcatttgtattcctgaagtccttctatatgcattcgcagatgtgttgccttcctctgaaagctccaacgaacgcccccttttcaccgtctttcatctctggggcttcgaactcgagcgccgtcacaagcggacaggaacatgtttctatgtgagttccagcaagattgtctgtttcctgaggctccgtcaccgaagaagaactggggactcaccagtcctctgcgaatatacacgcgcaacactccaagcacatccatatcgctcggacatcgctctctctgttcctttccacgcggagcgtttcacgacctgtaacttcactcacaccggctgtcgcaacgcgaaaggcgcacccgcacagaagcgtctgctgggttgcttgcgctgacgttgtcactttgttcattttataagccgtcgcaagcggtggtaatcaagtgtgtttgaggatcatccgcgagaaaggcgctgtcgggtcgcgtagacaggataggatgtgggcagaccaccctcggtgttgctatagacaggaacgctccagcgcagcggaaagggtagtgctagagcgttctcgggtgttgagaacacaaacccaagtacagtttgcacattcgggaggctgcgagaaaggggaatcacgcatgtttggtcacttaagaaaaccctggggtttttccttgcacctgcgtacgggctatcgactccgggtgcactgtcttttggcgacttttgctcgcggcaaaggggtgctttggactgtctgcgtcttgtgtgaaggtgttcatttgtcttttctgttcatgtgaccctttctgctacggctggccggcttccttcttgcgcgtcgggggggtctttttggtcgcgtgcaaatatcgcgtcttcctctgcccgtcccttccagtttttccccgtgaaaaagctttgtcggccgctccgccctgccgtctccctcgcgtttccacttcctcactgcctcggcttcttatcggtggcgtcacgtcagcacaagaatccaaaaacttgccctccccccccccactcaacttcaggggtttgtctcggcgtcttccgtccagcaagtcgctgcgttcttctttctaacatcatccaacctagatcctaccgcaaaaaaattgcccttccctcctttcctcccagccaaggtcctccgttctcccctcgttcctctgaactgtctccccttcgctcccgtgtctcctgtcccttgttttctgccaggtcacccacggctgtttccttccgcgccctgcgtcactgtcgtctctcgcttgtcttcttcgctgctttcttcccggctccttcctgggtcttcgttgtcgtgtctacttgcgcccgcgtatcgaacagcctttttggtcgcgcctccgcaaagccgtccgttgccccgaacctgcctcccctcctttcacta

SEQ ID NO: 470 - DNA, 5019 bp, Toxoplasma gondii
gaaaaaggtggtaagtggaataacggaacgtcttaccttccacaggctgcgcagctccctcgacagaagatggttgttcattcccggaaaccaaagaagagggagaagaggaaagagaagacgtaggtgggtggaagcctgttacgttgggagccatgcgagcgtgaggctcttgacacttcagctcgctaatcgactctatcgactttgccgattcgcctgctccgcgaggcctctcgtgaccccctccaagtgccaacgcggaacaggtccaacctgtttctacatcggtgctgagtacagaattgtgttgagggtttcgtgtagcaggatgagagcagaagaaagaggaaatgcgagaagccggcgtctcttgctgataaacctgctgagaaatattcgttttagagatgtccttctctttttcaacatatgtggctcgggcggacgcagccgcagctgaagcagcagctgtagtggagaggaatgaggaaaggcaggagaccaaagagaagcgaagggtgaaagagacaacgaacagacgaagaaaatcccgaggcatgcgaccgaattagataaattcagaaggagagacgatacgagaaagggctggcaaacaaggacatccgcagggcatggggcagaggcgatatgggaaggcaaaccaagggtcgagggagttttacgagttcgttccaggtgcacgctgtgactcctgtggagacggcgttagagaggccgagtgtaaaacgtgttttctattgcaggtaagagcaacgttccccaggctatctaaatgctgggttgttgttctcgaaggacagggaaaacgttcggcagcgaattaacaatctctcagctttccaggcatatccatctaagaggaaaccggaagaggaacgttggggcactctgggaaaagcccgattttcactcattcacctgtgtgctgggggtgctcgtagatccggaggtgtacagagacttcagcatcccatttctcggtcggcaaaagagcagcagcaatgtcgttcttatctacccagcggaggtgtctatccatcacacgaagagatgagggagagaggcacatgtgagtgagtctttgtgtctaacgaactgcccgtacaggcaacgtacaatcacgatgggtgcgtatgttctgggtagtgcatcatgaacacgttttgtcgtttctggtggcttcacaaaacgctcttcgtggctcagtcctctccacgcgactgcagtcaaacataacataatgtagatgcccaaacctttcgttccttttcagcggaacacgaagtcccacgaccctttgcttccctgactatccctctgttttctaatggattttatatagcatccacgtgaacatgattggagtaacggagtgagaagcacgcagccacagcgagcgttcctcgaaccatgagatcgcgttcccctgtttcttccatttccttctacgtttctcagggacctgggatattcgagcaaatcgaaaaagaggcactgaatattatgccagatttccgaacaggctttcatcttctgtttttctgaccctctttcgaggaaagctgccctctgtttaacgtgctcgacatgctgcatcctcggcgtcaggatatccaaattcgccgtgataactcatgcgcagagataacacgcattcgcatttcgagaaatggaaatgttcatgtgtaacgagctcgaaaatctgaccgttttattctgtcgcggtgaatgtagacttcctcgagcatttggtctaggggcacgctgcatgacactcgcacgtaaaaccatgtcggcggcatctgatcggagaacatgacgacggcaaggaagagagtctagacaacgaaaaagcaacaagtagagaaaacggcttcgtgtgtgccctaaaggtccttgcaaaacactgaatgattgcctaagtcagtatgtctttggtatgtttctcctgcattctgcctcatcctctgttttcactgatacgtcattgcataaaggaaggtgctgctgaattttagttctcactgttccctggaaaggtttcgtttatggcattcgactaaccgtaaacctcagtgccttacgcacctgcttaccatgagggagagacatttcgctggaagctagcagcctcgaggtcctccagtgacacacgaccgtctctgtctctgcggaaagttcagcagcaacacccacctatgtgtcttggataccatgaatttcacagggtatacggactgatgaagacacaaagtacgtctgttacacggactggcacagcctcaggggaacctcagatgcgcgtgtgcatctccgtttggcagtcaaacagcatacaagcgattttggcgaccgaaaggaaaatctttgtactccttggcatctcagaagtggcagtgaaaccggcactaacaacaagcgaaaaaagctggggtagtgtacgcgtgtaaccaacccgctagaaaggtgcaacgcacacacgaatactgtatggtgttttcgattccgtgtattgggagacacgaacaacagcagtttccgtgactgtctcgttgagatcgcccaccggagtatttctcagaaatttcgcgactttcatacatcgtgtggtaggcatgtacaacaggtaaatatttgtactttgcggatgcggcgagtggggttggtggtacagctctacagatgcggcagccatatcgtaggtatggaggttgaatcaccgttgtaagtcctttggcttgtctaaacgtgtaacatttaaagcggtgcttgctcagatgcagcttccggaccaacagtgtccacatggtggaaactatgtcaagtgcagatatttttcaatgctgctgtgcggttactgaggaacttcgataggaagaccgacgatgacacaatgtcattcggtgccttttccactcgcgatgccaaccacattgccgtttgttttagcccacggaggccgtcttaaccgtcgtagatgaagatttcaattgaaatgtgtttttggactcaagaagggctagtacctactgggactcctagaaggcccacactctacaacggaagcgcttcttaagatattcagatgcttgagaaaacggcttttttcccaggtggcaaaggagagccccgtctaatctcgcctacaaacaggacgactaaaggcgaaatggcctcaccggtcgaccccgcgaaaaaacgtatcgatcgcgcgggcgactcgagcctctagatctgcttttctgcaggcgaacacatgggaattcgtcagccgtttctggtggcgttgtgctgtttagaagtcgtctctcctaccacttcagaacagcggataaaagggtgatggatactgaagacgatgagacacatcatcagacacgcagatatgggtgcgagttgtttcttccaaggcattccgtgaccgacacgaagactctacagagcgatctgcgtcctcgtaattacacagtggattcttttgatgtactgcgataccaatcggtggagtcaccacaactgagcagcttctgttttcaagcaacatccccagtgtactgtgtcggaatcagaagcatatgcttaacgagcaaacggctgcaggcagaggtgaagagagggccgaatgcttacagggcaagagtgtactggaagatacgaaggagtgttttagactcgttactccctttatttccctttcttcctttgcctctggttaggttgatggtccccgccgtcttctggctacgtctttcctccatgccattgttctgtgccgacatcatatgggcagaccgtttcgagcgtatctcttgttcttgcctgttttatgagaatcactggaaggagcataccgtttctgtttctcttctcgcgacctgtcgaaacaaccctcatgccgtcgcttcagcgcctcacatagcctgatgcgtctttcttcttgtctgtcgtggctcacgtcctcctccatcgttggacaaagcttacgaatacctgaggttttctgctacattcgagattgcccagcataccctgagggagaacgcggaggcctttgtgtgtgtgtgtgcggcagtttctagtgtcttccacggaggcgaaggcaaaaacgtttgaggcacactgggctgcagaaacaatcgattggtaggtatatccggttctggataaagatgctccgtattggacagcaattcatcgaaggagacacgcgacctcgctgtgtgagacgtaaacaacagtcccagcctcgtccgtttcacgtccgaccattaaccaccgggcaaggatgaatatcatgagttgcgtgtgggttttgtgattcaaacaaggatacagtttagggacttgctgatattgggaaaagctgaagaggccaggaacaacaagagtgagacagggagggttgatttacacaactatgtggggcgctggcccacaactcaccgtcgaaaatggattctcgtaaatgtgacaaaagtacgccacaatggatatagctacaaattcttgtaagacatacacttaatgacgacccacctttctagagccgcacttggaaatgcagaacaccggaatgtcaagtgcgaattccctttaataaaaaccagctggtgctgccgcacactcgaagtttgctaaactcactcgaatgtggcccgctagccctgcatcgtcttatgaatcgatcatcggtttcaatttgaagtctggcaaagagtggtctatgcgttgagttccatttggtctttgtaactcgtagatgctctactgtactgatactcacgccaacgtcttttgatatgaagcgccacactgagtctgaaggttgttctttgtgtccaccacacaagggtgcgcagcttccgtcaaggccggtttctatactcaggttctgggatggaatgtatgaaaacagtcacggaagtcgcaccatatgcttttcctgttcccttccatttccaaagctgtatctttacggttcacagtgaacaacaa

SEQ ID NO: 471 - DNA, 3369 bp, Toxoplasma gondii
cctctttctcccttggtcttcgcgacttaggaaagagaagaccagtagccgtcttcatcttatttcacttcaaagaggtaggcaatctgttgtgtggctttgtccgcttccgtcctttttttctcttgaaggagtcaggtgcagtttcgtggggctctttgcatcgccatggagagctggagacgtcttgatacttttcttgtaactctgttcacggaaatcagaagaatgcttacatggtttataacgccccttgcatcttgggcactctcgccagaggaggaagcggatgacgaacgagatttacgcgcatgctttcaagcattagacgtctttacacgttccttggtttggaacaagcattttatctagatgcgtcttgagattactcagcttcacatgaacaccatccagacgaacatccgtgagggttctgcgtcattttttcacttctcgtttctcatttaaacaagaaagtcctgtttcgccgctccctgtctttccactttcctagactcgggtgggcttttctttccatctcgtttcgttccacatcccctgctcttcagttggttctcaaactcttttctgctgcatgccttcccctatctctgcgacttgtgtcacttcagacgacccttttcccgcgttcctcttcgccgttcttctcatcgagtcgccttccctttctcttgaatccatcgagtcctgttatcacgcatatcgacagaattcagtagacggaacctgcgctagacaggtacgttcatttgtgtctctcgtgtctacccgtcctttctgcattctccggctgagaaacttccacatttccgcgctctcctcttgctctcttatgtcttcgtacgtgtctcttttccttttctgcacggtgtttcgctctcgcgtccccggtttctctgtcctcgccttctgcgcccctgaagcctacaaagtgcccgatgcgcagtcacgttgttgggatgtcgcacatgcgtaactccgaccctggtcgttgccttagaacgttcagtggagttccgttgtccggtctgttcctcgccttcccgtctcctgcctcccgttttcgaagtctcctgtcgtcaccgcaacgtaaggccctttccgacgcactgtgctttctagccaccgtctgaagagcgctatggaggtcgcgcctctcacttggagccgcggtgaacgagaagcggagagccaggataaatggcggaagaatggcggggaaatccgttaataaatgactgaaaaaagggacctgcgacgggaggcggccgttggacaagccggcacgaatgcaagcacaagagcacttggacacagtgaacgacgtccctcaaaatctaagcaggagtcgaactggtagggtctacaatctcagaaaatgtctgcaaaaagccagtctcagagcggccttttccaggacgatgggaccggcacctgagcgacttccgtccagagttgagtcaaaggtcacagcgggcagcatgtctcaactgaaaggaagaaaggaagtgccgccccctttgaaagcccttagatgagacgaatgagaccggaaatggaaccgcgcttccaatccgtttctaagtagagagaacagatctgtcttcaccgatgttctgccaccttgaacgcaagtccaccgcgcacgcgagcaagctgtcctcgcggtgggtttgaccgacaagtctgcccgcgtaatgtaggttttctttgtgtttgctctcaacgtcgctcgcacagagtctctctttctctctcgatgcgtcgtttgcaactcggatctgttttcccttgtctcctcaccgcgcgttggccgctgtgtctaggcggcgccgacactcctctcgattgtccacgagctgcaggctgtgggcgcgtatttctggagtgccttttcgacgaaaaggaaacctggaggagacacgccggagagaatgacctttaccctttctcttctgaccaaagactttatttttacctttctcgtctcccctaagcctctcacactaacatgtgtacgaggactcgcaggcacacgcctagcggactgactcggcttccgcatcaacacacgcagacagaaagaagcaaagagcgaaggtactccacaacaccgcgagaagaaggacgaagagggattgggaggacaggcgctcgcacaattgtggtcatctggaaaggaagagcattcttcggaaacagctttctccgttgcatggggaaacagctggctacatggcccctcgtgagtcgagggcgccgccaatcctctgctgggggaggggttggccatttctgtcgtgaaggattggctctgttgtagaggcgctctttgcatgcagtggaaaacctctttctcattggacagttaactccccgatggcgaaacggaagggatattttctcttgtcatatgcgtgggcaggtttctctcttggggaatgccccgaaggaagaaacgacatgcgtgacctcgatgctctttgagagggcgtagaggagaccgtcgcggtcccgctgtttctctccccgggggtcaagccggggagatcttttgttctcaaacaacagacactttcgcctttcttctcgcgcgttttatcaaggattccggccaccgtccacagtgtacgctcaaaatccgtccgccggggtccctcgtttcctccgcctcacatttgaggggaaatgcattgatttgtcgcagcactctctgcttactcggatcgtctttcgaggcctttgtttttctcatcttcctcaaatctgtgtcatttctgcgctgtcctgccatcttcccctgcccgtcgttgtcgcagccaccgccccccaagctgtccacacctggggttgttccgggagttcgatgcagggaaaacttccttgtcttctcttccttcgttgtttccgttattcgtctccacttctgctgtgctctggtccttcttccttcgctccacgcatcgtcagtgcagtctcgtcgatcgacaggctcgagaagcagcgcaaaaaccccgggtgtgtgtcacgctccgccactttgcctgtgctgttcgttttccccatttttttctccgtctagcgtcgaacgagtcctgcagaaacatctggcgcttggcgcaggagcaaggggatggcggctgtgctgagtgaggcaaggactggctactgacttctctcttcagcagctatgtacacacgtaatacgaaaactaccagtcaggcggggaaggaaaaggaaagtagaaagtccgcggtgcaagagggagcgctccaaagtcgagcgcggagggtggaaggctgattttttttttccgaaatttctcggtttttaagtgctctctaaaa

SEQ ID NO: 472 - DNA, 2047 bp, Toxoplasma gondii
atgactgtcgttcatcagaaatttccagctgtttctggaagcagaaacgcggtgcgtctctcccgcacatggaacacactctgaagctgtcgccgcctacgcatgcgttttttttgagcttcttagagacaggggatagcttgacagaacaatcattcagaggcagacgattgctcgaccaagcaaaagatttgggacacaaagagaggcttcctcgtcgctaataagaaacgaagtggccagatgaagacacaaacagttcatgtgtgacatccagcgacggccttacagacacaaggaaaaagagtgttgaggcggatcagagaggaatatatatatatatatatatatatctgagatagagagaaagaggaaacatgtagagagaggcattggagaatgtatatatatatatatatatatatatatatatatttgtccggtagagacaagtagaggtagatatatgtatatgtactgtatatatgtcgtatatctagagaaaagcggatagagatagaaaggaatatccgtttttcagacatatagagagccgggtggagagagatgggcaagagaggtagaaatgtgacatcagacagagacggagagctggacagacaagtcgagagagagagagatggacatagagacgaagagagaccacgacaacactctattgagagttcctgggcgccagagaggtagagggaaggcgatgttaagacgaggtgttttcaattagttcgaaggaaagcctttttctagagatgcatgcagtttggaattacagcgctaaagcgtcaccctcctcctccgtagttcaaccttctctggagaggaagacgttgtgagattcgaaagaattctcctctctgtctcatcacacgcagagaagagaagaaacggcgaagccggaagacttacttcacttcaactttagaaaccagaagtggatggctgcttttcgtcaacacaaagggcagtcgcacattgccctccttctccgtagatctacctacaccgatcgatcgccatcgacgcacacatttaaagtccgtaactagctaccaaatcgctctccctatataaacgaactgaaaatacgttgtgagtatgcgtgtgtctctcattttctcattatacttgtccgcgcttctctctctctcggtgcttcctatctgccctctctcttctcgttccggtttttctgcttgtctttgggcctccgcgctgctatctaggcttccgcaggagggcgcagaaggaggcgggagaggcggacagtggaggacgagtaaagacgactgtttggtactgttttttctcactctctgaacttcacaagatccccgaagaaccgctttcacgtctcgtccagcacgaggtgaagaggaccgttcctgggagacgttcagggaacggagagagagctgcgggaagaaaagatgcccgacagcgtagacgcttcttccccgaatgtgcgattttccggtatatgtttcaagagtctgttctttgttttttaatttcctggaacgttggctcgaaaaacggtgtgcgacggcctcgcctttcttctctccttttcggtgttcttctctctttgtccctttctcgtcccccagtttctccttctctcgcttttttgagtatcgatcgactgaagtgtgtaaggtgtatatacagctcagagtcgcgtgaattttcaccaagtttctgcccccaaagtttcgtttcctcgtccctcttccgcctcccctgcgtgcgactcacctccacacagagagacctctcctcgcagattcacgcggcaccacagcgggaacgtcttgtgtgtcgagcctgcaaacgaggctctttcgattgcatgcagttccacggaaaccacagacagcgaagagaaggttcccgacatgtgcagctcctctgaaggctgacttgaaggcagacagaccctcttctctgcaagacagaacgaagcggctctcgagatctgaacgatatcagcagaaggaagacagaggacagagcctcgtgaggaaaa

SEQ ID NO: 473 - DNA, 3941 bp, Toxoplasma gondii
gaaaaagaagccagccgcgccagcagtctcgcagttgaacgtggaagaagactttccttcgattcgcgcgcatgccgaaggctgtggggcttgggatgattctccagactttcgccttctctctcggtctggacactgggcggacttctcgtgtctgtcttccctgtctcgctgtctccttccctccgaaaaagagcgaaaagaagagagagacccccgggagtgagcatgcgtcctcgccggcgccggaggtcgcgagcggatgcgcgggaggccgtctagtgaacagacactgcggcggccggtgactctaagcgaactgaccgcgaaaggcaagacgacaagcgagaggaggaagaagcagagcacggcaaacaacacagaagacagcacaagtctcgtttttaaagggtgaacaggagcatggcgacacgctgcctccgagacggaagggcgccttcggcagccgcccgctggtctttcgaaaggtggaagcgtccttgacggggacgaagagaaaacatgaaagtaggagagacagcacggacacacgcatgccatccatgctcccttgaaagggatttgccatgttcgtctacacccttgctttctcatcgtgttgactttctgacaacctacacagctgccgtcgccagcccgtcggaaaagcgccctccagattctcccacagttttcatccttgttatcattttatagagtgctaggccattcgtttaacttttgcctttttcctcccgtgaagccgctgtacacgtaccccgaaggcgcggtctctgctcggcgtgacttcagtcgggaaggctgccgccaaaacagcccattgttccgcacagagacccgagagatgcaccggatggttattgggaagaaacgaccctccagttctactccaaaaatctggggaaatgcaccctgtttagtcgaaaaaacgcgatgtgacggcgggtcgcgtctgtcggatggtgacgagacggagcgtatgcgccatttcgaacgacagtccagtcaagacggaacgcgaaaaaacggtgttcagagattcgttccgttcaaaaggacagacacaccggtctctacatttcccgactcttttggaagtggtatgggtcgggaagttcaagattgagatggagctctgctttccggcgttcctaggttcgcgcgtcaaagcagtggacccgtccgttctctgctagcgagtgaaaggcgctcttttcacttccagaagcgatctggaagaggttgaagtgaaagcaaacttgtggcttttctcgtaaggatatcgcggccaactagcgggagacatttgatctatggtcacacactgacgggacactgcgcgttcgagggtcctgcaagcggcgcagtccagccgtttaaacacgactttctccggcagagagtggattatgttctaggcattgaggttcctctctgaggggaagcttcttcagagatgcagacactttctgaaaccctcctccttgtcgaccaatgcatgcagggacagtgtgcatgcatgtacctggaagacccaacgcgtcgatgacgcataccgttctgcgcagtcagtcgtaacgggtgttcttattttcgacgaggatccttctgtagagttcctctacatagctcactcgttcagttctccgttagcgagcctccgggacgacttctactttcagaacgtcaactggaatacctgcttcaagcgttttccgtcgtgatacagatcagaaatgtgttgagtatcctcgacatgaaggttattccacatcggttatgttctaggctaaatgatcacctaaagcttaatagcgatgccatcttctagtgtccgaagagaatacaggaagacgaacgcatgtaaacgaggctcaagcgcacggatcgtcacgtcacaagcagacatcacgattctagacttgaatttcttcgtcagacaacagtggttctttcatgtcttttcttttgattaagctcctcaagcatccttctttcagtgagcagaccgtcgctactttttctagtggtcttcactctacaagaggcaacaacgtgtgcgacttcgttattgaactggcaacgaaaaaaaagaaccgcacaccgatctcggaggcgctgagctgaaggcattaccgtgcggtcgacatggcttttatgaagactggtcagcgtccacttcagcgagaagcgatgccatgtgctggcttcggttcttttgctgtagtccagcaaatccccgactgatctctacaggattttggtgtcgccatcttaggccaactgcgccgctcaagcgttctctatgtatgctggagacgatgttcgctctttctccggtccaggaactgaaaaaacatggtagtctccagaacgtgagtagagactgtacggggttgtttacggacctaaagcacatgatactttcatggtttccgctgttcttcggagtccttttctgtaagaactggcgactcacgactttgatggcacatgcagatgaatttgccgaagaatcgaggagtcaggttcccagaagcaagaaggcatcctgccgaagaatcccaactcgggctttccgtcctgcatctgatgagcatcagcgatggagcacaactttcacggttgcagtttccaggaatgggaagaggtgttgtcatgtctctcgatgtccagtaagaaaaacgtgcatcgatcttgaaagaggcgaacaaacgggactttccgtttatctgtagagcgggtggaaaggccgacacatgtttccccgacgttctgcttcgacagaaaaaccatgttcacccatttttgggaaagtgcttctctgcgctgccggagaaatccgtctttcccagttgtcttcccccttgtcaccgcggattgtcttgacgtacacaaaacggaccccgtggccggatgggaccgtcttgcgtgggtgctggaaaagcgtactacccagaacgaatacgaggtcctcccggtgtgatcagggagctctgtttgtcgagtccgaagtcctaagatgaacatgtgactctacacagggtcttctactcctctctttggtgaaacacaagaagaagttggccacattctcctcgttgcatgcccgatttagccagaccacgtactgttcgtatcacactgcaaacatatagggtccctaccacacagacgatccacgatccagaactgcgtgactcagatcgaataagacgggttttcctcaaaaaaactgcccataagccaaatctaatctctgcagctcctcctatggttccttcctctttattgtttctgtgcacgaactctttctgtctttcgatgtaaaacagagccactggtgaggttgccccgacgagaggtctcgggatcggatttgtataatgtttccttctatacctgactacttacttgggatctgaccagaagatttcacagtggcaataggaaacaggaaatcgcgttcattaccgggaaaacgactagccacattctagtggttttcttccgtttcctttctactgcagattcgactggcgacgtctccattttcctgtaaatgctttcagctgttcttgacgagccgcaagaagaaacaggctgcgagctgttgtttgaggtggttccagtgctgcttttttacgaaagcgtttgcatcctgacgtttgtgaacagagacgaggaggcttttatgcttgcgtcgctgtctcggcgacacgtgtactaaagagttctctcacgggaaacatcatcgggcacaagctaaagtttactctcgcggcgagtgattggcggtagagcgtgatcgtgagcgcgaggcgagctgctctgtttctttgggggaatttcgagtgcgcgacatttccggagctagccgttttctccccagcagttttcgaccctttgcggacgcgaca

SEQ ID NO: 474 - DNA, 3926 bp, Toxoplasma gondii
ttttgtgaggccacattgcggactcccttccactttgaatgatgtgaaaccgcgacaggacctgttcgcgtttctcgcttctggctctcgccctcgcagtcttccgcgctggacagtgcctccgggggtacagcggactgtcgtccgcctaacgctctttccaacgcagaaaggcatgaaagtggagagggattatatgaccatgggaggagagaggacgaaaaagctggagagacaggagtgacacataaaggagaagctgaacggcaagcagaggcaagacctagattcggggcaacacccgcagggctaagaccagacgaatctgacacctgtggccagggtaaagagcatcctttgccgtgacaaaaaactgccttaggagtgttcagtagtaatagagagtcagcaattcctggtaacgccgaacgacgcagggacagggagtggaaggaagagagagaacgagtgagctgaacaaccgggaaacgcttaggtcttttcggcaagaagtttgaggaagtgagagatagaagtgtgctatggatgaaaagctcaactgaattgtgtatccccgtagaacagtgggcaggcatgcgtgaatatctcttctgacacgcaacagctacaggtgaagcgactgaacacagtgaagaagagggaggaagacaaggggagctatgtatgtgtcgcagattggaggactgtagaaaagatgtccatgatatgatagaaaagatggaaaagctgagagcagtctctaactgtcctacagctgacgcagaccctccaggctcacacccagcgtcgacctgggacagcggtgtgtccggagtcggaggccgccgtggaaaagggaaaaacggctttgatccaaaagcttgtttttgttcagaagaggaatcacgtagacggtggagcggaacatttcgctcgattgctgtgaaggacctggtcaaggtccgcggacacggtcgagaagcggcagggttgctgcagggccagaagacagagagaaaatgagagtcgacaaggagaggaaaaacaatgaagaagacagctccgacggtcggcaagcaccgagcgaaagaacgacccattaaacgccaaatagagatagcccagagggaaaaactgtcagccatcagggcaacaacatatttggtagccatatacgcgtgtgcggcttgtgcatcgcatgtggcagcagtggtcaccgatgcctaaacggcggaggtgaaacagacgaatagtggaagaacctggccttttagaagcaatatgaatcaagaaagcataaatcttatcataaaaaagatgcgtcgtcttattgccaatggatctcgcttggtggagaccaggagacaccagagacacacaaacggtgtttgctagaaaaccccactctcggtgggcacctgtcggcgctgaagaaatgtgcaggtgaaccgacttcaaaagagatgtgcacgggaacctcactatagtgaaggatacgaaacaggaatatctatgtctttggaagtagacgcacctgtcaccgcaaggatgacaggacaccagtgaatggggggacgagagctggagacacagcccgctggacataggtccagctactaggtggattgtttgtcagaaatgttcgttcacttacaccacaagcttcagttacttctccctttcctgatctagacatcgggaaacaaagaaacgcagtcggccctgcgcatagtccacctgtgaaatcgtgcgacgcggtgggaggctcgcagggcctggtagcggcccgggcgagcatgaagctgcaaacagaggctgactcaaagaatctcagagcatgcttgcgggttctttcattctggacactgtaggcacacttcttcaactgacaatcttgatggagattaaaatatggcgccgccaaagtagacttttccactttcaatgcttagccatcctgcttgatctgtcatgcccagagtcgctgaggccgaaaataccgagacgaagggctaactgtcttacacaggtgtcagacatatcgcgtcagttggtatatgaacacatgaaccacgtccgtgaggagggggaaccccagagggcatcctcggtggcttcgctttaaccgtatacaaccttgccaagagataactccacacgtttggtggtacgttgtgcttctggctctttcattgtgaaccagttagttagcaagcgatgttactacctcgtgcatgctgaagtcgccctgttgctgcacaggccactctgtccgcaaggccggtcccgactgcgaattgtgcctgtactgcctgacctggtcaccatgggaagtgggtatgagaagtcctattgtttctgccatgcggggcgatactgttatcgtcaacactacatttagatcaacgagaactagacttcactaactagcccttcagcagcgcagtaatgctagcgtggcagcagtcggaatgacgtgacggttctcttcggggttttctagctcaaaacgacgatgttaacatttttggttgtaaacagactaaacgtgttcgtgttgacagcgtgacgtcgaatatggtctcttcaggggcaacctctactccctaaaatgtgcaagccgctacgggaaaaaatagttcgagttgcaggtgcgagaagcctgaacactttcgaggacgagatggtaagaaaactaacttctccatggtatctttaactatgtcgaagaaaaacatcaaaacatcgaaccatgtccccacggcgtgtggttcagccagagtcactattggcgtgttcggcctttcagtgactatcatccaggatgctcgctcgttttcactaacggcatcttcgaacagtgatcctcccattcccgaagtctgttgagcagtgctcgtttcttttgtctcttggtgagcttgactcagataaatggaggcgtggcggttagcgtgacggatactctctggatgattagtatggaactctgcatctcgaacaattgcgacgaaggaacaatctgacgaaaaacgagtgtgaagtgtggcctggaagtctctgtgttacacatcatgccataagacaagcgctcaatgtcattttggcattgattatgtgtgtgctcggttactacagtcgactcttttgcgctggcacagaacactttcgttgtttgcagtagtaggtcctccagggacgatatatcgaacgcaacagtaacaacaatgatcactcaggtagtatgaatttcactatttcgcttctgctaggagtgtgagtctacacggcttcacattccacggtttacagggatagatatatgctggtgacgagtccgacctcagagtggatagttgaaaccttgacggttctccacatttctgttgcgacggcaagtacatctcagatatactccactcaagtaacagttttatagggggatttcgggcgcactaccgaaggtagaaactcatgggaaacgaagagtgctgttcgtctccgatcgagaggagctacgcgaaatgtgtgtgcagcgtgcggttctcctgttcgggtgcacccgcttcgttggagggtagcgttgtttgaatattgggacgggtattcttgaaccgacacgtctcgtctttgtttaaggcatggtcccgtttcgcgctcgcaggtaggcgaccaagcgatctccgaagcaagcgatttttcgtgctgagtgaattgaaccacgcagctgtggggcccggaatacgggccggcagctgcaccaggttccttcgggttctcgtctagttcaccgtggacgtacaacacaggtgcatccatctgtagcactacacaactaacattttattctctgcaggaaacgaaggtgcaaacctcgctcgacaattgaatcgacttattgttaccacgacccccatttttcaaga

SEQ ID NO: 475 - DNA, 1949 bp, Toxoplasma gondii
aatgcccacgcaatttgcaatgcctgggctctctcctccgggcaaccgcttgccacccttcgttctctcgccagttttcagaagcgattcatatgcttgtgggtggcaactgaatgcgcctgtgctgaccatgacatccattgcctgtttccttgatacgttctgttcgtagtcattcagctgttggtgccgtccttccccttcagttggtacaccttgagctctcaatagcagtgtaactgcgtctctgagggatgatatgacatccaagctggtcaaaaacgcctcctctaaagaagagaaagacgacagagaagatcccagttttgcttcggttgctcgattatccgcttcgtcgtgggcttgaaggcctccttcaggcatgtcttcctcgcacgcgaacggaagggcgtcttcccgcccgccggaactcagaaaattttcatgcttatcattcctctgatttgctatcgcttgttctctcgaccagtctaccatgtcaccggcctccgtacagtgtcctccatcgtgcaccttcgaagaagagcgcgcatgctgctcaggcagtctaccgtcagcctcttccggctgccgaccctctctttccgtgggtatcatggtaatttgaatacctctggatttgctgtagtcgtcagggggccgatcgaaaacatccgtcattgacaggaccagcgcacgcgtgagccttgacggtgagcttattatcaaggctcctgtctacatcattccctttgcagtttcccccaatctagttgtttgtcccgtataaccgtcggcaatctcgctcctttctcggaacggatgtcgtagtgggtaacccctgtatcaccctcctcgtggcttgagagaaactctgcgttcaatgcataggtttgtttgccaacacagccgctttcattgacctgaaggaaagggtttctctgagaactcgtaaaaatgacgttgggcattccacaatgtacacttggtcctggaaaggataccgtctggtaggtcagacacatcgagacaagctatgatttttcggatgcgacattcgtttgacgacggaacttcccgtcacgttggctgcaagcgagtctgtcgaaattctgtagaaagtgcccagagaaaaattgttgccagggcaaccgtataaaccgctggaatttttctttggatgaaaccggagggtaaggaatcgcgcgcttgatcatctgcatgcctgctgatatgtctcccaacagtgtgacgtgcacgaatttgtttgcccactcccgccgggtcggtccggaaaagttacaacgaagccattgattcctactgctcgagtgtttagttaaggacctggcaatgaaggcaatcctctctcgtctgaaaagaaagctcactattgctagaggtaacgaacgcgcatgagcttctcgcgtgcagaccattccgacctctggcatagcgtcgagtcgacctctcaatcgccgccaatcagacttaggaaggcggtgccttccgacagtgcgttttctcgctagcgattaaggttgaaaccacatttcaggttcttaaacgaaaagtaaaacggcgtttgattgtgtccattgaatctatgctgtgtacttgcgggaatgtctgtgaatagcctcgggaaacagtagcatgagactgccgcgcttgggtcgtcattcctcgccgatgaaggacgtccctaccgcgaaagagctggtcacccgctgtgtattactcaaacgaaactgtataagagtacctttatggcgtattgtgagtccctcaacatctcatcgctgttttattagtaactcactctctcgtagtccactttcgtagaccgccgcagcggtttctgtgagacttggttcgtctcgtgtgcggcggttggtgtgcgtctcgattgcgctggctgagagtcacttgtttgagaagtagcaaaa

SEQ ID NO: 476 - DNA, 2846 bp, Toxoplasma gondii
gacacacgagttgaggacggaggcctcgcatgcagtcacatatgccactggactcatgtggaccgaggcaccctccacgtccgagttaagttccaaaagctcgcgcaccatgctggctgcgcgtgccttgccgaggtcaccagggctgagcatcgtattgtggaggtcggagcgcgtcacgtgggcatcgtcgataatcacgaaccgccgaatgccgggcaaaacaagattctttagaacctcgccagccacagcggatgatcccaaaacgagaacggatgcggctctgagctcattttggccatgttcaccccaaatacgaatctgacggtcatagcggtccgctgaggtacccgcagaggctgaacgcgtgccactggatttaggcaatccaccaccaacggactccatcttttcgagttccccctttggttcggaataatccgggaaacccattcaaagatgcggccctttacggatcagaggcagcaggctccctccggaagaagcgtgtcttcacagccaaggacgccgcttgcagtgcgtgccttttcgggacgcggtgagtcgcccgaatttgaacgacgtgcaattccccttcttcagacacggacacagcgaaccaatttcttctttaacacagcattatctccgctggtgccaacgcagagctcatccccatcgaagacgttcctgagaatagcacaaactcctgcctgttttcagtttctctacactatcacgcccagagtgtcatgacactggcggaagggggaaccgtccaaggatccgcgcacatcgccaccagctcacagagttccctctcttccaatgcttaggaaagacgagaggacatgagtttctgcatctctcttccggaccccccgaattcgaacgaaatcaactgcgattggtgacagccgccatttttgtggaggcgtcgtggtcagaaattccttctagcccggtatgaggagccacgtgcgtacaccgatggagagaactgctcgatagtgtgcagcaaaagacagttggaataatgcagaagagacactgacagagatgcgtacggtgttttacagagaacactgcagtgcctctgcttctattcacagtaaacttcacgtatccacatcctcagatgacgaggaaggcgatcccaagtggtatcggatgtgtgttgtccagatgatgatcggcgcggggaaggaatggcttaaaacacgaccacgagaacgcgtgttggcgattctacaagcgcagaacggtgacttggcggagaaaagcaactccagtgcacaacgcgtcccaagacactcagtgttcagtattgttcatggatcttctgcgaatctcctcgcgttagcgggattgtctgagacagggacacacatgacaatgaagcacgcgcagaaaaaacgcagcttgcttcgcgtgacttcgaaccacgggcagagcctgcggcttctatcgagtgtgcaagcgtggttcttcttcggtgttcgctgtgtgtagttgccaaatggatttgaagctgaaactttactggcttacacggctacgaccgggcagggccgacactgccgagacttcgatggatgcgtcattcttaagaagaaacagatctccaccacgtgacaaccttcagacgaaaacggtagatgcagagacgcagcccgtgcatgcgaggtgccaggaggcggtgcatcgctcacctggcggttcaggtggggtgtcacggcgaaaagcttggtctcaacagatttccaagaacctgggaaatacgagcccgttcgtcctgtgcctgtccgaaaccctcatctacctttcatacaagctttgaaaggaatgtctctcacagactcatccagcgtggtgaggtgaacttgagcgcaccgcagcagccgagagtctgccaaactgtactcctgctggctgtctgcatcactttttgactggtgtgtcctgctcatctgctcgcttgtacatcggactgcttgctttttttacgctttcccttcgcaagaagagttgaatactggcctgatttttcggcaatctacttcaatgtacgctgcagcgattgtgtgtttctgttacgagttgtctaaaagaaagtgtccgcgggcaagagttccggcggtccgcagagtcgtgagaaagtcgcaacccatgcggtgcgcgtagagacgtaaaacggaagaagcccataccggtgtttcgacgtttttgaaagactcccgattgccagttgtgtattgggatttttggtgggtaagatatgctggacaaacatctgatattttattttcttggacggggctgccggctctgcgggggcatccccttttcaacgtagacgccataacgggaacaccgggtacatcccctgtcagttttttacagctgtatccctcaggccattttactgggttacagtagtcgttgggagtactgtttacggtcttgccggtacattttatccgtcgggaccgtgtgtctctctgccgcaagtgtgtaggacggagacagacggagaccggttttcggcgctccgaacgaggctctctgtatgccggagctggccagttttggtatgctgttttttgcagcaaccgcgcctgtgatcagaagcgtctgctgtgactgggcgatatttgcgtgactcggttgagtcttcgtttcgtgacccgtgcgtggtagcgtattcaccctcgaaattttttcgaacccatccgcgtggccactgtgtttgtgttggactcaccagacagtgaggaacattagggttttggcccctttctcccgccaacttccctttggttgtatgttagtgtgaggaaaca

SEQ ID NO: 477 - DNA, 2000 bp, Toxoplasma gondii
ttgtttttctccacctgtttccttcatttctcttctcgttgtattgatttctctgcccgttgaacgctgcttgagttgcttcgattcagagacattcgacactgtttctggtacaatccagagaactgcgttcccggcggtcacacccagacttcttggagaacatctgctctccttttgagagcctcgtcctctgcgcttctctcctttcttctctccgtcgttctctgcgctctttccttcccccctcgtgaagctctgctcacctttcatcgcgaatcacgacggggagtttcttctgttggaagcggtttctgccctgtcgaagctcgaggctcgcgcgcagccggtcgaggcgcgcagagcagtaccttctgtatcgcagaaagtcaccgtgacggagaccattcgcctctctcctctcctccacgtatagcgagagcgagagcgagaaggagcgaaacgcaccctcaggcctctccgcctccagagcctcggccatcttctcgctcggacgagaaatcaaggacgaagaagactgagggaggaagagagaggagacgaagcgagcgaagaggaagacgaagcgaaagaaaagaagaggaaggagaggagaaaaaactgcttttgtgtgaacagagacgcggaagaagagaaggactgcacatgcgcaaggaagacgactaaggccagacacggcgtaaaacaataagagagagacaccagatattagagagttgcgataagaaggcgccctgggcgaacaaagtggagaggaatacgtctcgagacgagaggagaaggcggaaaaagcctccctgtacagacacccccgatgaacaacagcagaagccaagtgaacaaggcgcgtttcttgctctcgaaacttcttccctgtccgctgcagcgcagagagacagcccaggttttgtgctctccccacaaacgcagggactcgctgtctttcttgcctgtttttcgcttctctttgcccgctcacattcttcccccggaaaacacagaaagaagagggcagaggcaattcaacaggatctcctcggctgctccgcgtctgccgctttctggacgacagcgctttccagaatcttttcgcagaaacgagagaagacaggccgctgagcgctgaggaccgcgagagagccttgtcgacgaactcatccctgctcacagttcctttttctcgccttcctacatccccctcgcctccttctggaagtctcgcttaacctttcgctgggagttcgaaacggagaagaacgcgcgggtgcgaagtctcctcgataatctcgagcggagcctcgagttcgctgtcgagcaaacgagaaagaacacaagctgtctcgccccaggcggcacacacggccggtgacgctgcaaggctttgggaggctgcggcgcatgcagtttttttgaaaaatatgagcaagagagtcaaggcgggacgaggtggtgcttcgtgaaagactttctctgcagttcttttctgtccgttttagttgtctcccggcctcttggttgtctccctttctggagaaacgtgactttctcgtcttcgtctctcgggtgtacatacacctcacggcggactgttcccgccccaaattcgcggatttgaaagcttcctcgcattttttccatctgccgcatctcccactcttccccgtcttccgttcttctctctttctcgtcctctgtcgcgcgaatatctctcgcgtttcagaagactcccgcgcctctccccgtacacaccgtaaaacacagacccccccctgtctctaccttctctctccctttcctgctcttccgctcctgtttctttcgttttccgtctttctctttctcctcttcggattccttctctctatctcgacggctcccgttcccatcccgctgttctcgcattcgttccgtcctctcgcgaggccttccctgaacaggcgtccggccgcgttcttctctcgatttccgctcttccacga

SEQ ID NO: 478 - DNA, 2045 bp, Toxoplasma gondii
gaggtcgaggcgactgagtctccggaagacacgattggctgcgtataggccgagccgccgacgcttcggcgcgagacgccccaaccacttgcatgcgacgcgtatggagccgccgatgacgcgttgctttgtgcctggagactgttggacctcacaagagtcgcagaggatgcgacaagatgcgcagaagcgactgaggcgagagagactccaggaaaggaggaagaagccgtaggctcgagggaggaaagaaacgcaggatacgcgctttctgccaccaccgtggaggccggctgctcggaagccgccgctgcgtgtgaaacgccggccaccggcaccgtcgacatgtaagctacaggaagcattttgaaaatgaaagggaagagaaggaaggggaggcggacgccgagagaaagacggaaaaacagtagagtggagaaaggcggaaataagagacgggagcagaaggccagatgacagacgtggaagagagaggtgcaaacagcgagatccgaaagggcacttgaaaacaagggagactggaagaaagaaggatgcacacgaggcagagaggagggaagctcaggcgcgaaacaaatggaatatttcttcaggagacagctccagattgacggagtggatggttctggcgaaagattcgccagtaaagttgaggtctcgatggagactgggatgcaaaaaagatcacttggaggcggaaaatgacctttcggtcgatgcagggaccgccactacgtttttagcgcacctcatccagagaaaagcgctccacaaacaaaacctacgctacaagaaaccaggtacaatcacagtataaatcatgacaaaatcgagaagggctcccgccaacacggcggaaaaggacgaggattcattgtggccgcgccggacaacagagtcgctataaagagttgactctcggaaatcactgtgcggcagaagcggcgttggagaacaaatacatgtgtacaaacaaaagtgtcggcacgaagacaccctacaaaagagacggcgataaatgtgttcgatgcgattcacgtggctccacgagcctcactgaattcctgctcttgaaagtcgacgttagttgaccgcaggagcccaggggtgttgcaaaactgcacgacgaaactccacgcggtgaagaatgcgccgcaaacaaaagaagctcgttcaaatgataatgcatgctgagcaactacgaatgcaccccagtttcggtatagaaacgtgctgctactcgaaaaaggatgttgaacacgaacgcgagtcggagctgacacactgcagctgtacatacacctcagacacgactgtgtcagtgagccgcaggactcgccgcaatttcgcccgaaaatgacacgaattccaaatgaaagatcgcggcacactcagggcagactcgggttccatcgactgctccgcggaaaattcgacgaacggagagacaaaacccgaactttcgcgttggaacgcgcgtgcacggagcgcctggcgcgtgcagtgtgacccgcgcacacgcacggacatctgtgactcgttggagaaaggcggaaatcagcctctaaacgcagtgctctgcccgcctttttaaaagaaagaagcactattcaagcccgctaaaatataaaggggtgtgaagagaagattccgcgacgcgaagccgtgaaacccaacgctatttctgctgttgcacagaacgaggtaccgacaccgcgagcaagcgtcgttccagcacctgcgcagctttgagcgctgcggcaccttcgggcaaggtctggcgtggacggagtttttcgacttccccacccgccgacagaaggtgtttgcggattatgttcactgctttctgcctccgttgtttctccacggcgcgaatgcaaagcaagtcgctctctcgggcaaagaaccttcgtgtgggccgcgcgactgcgtgattggtgtagaaagccgtgttggcctcgacttgcgagcgcaacagcagagggacgactgttcctgcgaagcccagaaagaacggaaaa

SEQ ID NO: 479 - DNA, 1932 bp, Toxoplasma gondii
ttcctcgcgacatctgcagacttttctttcttctgagggcagacgacagggtggcggttgcctttgggcaccgacttttgaagggattggaaggtcgccgttcgtcaccacgagaaatcttgaacgtaaacttgcagtgaaacacgggcgatgctcccctcagcgacatctggtgtatgtacaccctggcaccgcatgcaattccgtttccctttgaagttcacttgcgcactcgaaggactcctcaaagagtcacatgcagcggaccaaaggactggctgctcctgtcgcctcattcatagtttatgcgaattattttctcttggaaaaatccccgctagagtcaggtgtcgattcacacacagaagatcacgtataaaacacatatatgtatatatatttgtacatgtatgcgtctctgttaatacatgtatatacgtaaatacgcaattgcccttatatatgcgtgcatttgcttaaaatatacatgtatatgtgtatacagctgtatatatatatatatatatatatatatacgcttattcgtatgtagataataaaagaggtgattttccggacagagggctggacggcatttgcactgagacatgcatggtcgatttaatggctgggaccaccgcgttttgggtgtggagaggcgcgcaaaagtgtgtggggaaagaagcgtctaacgggcattttctctttcgcgtgtctcttctccgaaagagagacaagcctttctgtcttggtcagattcttgccctatttgactctcttcgcttgctcgctcgttctcctcaagcacgtggaaaaaaccgacgaaaaggagagaggaaagaagagaaactgacgagaacgaaggagaggcaggacgagaggaagataattcgagagaaaaaggtagagagagtaatgacaaagggagaggggaaggaggtgatggaaggacggggaaggaataaaaagagaggaaaaaggaagaggacagacaatgcacagtcgatgagggaggaagtagagagaccagaaaaagggaatgccaagaaggatcgaagagaatgagaaggcggagtatatctgcagagagaatacgttgttcctcactcagagggcggtgtcttgttgcagcatgcgtcggctgttttcgagtgtatgtacagatcgtgcagtcccggagtttctgaacagtttcgcgaggtttggggagatttttggtgcaaacgaattccgtttttctctcttttctcattttcgagacacatcactttgcgtgcttgcaggtcggattgttcctcctgccctctctcctcccgcctcgtgacagtcgcgagagagaggtctcggcgagaagaaaaggccagcgcgaatggattcctttttctgttgaggaagttccccggccgacaagaacatttcctcgcgggtgaatctcgtctgctgtgctcggagggcggaaatgtcgaagtttcctcttccctctccccccagaaaagcgcagaattccggacagaagctttttcttacgcgactagatctggcaagacaccgcaatccccggccgaaatgtcacccccctctccactccttttccaactgtttggggagtttcgacttttttctctccatttctcctctctttgatcgctcccgtgtcgttccttccgcgattgcccaacttcttccttcgtccccagccgtccacggtttctcttctcgcatttccttctctgctcgcgcgaaacgtttccccaacgcgcctttttcgcaggagaaaccgatgtgaagcggtggagccgctcgaaaggcgcttcgaaagacgccgtagcgtctcctttccttcttctccgcgtctcttcaccttctttccttttctctccgtcatcttctcccccctctcctcttccaaccttggtcttcgctgtgcgaaca

SEQ ID NO: 480 - DNA, 2532 bp, Toxoplasma gondii
gagttcagacgagcagtctgaagttaacgaacgggagagggtccacgcgcgactactcccgaactgaggaggacacccttgagtgtgtagcgcagacgaatcaagggggcagaggggcttgtgaaaaacgaggaagagcagaaaggtacagagcgtaggaagaagaggacggcggggacgagcgaatgcaggggagaagcttgaagtcgagagcatcaggagcaaaaagggaggatcactgcgggaagctagagccgcagaccacgaaggcacaggctggagttgtgaaaatggattgggctgcgtttctccccagaatgttaatcttccttgtgacggaaaccgcaatcagtgaagattttcgatctttctcggagaaaccctattaccagacttctataaaagatgtgcgcagacctcttgctgtgtcactgttctctcactcggatggtgatcagatgcctggtttcactgtaggttcttgttggaattgcctagctgtctgccgctttccccaggggaaggtgggactccaaccacaagtgtaaacatatatgcatgcatgcatccatctctattggcgttttactctgcagttttccgtggaattggtgacaagaagttggcgtggcatctgggttcacgcgcacaaattcaggcaaatggcgtagcccaggatcgttgatggcaagcgacattgccggaagcagtcctccgtgaggcaccaaggtaatggttgcgaggccatgcctcttacctggctacagcacaaagtgcatggttagaaaccatcaagcttaaatcgtttgacactgctatatacgccactagccatacgccgttagggaacacgaattccctctcatatgagttccgagggttattcttcgcggatacttcgttgaccgctgcgaatcgaagagtggtttcttcgcgttttctagtgagaatgcgacaaatcacaaaatggcgacgcgtgcttcgaagttgcatatttcgtatgaggcagaattgctgccgaacgccccgtcgtgccagaggtacaccatccagcaggtttctggggacgcttgcatatcctggtgactttcaggggattcacgttgtgtccacacgcttgagtttcaatttgatgcaaaatccctggaaaatacgtcgtgggcatgtcttattcatggtgaagaaccgagaactgcggttcgctggcttcgaaagccgaatgcccacgaaaccgtctcagggatatgtacaccccgtgtcaccagcagggttccctgtcagtcacgttcgcattttacacatattcctcatctgggtttcagatcgagaaaagagcgggggtgtgtgttttctgtctacttcctggcaacgttgtgtcgcacggaagccgcagcagtgggggtggggcttgtgcagagagacaataaagaaagcaccgagtttccccgccctgaaacagaataggtgtgtcgaccattggctggcggtgaaaagtgccttgcgtcgcttgtttgcatgtgaaagagtcgagaaaagagggaaatcgcctgggggtcgttctgtccctttttcgagggtcgtcgcacccgacagctcgccgcggacccctacggcttcgcgtctcatccacaccgaaatatttggggcaactcgttctttttctctcatttttcttgctttccactcgctttccagcctccgaacctggacagagttcctcgactgcctcgctcggggtgtttcccttcgtgcccatgttcgcgccgccggctggcttcccgccctcagtgtaaaaaaggctttttccgcgccgcatgcccgcggtgtgccacgcgcccgacacggagacagggtttttcgagttgaaccttcgctgttctcagaagagacgtggatggctctgacctgcgggactggattagacaagacccttctccgaggcacatagtcggggtcgcagctgttcttcagaagaaaaaacgcagcccgtctgacttccggaaagaggaaacggcgcgcggagacgggcgacaccgggactctgtgcggcgattagccgtggcgagcaagtgacgacgtgtagcgacgacaacgtgtgaggcctccggctctcccctctttctcaaaagtcctgtctttctaattcgcctttctgtatgcccaccttttccaaaaaacaacttgccttcccacctgccccgcgactctcccgccgatacttccgcgcgacgtaaggactgttttcgcctcgagaccgcgccgtcaagacttcgtgttcgtggcgggggccggtgcacccggcggagaagtcgtggacgacttgctgcgctaaaggcgatttcccacggtccagcgcgctctcctacttcccagttccgaccgttaaacggagctagagagtccgttctggagcgtaccaggttgacccagacagtggccgagggtcgcgcctggatctcagctgggtgggcaaaagtggccacaactcattagtggaacgaggtccgtttttgcgagaatttcgtcgaacga

SEQ ID NO: 481 - DNA, 1688 bp, Toxoplasma gondii
cgtttattagacctcgtaacaactgagacacacagcgtttgacgcgacggtactcccgacgtccaccgtacgcttcagtttccagatgttggtcttcgtcaggagcacaggacggctcagaatcataccttttcatgattccgttcgctcgcaaaattatcaacacaggagacaaaagagtttttgtaccgccgtagctgctgacggatcgccagggttcaagaagcccccgggcactagcgacgctactctcaagggtggttcccagaactgtggcttacaagtgtagaacacagccaattgttttgcctctatcgtcaccagtcagaaaagatacttctactgtctgtcttacgttcgcgcgatgtactcaacggttcgcttcaggtgccttattgtctgagttgtatgctcgctatcgtgtctaacgatgcgtcggcgcttgtccgacttcgtcaacgtgaaaaagacgggtaatgcgcgtgaccagcacgcagaagctgttatccatgacaacaaagagaaaaatcaggccagagtgaaatgcgtaatcattgcttaggctatattttcggccttgatattagcccctagggagaggccgtgcttgggaaaaaaatgcttctctggcgccaaacggcgacagacgactactcctgcgattgccatgcccgactgaatgtagacgaaacgagtaaaaggagaacataatccgccatttttcggtaaaacccatctatccagtggccgatgactgcgttaatgccgcatgtaccagctggagccaccacgcctcgtaacacaaatcacaaacatactgctcgatgccggtgaacacgagttgtcttctctttctgcatgcttaagcgcttctcgcaaggaacaccatcgcgttagtgcttggagagtttccatgaagcacggaagcgtgcttcaacttgcgtgcctgcctgtgaatcagaagagaagagttactcacctcgggcgtgaaccatacttccgatgaatcgatccggtacgattggcgtgccatatacgcatctcttacttaacacaccaaacaaactcaagatgcagacaataatgttgtcggtaggcctcaagatgcgtaacaggtgagagttccgtaacttaccacaagctgaataaagatatgcttgcgaggagcggccattcttctgttcagaggtcgagtggcatcacctgcagcagaagggaatttcagaaagaaacagaacgacgtctccagtttttcccgcttgtcaaactagcgatgcgctgtctctctcgtttgcattcatctcgcgtagcttagcaagcccccacacagtgaggctaatagacaacaaaacatcccattctgatgaacaggcaaaccaaagacgtgaaattggccatgttgatgtccgtgtgcagctctccaactgctttgctacttgaacagccagttcaggcccgagagattcttattccctctccgtttagcatcgacctttgcatatatgcatgcgcatgccccgtcagcgcatgcatcgaagcgacagagtttgactccgctgcatatttctgcctttcggggtctcccttttattctgtcggagaattcctcgcattttccccgcttcgaattggagaaactgagcaaaatcctaggccgaagccgcttcacgcacccgctctcgccacca

SEQ ID NO: 482 - DNA, 3721 bp, Toxoplasma gondii
gaacgttcatcgcctgagaaagcatgaaaagtgagggaccgtgacagagcatggggagttctccgacaccctggaattgatgtggtgattcaaggatacggatacagagtgcggatagagctttgtccatttcgctaaggtgacgcctgcgagttgttggcgacagccaaatgaccaagtcactccgagttcagcactgctcattataccggaaatccactgctgaggcggatgtctacaaatagagttgtctcacatgaagcgcacatccgacagatctgataaacaaagtcagcagtacggctgtttgaggcggatgatacgagttgctgctcttccgacgtgcaccagcgggagaaggccatgcaccggcagaatgggatcgacgcaggaaggaacggcaccacatactcctatagaagagaagacttaaactaaaatagctttttgtgtgaaaatcagtggtccaccacgcactgcgcgcatacacggcgtagccgtaattttctaaattcatggcacgaagctctcggctctacaacaaccctcctggtttaaacagtgacagtccgccccaaaaaaggattcgatattagtcagcaggaataactccaccttaagtggcggcaacgacagtcctacgtgttatcatctgtagtttttatgttctcttgcgaagtcaaacacttccgcagatatcgaaatactgaccgtcagccccccgtgtgtggcgcgtccaccgtagcggtgaagtccggggtcaagaaaaaggcgacacgagcttaaggtcctgctcactaaccttaagaagcttgtgaatcagtgcagaggtcctgtactcattgtacgctgtttctggccactggtgaagagctcgacggacagccacgatccatgcattgaaagaagtttcactggctgcttcaaagagcgtggagaagtcgacaagagatccagagttcgacagagagctcagattcgttggcaccgcaaggaggttctggagctcgccgtccgggatgatatatttgtcgtcacttgcaggtgaactagcggctgccgccagcagaggaaggaaaaagaaagaatatgaacgtaaaaagatgattcctcgattccaaaaggttttcgaagccattttcttgtggccgccgcggggcatgggtttccctccactggtacagggctcactggcgcgctgacttcaagtggacacgaagagaaaggaggaaaacaaaagcgagcagcaatatcactcagaagttactgaaaaaatgacgcattcaaaacacgatgctttgtttctgtaactgaagctcaagatccagtgcactatatttctttcgcgagacacaatcaatcccgcatgcgctatgacatggctacccgcctgcaatctggtagcacaccaatccacctaaccggaggtcgaaataaggctatgatgccgaatgcgttacctcccactgtatcggtccaccacagatgcatcctagtaagttgttaacatagacacacactcaacagcaaaattgaaaggctggtaggtaaagtgttagcgccagcgtatcgatcgtagttgcccgtcatggaaatgatgcggctagaacgtcgaaagttgcaggtgctgcaggcaggatctcacaccactatggcgtggtgttaacgaagaattttcgcgtaaatgtctaaaacatacccatggcaggcgtatttttcgcctgcatgctgagttttaggacagatacttctaaaagtgatgtttcatcgcggcggtctacagacagtcgctgggtgaaccagagcagcactgtggaggcaaagaaagtcctttacatcccagtgttttggcacacaacctatgcgtgatgagcttctgtcagtggcaaacaagagcgttccagtgatacatgatactcttgatagaacatttcgagctccacggtaacatagccttcggtgcgggtctgccgaagccaccacagccgttattagatgaaacttctgccggcggcaccttggtctttgatagcggcagctagtcccgccgtcctaggatagcatcgtgacccaacacttggtggacactactgcgcaacagcgcttcctccctggggtcgtgctcagagtgtcgtctagtgttcttgcgtacggtgcaaaaacatgttgttttacctcatcattggaaagtggttgccctaagactcctccaaacaccacgctcaaaatagaaatgaattccttctattagtaaatgcaccttgacctgatcacgacatcgtcttccgcacggcgccatgatttcctctcttcgaacgatcctcgtgttaccaaaatgagatacgccaacatctgagctctggctagcgtaaaaggagatgaatttcccatcaacagctcaaccatctcgagctttttcgtctgttgagccgagactgggaacggctggttacaaggaacagtcttgctgtgaagagaggagccagcgtgcagcaatcccacggctgcaccagggtgcttctgctaggtcttctaagactattgcatctggctctacacgaggctcacccgcggtgggtttgaaagtctacttatttgataaaatccacaattgctttatgattctgtatttccattcgtgcaattacgatatctacagacagtgtgttgcattgtggaagtgggtacagccgtgagcaggcgatctgcttcggtccgacactggagaggcaagaatcttttgaagttaacgctgtattccttttggattttgctcactctggactttgcggtacgtggcaggctgctgtagcttttgtctctgacctggcagtaagctttcgtcctaaattttcagcacgcgtgtggtctgcgagcggcccgctgcctgcaccagcgtcaaccttgcgacctcgtatttgacgggagatacgggcacgtagatgctcctgaaacctagtgcgttcaggtgtgtatgtcactgttgctgcccatcattgtgcgtttggagggaacatggtttccttcgtgtggatgcagagcgccatagcaacagcgcccctacttgaagccccccatgttaaatttcgagttttcctctccagcgcattcacagtgtatcaatagaattcccaggttctatgtgatgttggccgcgcttagcatggttgtctgcctaggcagtactttgcagcggtctcttggaaaactaatttctgctacgcttgatcccagcatgatgcgtgtgctcatttactgcataatatgtaacccagcagtaccacatccaagagacgatgacatccgttttctcgagaacaagggagttgctaccacaaagtgtatacgcgtagactgccacgcccctcattcatggggctgcggcctgccccacaaaggcaggcttgttaccaagccatatgactgcaacatcggttttcactttttgtgtgctagggagggttggcgtgccccaaggttctgctatagttgaaggccgatacggtttcacgcttcgtgtgtcagtggacccaaaaaatgcatggcgttcattggcttatgtgccaccagtgattaggcacaaaaggaacccgggccggtccattcattccgttttctgcggtccttcacttggctctttttggaattgaaatattcataggcatccactatttctctgatgaattccatgttgtctccaccgactagagacggaaaaaga

SEQ ID NO: 483 - DNA, 1434 bp, Toxoplasma gondii
ttcccggatacgtctttttccctgtcgttatctcattacttcgtggagaaatctctacatttctctcctctctcttcatgtcgtcatttctctctgtctcctctctctctcttcaccttcttctcttccttctccttctgtctctcccgctttttctcttttctcttctggtgtgtacctgacgaagtcggacgcgtctttgagctcgcgtattagccgatctgtgggcaggcggaaagggtttcctctgagcatttgggtcatctgtctggtcacgtggaacctcgcctcgaaatcttccccgaatgttttggcgcatgcacgcaagaagtcccgatacggtcgacgaagcgaggggcaaggaagtgtcttctctccgtctttctgtgcgaagcatgcatccgattctctctctctctcccctgaaggcgcggctgtacacgaagaagaaggagcagaaacagcagaagagggtggaggaggagcagagcgttctagggcattcctcgaaatcgcagcagaagcgaagtttcttcggtgtgacgagagagggcgagacaaaacgacgaaagcgtgcgacctaacagcaggaaggagctgtgccatggtggtgtctttcctggaagagcagacgttgattcggagtttcacaacaaaggcaggaaactcgagtttgaacgggcgctggagaagcaagcgacagaggagaaaaaaacgtggccttgaatctggacggcggcttctgtccgcgaggaaatattcagcttatgcacagaagaagtcggtgagggatagaccagcatctgagtagtagttttctctcgctgttaatacgagggataacagtaatccatatattgcgcctaggacataaccgatgtcgaataacctgaaaaattccttcctttcgaaaaaaaaatcatgcaaatcagcagacgaaaggcttccaggagggtcgcccggcaaagcgcatcttcaccttcgcatgcaaagacgtaaaaaaaggaagccgagagacaagcggaaagacacgccccctctccctctgtcctcttcagagaagcctagcgaggttttccaaaggttgggtgtctctttggtctcaaatatgcaaaaacatcttcaagtcccagtcttcgaccagtccttccgctcgtaagatccccgaagacaccggagacgcatcgccctgtggaaggagacagggagaggacgagagagacagcgagtcctgtcattcttctttcttcgcgtcgaggttttttttaaatcgcagacacggctacgtcggtcgggatttctctacagttttttcgcctgtccccgcgattctcttaaaactcttttttctccgtcctcctccgctgcatgcggcgtttaatatagtggctttcagtagagcggtaacattcctcgcctttttctctcctggaa

SEQ ID NO: 484 - DNA, 2969 bp, Toxoplasma gondii
aaactcgcgttctcagggttcacaaaagaatgcttcagttttatgtgcaaagtcgaaagtggacatttatgtatatattagtgcattactgaatatatatatatatatatatatatatatactacagagaaatgcccgtggagattccacgtattgcgagtttggggaatccggagtctgcgggcacacaggtggaagtagaaattgaggaaagaaggcttttgccgcacagaggaagctgtcatgtttcttctggacacaaaccgcgtgaagaacgtggaactcaaagacttctcgaggttcgactcgaagttgtcctaaggagtcagttaaagatctttgtgcgcgtaggaagagcaagcggttctccctgtgtagtcttggaagtgcgtagagtctctgttttgtcctattttgtcctctgttgcacagggggcggtggactgttgagaaacgttctttggtcgaccggcacagcagcttccttgcagcgtgtctttttattttgtcttgccttccctagtgtctgtgttggtgtttcacacttcttccaccgttgtactttaaaagttccagcagctctgcggctaggggcgtcttctcgagtccgccgggcttcgctgcggcgacacgagatgccgcgcaagcaagacaaagcaaaaacagtaaatgcactcaaagtgtcggccgtgaagagcaaattcgaacgagggactcgtgataaaaaaccttgaagatcgaatcaggagtcgaacgcgcagtatggactcccccgacaccacagagcacgagagtggcgcacaaagatttcgaaatttgagtccacagcccagctcgcggtctgtactccagataaagaaagtgggttttgattaggatggctttcaacagcgtagtggagagacaatccaccaggtttgttcacgggaagcaagagagcacggcattgaagcccctccacatcggtggcgttgtcggcagattaatcgcgctttttatgcggcaggcatttcgcgtccgccactaacatatggggttaagaaaaactgttgagtgaacgtatccctgcgagagtctgtcacccttccagaacgagggtgctgatcctcgactggcgtctgtgtcacagttctcttaggaggcttgcaggtttctgccctcgatgaggcttcccagttgaaactcttccgccctcttcagtactccctgaggaactcaaatttgtgaatgtctgagcggcatctccttcgcctggaaaaatgtcgctaacggagaaactcctgcactgtcgcagccgatgtgaagaaggcgaaacggccggttgaggaaaatcctgcactgctcgctgtcatgagtgggtgcacaggtcgtcgtctgtcttccccagatcgagccgtttgacagagagagctagggttgcctcctcacaacgtgagagccgacggcgtacctttggcggtgttgtttttttggactgttttgctgctcgagtacactctttttttgtgaggggagcacaccgatgcacacatggcagagaccagtggtaacgaggcgacatcctctgtctttgtttcgggagtggaagctgcagcttcttctggcgctacgactttggctgccgcatccagagatcgttttctctcggaaaagcgaggccgcggccgcagaggagtagtccggaatcctacctccaacgccgcggcgttcactcggaggtcttccgcggggcacggaaacaagctcacgcagaaagccgacgtctgtctctagctcgcgaaccgctgcagcagcgggggatgacgtccgaggcaacacaaatccaaggcaaccggagcgacgtgtagaaagaagaactcagttgatgatcacacagggcctctccgcacccggcgtcgactgcgctagttctttggggtgcatgcaccagagagcacgagtcaacgccgcgctgggggggcgcgaggggaacactcagtggcgcgtttcctgttggagaactccaagtttcttctctctgcatccgttcgagggagttgggctctaccctcttctttttcctcgcgtttcttcccctctgcatgcgcctttgcgcggctccgccttctgcactctgacacccctggccccgcgatttgtgcctgtcttttcgtctggcacatcgacgccgagatctttcttgaaacgcctttttcgacagagcttgcgcgagtcttctttctcgtcttcctcttcgttctctcctttctcttctcgctcgcctttccgtcggttctcgcggtgtgcgcctcgcctctctctgccttccagctcgctctgtgcctctgtgcacccttctctcctcgacgtccagaaacgacgacgtcctgcggtgaacaggcaaacttttggacgcttttctgaatctcacctttcaagcgagagcgaattcatccgcgcgagagaggacgcgcccggagagtcgcagctgcgctcttttctccgccgcgcttgtcgtcgtcaccgtcctcttctctcggggtaacagcctactccgagtggcgtcgtgcgatcgtctctcttcgctcttgtctcctcgatccttcttccaaaaactgtcgcctttgtctccgtctcctctcggccaactctccgcccggtgctcctgttgcgtcttctcccgtctagtcttcgagagagctgctcttctctgcctcctcctgtctcgagttctccttcccttcgtcttacctcgttccttcattcagcgggcagagcacaatcgacgtctaccgctcctctcctcccctcccttactcccaacggaggaagcgtgccgtgaagcttgcatccgtttcctctcgccccgacacacttctgctcgtcttcctcgcctttttctttctgtttcgaacgaacgcgattctcgcttgattctcgctggtcctcttcgcctctggccttcctctcgtcctcttctctgcatccca

SEQ ID NO: 485 - DNA, 1917 bp, Toxoplasma gondii
gagaaacaaacgagatgaacatccgactcaggaaggcggcaaaggcctccgcaacggcgaacagggtggaaacatggcggaatcggtcctcaaacacagcgaaaaaaaacgcgttcaccatatgtccatatcttgaataaaagcgtatatacggatctacacatatataaatatatatataaatatatatatatatataaatatagattgatagagatactcatagagagattgatagatattgatagattaaggtgagtacgtagtaaaatgtattttcggaatgaccaaggtgaggagtttgttttcttacggctgctctagggtcacttgggtcgagaatgtccgattccggttcgtggcttgcggccgcagctgcgcgttccacgtcgaagtcatcgattaattcgtcgtctccgaagtcctcgccaaagtcgtctcccaagccaccaggttcccccgcaaacatatggtcgatttcgtcgtctgccattgcgaagtgtggaagaaaacgcacggtagcgaaaggcaagcgtcgctgaggtggaggcaaagcgggagagaagaagtcggagagagggagaaagagaaagagaggagtagagaaaatcgcgccctggcgacgcgccgtcgaggccgcggtacacgcacaaaccaggcagagacaccgctgaggagagtgaagaagagactccactctcgcgtttctgcgtaaagaaaaagagaaaaggggaagggaggccgatgggagaagggaggagaaggcgaaggaggaggccgtgaagagaagaagttttcactctaagagtggagagaggagaacaacacgctgcgacgagaaggcacagcttctcaagaacttgaagaacttcgatcggctgaatttctggcctcgcttttctgtccggatgcctccgcccttgtgcgaccgaacgaactgcagccgcctccaggagaggcagacctacttccctcgttgtggggggaactcgcagcgagaacggggagaagagaaggcgaaaaaacgggcagaagaatcgagagaaagaggagcgagagagaaggagaagaacgcgacaggtgaacagcagaacaagccagagagcggggagaaaaaaggaaaatgcatgcgaagaaaagaactggacgcgtgcgagaggcgagcatgcgtcacgagcgacaaaatagccgacagcggatgcgacgtgactctgtctgaagtgtaaattgtctgcaaaaaaacttgccttcacggcatttcgagttactcaggagaagagactggctgtgtctccacctccctcttctccggcttctcacggcgcgcctgccgagacgacaaagatagaagcgcctgttgcagacaactctggtgtacatacacctcatcccgaggagtctcgactgtccagacacgcgaacgaggtgtacatacacctcatttcgctgtgttggggaggcgaagtcgtcttcttgctctgctgctttctccggaactgcgtttgcgccgcgaggctctctctctctcggattctctcccttctttcatgcgcggcctgcatattctccgtgaacactcccttccttcactttgttttcctgtcggtctgccctcgtacctgttctctcggctctccgcgtgtccctctgttctctcccgtttctcccgtttactcgtcctcccttccacatttcccctctttcttccttcctaaacacctataaaaacgcctctcttctctcctctcttctctccttctcccttccgctactctctccacttccttcttttcttctcttctctctcccgtcttcctccccgtcttcctccccctcttcctccccgtctgtctcccttccactccgttcttcttctcctcctcccttgagccttttttccgtctcgctccgtctcga

SEQ ID NO: 486 - DNA, 4409 bp, Toxoplasma gondii
acaacgcgttcgattcgcctcttctccggatccagtggcacttgccacagagttgagcagctccacacctgcggggtatcgtccctgtctctccatccggtgactcctgaacgcaccaaaagagcctgctgccgtccgttcgtgcgcctccggtctgcttttcgactccgacaacggagactccgtcgacgagttccaagtgttcctcctctctgctgtgtagatggaggtgagtctgtgcgattggatcccccgatgtgatgctgcgaggtgccatacttcattccctctgtctcccgccgtcggggccctgggtctagggtacggcgtaggggcgccgtagccgttctgtccgtctcgaattgaagcggcggcactcgctgcggtgttccgtccactgcgtgaatgcactgaggcaaacgcgcacaagagacggagtcttgagcagaagctgggaacttcgctagacggcttttttctgcggaggttgtgtgggtcgactgtgactgttgaccgggctggaatgagggagggaacagctggaaaagtgccacttgcgtcgccgggaggaatgaaaatggaagatgcggcgtaagttggagaatcgacccgaagcagcgcgggagttctgatccacaaggaacgccttggctgcgcggcactcctaatcgacggcggaaaggcgctggactgcatgcgtgtcaggtccttgccagtcaaggttgagaaaggggcccccggagtaaaggactccgcattccgagaaaacgcagagtatgccaaaggcgaagaagttgagaaaaatggatcggaagattgccgtcgaggcacccatgagcccaagacgcgggcagaaactccacacgttccctcatagataggaacgtgtagaaagaaggacaaaagaagagagaagccaagacaagtcggggcacggcggacaaaagcagacttatctctgggaagcataggggacgccagagatggacgcccaacgggccgcccctccaggactacgtgcgcgtgcattcccttcagagatcccttcgatctgcatcgctgagaaactgaaaagttcacacgcattcttacaaaaaaagtagtttgcatgcgcgaattcgcgctcaacccctataccagtgtgcccaagaagtctgtggaattgcccggcaaacgtccactctttcaaggaaacttcacctccattcccgagtcgacgtcgcacgaagagtgcatgttcacagacacaatgaatgggatttccaatacagaagttccctcaactcacgcgaattcccagacagccgaggcggagcacgcgagcacgtggaggtcacacagaacggggttaagcagctggaggcaagcatggaatcttgacacgccttgaaaggcagtttaacctcaaaggaacgcaatgcagagtggcctgctggtcctcgaattacacgggaaacttgcagtgagtaacggcaagaacggtgcttgtcactcctgaccctccacgcggaacagatataccccaaatctcccatacccgtttaggctagttgttttcgagatttaagcgcttgaaagtgccagtgaggctgagaaacctgtagaagaaagttaaaaaacgggaagtcacgtacatggaaggaggaaacgggagaaagaagttggcaagacttccgtatcgcggtaatgtgtgcccgggaattccacgcccgacggcacacgtgctcactctcgttcgaccggatgcacttaacaaagttgaaaaagaccctttccttagtaacaatatttttactgagcatttgactggtgaaaaagagaacaaccgcccctgagaatctcaccccgtctgcgcatctacacaacagaagcgtcaccagacccacgtggagatccacgtaaaacaagcacattcatttttttattcgagtaacatgttcgtcagagtttctttaatgtgttggtgtttctgataaattcctgcttgttttctatcgcccatccacgttcattccacggacgcaggcctgcctctgtgcagctcgtcgtccacagtagcacacccgtcacgcagagcatactcctgggtcacgcagagcatgcctctgcaagccgaacagaacggcatacactttccgacgctgctgtcacattctatgcgcatcggctccgatttcctgctttatttccctctattgccgagggagtgaagagcggacctgacccttcacttggaaactgtggacggtttgttgtttgtgttacagctccggcccccccccccttgttcctccccgtggctggcatttccagccgcgcgaaggcgtcgagattcttgtccttccagaagtacagccacgctgtgtacgggctccagttgctttctttctttcactagtgtctgaaaggattctgaacctcaactgactctcgagaagcaaagatcgctagaaagacgctgtgtatagtttgtagaatgcgtgcccttctccacccatcgcgttcggctgtgagaaattgttcaagagttgaggacgattatgtcggagaagggtgtgcatgagcagaacgatgaattcttcaagtggatctggcgcttcagggatgaccagtttgttgcatcatgcctctggtccatctgcacgcaatgttgatggtgttgcgggtgcctgaaggctcgtattactctcgagtgcaggcgtgtctgtgaacgaaacgagactcatgttcgtcggtctgatccaaagcgaagacacgtttcggtgtatctttttgtagtctcgatttttcaagaacctttcggtatgccaccctgcctcgcagtcagctgttagtccacgcgggtgtgtgcgttcgtagcgcaaggcgttgtcttctgtaatgcagaagtgcttgtatgaaatcggcattggagtctctgtttcttctagtttcacgacttggcacatgaaacagactgtccgttctcatccgcggcggctcgacacaaaggaagtcgtaagcgcgtgtccgtcgagctccagttctcctcagtcccccggtagcgcgctcgtcagcccggtgaacgtttcgttgtcgctcgaaagtcggttcagcgtggaaaaacagtgtcgtggcagtaaaagtggttgcgtgtcttgctgtggggtttcttcgccgggggtttggtgtgagaaagtgcatgcgttccccccagctccgattcggggtggagggtgccacccgacctccacgaggcaaatcgccagacaggcaggtttgctgcagaacttgttcaatccgtttttttgcaacggaagtttgcatgcacatttttggctttttagaatgcctcgacatcgagctccatgcttctctactcctggctgcgcgtagtctgtcgggaaaactgcgatttggggggtcggacggaagatcgaggtggagccgcgcattcttagccactgctccgcctcttgaaactgcgaggaaagtgttgcgaagaggtaagggaaactgcgaaattgtgaattccttagcgctgtccctttgaactcgatccttgctcgcgaacaaacctgacgcagctttggaaaatcttgtcggaaacgcgttcggtgtcgcgtctttgaacgccgaccacctgaaagagcgccgtcttcctattggctgcgtggtctgcgtggacgcggtgctgttccacgtcgtttcttcgtgactcgtggctgtcgtgcggggtttggggaattcggcgaatcgacgcgaacggagtagctcgactgctttcttgacttccggtagccaaaaagtggcgaaaagcgtttccgatcttcgtggtttgagcaagttgtacagttgctgactctgctccgtttttgcgccctccaaccccacggcgtttccccccgaaaatggaagagcagtctcaactctggtgagacatgcttcaggaagaacgcggcatttgctggggtatttaccaacgttttttcctacaagttcttgtcactgatttcgattttttgacgtgaatgacatgaccgagctccgcgagcccgcctaagttcgcttctgcgtctctccgcggggctgcattttattaacatcttgttttgtgactagcatccgttatcgtcgctttttcggcctgattcgtttccacgtcgctgtttccccgcgcttttactctaggtcagagacccgagcggctcttttccggaatgcgcgattgtcgtcgggtatgtcttgcgcagctcgattttttccttgacaccgcgaaagtccaaggtactgtcgtcgttggcgttcatttttctcggacatttgagtcctcattccgctcgcgcgctcagtctgttcccgccgcgtgtttggctgggggttgcgcagaactcgagcccacgttgtcttaccatttctcaaatacacca

SEQ ID NO: 487 - DNA, 3237 bp, Toxoplasma gondii
agattcgaagaagcagatcctcgaatgtctctgccttcctctttccttccttctcttcgctcggcttctcttcgctcggcttctcttcgtcttccttctctgtttcgttcctctcgcgcttcgtgggccgcccagcgcgagcggcacgcagctccgctgtctccgaggaaattcgtaggcaccggaaaggcgctcccaggaggcaatgcaggccgcgaggaggcatgcgaagaaagacaaacagcgggaggagaagcatgagatgacacatgaagagcatggggagaagaagcggtcgacaaggaagggttttgaaggggatggaacaacgggtgcgcgttggaatgcgtggctggaggaactgcggggaaggccgcggcgacgcctacgtactgggtgacggagcctgcctgcgatagagcgagaggaggcggctggaagccaagaggcagatcgggtggaagtcccgaaagagaaacgacggcaggcataaaggcggggactgaaggcgggagggcagcgttcagttgcccggcggagggacaacggcggaacgcagcgtctccgcggtgattgaagggctccatgtctcagacgcgagaagaagcgagaagaagcaagaaaagagagaagaaaagagagacgagacagaagaaaagagacgagagagaagacacaacggaagtggagacagaagacaggaggacgaaaagaaagtcgaaagatccgtcaggagaaggtggggaaagacgccagtcggggatgtcctcctagtgagatgacaaaaggagcaagaggagagagcgaccggaaccaaggtcaggcgcacagaagatcagagcagaggtgacgaaacaaggagaaaagacgaaggaagtggaagggacaaccaaagcggagaaaaagacgagagaggaagagaagacgaagagagagaagaggaaaagagtgcaaacgatgcagtcgactgcggactccgtgtgtccctgcggcaaaagcgtcgcgcggggacagcagtcagggcaagtttcgcctttttcatggctccctggaatgtttactgttcaaataaagacgtagaacgcgacgacgcatcgtcttctcgccacacaaaacgcccggtccgccttcgcgagaaatggtgcaggccagaccacggcgagaaccggctcgcaaaacctacgttgacagggatcgaaaccgggtgtacacaccctgcatcgttcgtcgcaggcgtcgctgctcgggtgtacgtacacctcgttctcgcaccctccagcgctcgtcctccagtcgtttttgcgagactgcatgcgtagaaacgcgccgtttcgctcgaaacgttttctgtccttgcgtggacgcgagtgcctggccgcagaactcgactccaagacaagctcaaagcttcacaggcgaggcgcgctacacgcgctagacaggccacaaacaagtacgcgcgcacaagaaggcaaacaactcttcccacataaagagagtcgaatgtagatggaaatacacacacagagccatgcagaagtagatacagaaacacatatacgtacatctacgtatatatatatatatatatgtatatatatatgtagataggaaaccagagagacagagacagagagacagatatagatgaacagaagtcgagttacaagttcagttgggtggcgtctgtcgagagagcgaggcgctctcagcgtttacgcccgcagggagaggaatccccgtggaaggggagccgggggtcgttccgggaggcgcaacgcgaagcaccgccactcgtccgtctactcactcgctgtctgcgtcgcggtttctttttccgcgtcgtcctctttcaagaaagcttggcggctggcggcgtgactgcgtcttcggcgagaagaaaagcaggctagccgcaggctgtgggctcgcctcggtgcccagatcgaggcgtcgagacaccggaaaggagcgcaacagcagattttgaaacgtccatcacagagtcgcgagacagctctccggaaagttttcaggttcgcttgaatgcgggggagctcgtagtctctgaaagcagcagaacgtccgcgaatgcgccagtctgtctcctcgtattttctctccgtctccatccctctcgcgcctccgtcgtttcgtctgccgcgctctccttttttggaagcagttctgcggagggaggctttgaatgcaaacgttccccaggcgctggtcccgaagtttgttgttttcatcgcgagtcaacagcccctgtcgcccctggtctctctcagtcggcctctccgcacactcctgcctacagtttttctcgttcggcgggcgcagggacggcgctcgagagttttgctggagattcattcggtggctcggctcttctgcattcgacttccgcggcaaaacgaaggaaagacgacgcgacaagcgagagcattccgtgaaaaagtgatgcaggtgtgtgtgcggcgaacaagctgggtcttgtcggtcgcggcccggccggggctttgaggagcggccgacgcctccgagaaaacagcggggaaaagagaggaaagagttgcgaaaaaggagctgtttggagacagaccgggccgcttttcctcgccggcaagcacatgcgagaggcagcgtttgcgcgggaagcgaaaaacgcgcgctggtgtgcgagcgcgagctcttgcggtgtgtatatattcaggcgcgctgcttctgccaggcaggtcgagaaaaaaaccgtggaccagcggaaaaaatgacgtctccataagaactcgggccgtcttaaatttcgcgtcgactctagaagaaaggtcacttccggagttcctccgtttcttcctttcgtctgagcctcttgcgtccacccttgtcttgcccccctctcctcgacaaccacaacaacacacgggggagggcgcgagacactgcctttctgtctcctcttgatctccttccttgttctctcctcaggtgcctccttcgaccccattggtctcgtttccttccatcgttcctcgcctcctcctcttctcttcccgctgtcggactatcgccttccaaatcttttctttctccgcccgagagttcgcgtcccctcttcctctttttcctctctctctggtcttcttcttcatgttctccttctcccttccttctctctcccgcccgcttccctgtttcctctgcttctccctccgtcctccgttttcttcctcgaaa

SEQ ID NO: 488 - DNA, 1439 bp, Toxoplasma gondii
gaacagtcaaacaaggtctctgagatcgcgttccaagacacaatcgtccccctcaactgattgatgcaactgaaagtgctcgaagtcgaaagcaagcggcaggacaggactcgtctgcgctttactgtctctcttcgagacgcctttctcgcctagagcgaacacccaacagaattaacttacggcggaaggcgcatgaaggcgcgccactcggcgcggttcttgaaggagacagagcgcgaagagacacaagcccagagcctgtctctcccgagtccagagagagcgcccgggagagcgaagacagcagcgagtgaagaagcacagaaagcagacacaacagaccccgcaggaaacgcaggcgagggaggagacgaactggaagaagcaggagaagagcgagaagacgaaggagaagagcgaagaggagaagaagaagaaagagagcgagaagagagcgagaaaggagaggacagggagtgaggtggacaagagagagagtgagaagaagaagaagaaggagaagcggagggaggataggcagagtgagaaggagaagaaagtgaagacagaagagatgaaggaagaaaggatttgtagcaaactggagaggcgacgaaccttctcttcatggtgaggaggcagcgagcctccaggctcttccccgccatctttttacaaagacggagacaagaaagaagagaagagacgggaggagaaaaaagtcggggaagcgaataagacaagacaagaaatagagaagggggggacgataggatagaattgagaacagaaaggagagagaaaaaatgaaagattttacaaagcaagaatagggacgcccctgtttttgacgtaaggagcgacgactccagacacagacgcagaacagaacaacgcgagagaaaaacgaccttaaagaacaggtggtgagacgcacaacatgaaaacctgaaacaagtgagagattcgtttttaacttttcgcctgccgttcgtcggacgaggagttcggatgcatgcttgacaggcagagtacagctttgccgtggcttgcaccagcgtttcagtgcgactcagcgcatctacgcgaattttctcttttctctatttcctcttcatcgtccatatacctactagtgcactcagaatcacgattctccgtaccttcttctctcttctgttccctcctgacagtcgtcgccttcccctttctctttctcaaaaactctcctttctcttttaccatgccgcacctactcctctcttctcacctggaaggtcgccgttgacaaggcctcttgatcttcagtccttcttccttgttgtctctcttcttcgtccttgtcttcgctcctcttcgtccggatctcctcctttgttctcgctttttagtttccgtttcgtcgccattcgaggcgaagagacagtctctgaaga

SEQ ID NO: 489 - DNA, 4299 bp, Toxoplasma gondii
tttttcgggagtctgctgtgtgggaacgacctacttttgatagtcttctcgatcttgaatgaggtagcgtcgaagaactttcacctctcggacattctgttccttcttccagttgtagaagtcgacttttttcagcagtcgcttctcatggaacttcagttgcctcattgtggcgcgcggtgttctgaaatgcctcagggaaaagcgcctgcagccgcatgcagagtttcttctctctgtcagtacttgaaccccaatttcacccttcttaacccatgtcccttacacaggcatccgtcacttctcatatacaatatacatacatatatatatatatatatatatatatatacatatatatacatatatatatgtatatacaggggtgatatccttgatatatgtagatctgtggggaaggagaaaaggaagaagagacgtggaagacagaaagcgttttctcttttagttgagggacgagggcctagaaactctttccgacaagagtggtggcgaacggaactctgccgtctcatccggggctgtcgtcgctggagtcgaaaggtcgttttcagttggagaagtactcttgcgactggaaaggagaaggctccacagtgggaactcaatgagtcaagaaatcttaaaaaaagcctttttctcaaacttggaagcgcgcatcgaccatttcgtcgccctgcgtggttcctctctcctcgaatcgcggcggtgcttccgtcgttcttccgtcgcgctccgagaggcacaaacagaagaaagcggagaccccacaaagggcgcttgcgaggaagcggataggagacaggtgctctcgatccaggagagcgacttgagagaaaatgagtcttcgttgcatggagaatcgatctgttggcgatacttttctctccgcctccggggaacgcatgcatgtgccgacgctgagacgaaggcgacttttctcagaaaggaaagagattcggaggacgacggtgtaagcgggagagaaaagaatatcacactttcgtctttatgcgcagtttgtctcgtcttttcttcgctgtccacggccgttgttcctccatttctccagggagtctccccaaagtccgagagctcccctcgcactgagaatacacctcccggtttttctttctgcgaggagaaagcagacttttcaggttgaccgcgtcgcaaaaatgagtaaactcagtgcgttcttcgagaagaagaagaaaaagtctctcaaatcttccacccccgcaggtctcggagagaaatccgtgagtctccacgtcgtccgataacagaaaaagacgctctctacattcatacgggacccattgccttctccttgtctatacagttgtgtatgcacacataattccggtcgttgtgcttttcttcatctacctggatgatttcttttgcgggtgtctcatggttccgtccgtcctcattttgccgcttcctctctcttgagaccttcatttatatacgtgtgtctggttctcttctttttcccctctccgcgtccccgcatttccagctcgcagtttccgccgctctctcctccccttttctgtttcgcctctctctttttctctttctctctgtctctttttcggctctttctcctctcgtgtcttctccgtttctctctgcgtgacgcatcgctgacctcggcgcgcgtcagtctccgctgtgtgccggttttttccatccgcctcgtggagaccccagtggatgttgctaaaagtttttcagtctttttctttcgcaaggtccaccgtgtatcgacgtcgtctccttttttccgcgcatttctcatccacacgtgatgttctctccaccgttcgtttcttcttctcgagacctctcccgcgtcaccgcgttttctcctttcactttctttgcccgtggctgcctcctgcgtctttgtcgacttctctctgtgcgcagcttgcgccgcgttctcgcctggagcctggttgacttctctgcctttgtcctctctcgtgtgttcagaaaaaagatgaagaacctgtgctcgtcgaggaggactcctcggagtgggtggtggatgaccagccggcgaaacctgcgtctccgcaagaggactcactggcgacatggttgaaagtcagcgtcgtggacgcagcgtctgtgaagaaaaaggagcctgagaagacgtggatcgcgtacggagacggagacgtcgaaggtccggagagcgacggcgagagaggccagtctgcatgcagtccagaggactcgccggaggctgcgtcgctctcggcagagaaggctgaggcgcctgccgccaagaagtgggttcccccgagtctgagaggaaaacgcgcgacgggtggaggcgcgggagcttgcatcaacttcgacgacgaccaggacttggcgactgcagctcagctcggcttttattcgggtaaaggtgttcagaagaagaaggcgactccgacgcaggccgcgaaggagacgaagaaggagaaggagaagaagagcggggagggcgaggagaaacaggcggtcgaagaactaccccccgtccccgaattcgacgtctggaagtacgtccagatcgacggtggctctctgggctcgaaggcgccgcaaaacgacgaggcggtccgagcgaaatatcaaaacaggaagaggctcccctcaagatctgcgtaggccgagaggcggaaaaaagtttgctagaaaagatgcaagcgtcgtgtgaggactactggcctgggctggagagagagagtcgccgaacctgcgcggagtgaacggagagagcaggcaagagacaagagagagacagagagggatatgagctctgggtgttctttcgaagggagaaaaacagacatctgtctccctgtttgtggggcgctcgtggaccggcacccttttctctctctcgacgtctctctctctctcgacaactgtgctacaaccgcgtctgcggtttcgtttcttggtgggttagtatgcgtgcgttttgcctgtggggaaccgcgaacaactgtgtcgattctggggggtgaattccactttttttaggatcgagagtgtgtgcgaactcgcgaaagggtgtcggctttgttttcttccgtatcgctccggtgaaaccgaccctctgtgtcttttttccgacggacaaaacgtgaggaaacgcagctccaaaaaaacctttttgtctgtctctccaagtgtgagggtttgatgccatcttcaggctcagagtgtctctgttgcggggacgtcgcatgcatcctcgttgcttcttctctggagaaggaacatattttcgaccgagcacaaagaacatttgtgttcgctctcgtgtctccacgacgtagacaaagtctttttctctggagaacagagagacttctcgctcccacagtcgttccacgtctgccttcttctctcccctcgtatcctcgcacagattccccctctggcgcactccagtggaagccccacacaccaatatgtatttctcttggattgtagctctatatatgtatatgtggtatgcgtgaaggtacgcatctgtgtttgatatatgaagatataagtatatttatgtagatacatcaaggtatatatatgcaaacacttttacgtgtatacatatacatatatgtatatctatgcgtaagtgtgtatgtaacattcgacaaagatggggggaggccgacggctagagagaacaggaggtcgacgggcatgtcaacgctgacccgtagcacaggcctttccttcggtccaactcagaggactccattttctgcaggaagtcgagttgttcagtgtttctgacaagaactgctttttttcagaatcgcgaaaaaccttctcacattgtgacggtgggcgttctcagagaggaaagaagagaaatgtggattcacacaggacacagaccccggagctcccatacgcatacgctaacggcacagataaaacagactggaacattagacagatgctgcagtaccctttcaatatgttcacagatgcatttttgtagaggcatctttgcttctcaagttgtgtgttgattttacgccgctgatgaacggggatgcactcagaagagcctgttctttttgtcgcatgtggtgcctttctgaacagcaaaacgagttttgtgggccttctctttcaaaaaaaagaagaatgtgctgtgtctgcttttcaagaaagaaggatgcatttccgcgcttgtctttaacctggatgaggatcgatttatctgcgtttcaacgtggaaaacaa

SEQ ID NO: 490 - DNA, 4146 bp, Toxoplasma gondii
gtgcaagaaacatcagaggcgaaacgccacaagcactccgcacatcgccctccccttcactaccactgcggaacccgcaaacaaattctcctgcagaaggggatgtggcgtttatggagccgcacaagtgtggcgagaaaacacgcgcaaacgagcagggcgacgaatccactagaggcgacagagggtgatctgttgagggtgacgggtctgtggattcaccctccaagtccgccctgtgttgcttaactccactatccgcgacgcggggtgaacgtccagtcgtttgcgagtaatgctcatctgtatgcacatagttatcgacccgcagcgttccctggcctgctactggaacgtaaggggaagttatcggggaagtgtttttgccatcctgtgtctcggttgtctgaatatcagcgcccggtgatattttgcagagcccgcccacgttgcctcccacaaatagagagtgagaatcgcattcctcctctccttcatgccgaaaaacgacgtgcgcaattttttgtggacacgcacacacagatagggatgatgaagacgacaaacagacggaggaaaaaattgggcgaggagaacatggggaagataactcggttgtcgattcacacagactgcccccgcgcatccgggaaaatgacaccgcctcacttgtcgaagcagaagcggtttcttcggtgattgtgccgaccttgccgtgtcccctcggacgccgataagggtgaatcattttggtaggcttccgcaaggtagcacgtgtccgccagtgaaaagcagcgaggcatcagcattgaaacggctttcacactgcactaacaatgccacgactgccgcaggaagaaaatgtttgctaatcttctttaggtagtaggataggcagattaagcaaagacattatattatgattcgcctgagcttgtccactggtatattgagcaggcggacaaattgttctatttcggcgcatgaaacaggaacagagaaccactgttcctacgcagaagttttgcttgtgaacacgcgtcatccggatctttggatacctgggagcccctgctgattgccaagggcagtcgttcgcagtgggacgaattcaatgtgtcggcgctccatcgaatccacagaagcgacaaatataatggcgccgatgtcgaaaaaatcaaaatgatcgactaagaaatgggtgaaatcgtcgccagtacttggcttccagctgtacgtatgtgacaaaagacgagagtcaaagagggagttgaaaaccacattcagcgtctctacgacaaacgggtcacgaaaaaggtcaaaaaacgaggcgcccggagcggctgaggctgctggcaaaccgtcgaagaaagtgtgggaggtatgaaacagcactacagagtgtgtcttattacgcagtcgtattcagcgacgagtgggaaagaggaattgcagaaaaaacgaagactaagtttgtcacgcaggttcgaaaaaacatcctttacagccacggatgtagacaaagctgcgggcgtgctgcgggcaccgtagttgtatgcagtttctgtctagtgggaatacgaaaagtcgagacggttcaaaacaacagcaacatgcaaacgaaaaagtaacagccactgacggggaaggaggccaaacgtctctgtttgccgccacttcaaaagatcacccagagaaagagcacttgcaagtagtttgtgtccaatgtaggactggcaaacaggagggttttccgcggagaaatcggatataaagaactgcctaaagtgaagacttctgtagacttcaagaccatgaaaacgtcggctagacgagtgtatattccgtcaaggcaacctgtgcacgctctcctgtggctcgtgcattgggaccccctcgttagggggccgtctctcagctagtaaggctggaaaacgacgaagcccgtttacagcggcacccaggaccatgaacgcaccaaaacacacaacgggaaaactaggaagaaatttcaaccaattgacctgcacggtcggtgctgctgaatgagcgtagagtttgactcgagattgaggttacgcaaggtcaccaccccaaacatagtatagcgcattgcctctcccggtcgtcgttgagttcggtccaaattacgtaccttgtgcggaaacgctcgctgcaactctcagaaatgaattattcgagaaacatccgcgtgagaagcactgatattagaatctaggccagcgcagcgacgaatctgtatcaattcaacctcccccacggagcaggacaggcctgcgaagttgcggcacacgtagtgtgtctagcgctcaaggacgcgcgcgatcatcatcgcgtccgcgtccgtcgcaggcggaagaagactcgagcaagtcgacagacgccctccttactagttattctaggaaaagaagggaaacagagagaaaaaataaacaagaagccacgcattcctcagtctgcttcgcctcgcgcagtaattcgctcactgtctggaatagaaaaccggtgcggagctgtgccacataagcacggggctcgcgactcgtatgtttttagttcgacaacaatgtcgaccgtttgaagggtgcgggctgtataactgcggaatacttgagagctgcttccgcaatatatgtaaaccatacagcgacgcgagcattaaacggtagatgggggctcgggtgcttcacaacgggcgaatatataatccaggagttgtctgccgtctttccctctcacgaaatgtcagcagcggaggaacacccatttgaggcgtccgcggatgagcgtggctgcgcaacaccaatctcttcggaaacagctggtgacttttgacgcgcacgttcccagagtgagccgtaagggcggcggcagaagatgtgtttgcttcacatttcaaagagaggaaggtgtgctgcgggaacgctgccggcatcatcaaaagccacagaggtaattccggcaaaaaagcattcatgcggccggtagatccaggaacgggcagaaaccattcgaaatgctcgcgtgtgggtgacactttgtgctgaaggacatcttttgatgtcccttctgaagggttcctgccagcctctcttccgtgttaggactggtgcttttcgcggtgacttgctattttaggggaatgcagattaaagcgtgccgcgaaccctgtataaagtaaggtgatttctttggtttccctcgttcgatgtctcagagtcccagacgagaataagcctgtccgtaggcagaaacatgctcattagcagcccatagacacacggctttaaatgtcattacgtacatttttttggttgagttataccatcgactctaccaacgagtataaaaacatctttcggcatacttgtctcctctaaattcatgcacggctgcgtccgtgtgcacgggtgtgtcactcctgcagactgcggactacaggggcacctgcgtccgggcgcagagctagggcgacgggaagcagagtacgcaccgggcttgtagttccctttattgcaaacaggaggcgcagatgctgggtttcagtcctaacctcgacagcacggggatcgaaatcggatctggcgcggatgttgggttttgtactcgtgcgcagggccgaccacaacgaatgtcaactcgcttttgcacccgagacaagaaaagttgcctcatgcccgccagctcacaataacgacggacggggtgcggtcacgaacgcaacaccccgacatctgctctagaacacgcttcctactccttcctccaaggcagttacttgcggcggcagttccctcagatcttttccagaaaagcttccttcgtctgcgtttcgtgtccgaatttcaacaagcgcgttagcatccgttttttacgttgttttttcggcgtctcttgcaactgcggccggctgcggagaaacggcgcagaaactgtcaccagatcctgccttatttgctcagacgtcggctgcttcctttggtttgtcgcgctttcttcacgagtgaccctcgcgaccctgcaggagattcgtcgacgccagcagacgtatgggaccattcgccactgtgcggagacaccccgtgtagacagcagtaaagctgccgcaagtgctttgcaaga

SEQ ID NO: 491 - DNA, 1768 bp, Toxoplasma gondii
agacgtaacaaatcaacagagcgggtgacgagaaaaagaaaagcacctgtaggctgtgccgtcgctccatggggctgcaattgagggtgagagaaagctgaagaggacggaggtctgaagtcctttttcgactcctgcgaaggacgctgcacgagcagactgtcgaagaaattcaagcgacgaagctgctgcatggcggcactacagaaggtggagacccgagtgcatgcaggggagacggaagcggcagagagaagagtcgagatgcagacgcttcatagaacggacgcagcctgtggagaacgaaagatgcggaagggagaagaaggaaagaaggaagcagagaaaacggcaggaaaacgtcttgaggagctacacccgagtgcatgcagggggaagagaccgtgcagccgttctaccggcaacgaggtcgaccgggaagacgggatacaggcgctcgaactctgaagagactccccttgagaggagacgcgcgaacaatccccagagggcggagaagagaagagcggaacgaggacgcgcgacgaagagagaagagagaagagggaggcgccggacaagaacaagaaggatggacagcagggaggagaggtgaaagaggaagcgtctctcgcgcagacaaagggcgtttctcctcgtgagcctcgatcattattggcattggacggtccagggaatcgagaaaacaaagcgcgttcgacaactcgaggcagcagggagctggaaactcggtggcgagaacaagacacagggatttcttcggacaagccggttcagcagcaaacgccagcagaagagggtgagaaggaagagaaagaggaagaaagagaaaaagagagaacgatgcgtaccagccgtcagaaaagaggcgtcagacaccagaagagcaactggctacctggtcgccgtatctctcgttcctttgtttttatatcgttgcctcgcgtataggaaactccgaaaagagagcaacgaaagaagagagagaaacggagatacagagagaaagtgtgcaaagtaagaagcatacaagacactgaaactccgcattgaaaacgcagcgagaaaaagcttgtgtcttcctggtccatggttgggtcgtcgcgtctccttaaaaaagtcgatccgtgcatgcaaaaaagcgaagaagaagccacaccgaaaagcgagagaaatactcccaagtgttcttttccccgtgttttttctgctttctggaaataaagaatgctcaagtcttcctcccaatgctcgcagcttccttctctctgaaaggaatctctctttccctcagcttctcccctctccttcgctgtatcgacctgcttgggtttttttctccccttctgctttccgtgaacaaatctccagcttccagtccttcttctgcctctgattcgtctgtctggtttctctgtgcagcgaaaaggaatcatctttgccaaactttttttcgcgccgctcctctttgcagaggtctccgattttcggtttctctccttcctcgctctctctcccgcgcgtccactctgcttgcgtttgttcccaggctccttcgcctctgcgtctttttatcctctgcgtctctctctcctctgcgtctttttctcctctgcgtctttttcttctgcgtctttcatttctgctttttttcaccagtctcctcgtcatctcctgtctccttccacctcctgcgtctccgcttccgttccttctctctcagtctctgcttggcgccccagcgcga

SEQ ID NO: 492 - DNA, 4124 bp, Toxoplasma gondii
cgaagttcgttcagtcggttggtgcggaactgggaagaaatgtaatcacgaagagtgatacagtgaacatgcaattttttatggctgcttgtgtacgcgaataccttcggacatcatggtgtacttcaccgtcagtggtgttcttggttcagttgatgactgctaaccgtttaaagtctgtccgtttgcttactcgcagtaacattacagggaccaaaaacgcttgacgggaaacgtcagcgagtcttgacctgagagagaatgctgaaagacgatggtcaggttccttcttccgtcggcagtgaatgagtgcagagcagcagttcagctggagcaacggttcacgaaagatagctgttgtggtgttcaaaggagcgacactggggtcgcggttctgcgcacctggtattgtaaccgacagcaaagcaggcagttttgacggcgtagagcaagtgagagtattcttgctgctgacacacgcaagcacgtcttcacagtgccagtgtctttcgctgcatttttcctcgtgattgattaggacacatcgtagcctcgtttggagcaagaaacaattcgtggaacaagaaaccttcatttccctcaacaaatgtaacgtcccaaccatatggcagggatatatttacgtcccgttcccaccgatggctgccagagtcccgtcaggtctggccaaaaaagcggcaaaattcgacaggccgaggcccccgacaccgtcgctgtaccgggaatttgcgcggctccctctgctattcccgtttccggtggcataaggtgccgcaagaagagcaacaggtgctggggctatcagctgttgaatgccgctaccattcgctggctcttcgaggctgagcagtgcttctgtaggggtcgtggtgacgaccggattcggcgcagtcacggccactggcgccagcgcggctctcccggggacagctacaggtactgccgattgctgtacgacaggaaccgtcgccctctgagaaagggcgatagctggttgcacgacattgatgggcccttgttctgctaccgcttgctgtacaaccggaaatgccgcctggacaggagcagctgccactgtagctgctacagttgggtaataagatgagtacacagccggcgaagtgagtactggagcgcttgcagccgtaccaaaggtcgtataataccacggcaagtaggctgttctgtaccagttcagatacgctccgtatggcgtggctgtcatcccccccgggtaaaagccggctgccaatttacgcggattgggtcttttggtgaatgtgttgtcacgcgccctatcaacagcttcggtctcttgtactgcaatgacattctcatgagacgcgttcacttcacttcccgcgtcgtctctcttgctgcttgatgcccgctggtcgtcgtgttgacgggcacgagacccttggaattctcctgtactcgaagacaagtcagcttgttggttgccttcctcagagggcaaatcgcgacccgacccaccaaacgttcggccgtcagggagtcgatttttctcgacctgtgacacatttggtgagctgccttcctcgtgtccatcgacgtcaccgcttgggttgattctctcgtttttatttggaggagactcatcctcaaccacctggctggcggtaaaacttgaatgggacgccgacgcggcgccacagccactaaccaaagcacataccaaaagaacagcccagaaacgaagatgcccttgcttcatcacagccgacaggttgctgcgacgttgtgccttttgaagctccgtcatagtgctgtggaaatgagaagattttctctgtggggggctgaattttacagatgcctctgtcgttctaacaaatgggttcgcagggagagctgcttgatgaatgaggcaccaggatacacacgagtcgaccgggtgacgcacagattcgttgaggcaaacaaaatgtgaaagaagagccgcttcctttgctgtagtttgcccttcactgaaccaccttgtatcggattgcgacagagcgggctgaaaatagccgttgcccgatcaatctgctcctggagtcactatggcagtggcttgcgcgtcttggctagccgaggtgggggaaaaacagcatctgtcaggaattcgggcaagttatattgctcgtgacgcttctgtcactcataactgacacccgccaccggagggcaggagaaaattccatgcttctccctctctgctgtgaatgacagcgccgatattgacccgatggcgcacgcatatcggtctgtttactcactggggcaggggcgattatgagactaactctctctgttctacgtaaccaacaaagaagaagagaagccacaaccacgggaatgcacatgactctacgagatagctgtcgatctttttttaactttgctgcacaactttctcctcttacgtacagacatttaggagatagggacaatgccttagcaacgttccttacaggagagtgcattcgcggtcctatggaagaagccgcgtctgttggcagtgagcattgcttgtgtatttgtatcgaccgtatgcgtgtcgtttgctctcaccttacatcgtgtcgcagtaaaacatcacataatccttccctgtgcagacagcgactgaggtaagctgagaaattgctggccctgtcgcctccgagaaagtcttagccgttacggaacatgcttgacgagagacacccaaattcagagatacaggaggtcatgcctcgtcctgcccctgagctagtcttctatacaatctttttccagaaacagtagcggggcattgtgtttcagagaagcgtagtcgcctgtagcagatctcgttcgaatggcagcccgaagacttacgaggcttcttgcttagctcttgtttgccacgaggcaggcgacatgcccaaagcagcctactgttacttggttttgcggagtatcaggtttctgagcattcgcttcgcccgtgctggagcggcccgagggctctctagctcctaaggcagcctcttgtggagcttgccagctttccccggaaagacagctgcgtgttttttgcgaattcagtattactgaaggcatcccccggggtgcgtgcaagcgtaaacggtacacttcagatactggaaaatcgcacatggcgggacttgccatcaacgaaataccgtggcaagctgtggtacgtggtcgtgcttctctcctggctttgcttcctttcgataaatatatcatgtctttgcttaattaggtgtcctggaagtaaggcaagagggctgtttgctgaaaaccttccttgacaaacaggaggacaaggtacatcacccttcccccctctttgcctcaggcaagccagaagctctggcatttgccgtcgctctgtcaccaccaggcgcggcgggttcggtgcatccttgatggcacgcaagtgcccctccaaaacgactcttcgctaggaaacccaactgccagggttcgtgccccaccggctgttccttccttgtgttccggccgagcaattccttttcaccagaaatgtgttctccctcgtctagaaaaccaatccatcgagaaacacaagcgctatcagcgaaagaactggtgctgctcggtgaaacagctcactctccggagggtttgaaaagcggtcacgccgtgcaagggcccccgagcatgcgacccgcaagccgaggcaaagttgcaacggctcggtggtttactcaaaggaacgcctccagacttggtccgtaggtttccgaaccttgggacagctcatgtcgtcaccgcaaaacactttctctggagggtgaacagagagttttccagatctggggtggtcagagcgatacgcgcttcgcacaacaccccaccgttccgccggcgcgttcgcgcccagcatctgtcaagttgcaaaacctacgttattcgttgtcttttacaggtttgccgcgcgtgaaaggccgtgctttgtcctctctctgtcacttccgtttgaaccctcgctgacttcggccacgcattcacccggcttcgcgcgtggggtcggcgcatcccctccggtattttttggccgaggccaagccaagttcgcgcca

SEQ ID NO: 493 - DNA, 1221 bp, Toxoplasma gondii
gtacgttttccctctgcagatgcgtgttcttacagacccacctatatatatatatatatatagcggtccaacggattttgaacttgtgctacatatatatatatatatatatatagaggtagatccgccagctgaggctttcgaaaaatgagatatattcattgttgtagatctacagatgtacgtacagatgttgacgtataaacatctataataatgtatatatgtatatatatatatatatatatatatatatatatgtaaaccaccaagagcaagcgtctacagatatgaatgtgactgcagtatttttttctggttgtctgtcgggaagcgaagaggcttctaggcgaggtcttcatgttcgtgaggcaggcgttttttttcgtcggagaaggtcgcatcttggaaccggtgtgtttctgtgtgactcggagtcgttttccagaactaacgcgattacctctttccagggaccacagccgcggactctctttcgctctgcttcgacgtccgtagagagccttgaatcgagaaaaaaagttctgttcgacgtaggtgaatcagattcatgtaatgaaactcagtgcttcggaccccgaggaggttgttggttgcacgttgccgtgagagagtgtgacattttgtcgcgcacagtcgcttgtctcccgacgaccgcgagactggagtctccgttgtcgtcgcctgttttctcctcttgacacgctgtgtcgcgccgcctctctatttttccctataaagacgctgcatgcgggagtctcgtttcttctcgcgagttgtgtcgctttttctgttttcctggaaaacgccttttctcggccactgcatcgaagggccagccagggccggaatccgtttggagagctgttctctccgctgttctcttctcgtcgcgcgtttagtctttctctgctggattcccccgtgacttccgatcccgctaatctccttctcggcagcttctcttcgctttttctctcgtggacatccggaggtttcttcgactgcctccagctcctccctctccacgttcttttcgcggcactgctcgtccacctcgcgtctccactctctgcagatcttcatcccttctagccatccagttcgcgaacaaaaaccgctccaaaggcgccttttcggcgaataatgcatgaacgttccgcgaaaaaattccaacgtccttcttccctctcgcaacca

SEQ ID NO: 494 - DNA, 1922 bp, Toxoplasma gondii
tttgcagtcgtttcctctccaggaactccactgtctgtcttttccgctcctgtcccttcagtcttcgcctctggcaccgccgaaccgtccgcaggagacgcatatggctcttcccttccttttttctcctctttctcttctctcggggtcttttcagggtgttctgcgggtccacagaggcatgcagcgctctggaaactgcctccggattccccccgctcttctttcgcggggacagctggaaacgctgtctcggattctcccgtccctgcatgcacaggagcagcccgcagagaccctggcgcgggagcggcctcgggtgtacggacagtcccgtcggacggctccatcgctcgtgttcgtgcctacagcggcgtttcgcccggcgaatgcggaagagcgaagaaagctcttccgagagaaaggaaagaaagagactgttgtggagaaggaagaggagaggaggagaggcacagcagcgaggaaacacagcggaaggagaagagagtgctcggactttcacgaagcacgctagcattcacttgatggcgagaaagaggcgaggagacgagaaaaacgcgcgcagaaggagaagagagggaatttttgcagtgtgcacaagaaaagcctcggagacagatggacgaaaggaagaagagagactgcgcgcgacagaagaacgaaaggagaatggtgctcgaaaggaggcccgaagccacaggggaaagaaacctcatacagggggggaggcagagactcagaccagtcgagagactcgtaactcgtgaacgaaagcgagcttgtgacggaaaggaagagtttacacgaactgttgagacacgaaaagtcggagaccagagagatctagaaacgttaacggggacatccgcacaagtgcaagagaagccggagggagaagggaaacagatcgggagagacagcctcgcttgaaaaaactaagggcgtagctcattcacatgccctaaataaaggcctgtcgatacaaggtaatggaaagcgacgcttgcagagaaagtcttcgttgttgactgtcgacagagccacacagaggcacacgggaaaacgggagagacacagttttctgcagcccatgcactttgtgtcgctgtcgttctacgaggactgaggcgaaagaacgacggaagagagaagagtctgaggaaattgttcgtcggcagctccggaggaacagaagcatcgaaggtggtctccatatccaacatgagcatgcatgcacgcgtgagccgggtacgagtccacgagaagaaggtaaaactcttttctttccgctgacaactgcactagtttttcctcgcgcgaccaacgacaaagcagagagaaactctttccctgacggtacacgatgcagctgtctgtcgaacggattcgctcggcataggctctgcagggacacacagtgtttccttttcctcgccgacccttccgacaacccccgtcctctgctcccgtcccttccttcggcctcttctttctcgcttctccttctctcccgtaaacttcgctgcgttctgtggcacaccgagtctagaaaatgccgaagccatttgtctttgctgacatcgagcgctgacctggtcgggtgtacatacacgcccggcggtttggacgaccgacacgcgattcgcttgcacgtccatttctgcagttctggctcttctgaatggattgttgggtctcctgctgagtttcgactgtgcctcgttgtctcctgcgggtctgccgggcggctgcttccctcgttggcgtgttcccttccaatttccgaccgcacggtcgcggaactcacccgagactttgctgtgctgacgcagtcgggcctgcgcgaactggctgccgcgttccgtcgctcttccaccgtttccaaacttctcgaactatca

SEQ ID NO: 495 - DNA, 2979 bp, Toxoplasma gondii
ctcctgtatgcctatcggaacagatatccatgaaagtaaggccaacgtacttgacttcctgtactttgggcagcaattcgtcgttgatgcgtttaatgaagcttttgattttctcgcgttgacggagaaagcagaggaagacgccgtacatgtacgcgcggtaaaagcagcatccgtccttgcgtactcttctcatggtccatgtgccctcagctccgtgcagagcatcctcgtgagaatgtccggcttccctctcgttctcttctgcgccttgagctctgtcttctgttggactcgggctgcagcaggcatcccttctctgctgttgttccttgacgaacgtccgcgccttggcacagagcgcagggttcccttcgaaatcccgacacaaacagtccagactctccactttccctacaagtggctggctctcgatttcctgctgccattctggcaacgaattcccttcattctcttgaggtgtccgtggtgcttctgccatcggccctgcagaggtgttagggtctgcaacaggttcgacccctccgtttgaatccgccatgttcaatttgttcacaaggaaggcgagagtaaactgttcgataaacacgctttttcccccgttagacacgatttcggccagaagaagcaaggagggaaggtggcaaggcaaagcaccacgagaagaaaaagggaagtgaacggcagatggacgccagtgccgaagcaggaggccgccacgcgaaatttcgagatacttcgcagcatacaattcgtgcccgtctagataaatacaaggatgtcgtgagacagacgatcaaaggaggtgtggctgagcacggcagccatgtcggtcgaggggctctaggcacacacagtaatgaagttagtgagtttctatgtttcacgataaacacctgcctaaaagaggagaaaacaaacaaaagacgcacagaacagaggggacgcatgcagagaaagaaggtaaaaatgctctcgagcacacctacatgaggaggcgagaacgcagcggagctccggtgaccctcggccgaagatgttccagacggaaaaaccgacaggtcgcacccgcagtgaatacgggcgttgttgcccacgtttatgttggaggtttttttggtgtgcaacgaaatcactggatacagctgcacggaacacaaagcaacgcagaaaggacggtagaagagttttgagtgcatgcgcttttgaaggcgaggtgtcgttgtagtaattccagtaccagggtgaagcagccggctccatactaaaagacctgacacaaacagaggtgtggaccgtaaatggtacccttttcttgttctgatggggtttcatcgcagaatcaaaagtcaaacgacggaagctcaatccctgcctggatggaagcggcgcgcggctctccctatgctggaatacagccacgagtgagatccttcggcgaaaatccgcccatatctaactgaaaggcaaacaaattccctacgaaaagcccaacgtgttagcactagagtcgcttcggatggcagcctgaaatcccgaaccagtctcgttacagacaactgttgcatctattggaaggttgaaccggcggacaagacgcagtttatggcaacacaccccaagaagcccgaacgtcttgaaatgcgaacgacacaaacacaccgacgagatacgctgccttaatgagagatgctaggtatagcacctttttgtacgacggaatgatactggtactaagcatgctcgctcacttttcgtatgtatcagagtcagtttaccactagaacccccaggctttctccccggtttcttggcgggcctttcatcttttagggacctgtaaaggacatggtagtgactcggttgcttaggaggaagcttgtgtcaagacataattttctcgttcgtcaatcttattcgtttccgaacatcgcaaaggcattctacggtgttgcacctcgtccttagaggtactcattatactgtggtactatgtgctcagcacggtgagggaacagcggttgccgataaggtgcattttggccgagaaacaatctagaaaatgtaaatataagcaacggcagagatttcattccatctgcgctagacgtgtggagcgcctccatcagtttcatcctccagcaagttgccagttgcgccacgtggaagtacgagtagtgccacgggtacacgggatagcagacgccaaatgttttacacatttattgttaaatgcgactacgcacatgcagacatacatgtatgcatgcatggatgtgaaaacgctgtgagtggcggtcaaatattttcattcacgactaaatatgctcacagtttgtctcccagttactcggtcacctctctgaactacgattcaccggcgcttctgcttgtctcgtagcctacaccggcgcaccaactcgcccgcttagactctctctggaagtgaaacagaaattaccagaaaaaagtgaaggaaaccgcgcttatatgtgccctcctttatgcggctggtggctccgttgttgtgttaaactttttcaaacaaaaggtcacgacatcaaaatcagggactgaacagcggtggccgcgcgcggtcaccggggacagcggtcactactttcatccacgacaaccttttgtatctcagcgaaaagactctgcccgcgcgccaccccgtatatcgcggtgtcctgataagcagcaggaaggccgcgatgtttctctgtgtgtatttggtcggcgcgtctgttcctcaacttttcatccaagttttcttctctttcccttttctgtgtctcttgtaaacactttccctcgaaaacattagggggaaagttttcgcacgtcattttccggtcactcgttctgctggtcgaggatcgtcgcgaccgcttgctctctttactgtgccggcgcttactcacctggtgtttttcaaacatcttttaggcacaa

SEQ ID NO: 496 - DNA, 1717 bp, Toxoplasma gondii
atgtctttgcaccaaggtgcgacacagatgagacgagcaaagaggcgaaagcagcggagaagaccgcacagttggtttcggcgttcgtctgtcagcagacaagaaacgcgatggcaccttcgtggacgaaacagaccaccgaaaggaacgcaaaagtggaaaacgagaggaatctgtcaccgagcgagggacatgcccccatggctcgtgggaggtgtctgcggagacagcgacgcgcagaaaacagagacggacggagaaaaatctgaactgattttgttagacgaaggaatcatcttggccagcgcgagacagtgggagagggaccgataaagaatcgaaggagaggagcgaggacgggggcagaaaaacgaaacagacagagagaaggcaagttgcctacaaaacacgaaagcagtctggacaaccggctttgagtcctgaaaaccgactttgaagttgcagacgaattgcaacggcatgacacagtggcgactgaagatttacagctatcggcgatgagacttgtgtccctggacggtgcaggtagaacggttggtagtcggatcgggaccagcaaaggcgagaacgggaattctcgatctcaattcaccgcacgcttgccacccgcacaagagaaaaacgagacagaaggagaggttgacaaagccaccctggaaaacaatgggacttgccagcgtgagagaaatctgtgccacgagcgagccgaaggaaaagcgaagaagacacaaaggcttttcatgacagtatctccgtcgcaggaaagagagaaagacataaacggcgctgcaaactacgtgcagacaagccgaaagacaaaccaagaggtttttcggttaaagtgaaaatcggagacgtaaacctgtacaactgcgaaggggcgtcccgcacgaacaacgaggcagccacgggaaaacggaaccgttcccggcgcaggtgtacatacattcgaccacttcacgtgggacccgggctagccttcaaatgcacaaacgttccctgaagctgatgagggtttgtgttcatcaatgtgtggaaaccagcgagcagagcaaagggaacggaagcaggcaaaaaaccggctgggagtctgagccccgggtcgactcggaggcagagtgcggaaatcttgcccccttgcagcgcgcggaccgaggaaatgagacaaaattcgaagtcccccttcaacctgggagactgacaagacacgtgggtttcccagaactccttaggaaagaaaaactctgttcgattttaggcgttttccagatcggcaactgaaaaacgagttccgcaacgggcttgtaagacacaccagccaaggtctaggcatcagcgtgcggaaaagcagacaagggccacgagtgcctcctcttaccggtttcctcgcgcctggctgcctcaaaaacaggagaataaaactcgaagcagagccagacacaaagaagatacccggctagagtgtccttcgttgggtaaacatccctcccatcaccgcatagatgttgactcacaccccgcctgctttctgaaaaacagctagtcgagtagttcggcttatattcggggtctcgagtttcgagacacggtacatacacttattttccccaacctatcggcttatatgtggcgcgcgcgacctgcccagccgtcgcccttgggcgtgcgtgcaccgctacgtcggactatattcgaa

SEQ ID NO: 497 - DNA, 2471 bp, Toxoplasma gondii
ggaaggcatgactgagaaatcccggctctggagttccggtgtcttcgctggcagcatagtcgggactctgttttgcgcgatattttttccggttgcaccgcttgtgattctctgtctgataattcagtggcttgcatatatttggtactctcttagctacataccttatgggcgcgagagtgtcttgtggtgtttcagatggataagttcgaggttataattgaactaatcgagtaatagacaggcctcgtgtctggcactgcttgtaccatttgtgtgcgcgaggcgtgcattttcagccttagctcctgttacgcgtttctccccggacgcatgtgataatctgaacaagaattccccgtctagcacagacgagatagtcgctttcgggaatatttcgggagggagtatcactgacgaggagacccatggcagtcgagtctccgagatcaaaagactattcggactgcgtgtgcagtagtaatctgcgcatgccatacgtactttagattcactgtcggttctccgatttcgacaacgaagaacgccgcagtattcgaggagcgttcgcgaagtggcaagacctttgcgtggtgagacagcagaggatgcgatcaatgttatagcgtactcctcgaccaccgcaaagctgaacctcaattttgaaactgttccttgctgttattttgaacacttcgttgaagttccctgcgttgagcctttctgatagtgcacccgaaactagacatggtgaatggagacatgtctctggtagttcatgcggagtctcgccgtgatgatgtggtgctattatgtttagtggctagataacaggaactgaccgacagtagcacactaacacctgcttcttactgtgtgacagtctcgctaccgctccttaactcaacgatgacctgggatataactggggggcagcagtcaacctcaaaaccaaacggggaatgaaagcctacaccagagaagactccggtgccagtgatcacactaggcaggcagacatgggtgtcggacatacattaccttttgaagacgtagatgaaaatatcggtcgtctgaattgagtgacgctgagaacctgttgttgtgtggggtgctccggagaaagcggcaggactgccacataagcaggtactcagtgggaccatttcggttgtatggtgggacgttcacggaaaaagcatttaccgacaggcctaagcttaccttttgtgacgcagaggtgaactcattcctctctaaaggcgtaccagtttcccttctcgaaaggaacgggtgtcttttggatccatcgtgaccacatttgcaacgagcggaagtggtagaggcgactgtgtcggtcgctgcctttcaacggagaacccttgcagtacgccagggagataaaggcaacaaggatactctgcgcatcctgcggtaatacgtttacaggttccatccgggtacaccatggaaaaagtgacacttgatcacgcaggtgattattcacgccaagatggaaaacgccctacaggcaagatacaacactcgccgctaacgctcacctgttccaccagggagacgatgatgcacctggagtcttggacgtctaaactgttttgagttcttgtcattgaagaaaacacgccgagtggatgtgcgagaaccgcgggaccatgtgtggctttggatagttctatcacgtgaaatcgcggtcgaccccacttcatccttcgtactccacgacgacccgagaacgtgcctgcctacagctcgcctcccagcgcactactttctgcgacagcacgggcagtacaagcgctctccttccgggtacgacagtccgtcacagatgtttcggacttaccctgagctctggccttgcatcattctccctttgcaaacagcagctgtcgccctgcccccctgttttacttgtgcctcgccagcaggcaagtgtcttttggaactgttcgctcacgaggtctcacggaggaagacctcatgcggaactgtgtcgtacacttatgttccaaaaaagttttcctcgcatcgaaataacaaataacatcccggcagcaatcgtaaggtggcgtatttctctccttatcccctcacactcgtcagcctccaccgcgagtcttccattgtcgctgatatgcatgttggcgtttcaatgtgtatcgtgttgcagtgagctaccacgggccagaatcccaatgacagtgtacttgcgctccacaaaaaacgcgaagtaaatggccgagagcttcgatagtagagtgtgctccttcagagatgcggcggctgaaacagatttctccgcgaaagaccttcgttcgcactgtgtcaatggtcaaatggaaattcgctgttcgtcatcgcgtcgtgtctgtgcgaagtgtggattgacctccgcattatcccaggctgcaatcggagagcgacacagggtggtggcgagtcgcgcaaca

SEQ ID NO: 498 - DNA, 5008 bp, Toxoplasma gondii
tggcagttgccgacgaagtaagaggcgaatataaaacactgttggcggtagtgggggaaaggtcagcctcgtcggaggcccgaagcgaggagacaaccgaatggggggaagactgagacgcgcacgttgacggcgtacaggcggccgcggctggcaatccagtacggtcgctgttgttgattgggcttggagtggcagaaggaggtgacgctgcagttgagagagatgcgacagggttaccagacgggaagagagagaggagtgcactagaagacgctgatgatgtgggggtctggagagccgggcagaccgtcggaaaacaaactgaagctatttcggcatcggaagtcagcaatttccctaaccggtgcttcactattgccggtttatcgacgggagattcctctccaccagccaggaacaactgaatgttgtcttcgttgctcggtaagccaggagcctccattggctttacaggttctgaagtatatactgcatccgcaagcgaatcagaggatgactataaagaggcacaaactaagggtacgcggtcatcaaacgccaccagggtcattcgggcccctcatgaatcacagctgcacacggttctaaagattccccactggcgtcctgtgagtggcaagaaatcgcatctccgccaccaacccgatttccctgccgactctgaattcagaggacaaaaagtctcgtgttggaaggaatttctgtgagaagtcggctccagcaccgcagagaggcttctccaggtgcttgcgccattagccggatatcagaggagtcgaaggcgttgccaaacaaaatctgcgagagtatgcggaaaaagtgcccaagcaggacgagcattcataggcgcggcgaaaacttgaccgagtgttgcaaacaccaacgccggcatctgcttcacactcggcttgtgtgatacggtcccctcaaaaaacgtgacgggagacttgtgattcgagagaggaaacaaaacagatgcagcgcagaaaagggagtacctcgagaaaaggtaggaatggagaagaacagacgagcaagcgatgcggatttcctccagatacatcgcagttccactgtatgacgtttgtttctgatgtgtgctcgcactgagacagcagaacggactgtaaggaaactggcaacacgaatttggagggaagagtcgagaggcaagttcggcccggtgcgttacacgtcgtacaagccttgcagatcgacaactacacaactgcaaagcaaagagatgcagagatcatgcatggaaaagacaaagacgcttgggttgcaaatgtcagaagcggcgacaaagcgcatcgcagagcaggcgttctcttctcagtgcgagcgagacgcaaaaacgtggggcccgaatacgcggcgtggctcgatactctcagactcagttttgataccttaagcgaggaattgacctcgtttacgggaaaataaaatgcaaatttgaccaggagaagcacgatcaatccgcgtttccaagcagcgaactcacacttgctgggccgacgtcagacgcacggcagacgcaacgaagaagcagaggtggtagatgagggtgagggtgccttgtgcggccatgcgcaagcgatgaccaaaatgacgacgggcagcgccttcgctttgctcactggcggggccactctcgtctcatgtgcagtgcgctgctgcggtagtggaggaagaaacggggggacacagcggccgaaaagaaaaggaatcctcaggagacgcacggcatgtcccggcctttctccacctttcaggcagcaaacaagcctttacagaaaggtacagcggctaggcacgtttggggtcgtaaaagaaagacaagttgcgagtgaaaccacgccaagaagtgaccgccagacgagagaagcgtgcggcccgtgcaacacacggacggtcccaagaattcgagaaaggactcagaagcagaagaggcttagaggggtgccgttgcttccggggacacaacgggaaacttgaaacacaataggaacctgagaagtatcccaaggaaacaaataaatttaactgttcggtttacactacatataagccaacccttcagaaaatgaagaagacaaaggcagtcgcgaggggcgtgcagtcaggggtaaccagacttccggcctgcttagaagtcaaggccggacgttaatgctgaccagggatgtagagccaagaagcgacaaggtacgtttaggtggaagccttcagcttgttccgatgcattaatcacaagaaatggctatgggccagtcgaagccacacatcagtccgacaccgcggccacagtttgttccgcaccggtcgtggagcgacttctggaagcgcgagtaagtccgtttcacatgccgcgatgattgacgagactccggcgtcccggacatgactcctctgtttatgaaagaacgctccagagggtaacagaacgaaggctctgacaggaccagagaaaattagtttcaaaggagcttggtacaagccaagagcaggcggcaggcgggtggaccaccgtggacttcctgtctcgtccttcttcgaatcgctgtacgtcatcgttgccagttgcgcgggcggcactatctcatagcacctgcgccgtaggctgctacgcctactaatgtgtcgtcccatcgatatcattatgggggctgacatattccaaagtggtaacgtgccaaagattcacctaccggcggggcgcgccatgctgattctgttttagagatgcatctagagtcacagcaatgcgatcggcgagtatagaggtgtccgggagtccaacccttcgctccaatatatgtggtcactgtttctgcgacacttgaggtgatcccagtcgcggaagcagacctgtcgcgcgcacagatggtgtcaactgctgtgtggaggtgcgacatttacttaactctttagcacacacgggagaaatagtgatagagtgctgctgcagaccgtgcatctggtgacggctttaccaccagcgaaactgtcgactcggctgtgggttcgatctctctcccgggagggccctccttggcagtgctccccaaagcaggcattcatcagaagagacttacaaccgtaccctgcttagatatattcaggatccaatgcgtcgcccgacacgtgttgtggtccataaggtctggattcgcatgctgtatccttcgtcccagatcagctaggttggccgctttgcgtccctgatatattttctgatttcacttgttgaaacattgttgtccccccgctgttgtcgtgcgctctgaatgaggagcagggcgcgttcgtcattctgtactaagcaacgctatgcgaaccagatagtttaaccgtgtgtttctgccggctccgtctggaaataattgttaccgttagcacggatgccgccggtaacccagcaaccgcagctcactgtagagattaacctcgaggtgacgctcgcctcagggaccacacatttctcccatatgcagaatgcgactgtgccgtcagtggcttcaatgggggaaaggctgtcgagttcttctgtgtaaacacagcggagcaagctcatctgcagacacaacgttgtggtgaagatcacttacaaaaacggcgtcgcactcacctcatctggaccaaaaattatcttcatgtcaacgctacgactgtttgtgagggtgcttccaccgctgcgtcgtgttccaaatgaaactgagaatcagcttgggtaaaaattcccacaccagacgaaggtaaagacgaatgccgccggtcatctttttttctgtcattctccacacactacacatggtgcgtttttgggccaaggttgcgttgcgaaggctgcgcgtgtgcgaaaggcgatgcgttaaagaaattgtcaacagctctcgcccatttcactccgcagcatgtgcttccagaatctcccagggtgctacggacttgtgtttgtccttagccagtatgaagggtgtcggttttagaactaacggcgacagatgcccgaccacctcatttcgaaagtcgctgcaacattccatgagctttgcggtataagaagctgctgaagacacccacgagcttccgagagggcttcctgtcgtatattatgtgaccacgtcgtcagattctcgttacacaaaaccgaatgtaggcttgaacggtggtggtgttacttacagtagaagaccaccaacccggacacggagtcaaaaggccacatttacgcttaatgcacgccaacgcaggtccgcactcccatcccatgcgtccttgggacttcgccaaccacccagttctctcttactgagcttagaatggcgcggggaaatttgtctccctcagaaggatctgcaaggtgttgcgctcgaagttttttgtggttatgcgcagggcgtagccagacacgcagtaccctctgaaagttagcgtctcaggtctcggcaggacgttgcggcaccgaaatcagttgactgttgagtgcgataggagcaccaccacgagcaacccgatcccttctgcgttgcaagcctgtttcctctgagcagcgttttcgagagtacatgtttctgcctacctcaccgccgagcaacgggagctgtcacagtgaatggaaacagaaacacttgtccctcaagggcctaagattggcagtcgtatgatccctcccagccttggtgggtcctgttttgatgctctgttgcgaaaagatctagtgcgttgggtcagtgaagccaagttcatgaaacacttttctattgctgctgagttcttgtgggcagataaagatgtcgcatcacatgagttgtggtccgacgcttcgctttttctgatacatgtatttgacgtctgatcttttcccgaatgaaaaaggggttgcttcaagtgcatgtctgctgtcggaagcacaccggcccggtttggatcgcatgatgctacagagtgtctcccggaaaaatcgtctcagcgacca

SEQ ID NO: 499 - DNA, 3516 bp, Toxoplasma gondii
gggtttcgaggttgctggaggccactgaaaacgaggaaggaaggttgccgagcgctgcggggacaggtgcggtccaaacgcttgcttcggaactagctgctgggtcgggggtacgaggctgcaaggaaaagccaaacggcgtgggagctgcagacggaaaatccaccctatccagaatggcggagatgaacgcgattattcagtgtatgcaaccggaaagaggcatcgtggcgtgggaactgcgaaacccccctcgtgttgtgacagcaaggggaagaggcctccgcggacaccatcagggtcgttggcgcgagggagtagagcaccggcttggggagaacgcacatgataggtctggcgggattcccggcatgtttgcgcgtcttcgtattctgaagaagtcagatgctgcagagtcccggagagaaaacagcaatgaagaacacgctgggcataccttgcagagcagcgtgaacggagagagtgagacaattacagccaccgtggcgggaaaaaaggaacgttttatggttcaggtcggtgctacttagactggtgttcttagccgtataaccagagagtttccaacacgggaaggatagtgactgcgttccagcgacaggcatagtgacttctgatcactcagtgttcagttgccgtctcgtttggtgctgggagagtttcttttcaaagaaaggatcgggccataaaagtgcgcagctggtgaaatccaaccaagcgctgaataaaggaccgtcaggggtgcctgcagatcagactgtcttttcccccattgtcctgtgcaacggtcacatatgctatagacaccgagtttagtcaacaaaaggttaagtactttcggtggtgtgttccaaggttgcaaaaccccgacggaacccccgacactacacccagttgattctccataatttctgtgatgcgcactctgcggctggtgaaccaggaatacgaatgcatcggtcattgtgcgcatgtcaagagactgagcgatgactagaggcagtctcgtgagggactcattcggtgctgaactcccgctgcacagccggaggaatgaaactgtctcctatcaccgttaatctacagtagtacgcaggaacagcgatacccatgatttggagctaagcaaaaacgaaatccttgtaggggttcgaaatgacacttccctgtcgcagcccatccactctcacgatttcaattcatcgcagcggatcacccggaaaggtttgcgtgcattgctctatattgtcggtgaacatatctcgctccgacataggttacggaaataactcggattgtgtacgaagcgctaactgtatggttggaacgctaggcggccgtagattgataccgtaccacatcgtgtatccactttcctgtaactgcccccacacctgattgcagggcctctattcaccgtgttaggatgacttctgtcaaacatctagtcacatctatctctcacggggatgcgcagcacacacgcgctgagtgccgggattcacggagcgatgcacacttcggtgtaacatttgtcggcgttttgacccataccggcaatgcagaaagcgatggaggagaaacattcacagggggacagactgtcaattggcaaatgtcctgcggggctgcagcgctgggctaattctctggtacaccttgtacctacagctgtagggaacatgagtaagacctgtggtattgtggacgcatcggaaacgcatcctgctgctgttcccgcttgacgctcccacatctagtgctgcacgtgagtgttcctctgtgtttagcaaggggcttactctgtgttggtttgctatgagcatagaaccaatccggtagtaaggtataagatggtaggtggtacatcctatgccctccgtggtttgttcttcttatgtgaacatactctttaaagtggactcagggataaacgtagtgattatcctctcactctttacaactgaaactcttcgggtacttcgtgtaagcaagcggcgcagcgagcagcagggaaaacgattggttcttcgtggcttctgatctactgctctgtcgaagcctcttaagaaggatccttgtgaagacaccaagtctacacaaacgtttcctcctgagtccactcgtacgtcgaaacattttttcggctttgttgaccacacagtctccgagaaaccccacagacttgagtctgcagactgcagcccatcacggcggtgacgaatttgtttcgtcgtggaagtagcacataactggaaggagtatgtgtttacagaaaagcaaatgctcaactgaagttctggaatgggtcccgtgcctgtgatagcagatggggatggggctccatcgctcacacaacgggacttgcgcgctggacgtctcagccccgacacagttagacactgaacgctgccaacggcgttcaataaatttcatgtcccgatgagatgatgtacgaatacgctttcgcagaaggcggtgatcagtaccttctccgacttttttgtctcaataggagcatagttctgccgtttggttgtttttgtagactcaagtatcgtcggtagtaacgcggttgaagccacccggtagccgggcgcttgtcaacccgatagtttttgtgaccagtaccggcacttagcgggtttgcgtcgcggaaacctgacacactttggaaatcgcgaaaatgtgcagtggttaggagagtgagatatcattgttacacaccaagacacactcacctcaatagtcgctattggaaaacggcttccacgacagaagtcgggaggtccagggggaaaatcgtgtggctgggggtacgggtggcgccggcggtgcagcgagcttttgctggtacgccttgccggaacgggaaaatttcgtgacggaacatgtggctttgcatacttgtggagtaatgacggggcgtttttgaggtccgcgaaccgagccaaagttgcaagtgtctccctacttcctcccctccctacttttgagctggtagcggaatgccggtggctttgtcatgcatccgattgtgaatctcgccgcatatttgcgcctcatttgtgcctttccatagttcgatactcgagtgttgcgggccagtcataccaagggtgtcttatctagcccagggaattgtccgaatttcctcatcaggctatgcggagatggccgacggcgaaagcgcatacatgacaaattttgtgagcagcttccgcaaatggcgttactcggagctccacctgatttttgagtctgtatagtttacaatgtgcgtgtctgattcgtttggtgagataaagtttctccgtagagacgggctgctggagccttttcccaagttatcgatccagacttctgctgctagtcgaaaataatggtggaaacgtgaaacgcagctgcagttgagaaacagtcgttctctccaagctagtccttaggctcgccaggagagtaccgttctattacctcttcagttgtaacaagcaa

SEQ ID NO: 500 - DNA, 4293 bp, Toxoplasma gondii
atgcaccttcactaggagtatatcgtgatgcgatcttgcaactacttgctcgatactctaatggtagaggactacactcatccgactgctcggtaggccccctaggtatttccgaagaacaagtctgtttatctgcaagctggtaaactacagcagtggcttcatcagtgtctttcacaccttcaccctgactgctgtaagagctgcacgcttccgtacgattcgattctgtgggtggctgctgacaagatgggatgccgttggctccagcagcgtcataattcaactggctagcagtcctctgcgaaaccctagtgtctgacacatgtggcacgggagacgacgccttctcttgcaacttgaatggatcgtgaaggagacggtccattccctcagaacaggggaagatagtttccatactatctttgctgggagcggttcgccccttgacggaggcggaaacaatctttggcaagcggcgggcctcgtttcgaacagcaagcaggtaggcttccgcgagcggttgaagcaactcacaactagcttcagcatctccgcatgcatccactgcactggaagctgctgcaacaacttcggttgcgtcacagaaggcgtccaaggcggcgctggaactggccaccggcagaacctgctggggaaggagcgagtcctcccacccgtcatcggggactgagactcctggtacttgctctgatgcattcatctttactattgatgaagacagcacgaaatgatgttgagtaaaatggctacataggaagaccaaaattgccagcaactttcgagggacacgattgtagagccacgactgagggaccaacaccggctagtagacaaatggaacaggcaccttccgcggaaatgccagtatcgcgactaccatacagctgtgttctgtgctttgggagtgggaagaacagaagcactccatgatcctgtgaaatggcttgagagtggactccaatgcgggcctctgaaaactttcagctcgcatgcaccggacggccttcgcgtaggctcgcgtgctttttgacagtgctgaggaacatcactgccttgctgaaggttccgccccatccgatagggcatatgaatcaaattttatcaccgaaactgcccatcaagtttccacgcgtgacattcttgttgtttttaaaaaccgctgaagtgcgtacggtctgaatgattgcatgcccggttgcatgcacgccatccagcagggtccgagcactgctgaacgctaccctcgccaacaggtgcgatgttttcagcgttaataattgaaaagatctccatatgaatgcaattcggaagggacaggtttacgtgggtggtttcctggtactcggcgtctccgtagacttgaggtcggccgctgcgtggctgttgaacacttcatttccataggacgctgtaaatggtatacttcttctgccttggacacactatcccatccactacgtgcggcgcagtggataagttctggcgatgggacatctactcagtagagcggattcaatgtgtgcagcacgtccgctgctccttaacacagtagctatgcctttctagctccgtcgtatcatgtggcacactacgacgtgtgaaagttacaccatgcaacaccttgaaacaacccgattttcgagcttctttgaaattatatagcgacatagtgtcgtatacaacctgaacggaacttaagacagatcagcaggggcttttgaaatagcataggagacggcggtagcatctaaacgaaaatcgttgttcttggacgtagatgcaccggtgcacgaaccgacagcttcagaatttgcagtcgcaggggaaataggcgttgcgacagcagaagtgtctcgtaggaaatctcgactcatcattgatttcattggaacattgagttatcaagcactagctcctgacatctacacgatgtgcgaccggtgttctagcggtggttcacgacagtctgtcagaggttcaaacacctgaggtggcagaaccgagacttctccgacattttgtcactctctcgctgtggcgaaagatggctactgacttttagagcatgcgacgcaccagcgggattttccagctggtatcaacagaaaagatgaaatgcagttagttgttaatatacggaaatccataaatgtgttgcataccaagtatgtagacacctgcctccagtgtacggattacatgcaggtattcctctatactcacacagacgcttatcctgtaggttgccccgatgagaaaccctttattctccgtttagtatgttgtgtttacaaacacgcggtaaacattgctttgcagcttggttgagacgatggcctgtacttgcgttgggggcatttcacttcatatagttgagtctgaagcacttcgatgaggcactatatcgcccgcggttcgtcctggtaccccctttacagtgcgctgtggtcatcctgtgccgcacccgtcgctggtttcgacgtcagcacgcattagactgcgagcctgcgagtgaatctgtggtctacataatctatcatagtggaagccttttggcaaaggcaggcgatctacaaaatcaaccgcttgtgatgcagtgcgttctgaaaacgatattatctgtggcatgtataaaacatggacgtagtctgaattgcatgcgaaaataacagtatgagggtgtacaggacgcctagtgaactgctaagcaacatgcatagagcacccaaccctctgctatgatccaactgaaatgctgcatggatcggtgctacagcaatcgtgctgaacgtaattagaccacgagagcttcgtgtgaaaaccgcaccggagtgtccctacaatgtttgaccgtcattaagcgatgaatcttatttttcgtcgaccaacacatccgatttttgaatgtcatgccggaggagttacgcggtaaagccttgtcagtcgagaacacggctccagtgaatctgttccatctcctgttcttgtcatatttggttccacagtgtcgatgaatctcccaatgtacgtcattcgttgtagttcgcgccgaaaatgatgtacagttttctggccgcgacgctcctcctcccagagcgcgcatgttcggagcaggtcggggatcacctgtcccctttttctgcttgctccaccttattgtttcggaatgaaaagacactgcccattgttgcgtcaataatctgctttgtttccattttccccgccgtggtttgtgcccatccttttcttcctccctgcagaaaatggcgttgtgaaagatcgccttttgaactggcagcgtacggggcgcgatttgctcatgctgcggaggtgtaatgctggcttacacagagcgtattgaatacgaaatgtgcctgtacacggacttggaaaagtcagccggtaaagatgagtcgtaataaaaagaaaggggtctcctctagtcagagacctccgtgtcgctgtttccactcgacaattataccacagtagacggtttggaccaaaggagcagcggaaagcagaggtttctctgtcaaccactgttttttggtgccccagtttgatacaagcagcaagaaaaatagtagctgaaggtggatcttgagtgagggtttccttcaagcaacttcccccaatgtctgcaagtgcgtgcatctgtgttctagctcccccattcttagcgagaattgcatagtcttgcaaggccaaccgccgccaaccgctgtcaatgaaacggattattcagccagctggtgtaccttttgcccctgttgacaagatcacctccgagctgaacccgccggtgccagtcgataggtggtcaagcatgatggcagttgttttcctgtttttttcactcgtacatccatagatcgatgctgaggagcgaagtatccccctctcgtcttttgtgcagttccggcatcacatactagggagcacttagggctcttcattcttgcaaacgaatgcatgctttggctgaccaggtctcttttatgcaggcagttattgtatagcatgaggaccaaggattgtcctttgttgtcagtacaattggaccaatttgtttctactttgttttcaatgccagtgaaaaccctgtgaagttgaaatcaagggcgcgtcttgcgaaatatactatgtatttgcaaaggaccgcgtaaacactgattttggacattattacgaagcgatactaatgccgctcaaacccatcatcatctgcgcctactaagccaagtgtgttttgtggctctgcaacca

SEQ ID NO: 501 - DNA, 1826 bp, Toxoplasma gondii
tacatcctctgcttctcccagtatttccgattttgctatctcctgtgtcagtgagcctcaactcgaccgtggcgggagacgagccggaggcaaagggatggagttttggacagcgactactcatgcggctgtggcgatgaattctgtcctgattgtcaaaatatgtaccatgaagtttttctggaatcatcaggacaatgagaagctggtgttcaaaggggcatacatcggttggcgtaggtgttttccaccacacgccgatgccagagcacgtgaaaatgccgacggcgttcgcagacagcggcgttgcaaagggcatgcagccagtggtaacacctcgcgactagacgttttgtgcatggagacacagcttggacgcaaagtgacgcgaagtagcgaggcaagggtgcttttccaacagagaaaccacctgtagtataggtcgtgcgacttcttgcaattagctttggtggtttcacgccggaaaccgtttgcgagcgctgcggtggagaaccaggggacatttagtttggggtttcgttgaaggaagccgacatgatagctgcatcgttgcgacgcttttgctcctgagttgtgtacgaaaaacggatacagttgcgtgagtcaaatcgaatgcgtgctgaagacgacacacacgttctgtagttccgcagctctcactgctcgcccatccgaacctaattgttgattccactgcaaacaccatacacaggcgacagaagtctatcagctgctccatgcgataagttggctgttgcggagacggccgggaacttggaaaagccatccccaacgctctttactgccgccggctctctaacagagttgcgcccagctaggtgtctgacaatacgagctctgaagtgctacaactcgtcaacaggagtacgcttgtggacgacgccagagggtgaaacaaagtctgtccttgctgccatttcctagtgccacattcatgccctttcttctttggtcaacagtgtgttccatgctccctctgttctgtcgagatcgcgccgttttaagttcttctggccgtagcacaatcgtccgagtgtgggctggagttccgcatcgcatgcatgcacgacagcgttgaactccgaatttttttctagaactcgagttttccttccttttttctttcggtcctctccgttgcttgatcgcattccaagatccttgcagcttgggagcggtcgttttcctgtgaagggttctgccttctcatactgcactgcttgtttccttgagtgcaacacctcgcgaaacagctcctgcatgcaatttcttctttgctgtcgacgactggtgcttacctttcgcttccacttgagtttcccaggagctcctcagcgttttccagttgtcagaagagcttgaactcagcgactggcagtcacggacgaacctttctgctggccgagaagtgttgcacggagtctggtgcgttccaagaaccggcgttactagagtttccttgcggcggtgtctggcaaacacaagtcttgtgcaagttgaggatttaaacttcattagctgtttgccgtactctttttccgaatccgccgctgacagcggcgtttcggcgccgtcactgacatgccccctgccaacctcctccacggcgcaattgtcagtgaatcctcttcgccgcgacagctggcaaaatcgacggtaactgagtctttttcccaccctgttgtctgatgcaacgcggttttcgaagagtactgcttttctgcaaaactgacggcgcactgttgcgctccgtccgttttccgctgggagttttccttccacaa

SEQ ID NO: 502 - DNA, 2488 bp, Toxoplasma gondii
gaaaacacaaagctgctttttctaacgaggaagcggatctaccgcggcgcaagaccggagcgaccatgcatgcaagtgcgaacgtgtggaacagccaaggggtggaactagaaacccgatatgttttgcgtgcgaaaaaatatgaacggcgaccaaccctggcgtgtcagcaccttcagagtccgtatttgcatctatcatctcgttgacatcagctgcggccgtcaataaagtagcgtagacagttacttatatataaacgtatttatgtatagtatttgtgtacgtacgtatgcgtgtgtatgtatgtttgtatgtatgtaaagtcaatgcgaatgtgtaggcgggcatgtacagagccggcagcatgtggcggggtcaccagattcgcagcacgtgagaatcgcgggttaaccgaagagaaaggcttctgacacagcttaaggagtaggatgtaaccgccagatccgccacctcctccctatattccatgcagattttggagtaggaaggcagcggcatacacccagcgacgggaggcgttctccttttacaataaacgagcgacaccagcgtcgaagcggaggcttggggattcacctccagaagttcacgggggtggactcgttgccgcagaaatgctcgagctaatcttcaaatgctcctctcgacgagaagaaacgagctgcattttgactgggtgcgctcaagaggctgcttctcattgtcttggtacatgggaatccccaccaggtttctacttcgctgcttgcaacaaggcaatgctgcgctattctcaatgcgtgtgcactgcctatgacaccgcttattcccccacacagtttggcagttcatcatttccctaactccggcgaaaaacgataagagcgacctggacactttagcagaagaaaagccgaaaagcagctgctcattacatcgggctgaggttccgatttacccccagttcacaagggatacttgtttgcttgaaacatggtacgcagttcaggcagacagctgaaaggtgtctatcaattctcttgttgaaatccttgaggataaccccgttttacaaggaacaccgcattctcccctagtctcgaatagtggaagaactagaaactgggaagcgagtgcgctcatgaaaacagtacgcagtgtgcggaacactcgattgatgtgtttctcttgcttctccattcgaaataacagttgttccccgaaactggctttcttgagctctctgaatgttccgtgtttttcatttcctcgggtggcccagcttctctgcatttcttctgacagctccaggccgctgagaagggttgcgcaacgagaagcattctctgcgtttctccccgtcgctgtttagccctctaaaacagcgcacaagccaaagtcggacacggggttttagcgtttcttttgtttcgcgaaaatctaatccccgcaagcaatcttcatgaccaatctgggaatttcgtgtaagttctgcaagtagcgtaatccagcaagccgtcggagtcttgctcaacaagtcattttgccgctaaacaacagcgtaaataaaagccacaccttccggttttctggactgcgtttcgtggagcaatgaccagccaacagaaacgcggcagggaattctgggtggtctgtagttctcggctgtttgtgccacggtctcaacagagctggtcacagcacaccgtttccaaaagccctccatcgtcgaaaaccttctgaaggtgagagctttgcgcgagttcctcgcggtaaaaatgctgttctgttcgagtgcttctttttcgcagtctgttttcagtctctccttcgtttcttgtttccgactccgtctgctgtctgtttccctctacagaagtgcccttcattgcggacaaagcgcgtctagagttctattcctttccgtcggagtgcgagtctcctctcatgtttgtgggtagctgagtgtgtagtacgctcccccgtgagtgagagcttcccttcgtctgcctcgtgtatgtccggggttttcgtgcccgtttactcttctttctgatttcggtcttccacgtcgtccgagttgcagttcccttgttttctcagttgttgagcgttcgcctctacccacattttcaccgtctcgtctccgcgcgcgcgggcaccggcctgtctcgtctcctgttcgccgtcgcggatgctcccctcgtgggcttggacttttgctatgttttgctgtcgctgagcctccttcgccgctcccggatcctcttgtttttctccttgttcaggtttttcgcgcggcgcctcttctgtttctctcggcatccgtggccgttcgcttgccggttgtccagaggtcaccgcgcccgggccgcgtttccgtggacgatcgggtcactgctgcggcgactgtgcttttccaccacttttccctccgcaatttctctctcttccccgtttctcttcttcagcctgcgaactgcga

SEQ ID NO: 503 - DNA, 2220 bp, Toxoplasma gondii
ctttctctcgactcacgtcttctcaagtagaatctctgagctagggtggcgtccttcagtctggcacaccggcctccctgtatacatccggaagtgaatgtgagcagacttgtttcgctagtggacagaggcaattgtgcacatttgcgcattcaaaaagttgaaataaaatggtggggacaagaggtgcgggataccccatttgttgtttatctgctgtctgccttgccggtgaacgtgtttcgagcttcctcggttcgtcccctctcgttttccctgggtgcacgcgttccactttccactggactccgaacagagacatttcactcctagtttccggaggaacgcagcccaactccacatccgcatttctcctgaaaagtgcgtgtgttaggctatcagtctttgaacaggagtcggacgcctcgcctgcgcgttgggagcctcattaaacgggtcatcgatgccaaactaggtttcgtcgtatgacacagcggtatatctgcccagtaatcagagacagtgtagcgtttgggctactgagtaggactccagtggtgagaactaactgtagttatgcagcgcgacaaagtgcacttggacaacgagaacgacacgaactggcaacgtcctggcgagatacgcgttctctgcagcttttcttcccgcgttgaaggccatctcagaatgcttggtgtcgacgtcagtgctctgtgtggggtattgcaacccacagttcacccctgtggacgatttgcctcagttcagtctctggggattggtgttctgtgtcagcacatgtagcagacgcagcgaaactctccggtggacgagttcctgccttcgtagcacacgctgcggagatctcttggcaattcatcccgatgtctttaatgcacttcttcaatagcaagacagtttatttttccgtgccaagccatcattttgctctgtttatagtgtattctccacagttagagaaatgtaggttagatgaaagctatatagagtgaaagtcgatctttctgtcgcttctatatccatgcggaacgggaggcgtctcaggcaactttgatttctctttccttgccctctgtcctagacccaaaactttattccacgactttctgtagagaggctctgtcagtcagaagcatccaagggacttctttctcgttttctctccctgtaaaatctcacataaatgcagtagccagcagaaacccgcttctttcctctcttgctagcgctcgtggtgcttatttctctcgacaactcgaggccggaaatcacggccagacaaccgggggtgaagttcagcaaaggagacacaaccacttcttctgtcgccttgtagccttccaagtcctcatcacagaggccaaaaaaggcgatgttctttgggtcagcggaaaacaccggaagggtcacgttcggggagccacgaattttgtctcgcgtggaccgaaaagaagatctgaacgatgaacttgtccaaggagaaccgaaatctcaaaaatccatttgaacggaaaagaactcccacgcctgcgtcgctatgtcactgctcaccgaaggagcacagcttcagatgtacacgctgttttggcaagaacgacacgaaagtggatacgcttgtgatcgagtgtgtacaaaagatcggcttacgtgtcaggcacacattataacggaaatttcagcttgttttcaccgccgattctgtaactgtatgtgtctctgtttgagttcaccaggaaatgcgaaactcgtgaccgtttcgctgtcttgcgggctgttttctacactttccctcgacagtgacttcaccagagacaccctgccgcgagttaccgcttccctttctgtttagaagagaagacactggcggcaaaaaagcaagaaaagatgtcgaaattcccagacgaaatacaaagtgaaacgtgctgtctgggagtcggggcttggcgtctttttgacgacaaacgcagagcacgacgtgcctggtttctacaggaaggcaaaggacagaactaagcgaaacacgtagttttgaagttgttaggatttccacttcgctcatcttggccccctcccagaagctgcaattccctcgctacctagatttccattttcacggtagtgcacagcaacagaagctccgccacacgacctagatcgaaaggccgagagaagctgttttcagtctcaagaccgaaatca

SEQ ID NO: 504 - DNA, 2108 bp, Toxoplasma gondii
tgtttgcgtgaatataaggtctccgactaggcacacattttggtgtttctcagataaaaagtgatacacactggagccccagacatatctgcacagaaaaagtgacgtctgtgtggagcctcactgtgtggtttcgtttttctaagaagccttcctgctcggagtggcgctgagtgagtccacttatattttgcgcttctcacacagaatgcatctcctccctcctgtcgtgcatgtaagccgcgaacgctcttcttaactgcatcttttccctctccctagcttaccatttctacacacatatatacttgcatgaatctctatctttacataaacacaggtatcataatatatatacgtgtatatatcttgatgcccatgtggcttcttcccggagaggaacatgcgcggcgactttctggcggctgagcaacgcgtttgtctccacgaggttcatatccaaggagagcactggctgtagcgcgaacttgtgagagacttgtgactatacgagacgaaagtagacacacaggttcacggtacctccagctggactgtcctcgcgagtcgtgagagctgacatacagcagcacaaggaagaggtcggagcgaccgcactgtcgaagtgccacaggtcttcaactgtgtgtctgtttcgcctctccgtttggttgcctttgcgttctgttcttggctcggcaccgagagccactgaaaacgagatggtgaggagagaagctaacactgggaaggaagtactctcgactgcacagatactcaggggcgcggggactcgctggagtctaagcagcgctttgcgtcagtcgcggagaatcatctgtgtcgctcgcgaggcatgcgttctcctggtctgcctttgctccttcttcgagactcggcctagcgtcgcatcgtctcttcctcagcaaagagcaagcgaacgccggagacagccgtcgcgtgctcgtgggctgtctcgtcctgggatggagaaaggcgtctccaggtcggcgattcttcagaagtctgcggccttcaggcgtgccctccctattctcctcaacacttcatttttctgctgtgaacgcgctactggcctgggcagcacagccttgcaccctcgcttgactagcaacgcgccggctgtgtggcgagtcctgctgaggctgtctagagtacaagctgtccgtcacaacatttactgcaggcgcgaacataagagaagcggaaagcgcgatgccggtcggaagcactggccgccttcgaggcgccgattcagtccgaaggcgacaaccactccgttgcgttctaggcgcaatatctggaatgtcgttcccttctcgcttcgaaaagaggaacgtcgtcgcgagtctcggccgccatcgtccttccgcctgaaccaaatccagtccgccgtgtgcagctggcactcgtcgcgaactttcctgtcgtctacgatcgagaaaaggctcttttctctgccaggaaagcgagacaacggaactcgccacgagcgcggttgcacatctcgagcccgcgtgttccaggtggacgtacagcccggcacttcgccagattcagcgattccgttgttgggtttccttttcagtctcggtggtgtctcctaaggaagagtgagcgttttcgcaatttgctaggaactggaactctgctgttggaagcgcaaagcaagccgtagcggcagaacagctctttttgagcagaggcgtcacgcgtctgcgaaaagcttcgaaattcccaaactctccagagggcgccgcgtgtgtctcgctctccctcttctttcgcgacttttgacagcactggcctggcggcctttatacacgtcagcaccttcgccttttctcgtccatgtagaagccgcgcatgcttggttctcttcttgtttccaaacgcctcctctgcatctgtttctctaaaccttcttacgaaaaaaaaattctctctactcttgccgcctcctgcatctccgcgccgcctcgcgctttgtgcagaactcgacgaggtggagcgctggcagcagcggaagctgacacatgcttttttctgatttttcggttttctcccttccgaagcgcaaggcagga

SEQ ID NO: 505 - DNA, 2729 bp, Toxoplasma gondii
tttccttttgagcctcttctccgctcttccaaactgcgagcaacaggctgcgaggaacgctggggaagcgcgctgtcttgctcagtggagtcctcatccctgttctccccccttcgctctctctcgttctcccccttcgtctctctctcgttctccgttcccctggtctgcgatgtcacagaggctgcgagaggcgtatgcttggaagaaggctttacatcgggatctgagtctccagaaaagagcgaagccacagtagactccgcgaaaccttggaattctgctccttcgctcaggtgtagctccagcgcgatgtcttgagagctttggagagacaggaaggcttcgagtgtcacacacggattctcgactgttccttcctccacttcgcttccctccacgttttccacctggtccgccccgcgtctctcagacgcttgtttttcatgttttggcgacttcgcccacctggcgtctcctcctgcttctccctgtctctccggacggagcgcgagccaagtgacaggcacatcgtctggcagcaggtagcagccgttctgcgcgctggggaacgggcgcccggttcgggtgtatatacaccgcgcgcggaggagtgcaatgtactcgcgggaagcctcgccgaggctgctgcaggcctgctcgctcggcagactctgcagaaggttgatttccttcaacaccgccgcccagcaactcttgagcgcgccgcttctgctcccgcccaatatctcctctgcatctttccagagagcctcgaactctgcgcggcccttcgcagcagccgccggtggaagaacgggagcggctgcgagaggcgcagcaaaagacggaggagcagagccttgagccgaaggcgagaaagcagagaaagacgacgaaacacggaaggaagacgaaggagaggaggaagcggcggaagaggcgaaaggagagccagagatggccgaaaaggaagcgtcggaaatcgtgcgcttcagagatggagaagaagggaaggaagcggcgagagcaagcaagggcgcgcagaccaagagggagagacaggcgcgacgacagaggcaaggccggaggattggagaagaccgggaaagcgcaggtcgtgtcagaggagaaggcgaggtccccaggaatagcagatgtgacagcagtggaaagagagtgagagagaaagcgagacgagaacgagaagctgccattctcgcagagagcgtggcacatcgttacttcgaggggaaagtcgaagacgtttttcctttaaaccagaaagctgcgtgcttttcatgttgtccagtaatcttacatgaagtgtatgcatgtgccgtggatacgaatcggtgtctgatttcctctgttgtgtgtcagtgtcggtctctgccttcctccatctaagagaggacactgcggcctcacgtctggtacggctgtcacgacatctcccggctatccttcgctctgacttccttcccgtccattttcgtctttcgcgaatgcgctgctttccagcgtccggttccccgaccttctttttccctcttttcctggccccctgtctctttccattcattacacacagtgagaagagtcgcgggttgtgttctgagcgttgcagtgcggtgagcatgcgcgcgagctagagaaaattcagagactctcgagcggcaggcgaggccttctgctgtcgagccaccgcagtgcagagaggcgaggaagggcgccggcctcgaacggaggatgcaacaacttgtttgcggcagtccccgttgggtggaaggtcgtttttccaggaagcaacgcgtccgcctgtttgccccagggccagtagtgaactccggtggtgtggtcctaagtgcggagcgaacgagaaagctacaaggaactttgacaagcaggacgagatttatgtaaacgacagagaggacgaagagaatgtgacagacacgcaggaagagagtctagcggagcttaacaactagcgggaagagcaagagcgggcaggggaaaacgcagaaaccaggggcatctccagactctccgggagccccaagggaagcggaaactcgagacctgtctgcaagagagcgagaaaaaatttataagatatagaaccttggaagcgagaacaacggggtagggacaggagacacgtggtgcttgttcgtcggtcagagaaagaatgacttgcaaagagggaagcgaagggtctgcgaaaaaaagaagcggcacggacttttgactttcaccctgacactgcgagaatccgcaagttctgattttcctttgttctttctccaacagactaccaaaagtgtttctccgttcgcgcagaaaagcctggagacaaacttggaaacaggaaacaatttccagctttcttccttgtcacttgctgtctcaacttacgccctcctgcattccgaccaccacgactctccccgcgggcagagaggcgccgcatgaaaaaaaccatttcttctgcgagaggaagaaggctttcaccgcagagagtcacgaagacacttgtggacatctaaagcctatctttgcgctgtttcgaggtgaatctgtttgagtgtggcagtacaaacgttttaacttgacgctgctctcactcgtgtgtctgtgcacacctagacaagatgcttcttccgcgaacacgaggatgggtgtcgggaaatagttgattcaattctcataagccacaccgtgta

SEQ ID NO: 506 - DNA, 1723 bp, Toxoplasma gondii
atacgacagaggattccaacccacatatgtgtgcgacagagcttatttaaatcttatccggttcttatgcgcataaaaggggacatgataggccaggggaatcaatacgtggttcactgtctcgtcttcccatccattgcaacaggggtactgctttttttccttcattgacgctgatgtctgcctcgttcattcagatcatccagaaatttttgctacgtgggtatcataaatacactgggatcacagtgacgcaaaaggagttattactgggttgaatgtacaaagcactgcaccaaccataaacgctccacacatatccgcatgtccctgcctgaattgggtgagatgagcctagtgcactctgataggtttactgacactgcttacttggagtcgttcttttaactgagacagcgactgttgcaggcccgaaagtcggctggccacactcgcgacctgtaggcaatgagtcacaaactcgcggcaatccaggccttgtatggtcggccacacgacaccggactcttcctgtcaacaaactgcgggcgtttatctcagtgcatgcacaactgagatttcaccctatctcagtggtacagttgacgtacatcgccttccacataggtcagacaccgcgatgaagataacagaacactgcagttgtccaccaccgcctcctccagcgcgccattgagatcttcaagtttaagctgtagaactgcctggataaaatgatgcgcataaaggaaaaaaaaaacgacacgttgtgattgtggagcctgtatgtttaaacatcggtgctggtagtcgaaagaaaaaagacacacgaagggggctcctttggatatccacgcctcaccggctccttagccaagcggtccagcggtaattgtgagaggcttttaatcatgatgaaaaacgcggagatcagacgatgtccttgctttgagagcgaaaagcgtcattatctcttggagttcatgctgcgcgataagcttaccgtcaccaatcgtggcaacaggaagcaacagacgacaccatgccaccgttcttcacatttccaacagcaacttatttcttcttccgagtggtcatgtgtaacaatttgtattacagttcgctgagtgtcatagtgtgaaacacacaggcgactgtatctttgcaaattaagaagcgacgtctcgtcgattctgcctgcggcttagaaaccgtcgctgtgtatcgcaaaccgacgagttgtttacgaataccttgagaggatgcagtgagttgagaacatatgtatatttcacggtgctcgcaacgaaggccgtcgttctccaaaacccggtgaggcaacatcagtttcagatgcacactctgtcgctctgatcaggctgcgctgagaaatttcccagcatgcagcatgcaacgtaactcgccggccgtcccaaacatcagtaacccatctctgcggcaattaatacagtttcctaggtatctaagggacacacaaatatttgaatactgaggcgagttctgtatgaggtcactttcccttacaaatacggtcttgtactgtagacaggtgtcaacgctccccccttcgcatctcggacaactgcagccgacattctatacctgcacgttgacgccgatgcgtgcaggctgtctttttgcataaacaaactgtatccgaagattactatttgcaagtgacgttttttcgctacatccacca

SEQ ID NO: 507 - DNA, 4932 bp, Toxoplasma gondii
acaaatgagaagacagtgattgtgcatgagtcaaagagatgctgcactggaggttcttcgctttcgctgttgctcacctgcctggctttatgagatcccggacgagcttcagcagagaatttctctggttcacgaactcgacaaggtaaacatgctggttctcctcttcacagacgcttctgatggtgtccatccactgctcctttacctccctgccccgtcccccgcacttctgcttcttcactttcgtcaaagaaaccaccttgcttcgctttgagaccggcatctttgcgcccaacaagggtgataaaaaaatcctggagaaggccggaaacacggcggcgaccgcggaactggtgcacttttttgcaaagagcttttgttctgagaaacccgagaaagtgcggtacggggaagcgcctatacatgcgtacccttggaactggcggcttcgagtgtgcgtctctcaagccgcatcgacacctcagcaggatctccagttaaatatcgtcagaataagaacccaagccaagaatgtgacggcgcaatgtgagatttctttattcctccaaacactgggaaacggtgatcaacgaacaacaagtgaaccggagtggaattcgccctgcgttgtccagtttagacttttggaacctgagtgtttgtatgacagagaggcaacacgacaagacttctgtcagatgaagaaagaaattcagtaggtatgggacgtatcgtcgttactcaggacaacgatgcagcttttccacagcggagtctcatttacgagccgagttggcggaccatacggaactatagaaccgcgtagacacctcaaagcgaacgattcacccttttgtgagaaatctgaagaagtaggaaagaaaagctggtcaatggaaaaacagagactggaatctgaatatctctagcccgcacgtctcgaagttgagagacaacgcagctacgaccaaaggattggcctcccgcctctcaccaattctcgcagcagtggagtccacaaccctgtccctctaagagattcaggaggcgcttggaaattaatgatttaacccagtggcgattttttttcgggcggaagtccgaaaacttggctcccgatgccctcaatcagatgtggggccatgcatgcatgcaggccgacaggacagctgggaacctctctcctttcgtcatacgcatgctggttgtctaaaaacattcgtccacctcgacgtactgtttttgcaggcagtaagattggttgtaatttctactttacgattagatgttttttcctaagagcaaatagatgcgtttgcagaggaaaatctcgcaagtgttggaagtgtgccgcgaaagtcacagcggtgcttccactgcaagcactccagcctgttgttgtccttaatttttagtactgaagtacgcttacgtaggattagtcgacgacttgacctccagattgtgtttctactctgtctctcgggcccaaacatcactcttttcttcggggatctttactcatttcaacaacggagtgtaactgggaccttcgtggaccggtcttcagtgtttttgcagcatccccgacctcaaaaccaatcacgaacagctgtaattttctgcaagcgtggctctttttttctcgctcgtccagttgtctgcgatgcagcgcaatatatggcaagtagactgcgcaggcttgcagggatggtttttttgcggtggacgcacagaacgcttaggcgaggaaaacaactggttgtacccgactagcgagcttcttttccacgagtttgacatcgaaaacgaaaactcactgcactgcattttggtgtctggtcctcagggaatggtggtataaaagcgcggattcgtgtaaggcagggaccttgtgctacttcaagccatacgaatgtgtgcgccgctgatgactagccattcgagaaaaggtccacactatgttccggacgcgtatacgttatcgtttactcatacaagtggcagcaaacactgaacgactgcgatctcaatgtgtggaatgtcataggggtgtcgcacagtgcttaattagtagcgaagacaatacaggaagcattcgtcacgatagaattcacaggtaacttcattcctcacggtgcggatagcatcgaaacaccaaaacatcgtaagtaacggaagatggaaactatagtattcatgcttcttcggcgtctttgatacaatcggagcgactatccaggcaggaagcacggagggaaaaaggctttgatgtggttttcacgggtcgcggaaccatggttgaccaggaattgacaaatgtccaaggtcaccagccatggagtgcgtggtgaccttccgtactcttggcacgaaatagcttgcctctgccgcaacgtaggtgttcatactttgggggatacttttaacgtacgtgcatggtgattggcgctaaacaacaacacaagtgtgtagaaggcaagcgggctcgacagtcaatctgaactagttcaaaccgggccgtgagcttcgtgggagtgttcgctaaaagcacgtggtcatcggagacagatttccaaagggatgggactaccaccgtcttgcaagttacaggatcaaacgcgccgaaatcatattattttactcggggccaccaggtgttagatgcgccactttggtgtcaccgctacaacttcatcctgggtgaaatccgccgatgaagtcattgcaaaagctgtaaccggtatcttcaagaattaggggctcctcatacttttccctggaatttaatgctacgcgtttgacaactggttgaggttgcgaatgcctttgtttaacggatccaagttctgtttcgctacagggggtatgtttttatagctgtaactgtagacggcctcggcagcacctcatccacacacattcacaacagtagcaagcgcgcagtgagaactgatcgtagatagccaatatgattggagacgcgggtcagttgttcgtccccggcacgtgtgtgtgatgcagaatggtggctcccgcggggtcattgcaacgtgctgttcatcctcgtgtacatatcacataatatcgaactacgaagacgttttccattttcttacatcggagaagtaacctgtgtactgtcgcagctccggtcgcccaaaatcggctgcctcgctcctggtgaaaatgtcagaattgctcctgagctgcgacgatatctctgaaagcgtggttaaacaaaactgtcttatcgggggtttggcgaggtgctcctaaatagccacggccacaagcatttctggaccgctgtggccgccaaactatgttcttgacttgagacagatctgcagggttttctgggaactaccatacgacagttgccacgtttacttctccagcgctcaaaagccccaccatgcgagcagggagaaccgcgtttcacctcatggaggttcggaggactggggcggagcgattggcccgctggaagttgccttgatttccgctgttgtgtctcttcgtagtgaagcaaaatacggcgcttcttcgacccagatccaaccgcagaatgaaattgctccgctgcaccgaacagcgagtggatagccatcggctctgcgttctgttcttcagtcacagctcggcgtcgagtttctgtgtgacctgcgttgggaggcggcctttctgccgccgcccaccttcatctcagccacgagacacaacacattctcaggtgacacaaagccttcctccagcgatgaacagtactgttgcctacgagagagaatctcgtttttctgtagggcttgcccccgttacgtaattgtcacagccgcccaccgttcgtaagtatgctcttcgtccttctcctcaagtacgccgttacgggtaagaaacggtgttgaaaaggagacttctgatcgctccactttgttgccctatttgtaagaggagctacaaggacaacagactgcacttgtgcgtgtgacaggaagagacatttttcgcgctgaagattggagacatttcgtgtcgcgcgacaggcagagagccttcacagccccgcacagaaggagctgtggtgttgctgggagcagtcctgcgcgggacatctttcgagttgaggctcatcgctggatattttgaacctcttcgattttttctgtatcgcttgttcttttcaagtgtcaattgtatatggcggccgccattgctgccaggcaaaccccgcaacctgcgtttcctcgactacccctcccccaacagagccagctggccccacacaatcgtcgacccagacgaattccagtttgttaagaagtatttgtgcattgtatgcatcgaaaatacgcagtggcggttttcctgggccatttatttctgagaagagtcgttttatttcaagttcacttgccatttttacacgcgagtcgcaggccatctgccgcctgtcccgttctggctactccgagcgcgaaggaactccctcagccgcaacgaagctgctctcatcgaagcgtcttgacgttattcaccacgtagttgttccggtcttcacgttctcagcgcttgatctttacggcgaactgggaggttctccgaacattgcggtcagcaacagtccaccgcttggacgcgccggcgagttcgtcacgttcgtggtcccgtactagtgtttttgtcgttacagagacgatgtgggttgtaaagacacggtagttttggtcaccttcattctctgagggaacgcgccatcaccttaaccttgcacatttttgtctcacggtctcttggctatcgccgtcctagcaacggcaggcacttgcctcaaatccaggcatactcccaccttccccccgatgcttcgttccacaacgcaaaagactctcggcacccctcgccgccttctttgataaagtccgaaga

SEQ ID NO: 508 - DNA, 4036 bp, Toxoplasma gondii
gttcacgtccacaccagccgatacaggataggatccaaaacgagatacacggcgtgtcgcccgtctgtacagtgccaagatttcctctctgcattctatctaggagggatcgacggggttctagaatgcaggcaagtgaacttgcggagcagcttttcgaaacgcgcattcgccgagaccttccggtcgaggtccgtggtcattgataaaagtaacggggatctcggcagagaggtggctgcgtgttccctagcgttggggactctcaaggaacagaacgaaatcactgtgcgattaccatctcgtgctcatgtgcatccagtggtgtgcaaatataagaaaacatgcgtacgcatccatctatgtagagccgcgcgggtgcacaccgggggtctactgcgggtcttgaaaaggagctaacggagtcgtttcggagagaagcaaacaagtgagggctgagcacacctcgggtggaattgcgtgctgcaaagcacttgcaggcagaagaccgctgacgaatactcgttctttatcgggctttttctgcaggaatggaaggtgcccgacatgtcgccaggcggtgaagggagtggtggaactccaggacgagtcgtgtcaagtggaggaagaacggaattctcaaaagcgagacggagaccggccgtgggagaaaaggggagacagacgggcagtcgtcactgcaacagtgaaagatgtgaaaaagtcttaagggtctgcatcctagtgtgaaagcgagctcctcgaatccttttgtctagaaacggtggacaaatgatggggaaaaggtggcaaggagacaggagccgtcaacggctggggttcattttcgcatgctgccgttgcgagattcgcaagcttttttcgacagggatgtttcgtaactattgctttggcgcggaggggggggcacacacacgcgtacggtctaggaattctgttctttatcacgtctccagagttggcagcgtgcgggatggaacgagctgagcacaccggaaaaaacagatggacagaacggagtgcgtggcgacgtcgcaagagaactggacaggcagagcgagggacatgaagaagaaggaactcagcacagtgaaaatggtgtggatggaggccagagcttcgtcttcgtgcagaagacgtttctgttgtactttgaaaacttctgaaactcctcggcatcggctaaacatgcctgacaagacgaagtagaggagcagagatgcaaacatgtgtctctttctctcgcagtttgtccccgtttcagagattgaaaaagaactcttacggcaaacatgtgcgcgtctggctgtcggttcgcagcgagaaaccagccctctttccttttcttgatgcgtatgcgctcacacgcatgcgcacacattttggtgtcaaggtacaactagggtagcaacatagttgagtaggcagcagagtcgcttatacctctccgtggttctcttgcccaatccattaatgaaaataaaagtccacgaaggtccacgagcaacgcgcagtccgggggaagaacacaaactcgcgtggccgccgcgcgtcgtcagagttaacgggaaagggcaaggaaagtcaacttccggaagcgcatgcgtcttcttctcgacagtgcacatcgtccttacccttctgtggtctcttaacgagggaaccacatggcgtttcaaatctcggcagtctacgttgactgtatacgcaggcagatctctgtataccttgaataagggaaagggctgtgtgctctcatggaatgatctagagatgagtcgagtattatccgcacatgccacgtgcaagaaaacctgaactaacacggaacccagtagtactcggcaatcgaagatcccatccgttcttcgggaaacagcttccgaattgagaatagagaatcggacagacaagctaccctaaccttggtgcacagccggtattcggaccatgacgattttgcttatatttcttcacatatatatgggtgcgtagatctgagtagcttgagaagaaggcttctgcggatctggaaatccaacacttgtcgctggatagcggggacagcccacaagcgttttcctcacttgtgtcttgccctcaactggagccttcccagcattctccgttccaccttccctatagaatttctttcaattcgcaacttcaaggcgctgtctggcagcatcatcgcttcccgtcattcgaactgcctcctccaaagaagcggagaaaccgtgtgtcgcttcttgcccactttttcctccttcccttcgcgtgagagtggagttgatgaacctccacagccgccgaagggaagtgttctttgcttgccgccaccacatttgcgtgctcgactcactgtgagacgagattcaaaccagtagtccaactcgtagtatatactgccgagaaaaaaataatttatagagtcgtaggagtcccatgttggtccgactcttcacatgttatctaaagctgttttaaaaagtacaatcttcgaatatgagaatcgagacggcgcgacggttacggaggtgaacgcgtttacattcctgatgtggtaaacagaatcaaatcttccttgagcgacacgacagacaccagaggcagcgtgaaagttgctctgagttacatgaacgaatttacatcctcgccttgccaggtcctcagcctacctcgggaagccgcttcagagtcaccattcccgtgaaagccgaacaacgcggaacgaacagaaaaccgtttcttcgttttgatggcgtctgcgccctgcggcggttctgccgacgggagaaactgggaactgacttttgttctgccacgagagaagcattttctggcagtgccttcagtttgacaagccatcggacgcaacagattagccacgagaacggtgtccttttctgtatctttgtgcgcaggagtgcaggggcccttgctgtttgtctctgggtgtgtgtctgaccaccctcttcgtcgcgtgtgcgctaggcgccgtttctccttattttttatgttgccttcatgcgacatcgaaagaaaagctgtctgccggctttttctgcaagccacggcgtggtggcctttactccgcggcccaggaaagaaaagttccttctgaactcgtcgcagcatcggttccatgtgtggcggggagacgaagaggagcggcgatccctcgtaccccactctctgcctctcgctgtttccacgaagttgcacgtcgaaataatctgcttttcaagggcaactttcccgtttcctcttctttgttcaatgcatcacacgctcaatcttctcgtccctcgcctttcgtcggagtcctttccttcccggccaaaaaccgagagggcgagtcgacaacacgcagtgaaaaggtaggcagtcaacatttcccttttctacttttttacgagcagagccgctgttgtggcattttttcccgtttctcttttttacttgtgcgcgacgcgggcttttcgctccgtgtggtcccctccaactgacgaatttcgccctcaactcgcggttttaggatttttcatctcaagggaaggtgacgttttacgcctgaatcttctcccgcctgttttcctcttcatacatctggtccccggtggtgctttcccgccctctgtctgttttccccgccctaagatcgggcagtgagggaaacctttcagaccgctttttctgtccacctttcgtcctactccgacacttcccccccgccaccctctcgcttctcctttcacgcgccttttctcctcgcttgtttctcagctcctttccgattctctcgtgtacgaattccgcatctattcccaatctctgacttttctataccgtcaccccccccctccctccgagcacctcgcctcttctttgcctctctgtgttgtgcgcctgcctcgtgtccgtctctcgctctcttttttcattttttcctcctctccttcgctcgcttccgctctcgctctctcgggcgcagtgcaagcgtctccgtctgcga

SEQ ID NO: 509 - DNA, 4719 bp, Toxoplasma gondii
tgattcacttgttctcgtcgcctgctagcactcggcgagcgtctgcgccacagcctcccaaacgtgttcgctccacgaaggcgctctacaacggagatgtgggcggcattcaccaaatgtgtttgccttgtatgtgcttgtgtgatcacagctcggaaccatgcagggcacggtcgaagttatggcgcaacagggatacccgacaatgcccgtgccacagggatgggacggagctgcgcccccggctggctgggaaggctggtccaaggaacacattcccaccgcccttcgatctgaccagcactcgagcggcgccatgactcccgtcagtgccggcgctgccgttggatccgcgcctgcttctccggcgcgtggccccgaggataatcaaggtcagcaggcgccgcatcaccaggctggtggcgaaggaccattcgtgcaggtctctgtcacccctcttgctccgggacaacagacccaagtcaatatcaactaggaaaacggacagggcaattaatatccgtgcgtgaagcgtcagccgtgcgcatgtggaaagcgggaagacaaacgcattttccaggacctcgattggcttcgttgaccctggcgctgttttttcttattgtgcactgttgggagggccgttgaacaccggcgtttatgtaaaaaagggacgggattgtcgccgccaccatggagtgtgctgtgacaccttgaagattcacgtgctacatttgttcgttgtaacatctggagcgtgctgacgtgggggcctggcttgttggaagcgaaacgggttatgcacaggctggttgaatgtttttttccttccacgtaaacgctcccagaacgcgacggtgtcttcacagcgaactcacgaactgattttgtcagtcgcttcttctgagaaggctgaggcttcccactcgaactggatccgtgcccttccgcaactgcttacgccgttatgtgcggatgtgcctcaaagccagccagcgatgatacttcattactgcgagtcagggttaggtccagcatggacggtaaagataactggtcatacacatgtgcgtctattcctggtacactgcctcgcgctagtaaccttgaacagctgcacctcaggtaatgccttgggtacaaacggctgaaagctgccatccgtgcatgcttatgacatgcatcacagattagaggtgcagctatcgggaagctaatgattcgatcatgacctcacgtactgcgtttgtttgatgccatcttccctcgcgcctttagagggcacgcaagtggtagatcatattttcagagaaacgtccgctcacaaatgccatatggccatagaggttcagttcccattatggaagagccggggtctgctcacagcgccacagccagaattatcaatgaagatagacgctaatcaaacagcagtcaggtgttggcatacgttggagtccgattgaagcacacggtaggcgagtaaatgcatacactcagtcgccattagtcttgacaaatgataaccagaacaacatccttgcacattagtccccgtcaggaggcgaacgaatatagagttgtgagagtcacacttggccacaaatccagactaggacatgcagttatccgcgcgaatagtagggtggccaaacggtgcggccccgggtgtgctgtggccggattctcccacaagcaagaagctgttcacgcggcttactggggtgaacaacaggacggtgcgtcacttcccatataagcatgtgcagagacgggaccggttaggcatttcaggtgctatctcctcgtacctatgagtccctcatctttacggcaaaatgccgcatgccactttacgggctgtttcagcatcaggcacgcttgcatcattaattcagcgctcagttgcacctctacgggaatgtcttccgggtcaggttagcccagaaccggcggtgatgtttccgagacttgattagccagaaattgaatcccctgaagagcccgacacttaaaagagtcgtcggattgccgtttcatgcatacctactcaggtatacgacgaacaactttgatatgacagacgcacaaatggcagtgtccatccttggcatgcggcgctttacaaatggccgccgtactgagatggggcatccagcaaaacgttgtccacccatcatcaccacttctgatcgtttcacgcaacacataaaacgctgatcgcggattgcacaactgaaggtaacgccgcgtgttcatggtgcagcagttggacgcctgatgcatattaattgtagctactctactgaatgacaaccaaaatactagcagtgaaccagagagtttgcttaacaagaagttacacgaaaccctcccgacctcacgctcattgcgaggtgggggcattgtcgacaagccgaaaggtggactttgtccccatgcttcagctgcaaacaaaggaatccaaattgagcagttcctttcgaccttgttaaatcagacgaaagctccggtcaagaggaggttaacggccggtagcaaatccttcagaagctctgtgtatgtcatacccaagctttgctgtacgtcttgggattctgggagataacgcgtgtcagatagggggctcagacgcaacttccactgacaacgtaatagaactgcactaacgggaatcactagcacgtgaatgaacggctgacgggcaaaagtgtccaacaaggggcttgtgtgtcggtggcaacgagagtatcccgacctttcagaggtacgattggctaaccttcaagagtctggcatccctgtttaggtgcaggatatcgactctacgcataagcgtaaggaaatctcctgttgccatataattatttcccactgcgttgggtttcttcaaaccgttcgtcggtgatgaaaattccgagcaaggacagaggtacgccgttttcggtgagctgtgcacacgtatcgtcccgttcaatactgacgaaaggtatatgctgcctccgaaaccaactcccattgtccacttctaccttgattcagtatccggagcagctgaacaatggctcttccactattataagcttcgagttatgtgggtgtgtgttatatatactgcctcgggtgatgatacagaacgaaggaagtggtcgccgcgccttgctgagtaacgaccgattctactgagccatatatttgtttgccattgtcttgattcggagctattgtgcgcgtccacagatgcttgggtaacaaagaaaggcaaatcgattaagtggacgtctgtgcgaagcaggactctcaaagaagcacctaatgcgtccagttgccgtttcggtcacaaaaaaaagtataacaaaaaaacagggaccgcagcgagatgaaagtggccttttgctcattgtggtgcagtgcttgcaacgacgctatatttcgaataaatttaaaggtatcttgttcttacgcgtttcgctcccagcgttttacaccccttcataagaagaactatgtgtacattaatagcgacccttgattctagccaatgaaggcctagaagtgaaaaggctgggaatctgtcatctgtgactgccacagggggggggaacaagtgcctataccatgtgctcaagcgcttcacgggacgtaccggtcacaaacggggcggctgagaggtgttacgatgttagcaatcacagccatagggccttcggttgctcaacagacaggacagcatacggacctgggaatgctgcatcactttccgttcttgaatgttaaagctggaatgtgggactccaacaaacaactcttccgttaatcacacgtagttcagtaaaatcgaatttaacgctgaagcatcgcccggctatgacaagcactgccatccgacaccacgttcaattcccgttagacgaggctgcgagctctcatacctgccactgactcatctcgaaatgccagcctttcttcgattggtgtttaaaaaggatggccactcgaaccatgtgcttccattacctctttagggccaacagcctcactcacgcagacgctgcaaatgctttacatcacacaataaaggctattatttgctgtcttctaccgtggctactgcccccaccaaactggcggtgtgaatggctcgcctgcccggtcggtaaaagcccggctctttgtcagcgtttactacatgcttcccgaagtattcttgagcaatccgctgatagaagcgcgagtaatttcacggacaccatgtatttcaccattttgtatttctcttctcgatctcttcaagatgacccatccgtcacgaaaagtcgcgttcatgacgcgggggtcagctcgtctgtcaattccggctcgacaggacggccgcgataaaaaaatgagtagacaaactcacagaaagacagtttcacgcacaaccgaagtgatttgagtgtcgccgtttctcctgcattcgaaattcaacccacaatgacctctagggctgcgcaagtggcatgaggaggcgaaagcattgtttggccagacgaggagacgtagcgatctgtgactgtagcttacaccgctatacaccgcttgctggactgttgcttcgtaccatttgccaatcttaaagacatctcaatgcacgggttttccgcttcacctgttcggcgactgtctgtagccgtcagtcactgactggcggcatttgactctcgactggctgacgaa

SEQ ID NO: 510 - DNA, 4719 bp, Toxoplasma gondii
ctgagcaacacttttcacaggctgaggcgctacgtcttttctacggaacagtgcggatcgaatcccctttcgtcctgggaaaaaacatgctgaatgaattcatttcgcagaatgtgcccctgcgtggcaatcacattacgctggaaacggagagcggctattcacggattagtgtaaatcagttttcagaagcagatgcaggtcgcgacactgacaaaggcgtactctcatggaagcacgaacgcatacgacagttctaggtttagcacggcagtgggttgatggtcactactgtagcacgtacacccttctcccgtcctattctttcaatcttccggtcgtatcttccgcactggtagacctgccttatttctgcccccgtcttctcgacacacgaggacacgcgcatcggtgagacggcactccacaacactagttgctctccatcgtgtccagtgtgaaacggaatgacattcgttcatcgagtggccttatgcggccctctcaacggcggttttgccgcttcgatgaatgccaacccttcacaagcaacgatggccactacacttacacaaggaccgcaaacgtaatcatcatgtagccagtcgagaggatcccgacaaggcacaaagtgagtatgagcttgttgaggaatcccattttttggtagaagggcccgcgtttcaggatggtcaaaggtgagactgttctgccataggcttcaagtgcccaggactcgactgcggctcaggtacctacttttttggagcggcacaagatagagtagaattcagtgaggtctctgcagaagacgaaataaaggcagtgacaccaccacagagagaactgacagctctctatcgggtgtgctgaacgaagtcgtgggctacacaaggtgatgcctccagccaccgtataccgacatcaacacattactctttagtgcatacaacgaggcccataatcatcacataacatgccatgctgacagctccgctgaggaaaaacatttccgcaaggcccagcattttgcagcgcctgcagatggggtccttgcatgcaactttcccagcaccgaggtagaaccgcccgggcagattcgactggcacgtgttaaaccctggcctgcacgtttgttggttgaccgcgccacgaagaaaacagagaaaccgtcttgggccagatatccaaaaacaggttgtggcaaagaataaaacgctggtcgagaagcagtcctgacgctttcgtggatttgttggctacgcagctgctggcgccgggtggaacgctattgacaggagtcggctgcggcaggcgggccttccgcgagcagctagctgcatagcagatctggtgtgccatgtagcaaaatggtagagaatgtgtttcttttcccaaggttggttttttgaagggagcgcgaattgcttttgactactccatacgacgtgcacactgaccaccgggctgggtccgcgaaacaccattagctgatttcttccacatcgtatatgagcggcggaaggcttactaggtctagcaatggcacagcagtcacgcggcgaagtgactctggtgtgataccccgtatggagtgaggtagccgagtatgagtgctgggacaagagaccaactcgttttatagcacctgctactgcctgtttacggtttctctttgtcgttgttcacttaaggggccaatcgtcagcgaaaggagtcagaatgtgacgatgaacctacttattaaagcatgcttccaggggttgcgagacggacccggggattggtgtcatagcttcaagttgttcgttcgtcatcggataaagtagcacatgtgccttgaggcgctgcgaggaccagccctggcgtcagatgcggaacacaagtgaagcatgcagcgcctttatccggcgtcttgtgtttagttttggcccgtgaaccgctgcaggagccgaaggtaaaaatgccatgcatttggtccacgaagtgctacaacaaatcgggctgttcacgcggtagattagggggagttatcaataactgattcttggatggattcaccggcacaaaacattacacctgacgggtaggtcaggtcatatattacagggttccagtgcctacttctaaacggccagaactcgtcgctatttcagcgtacaccgatcagagacagtagagtaatcgttattccttaattcggtgagcgttgcgttgaaacaccatcatctgctccacaccccgcatgacagaaaactgtgccacgcggctgcggaaatgcattcgtcaaggcacggtgatgctgcccacctaatgatgcacacgcattaggccaactatcggtgagaacacttcaccttcgcgctgccagcaagagaacctggccaaatgaggccgcacaaaccggacgagcaaatgagctcggggaggcagcatctgcaaggtggatagacgataattcgcctcgctccgcgtttcgccacattaaggaacaccatgggacgacgggggttttgaaaggtgtctcatcgtttcacagaaaggagaggcaaactggacgaaaaaaagctcaatttctgtgttcaatacattatgttgcaccgttgactgttgcgcaacaacgtggtactgacatctgcatcgaaaaggatgggtaaaggacgaacagttcgacggcagtagccctactggtagcatttcgatcacgcagagcgtgcgcgcagggatgagctatggacgaagaacaggagttcagagtcacagcacaattcgcaagccgaaagtgtgtatttgcatgtggtgccctaaataggaatctattacaagaagtggctacaagttcggagaacgaacttctggtgactagcagtaccgccacggaaaacatcattcttccttgtctatgacacgattggtgaatgcccctgaagcgaaggcagtaatggggaaaccgagttactgtgtcatagttactgcatcgaactacaccaaaatggggacaagaatttacgctagcaacgccaaccacacaggaaatcagagacctcaaccttgaaacgttgctggcgcacgggcagccactcagcccacggggtggccatgcgtatgccgactatgcgtgttgtgccgtctcatcccataaccgtaccgctgaaccaacacaatagagaaaagtgcatgttatcagctgccgacggtatagataaaatttcagggaaagcaaaggagttaagcactttggtggactacgagtctgcaggccgcctatgcctgcgacctcaacctgatcactatattggtgcaggctcgcattcgggcagttgccagacgaaatcggacaaatcacagaaagaaaaacggtggcatcagtacgctgacatactgctgttccgagcatactaggagccggtgatgcagcctcatatacttttttaccaagcacgattttgcatgctttggccttaaccgatatcttctactgttcgggaaagactttctaggcactgcgatcgttcctatacaagaacacagcagctcaagactgcatttcttggtattgttcggttacacggcattgctgatgtaaaggagtagagcctcaggagggaagccctggttgttggttggagcgactcttgatgacccatcagaaggcatcactttccaaatggttgcttaataaacggcatacactcatacatgtgtgaaaatgatggtcccctgcaaaatagggcagctgttttgtttgcgggcaacccggttacaaattatcacacttacaggttcgagcacggagaacgggtaaatgacctgttcgaacttttcatccattttgccgggtgtacagaagggcgctcgtaagatgattttatttctactggtatggttttgagtctggtactcgtttaatcccaccacgctggcaagactaccggttggaggacaaggggcaggacacgcgcaacgattgaaagggacaagacgggtctcgcaacgaagcgggacgggtgacttcgctgcagtcgcctgagcagagaggtcaaccgggagaagggggccattttctcctgcgctatatactgtccttgtttttggctttcgctggagacactttgctgtgtgcaggagattttgtacctcaagtctgagtggaaaacaatgaaagcgacgaaaacatgagctgatgtgtgggagtttccgacgtcagcaacttggccaggcgctgatcttctgcgaatcgccgaggagtcgtttttggcttggtagttccggattcttcaggaaagacctgtgcgtcaaggtaagtggagacaagtttctgaaacaacggcacggagctgctagctcaaatagctgttcttgcttccagtagccgaactctaaacaaacgtccttcctgacaccctgattctcattattcgcggttgcggttgtacctggaatcaatgccgccgcccgcgatcgcttaggatgtaatacagtttgcgatagctgtatcctccacctttatttatcgcgcattgaaacggaaagacagacttccttcccagcatgcgatttgccttgtggtaagcgactgtggttaattttttcctcatttgtttgtgcccaggtagggtcattttgggccgggcagtaaaattctgtggttcatccgtatccgtcaaaagagggacgatttctttctctgcatctgacccccaataactggggacgaga

SEQ ID NO: 511 - DNA, 2125 bp, Toxoplasma gondii
tgcgttcgacaagagcgcgtagtttgcggatggcttcgctctcttcctcggcctgggtttcaccgtcgaggaagagaacgagggcctcatccgtcttgtcgaattctgcgtctgtcacaagagagaatccttcgaggggatctcgccgcacaaggaaggcgaaggacgaacgcgtctccttcccccctgtctccgacttcctgtctcctgtctcctcaggagtctccttcccacccagcgcggcctgcagcgcggcctgcagcgcggacccaaccggcacgtttttcaggtccagaggcaccgacggaaaggcgaagaagagaaacgcagcgccgcctccaacgaggagaacgcacgagtagaacagccgcgaaaacacgcgccgcagaccgcttcggtggaccgcttcccccgcccccacagactcagactttccacgactcccctccgtctctttctccttcttcttcccttcattctccggcgcgctcgcctgctcggtctccttcatttctacgtcgttggggtgagacgcgctgtcgagcgcggcgtctcgaccttcgccggctctggagctgaagaatttcttctcgcggctgctgggactcgcggcagagccgactgcatgcacaacttctcggcggagaggcgcgagcagagcgccgagacgcacatcgcgtttgagggcgcgttctgcggagtttcgatcggcagtggaaaccggattcgagacccgtctgtcactcgagagccgcgaggtccacagggaaaccgcatgcgagcgcagcgcagaatttgcacaagacgatgataaggcgctgcagaaagcagcaaagccgcggaatctgcaaggcgcctgcgagagagaagcggcgcggacagcgaccgcctgagaggcgaagaaactgcgaggcggaaggcggcgcgacatggtgtacgtacacctgaaacgagagaggtgaagaggaaagagaaggaggaacagaggagaggacagaggtgaagaagagagaagttgaacgaagggagagaggagcggggaagtggagaagaaggcagagagagtggagagataagaagcagaacttctgcgtcctccgcgacagcacagagaaggggaaagcgtgagagtgagactggaccgtcaagaagagggaggaactcgagggaaagagacaggacgagagagaagggaggcgaagagaaaaaggaagaaagaacagacagcgacagaccggagacgcgacagcagcccaaaagcgtccaggaagatcggcagccttcacgcacgctcttctccttctttctctcttctttctgctcttctttctcttttctttctgctcttctttctcttttctttctgctcgtcttccccagtgtctctctgcctccgcgtctgcgctctttttcgcggcgaatcgacgggagagaagcggcaggcttcgaagggcttctcggttcttccctggacgccaaggcagtccacaaactgaggacgggggaaactgtgcgaaggaaatgcgagacgcgagcaagcagaaaaaaggagagaaaggagaaatccggagaggttctcgcagcgccaagatcgtcgaggagaaaccgaggagaatccgctggacggcttctcgagaaaagtcacacacgcgacgcttctcgacgacccactttgcttctgaaggccattatttcgttcttttttggaaaactcttctttccaaagttttccttttttctccttcttcacatgttttctcacgtcgcctctctcttcgccttcttcccttcttcaccgctctcgctgtgtctccgctccctccgcgcgaccttcgacgccatgtgtaaccggagaccagccaggaggccgatcgagagaaagaccggcaatcgaccttctgctgtttgaggggagtttggaagcgtcatctctctccgcagtctcaggttccgcagaaacgaggcggacaatttacattttctttcctccctctcttgcctccccgtcctcttcttcctcctctcatctcctaacgcagctgtcggaggcttttgagtcttcggttcccgttttccacgttctctctttttccaattctgtctcctctgtttctcttttcgtgca

SEQ ID NO: 512 - DNA, 2283 bp, Toxoplasma gondii
gttgtaaatctaccgtggcgatgggagggaggcagtctccttcagaaacccaggtcagatttctgtgtaaaatatgcttgccccgctacacgtagcggacccatcctatgagaaaacgtctgtggctccgttaaaacaagatccaccgcgttccacaagtctgctggtcagcctttgataacatttgattcagattcgcctacctctggaccgtcataatacagccgcagttaaaaaaactgtcccacatggggttcaactttcaagttggcttcgacagtatcctacatcacatctgtgtgggtccaaagctgccatacatccacttggccgcccaaattcttgatgtcgatatcctggtaactacatgatttgatgcactacatcgacactgttcgcaggactttggagaccacgaacggattcgccacaaaaaactggggaaaagggaactaccatatggaggacccacttaaaaaacatattcctgcttttatgatcctggtccacgccgctcccccttggttacgggtggaacaagacgaagcgcctgcaaacttgctacgatatttgccaccgaaggatcagaacctcccctcacctgctgccgcattaaggacagagtcgccgtagcgagaaagcgtgcatttgctgattcattctggaaaaatacacgctgtcgttcagcccgtcggttcgcgctgcggatatactgctctttccgcagcgttgaacgcctcgatctttcttgaaccaaatccgcttcttctcttcgctgacaattcgtctctctctcacacctcctcctctcaaagtccagccttttttcgacgactgccgtgtgccttcttctcagttcctttaattccgatgcaagctgctgtgactgtctcgtctccgtgcccccagcaccacctgtatctttctgttgggtcgatttccaaaaatcagattccttcctgtgcaacgcttgtaacagacggctttcctctcgacgtctctcttgttcttcctgtacatcccttgcaatgtcggcttctagcttcgcacattctggacacgttttatggggctcaggcgaaacctccctcttcggccgccgacgacgaaagaacacagtgtatagtcggcgaaagagagagggtgagctacctgaatcacctggtgcatcgattcctgataaaccccttgactcatttccatggccttcgtaagaaccacggcgttcaccggctccatcgcgtgacagaacctcttcagcagctttagcgggagagacggagggggccagttcgtggcctattctgggactatactgcagcgccgtcacaacgcacgccattaccgggaataaaggtatccccaagtccctgcttgccctcatccctactttgtttcccactcttatgagcatgtacaggacacattccccacttttcagaggcgtagagtagcgcacgccaccacctggctcgtgtccagaccgcgacgctgccgggcaccgtcgattttcctaacttgcttgcttgaatccgacgtaaccctccttgatcctttcgcaggcaaggcagacggttttttagtagatgttttctagcttgaatcacccaaggacgacacggtgacagaaaatggacagacaagtgcatgtcttgttcgctggtcagggcaagcgaccaccatttgctggcatagcgtgatccggaagctcgttgtctcactttccggtgaccttcctccgacacagcaaagccaggacccacatccgggattgcatgatgttgcggtgtcatttctaggtttcacgaaacgatgacttgcaacaatcaatcatacaactgcctcaaacggcgctgctccacggacgagaaagccggttgggagggccccgtgtctaccgttgaggcatgcaactgtggcgtcaatctagcgtacgagcgagcttttctgttcgactgcatgcaaacttgacaacacttccgtgagttgagacgtgtgggagagatatgcttgcacgtcttgtttggatttacggctccgttggtccacttccttgacacccagaaaacgtcccagcaccgtaagcttcgttcctctcttgctttgcgcttctttcattaccttggataacgcacatctcgagtgcttctcgccaagacctctgtcggggcctgactcacgagaggcgcacattcagtgagaatctcccatttgatttcctactaaaagcttcatttactccgagaggatccgcaccattttcgtgttttccgtcggcagcca

SEQ ID NO: 513 - DNA, 2094 bp, Toxoplasma gondii
ctggaacgttcttaactcctgaacaatgtttggaatcattcgcattcttcggcatagatcccgagtgttcttctcaagctgctcagtaatctcttgcatgtcatccgtatctagtgtaaccagggaatcctcattggcattgttaatactcccttgatacaactcttcgaggcgaatttggttggataactttctggccaattccggtccgagtaagtttgtcgccttgtcgccttcgtcaccttgaataccttcaagaacctgtacaagcacgtcttcatttcagtaaaattttgtgtgcgaaaccgtctcttgggcgtttttttctttgatggtactcgacaggcacataatgcatacctgtcgggtggcgactgagagatacgttagcttctctgtcacctcctccataatggctacaacacgctgggcgtcaacagtcattgacttgctagaggccattttgcttaagagtcttgcttagtctcctctgtaaaaggaacccatactcctgggcatttcttcttatgccgcttgaatgcttagatagactgcaagcatctgtccgggtgcttgaacacaacttcgagatgtagcagttgtgaaggaccgacgcccagctttcctatgacccagaggcgaggctgacgaaaaagggatatccgtttcagagacgtctgggtcgtatgcttgatgccaaaacgaggctctagacactgggataattcagaggtccataagccatggctttcaaacaacaaactgcagacaaaattgtgtagccgtgaccgcagcaaattgggcatggctcggtgggactctctttcctaaaatgccacggaagacggctagagagtacacgccttgaactacctctttttcactctggactttgtgaatgtacaaagggttgtcaggacagaagtctcggttttcccttccttgttacaatgataccctagaggggtaaaacgcctaccgcaaagatgcgtattcagcagggaggaacaaactccggtgtattcacaattacaggcccattcgtgtgcattgaggacgctatcgttgttgttttaagcacagccacaaccagctggcttggttattgacgcaaagtcatatttacagatgaatatgatccagaaatgaagcactgctgcccgattgttgcagcctctgtcttggttgtgatacacatcgtgtttgcggctgcttgcagagacgctctttgtgcaccatctcgcgttatagccgtctaccccgtgagcctgacttgatagcaacatacagttatctttttttgaaagaaaggatattctacgagtcaacaaagtcagacagaacgaagctcgtcgcggagccccatgaggcgttttcgcaaggttcaggcgccacacgctgctagcagcgccagcgtgcgatcaaccactcgaggtcacctttgcgaagcccgtctgtttctgggctgccgtttcatcgggaaaagtgtgatctcgtgtatgtcaccatgctggcccctggttttctgaaggttacagtctcctttctttcgagaacgaacaagacagcttttgacgaatgcctgcgcctggatgcaaaggcaacagaggggatccttgagttgttgccggtcttgctggtcccttctcagggggcatgtgcatccgacatcttccttgtttcctggccccttgacatgttgcgcatcccctttgttgtctcccattaacaagcgcgtgcttttacgctcagtggcctagtcatatgcagctgctagtatcgcgaaagtccctattgcagcaccgcttacctaaatttgcagaaagtgtgcgcagtccctggaaatcgttctttgtctttgtacgttggtcgcctgcgggttcctctctcgacgtaggagggaacagtgcatgctctgtccgttgccgccccagaggttttcaattgccgtgccataaagtgtgccacacacgaaaaaagcacacggcttgcgccatagcacatccggtatcagaggcgttcctactaacgcatgagacaacgccgaaggcctgctgacgattctcacctaaaatcggtgttagtttacaataa

SEQ ID NO: 514 - DNA, 2680 bp, Toxoplasma gondii
gagacgaggaccacagaccacgcgtagacagaaacggttgcaagtatccagatctctcctgtctggcaagtcctcgacttaaacactcagtagcccagattccatgaaaacacggaaagcggcaaaatactgaaagcgacacctttcgggtatctcaagtagttgggagggaagccgtacgtgacgttcctcgatgggaaaccctgagcccacgcaggattcctgtatatgccgatgcggtgacaaagacagatctgccaaacttcgtctgttgcctctttctttaatgacaaaaaagcgtgccaaggagagatgagccagtacccaaggtgtcagccaacactccacaaagagaacccgatttccatgccagtacctgcctgccgggccctgcactacacacgcgggcagttgcactcgaaatgcggcgatgtttttactcacacgggtggcctgatactgaaaatcttattgtctgcgaggacgcctgtacagaaataaatatgtctgcgcctgcgcacagctgagatactgttagagagaaagcgagacacgagaaaaggaactttggcaaaccaagtcctcgtggcgaagaaagaggtgcgctgacgccacgaacgctgtctcctgagtatacgacagacaaaatagtctgctacgacaccagaacgaaactgttgctgaactacggtggcactcatacggatttcagacgggcagaatggcagaaatagtgcccaaaagaagcagaaagacaagaacgaaaagagggaacgttttcttcaaatccgaacccgtctgccttgggctcctgcggtgtccgctgatagctgaacagccataaagaacagacaaaaataccatccgagaaacaagagtcgcgacactttcttgtccttcctggaaaggccagacccttaaagaaagacaaaggcgctctcgcgcgatagaccaattcatttacttttctcactcattacccaagagcaagtcaaaacaaacacgccagagaattgacacaccctagtgctccggtggttcctaaacggtcatcgcttgttcagaagacggtcaaaagtagggcctggagtcaaaccggaaacgtctgtggagtcccgagacctcctgtggtttcctgctgctttcgcagagcagaacgacagaacgacgaatagcaacaacgtcaaaaacgcggcaagaactgcgtggaagatacgcttcatttgcaagacgctaaaataaacaaacacgcgcacacccgtgcgcgcaccagctacttggtttatgaaacccgtggcaggagagaacccccaacttcacttgtctttctcagttggacttttggcggggaaggcttcggggaaaggagcccgcgccagtatacacgcttgccaaagttcgttgtcttaacccgcaaccctagacacttcacgcaactttcggcggcgaaattcaccttaaatgagaccctaacagacggcattttcccctcagtggaaaaacatgctttgctacttgttctggtgggaaagatcgagttctggctcgcgatcatttgtctcgaaaccggtgaaaagtgacgttcgagcgaccgcctggcacacgcgctgcgtttggcggaaactcactcgagtcatttcgcacggtttttcaaggccgtcttcccgggagtctctgctcctgtttttggttgaaaacacagcgcaattatcttatagtccatctaacaggcgagaccgtggcacttcgcttcttttcccacggacttcacgtttgagagaaccatcgacacatgcagggaagtccgccactgttggaaggtctcaaggtcagcggccgctctgcgagccaccgttcggggatggggaagtggaactggagggttgaggaagaccgaaagcaggaaggcgaggaaaccgccatccaaggttgagaaggcgaggaagtcacccgccggccaaggataatacgattacctctagaaaaagacaagttcaagagttctttcccgttgtattctgatggaacctagcctttttccactatgtgtgctggaaactctttaaagacatggtctctacagtttttcaaactgtgacgtgcacgccggtagacccattcgtaacttcttgaccgaccccccttgcataaaataaattgttctacctctgaggaaatcatttttaatgcatgaacaggttgttcaatgcgtcggtgttactggcagcggggaagtggtttgtttgccaggcttccgagggacagtttgcggggtttgtagtgcgcaagacatgaaaccttccagggccatcgccttttcctgtgtataactcaaagcatcttgcattcattttcctcgaagcactgcatatctacttattttgtcaccttttctgattaggagtgcttccccgtgtcacttgcgtccctgcgcaagacgcttgtccttttttccgtccaagccgttctacaggtttccgtgtttctgttttctttgtctgtcttacgaaccgatctgtcgtgtttccgcaaagagacaccgtatcgtgcgagctgtcttacgcggagaactatcggtagggtctgcctacccgcggcaacagacgctcaggtgtttttttcgtgccgagtcaggcctctgtccgttactgtctctaagcgtctcccttaaaaacggaca

SEQ ID NO: 515 - DNA, 2059 bp, Toxoplasma gondii
tcgcttcctctgcaaattctttatatttcgatggatgatgcatcgctacgtctttgcttctttcttgcgagtcacctcaggtaattcttgctccggcggcaggccccgctcgaccgcctacgcaggagccttaagggcaggtcgcgcaggaaatgtcgctccttctctctagttgcctgtttctgtttttcgtttcccgctcgcgttttcgtggtgtttgcgtgttttttgatcgagaattgcccgcgaagcaacaacgctttcacgaaagaggggaacctgctcgtgaagagcggctgaaaagctctaacgcgacggtacagggagctcgaacaagcgtttctggagttctgtgtgaacgaggacttttttagaacgaagttgaaagaacgaaggagcaaaaaggaaaggttcccgcaggggaagaaccgcgtgggtgcagtagagatagaggaagtttttttttccattcttccaatctttgtacctcctgaagtcactagaagaacacaaccacgggcggtgcttcccctccagtttcaaaagagacgaggaaaacatccagtctctgtcagtcccggtcagatccttcgtagacaggaacccggcttgggacttgcattgctcggaaactggaagcggcctacagagatcagatttgattagattcgagagaaaagtgcatttttcactcgcttcgctcaaacgttttacattgcaaagcctaaagaggtaagagacaagacttgtagtcgaaaattccaagttcctcaagaggcacacacagcgcgcggaaaccgtacctgcgcctccttcaaatcgatacaacagcaccgatctccacggccgtcgtgccagacttgtccggtggatgctctcacttcttcgtctcacttgatgttaagatttcggaagtcagttcgtcaacaaagaatggagttctggcccctgtcgtttcacgtccatgttttcgacggcacaccgggaacatgtttcgcaagttaacgaccgaagagagaaaaacagagcctgcaaatgtcctagacaacactgcccagatgcacccaggcgccccccgaatcgcagtgttactaaaaagactttcattcatagaggcctacaagatctttcctgcctttctgtggtcgggtgggcagcctacagacgtcacggctggcggctgcgaggagcgacgcagctgatcgaggcttcgggatgatctgaacagacgaatgcgtttgcgcagcttctgaacaagtgtctccggtggccaatttctgcgttgaactacgctctttttctttatcgtttgagacgtgaacgcgtggttaaactctcggcgtccatgctgcgcagaaaaacaggtagctgcggacactaacgccaacctatgcccgcagacctttttctctccccgtcgacgtggacaacaacgcaggataaaggcgttccgcaagcgagcgtcccggctagcttttctgaagtcaccgcggtttttcctgagagctacgtggttggtcggtacacgccgagtgcccgacttcaccgttctctttgcaaagtctcggatttttccccatacgtggaaagctgctttcctggagacatggctcccgccgtttctcgaggggtcgcatgccctcgtttagctctggagtgtctcggtttacggaaacaacttcttcctcatcgcaaacaccgagtcgtgagcgaaaagcgtccttcacaggaaggcgatgcttcttgccggccgggagagtgtgccactgttcctttgtggcagcaccaccgatcgaacatgaagtcgccgtgacctgcaaaactttcctcgaattgactgttgtttccttctacgacgtcagcaggaaagacctggtttctctccagtgtcagacgataacgttctttgtctcgtctgttccaacaccctctcggtaaatctctcacgccagctcgaagcgtccttttcgagtctgcttttcagtggacgctcgctgtcgaggaaagcagagcgacctcccagagtgttcacccgcaacatttctgcttttccccccga

SEQ ID NO: 516 - DNA, 2740 bp, Toxoplasma gondii
gcatgcagggtctagggttagattctttgggcgtcactctcaagcgcggtggcttcatccctgtagatgcatgcatgcgcgtcctgaagcacgctcctgaaggcgacgaaaagccagaggtcatccggggagtgtactgcgtcggagatgccaatggccagatgatgttggctcacgccgcttcggcgcaggcggttgcggcagttgagacgatcgcgggtcggccgcgaactgtgaacgtgaagcacattcccgcggcgtgtttcacgtcgcctgaaatagctttcataggtaaagtcaataatgtgacggtaaattcgaaggactcaccgcttgtttccacgccaggtccggtgtggccgctctcttgtctttttatggcgttcgtttttcatgcttcgacggtttacacccgtcgacgagggtgtacttgggtgtatgtacaccggaggtaaagctccaggacacagagcgtggttcaacccaaaatggcagatgcactgaggattgcagatatgcggggcaggcagtgtcagggaagtattgccaactcgatgcatgtcgagaagattgggtccattttgaaggaaagtgccatgctttccaccacgggcgtagattaccgcgaaagtgcaactcacggggatgcgtgactgtggcagacttgtggctggttatccccggcgtgccgtatgattgttatgttctgtattgaaactaggtggaattagaatacatactttctgggtccgcaagttcctgagaaagcgcgatcttgtattttctagtgccccccctctggagtgggtgttttttgtgctgtgtcacaggcgacactgaagaagcggcgatggagctaggtgccaaggatggctttgaggtcggcaagagtgtgagccatttccgcgcaaacacgaaggcgatcgcggaaggagaaggcgaaggtatattgaaggttttgtaccgtaaagacacgggaaagattctcggttgtcacatgatcggaatccacgcaagtgacttgatccaggaatgtgcaacggccataacgaacgacatttcagtgaaagacctcgcctttacggtccacacacacccaactctaagcgaagtagtggacgcagcgtggaagaaagctgtgggcatgaatgcacactaaagaacaggggtaacagggactcttatgaattattaggctttcttgaaaccgtttcgctcaattgaacggtcaccgaaggtaggagcagaaaattgaccacattcaaacgaccagatcggccggaaaagttcacatgacggcaaacttggctggtctgtgcacacaaaatatctttccgatgaataccgagcaacgtgtgtgtctgatttataaatatatatttgtggccaacatatatatatatatatatatatatatatatattcgggcctagagaatagagggggcgccagcgttctgcgtcttggcaattgtatgaattctcagggcctggtgtttcgagcacccgtttgttgatgttttgttgtatctacaaccggaagtccggtgaatcgaagggaaactgtgtcccttcacttgaaatctaactctttgtcctgacattctcctggaaatccaggtcccttcaaccgttcacctcctttccgctggtgctgatttagactgaacgcatgaaaacgagaacgtaacgcaaagtacgagaaaagacaataatgttgctaccgttttagatcgtgcggacgttgactgtgtgcgatcgcgtgcacttgattctcagggagagttgcattgtggtggatattcatgggaatagcggttgagtacggggaagaataacacattcggcaggttccagggaaacctggacgaactcgcgaaactccggagtctcaattctacttcagcgatatcgatgcaaaatccgtttgctgttacgccctagaaaacgtcatctggcaatcatgtttccagccgtttcaatgaatccactatcacctgcgacgcaacaactgacgggcgatttcttttgaagttggttcattgctctcaactgaaatcttgtctgtcccgtgctggcaccccagtcccgagaaaacattcgctggagcgcagaatctctgggtgccactcatgcttcagcagtggtgaacacccttctctgccgtgtctgttagaaacgacggactcaacatctcaagaaatcctgcgcctactttctagacacgtaccaacactctgatctcgtacttcacatgattaccttcgtctggtatcttgcactgcacaattcccaacgccgtgttcgtttctacttgtccctctgtgccgcctttcttcccggcagttgtggcgcggcctgcatatcccccttctgtacattcattccgccttcagtccgtggggtgtgcacgtggagttatccgcctttacaaaaacgccacgtaaccattttcgtggtctatgtccttacgagtgtttccgcaggcacgccgaaaccacactcccgctcaaccatcttacggctggactgccactacttgtccgctcggaattttcaatcgctaactttctagctttctgcgtccctcgcttgtccgcatttttcccgccaactttatgcaaacacctgagccttgcacgctggttcttttcgctggctgacaagagcgctgcgtgtgtcgtaaactccgcttttcacgctgtgtgcaggagcgcaaatcagttggcatattttgaaaa

SEQ ID NO: 517 - DNA, 2799 bp, Toxoplasma gondii
cgtcaaagaaaagcgaggagtcttcagatgcggaggcagcgggactggcctcttccctggttcccaccacgcgaagtcgaagcgcagggcgtctacgaggatgaggagaagtcgttcgtacggatatacagagacccaagaactggagggcgctccgggagcggggggattggcagaagcggcaggacctctggagggcagagaagactccgccgaggctgcacgccttcgatccccgtctgcttgtcgcgcctgggtgcctccgacgcgttctcgcgctgtcgcaggaggctcctgggctgtggctgggggcctggcctccgcagtcgggtgcagatgcggaaagagaagaggaaacggcaactccgaggcagaggagaacacgccgagctcgactctggagagaaaaaatcccttcaagaagaagaacgtccccgccgcgaggaggaagccgatgccgaagagcagaaacagaggtaccctcatcagcaactcccccggaggccggtagcgaccccggcgcctcatggcgacaaagagaatggagaaggtgcacccagagcaggcgacaaaggcgggcagagcagaaaatgacagagaggaccagacgcagcagaggcgggcagcagcgggacgtcgctcacagaggtgtgcagatgaagagatgcaaagaagaagcgacctgtcactgacaagctggtggccgcagagaaacgtggtcgcgagttttcgaggagaacgtctaaggtgaggaagtgagagagaggacggcgagaagacggagaggaagcgaacactttcggtctaaaaaggaagcgaaccgcatcgtcaaaacggctctttggaaggggtacgggcggattcgtcccgagaagcgaactgtccctccacttcccactgtcctcagtctcctcagagtcttagcaagagactcatccctcttctcgggtgttccacaggacctcattcgctgcaattgtgtggccgcgcaagtagcaaaaacgagcagcgcggaaacgcttacatcgagacactatgcacgaacagctatacctacgtgctcttgactagctctgtacacagatacatgcacgtaggtgtagacttaagaacctgtggcattacctatcggcacaaaaacagaaaatataaacagacacatggacggacttccgatccggaggttccgcaccactgagcattcatttactgggcgcgatgtcgggtcacagcgtagctgcccctcctcacagactcgagacgaaggtatctacacgttgactccgatcccgacgagtcctcatttgaggtcgtctaatagaacaggtatgagagcaatttcagaaaacacggggaggttttggaaggagacgcgtataaagtgtatcgcgagggtgctcgacgaagtctacgacaaacgcgccacaaaagaagggacgcagagactttgcaagaaagcacatcgtttcacgtggagacaaccagcgcaaacgtatgtccgctctcccctcgaaaatgacaaaggtgcgatttcaacaaaccaaccgagcgacatcatctcagcatccgtctgctgaactgcgtagatcccggtgcccccttggagaggccgaggcggcgaagagacgagagtgcagacgtttttcgccagagaagaacctgagcagacaaaccagggaaaccgtggtgtgtcggcttcaattccaaaaacgccaagtatcttgagcagcggagctcgatttgggtggaggaacaagcagaatcacccacgcgagtccaagggacagcacgagtctgctcgacggctctgaaaggcaccgacgcttgctgatccctccactccatgggcatctgtgcgtgtgtgagaaatggaggaaacgaaaactggagaaacgtgcgggaaaagggggcttttctcggtatgcacataccactgccagcggggccgaacctccgacaaaggcgtgaccgcgcgcgctgttgagacaagacacactttggagacaagccgatgttctttctccccttcgattggatgtttttacgtgtccggtcgggtgttatagaaagaatgcatttcatggcacacccttggaggtgctcatctttattgttctcgtcggaaaaccgcagatcgtgactcttgggagaattctattgcatcctctcagctacttcaccgccgccgatgttcttgtctcctcccggccttttcgcgcgtcctgaaaagaaagcaagaaggactgctttttttcctgctgtcttttctcctttccaggaacaggcacggagacgctgttgatcagagcctcgcgcttctgctgcgcctctgttcagacgaaagaaatccggtcccgataaagagaaagcaggaagcgtctgctttcggagctccgcagactttaaaccgtgccgatattgccttgcgtgtctcctctcgatttcctaggttaattttgtgcgctggaaaaacgccttctctggcgacggtccaagagctctcccctgtgtcgagactcaactccgaactggccttcctcgtcttcatttttttcacacccccaagacgctgttctttcttcccccctcctggagacactttctgccctgtgttactcctttcgttctctccactttctcatctctgcttgttctcttcagtttcacttctttcctggtcaggagcttctcctttcccctaaaaggcattaactcacagcgtttctcgttctgcttcttctgttcttgcttcttcttccctgtcttcccgtctccttctctgcttctctgtcggctaca

SEQ ID NO: 518 - DNA, 3350 bp, Toxoplasma gondii
ctccaggtttccctacatgtttgtctgtctactcgaactctcaagaaaaaggaaaaacgtattctgtccggtcctctgcgcatgcaagtacctcttcttcacaggctactgtggcgcaggccagtgattggcatcgacgcaaacgcgggatgaagcaacatgaagaattcaatgacacacagaaacgaaaaagagcaacgagtgagagagtcacaatgtgcgcaggaggggggcctcgagacttcacaaaatcacatctacaccgtgatgggtttctctcggggtttccaagctgcggagaagcctctacgcgctccgctcttcgccgaaacagaccttggatgccactgttttttcggagaggtccagaacctgagtgttgagacagtggaaaggaaaaaacgcgctggtgaggaagaggagctggagaacggttccggcgggaaaggggaaatcagtggtgattttgacgtcgtcggacgcagcccagagattcgtgtcgaccccaacttccttgcgaaaaaaacagaagcaagttttacagcacgaagggaaaagcgttctggcattcacatgtcgaaagcagagggcctaagatccgttacacgaaacttctttcaggatttaaataaatagtccaacacgtgcgactcacgccccagaaaaggagcggttaaaacgacaaagtcctccctcaagcgctcagagcgacggcgggagtcgtaaggtggagcttgaacatcaaaaaatgtccgtggttgactcgtgctgacgggttgagcgccagcgagttttctcgaggggagagacaacgcaaggcaagttgagccttgtctttcgatgcgaatgctcgcgagtagcatacacactagaaacgacgcggaaaacgaagtcgaataaagagaaaagcacgttcggctgtccagaggggggttggctaagctgcgcttgccctcaaagtaggcttcagtcggttcggtagaactgagaacggaaagtgcacgggagtcatctagaaaaccaagaaactgacgagacgaaaatcggaggcaagatggggtaacgattcccgcatgtgacctcaaggcgctctagcgaaatctgccaattaacctcagcgcgtttgcggacccgcaacgccgggaacgaaacgcgaaacgggagaaaagcgaggaagttgggtggcgaggaaggaaaaccgcactagaagctagaaaaacttatcgagtagcaatttcaaagcatagatgtcgtcgtgggatgttaactgggaaagaaacgatgtggttttactcagcagaagccgtcggagtggaggcgcaatgcctcatccgcttctagcgcgaaaagtatcacgagtccactccggcggtatttttcaccttcctcagttagtgaatttttttacaaggagtaaagtcgaaatgcctagcacgtttgctttttctgcatcgcgttttcaaagcaatagcactacaggagcgctgaatatcgtgaatccagctccaagtcctccgcatacgcgggcgcgtaagaagccgttttttcatcccagaacggcatgcctggcttacgggctccatagaaccgtgggtggcgagagttccgtgacggcgcttacgggcagacgattagactgttctacagactgttttttcaattcgtgttccctgcaaagaagtaaataacatcttcctcagtgcgaatttctccaacgtcatatttttgtgggtagaacaaggagtcgtaggggtttcccgactccattatataccacgaatcgtgcgaaattctaggccttttttccgtcacgtcctgtaaaatccttgaaatatcgtcccgtgttctgtctccatatgacagagtgttactgtagggcctgttgcggccaccaccactgttcgataccaacacatctctactatggtacgattttttaaaaggggaacacctagtcagattctatttctttcctaggcatctttccccaggggttaccgtgttggtgatagggcacagagcatgaaaaacttagcctactcgattgtgggtgcctctggacggtgtcacagaccttgtgtacggtgcgatccgtggcacgtagaaatgagagcaccgcagcgaggtacgagcgataaaccatttccagtctggaaaaggaagcgtccgtgagttggcgagagagtatggctgaaaatacctcctgctgggaaacgaagccacgcgcgaaatagcagtgttcgtgattcagggttgttcgcagaacgcgtgtagaggacaaaagcctcataccgtgggacacggaacagtcgagaggataatacgagcgatttacatgaatgtgttcctctctcctgctggtacatggtttttctgcctccgctgtggaaagaacgcctaccgcggccgagggtcgcaggtcgctggcacctttcccacctgaactgtgtccgaggtggcggcactctctggcgtggttcgcgggttttgcgttcgtgtggtcgtggagttccacagaagagcagaaaggtgagaggaagagtgcgcctggatcgaccgcacacgtggagtggaaggtatgtgtgggtctcatgttccccatgaacgaaacgctctcctcaaggacaacatccccgttaaaaatggatcctcgtctgaggggatcccctcaattctgtctgcagcaaaaggacgcgtgtgtacgggacggcgtgttggaatatccttttcttcatgcactcgcgggttctgaacgtggtgaaccctcgctagatagccgtgatggtgttctggaagacgccgtgggcagagaattcgaacgactatcacacccgccgagcagacggccagcgccgtgggtggtgctcatccttcctgcggcatgcgccgcagggttcagcacgctgacttgaagttgcattggacagggcgagttcgcaatcaagccggaggaaaaaagggagggtgttgctgggcaggggagcagcgcgaagtctggcgtctttttttcgttgcgtcgggtccaaaaaccgccttttctctcgcgtctggccctctcgagtttcgcatctttgtctttcttcactgtcgttcgcgggttttccacctttgtcctccacacacgcgtgttagaagacaccttccttccagcccttcctcatttgcgcgccgcagccaccagtttgtacagcggccggtttggtggtgttgcgccttccgaccccaggtgctccggcagaacgctcccgtgcgttggtgttaggattctttcctcccccccgggacagccgtttttgtcgacttttttccttctgcgcgctctggttcctttttttctgcatcttccaaaa

SEQ ID NO: 519 - DNA, 3464 bp, Toxoplasma gondii
tattttactcctcacacacagccggatgtacatacatcgggagccgtcgacgcttcaccagctgcaagcgcagttgcagagagacgcatgggaagcgaaggcgctgggttgtcgagttttctccgcgcctccgtctgagaactgctcgaactccaagagcccttccggcctatccaggtgtctgtacagcgcaggcgtgccgctgaacctaggcctctttgcagattctctcagtctctttcactcttcctccttcaaatccaagacgcggagagagaaggcgaagaagtggagagaaaaagaagctgcgaagacggtgcagacgatcttcagactccgaaaaaaggaaagcagacgacacgagtgcctatgcgtgagcagaacagcttcttgtccgcgtcgtgtcacctccttcctccttgtgttccctccaggatgattgaacgaaggacagcaggccgttcgtcgttttgcgcttgtccccagaaagacgaggagcttcttgttccgcttttcctctaggcaggcttctgtgctcttcgattctgcacagagcgcaaggagagattcatcccaggcgggcgccaggaaccttttcacttctttcaaggacgagaggcgaagtctgcattcggcgaggaagcctctctcctctttttcttcgctctctccatccttgcaaacacgaaagcagcgaaacgcgcgctgctgagggagcctccggtgtacatcgacccgagcgccgagtcagaacatcctggcggggaagctgcagagacacccgagctaacttctcgcgactgtgtcttcaggcttcagttttccgaagaacgccgcagacacgcaagcagctgtcttggaaaacgacgagcgcccaccaccgccgccaggccgagagagaacaagacgcgcgaaagcggggcgagaggaggagaaaaggagggagaaagagggaagacgggtggacaggaagagcgtcgaaaagggggaaaagaggcacgcgtttttacggagaattcaaaaaggcggaggagactgcgatgatgtaaaaaaaagagatggaaaggagatcgaaaacgcttctgcgcaaagctggctagtgcgtttgcggggtgacagtggcaactgtatgtacagcccaaaagccggctgttcgaactcgaagacagaagcaaaggggggaggtgcacacagaggagagagcgtccaacagtcgtttttctaccagtcttttccccgaagagaagctggacaaaatacgacgaaatcttgtggcgaattcggtaagccaagaggtaaagctgtatagacatcgcgcctccgactcgaaagggggaacacgggagtttgcgtgccgggcgtttccccctggcgattcacaaaaaaacgcagaaatcgactttttggggtccgaaagaccgccaggaactgcctgaaggacgcacacaagggcggaggaggacgcttcggagaaaagacttctttcctcgttcaacaaggtacaaaagagctggtgattccctcttgggagacaccgaagagcgtacacacgtaactgttggcgggtgaggatacacctgagtcgaactcgcgtttctctcctacggaacaacagatttccgagaacagagccacgagctgctcaaagaaaatttgctctcccgatcgcgagtgcctgcctcttgagttttttcaattctgtaaaagtctaccacttataaattaaaaacctaccagacgagaacgcacctctctcctctccaacacactcttccaataggttcgttcctgaactccgttcaccccattcttcgccttctatatatattaataaatacatttacatttacgtaaacattaatatgtatgtatatagtgtttatatatatatatatatatgtatgtatttatagagtgttatcactcccactacggccatcctgataagggtcgcatgcgagtgatcgtttttctcggctttcctgttttttctgctgccacgactttgctctctggaaggcagaagaaagtgcaccgtgtcgacgcgcgtcatctgaaaacattcacttttcgcgcatgtacgaatgtgcatgagcctacacgcacgactagaaatgcctgtctctcttcgcagaacatgcctatatatctttatgcacatatatatatatatatacatatatatattgttacagacatccctaccgcgtgtatttacgtaggcagactacacatgcacgttcctgaaggtgtgggctagaaattgaaaagaaaagaagcttcatccagaacgaatagcgaggcgcgtctgggatgcgaagccgaaaaagcttccgggtgacggactcgtgactcactcccgcttctccctccgcgttcccctcacagccctctccttggtcgctttcttttaattgtctgaccgcgaacacgcagtcgtcgatttgcatctgactcggattcgaatccctgtcctttcacacatttccttctgcatttgagtaaagtgtctggcccccaagcgcgcagctgtctaggcagaagactcgaaacgaattcgagatggactcagaagaatctgcgaagagagagagaacgcactcggaaggataagcagatgttccacggcgggggtgcacacctgaaccgcggagaacgccttggagtggtgaagagaggaacggattttgactggaggcggaaccgaaagacttgcaggcttcggaaggggagagtcattctttgacgaaaccagcactcggtgaacgtgagagaattcgttttttaaacagtcaagtctcttgtttgtgggggctctttttggcaggcatgccctagcgattggtgactcaaggaaccggcttgccagctgtgtctctcttggtgcctctcagaaagagttttttttcttttttgcatttatttgcctttttctttcgaggccgttgccccctgaacctggggtccctacgaaattcttctttccttgccttcttgatcgctccgcgtcttggtgagtagacctgctgcctcaagcgacactcactcctcgtgtctcacgctgttttccctcgtttcctttcttcttctgttcttctctcttgtctcctcaacattcttgtttctttttttttgtttcctcctgcttcctcctctctttgctgcctctttatcccatatcttcgttctcctctcctcggtcattgtctcctctctctttcctccgttccctctcttctcctttttcttctcgtctttcttctctctcttcttctcttttctctcgactgccaggccgcctcacttccctcctcgctgccgtcgaattgtcgcccctcttgttctctccagtgtacatacacccccacgtgggatactcttgttctccctttcgctctttctctcgtggtttctctcttccttcgcggctattgccgccagcgtctagtcctctgttagcaaca

SEQ ID NO: 520 - DNA, 5010 bp, Toxoplasma gondii
gttgagttacgcgagcccagaaaggcaggaagtgaagatacaggcccgctcgtggatcgccaagatgtcgatagttttgcggtgggcgtacactcgccggaaggtacgatgacgcggagggtggagctgcagaaggcaggggagaagaggcgaacgacgaacgagaagagaaaagagagggagaagaaggtcgaagagaaaggagggaaggaggagatggagaggaagagcccacggaacagagaagaggtcttggcgcacagcttctgagagccgaggtcgaaggggagagagacccagaaaactgcagcggagacgacgactcgcgtaagctcaggtgaggactccctctgtgttgtttgggcgtcgagccttctgctgcggacgaagtccaagtttctctacgaacgtcaccagagaacggaagctctctgttccaggtgctggacttggaaaacggagaaggcgagaaacgtccagaaagaggcctggtcagaaccgacttcgcggctgtgaggcgacagccaagaaagagagagtgagaaaaacagtgtggaaaaacgagagggtggaaggacgccaggcttgggcgccgccccaggagggcacccgatacgccgcggacgctgtgtgccgtcatcgcggaagaaacgagagtttcaaggtgaaaatgaagccattatcaccggtcgagacacgcaccgggtcagcaggaatcgagttgagaaaaaagaaaagaactcgagcagttccgctctccagtttccacgaaaaacgacgcgcacatggagtgtgcccgagagcgcgctgtaaacgaacacccgggaggggtccagtgtgtcttctcggaaagaagggatggaaatgcgaagaaagcaatttgtttgcatctatggaacagaaagaaaaggacagatggtccagcaaagctcgtcgatctcccttttcccgagaccgaactctgctagaacggccgacgaagaaacgaaagtacgcgtagagaaagatctcgacgaggtgactttgcgaccaagacccaaaaccgaggaaacgagtgaacttgacgaggcagaattcgatcccgtctgcaaggacagagaccaaacagaaaggacggagttcgagcagtgaaacgagaagcggtggggcaaactgataggaagaacagagaagacgacttgctcgcggtcgtatgtgtaaaagaacatgtcgagtctgcaagcccaccgcatgcagtctgtgcggtggcgtcctgacaagctttagaggaatgagatgaccctccacagtttatggcactttttttccgcatgttttgggcgggaccaccgtctctcgcgaaatccgcagatctgagggtttcatcgcattcaggaaagcagaagggagggctccccgacctcagtaaaaaagcagcgcgggtgcctggttccctggctcagatcattatgtgcgtagagagaaaaaaaggatgctgcattcatactctgcttttgcttctctaccttagtgtggaaggcggccagttcacgagaagctgctgcagcctctctagacgctgtagaggaacctgtaatccttcgtagtgcaaatgcgacggcacctcagaaaaggcgcagggttcaccatgaatttagacttgcccacgagatgcaggtagttcgtccagttcagtctcttcagtttgccgactccgtggaacggaagctaccgagggccgcgtctgagtgcgcttttaccaggcagttgcgtattcttgttggctgtcaaatctcgtgcaatttgagacgtaattgaggaagcttcaagtgactgcttctcacacaaaattcgggcaaatctgatttcacattcagcgttttccgcagagcgtcgtgcagcagttcagcgagtatccgatgtgagaggatccgcgaagtgacagcatcgccacttggagttgtcatatcgctccgaggtctagggcatagagcgcccttctttgtctgacggtacattccacttgcgtacggacagcgaagcaaaagcgaggggaggtcatgtgtgagagtgacaagggtgctgcaacagatcgaactgtaggcgaggctactcaacgggaaacacggttgcgtcgttgccatcctagacggcttgccgttgatactgacagtcttaggcatcgaaggcaggccctacggtcgctgtgttgacgactttcttcgttgacttctctgcatccagagactgaaactcggatcgggaggtacactgcttcgaccagttcaggagaaactgcattgcggtcaagaatctgttacttttttaggaattgcaagagggtgacggccgagccagtcggttccactgaacactcagcgaaaacaattcagacaggaaatggagcctcgcgaataaaaaaccgcggtcatgacggggcattttcccgtttcctatattcagtggccaagggtggtgcggagacactcaccatcaggtatcgagaatatgctccgcaaaacagaggcttgtctttttttcacaagagcttgcgacaaaagcttgcagaaacgtgcacgacaactttccgggcgcctgctcattgacagaccttgcgaaacaggctggcaagctgtcgattgtttctactgacacaaagagaacagaagtttcctttcagctgaagacgaacatccgcagttcttgtggtttcttcgaatgtgcagttggtttactttcgaggcaactgggagtctttctgcgtctgcccgaactccagtcttggcgcttaagaaacgtctgctgcggtgtcgcgtttttgacatattcatcctgtaagaggacagtagatccttgctaaacagaaacgaaatcgcactgatgttagacgattcttctgtgtacaacactgcactgtgaggcaacaaaccagttctgttacaatgctgcgtgcgtcttttattgtatatctgccggactgacgcacgcgcatgacctcaattttaaaagaacacaagttcctctgctttccggtcgaatgcgtcttgacctgtagttcgcatcttgctcgcgatttgatgttgagacgctgcttctgcgtatatcgatctagcactagcaatcggttacaatgggctcttttacatagacaatcaattcacagttccgttttccgtccgaagagctttgcttcacgcgaagtgtttgactgtagacgcggcttccgagtgtttttaccttctgaggaacaatgatccaacagatgtagttgttttttgtgagaaaacaactgcaaaccaaaaatacctgagtctgcggcaaggggcgaccacagacactctagacaccagctgttgggggtcactagtgtccatcgtgaccgtgccacggggttcccttattctccttgcaagttgtacaaagatgagaaaagagtaatgtgccttaacgcttcagcgagagggccttagcatccgagaaatcgatcaagaatacgaaggcgtgaccgcaagacgctttttagagcaaacactctccgtaacgtcgctgtttttcgcgcttctcgttcgtcgtaacaatccggcagggctgctgcttccctggcctgcctgcgctcgtggtatacacatcaactcaaatccgaaaaacaacaggacatttgctgcctgtacgtgacatatgcttcgcgtcttgcccatgcatgctcggttgcacgttgcttctttttgaggagggtcctactagctcgctcacagtccgttgctgaacttccatgtgacttgcttgtgcgccctgctagcaggtggcgggcgctcgacgtcgtcgccattctgtcggaagtctttccgaggttcgctgaattgttttccggaaaactgctgccgcgccaagagcctgtctctatttgtgaagaaatatcttttcgcgggaggtctttcagaggtctcaagcagtgtgctcgtcaagacgggggaaaaatcgtgcagccagcgcacccagccggttttgcgcgcgtcggtctgcggctttcctctttttgcggcttggctgtttgcgttttttctttccctaatgcatatttgctggacacggaagtcgacgctacccaacacacgccaacaggtgatgtaccagctctcgtaaaagccggagtctcgtaggggcgccgctgtcgcaagggggctaggccgagcatggcgttggtggttccgtggttctctgaggaccgtcgatatctgctggacgatgggactgggattttatcaccttagtcgcgtgttgaatttttcgagggggattgcggtgtatcgtttgcgttttcgcggagagctgtttctccgcgatatccaagcgtttcttcgtttccgcagcgaggttctctccggcggtcgttccctgccagtgactctttcgttcttttcctctgcaagtcacctctttgctagccgttgccacttcacgcctttcggccacagaagagggttcccttttcttgtctggtacgagttcccggtgtgagcgccgtctagcgttctgccagtgacaaacactgtcgtggcttctttctcaggtgctcctgtgcggtgaagacttgcacatccgacacactgcgtttgcgaaggatgacactgctctccacgctggctcaaccaactggaacaggtcgaaaactgcagcccgttctttctgtcgttttcttttcgagatcccagtcctgtgttattcatgtttcgcaacctgtaccgtacgggtgctgttactgacagtctcacctccacgtcactctcacaattgaaccacttcgttttttccgtcgctgcccttctccagtgcgttgcaaagtgtcgtttgcaaggatcgcgttttcgctccctcctctccccattagatgggtgcggtcggtagacgaccagcgagcacagcacctccgtacccctcaaactgacggcaacggcgctctttggtttccgtatttttcttcaggagctaccggaagaacgagggaagcaagataaaagagaaaaccgaaca

SEQ ID NO: 521 - DNA, 2415 bp, Toxoplasma gondii
gtgcaagaggcgcgatgtgagcagaatcgttgaggaaaagaaaatacctcgacacaggacaaccactgtttgacgcggcgtccatctaattagatgtgcacatccagttcagcaaaaaactgcaggactgaagagaattccgtttgcaacacgacgaaaacagacggaaaagtttgtagtcggatcgatgtcgagactaggctggaagattcgctacatgaagacgaaacccgacgcatgtggaagccgcaaaagaaatgagggaaagctgtagtccgttgttatgcgccgggtagtcctggacaccatgtcacagagtgtgtagaagtcttaacagagaaatcatgaatctgtcagtcttcaaagatgcagaaacttacgaagccgttcatcatccggacaccaaagaatctgaggagaggtgggaatcccctggaaatcctgagaccctcaaaagctaccgcggcgaaccctccctttcgtctttcgtagaggcaggcaaccgtttcctaaggtcccgtatcgacggagaagccgcatctgtcggagattacgagacgctggaggcgtcacacggaaaaagttgatcaaagaggataccggaaacccgacagtgaacaatcggaggagacagcgcacaggaaacactcgagaaaagacgagacaaatctacgaaactgtaagtgattgagacgaatgtggagaggtaagagagcaggatcggagcgtaagagggaagaaggccagcgaagtcggcgaaaaaacgactcggaagcaaagaggatggaagacagtaggcggggacggagtagggggacgaagatgaaggagaaaacgcgccagaggaggtggcaagaagctccagaccacgggaaggaggtggatatttgctcggtggactcgggaaacaagctctctcgacgggaagctatcagcaaaaaggctttaaattgcggtagctaggctggaaggaaccaccaaaagaagatggccgccacaagcgattccagtgccatgacagacaattgagaagcgagttgtctggaacaaaacaccaagaggaaacgaaattcctatttccgcttcttcggcttccactcaagtgccagcaaaaggcgttcgttctgcaagacaaaaaaccaccagttcgcccgattttgcgggtgttttacagccgcgctcgcggtggctgcctggccgtgaaacgatttcccccgtcaacagcggcttcgccgatgtcttgctcgttctcgtctgcgtgaattttccctcagagcttctggggccagcaaggcagttttcctcctctctgaggacatttagcgctccagttttttcgcttgtttcttccgcgagcgtgtggaagtcgagtgaaaagtacgaaccatgaacggagaaaacgctcgcccgggtggtcggcttatttaagaaacggggtgccgcgagtgctggagggtcgcgaggcaaggggagacaaagtctcgatgacggtgggaatctcagtttagaatgccgaacaggaagtctagcttcggattgctgatgcttggtttaccatgctctgagtacagaaggaaaaggaaggcttaaacagttgattttccgcagctggagggcgtctttccaggccacattgaccgacttggtcgctcggaccccctctcacacggtgtgccacagtgtctagttttgagggatggggagaatagtaaggtgccatcaaagcgcacagacgcccgcgtgcaactttttcgacaaagggggcgcgtcctaagcgtcttggcagagacatcgaaaaggaatcgagcaagggtttcccgccgacctctgtagagtatttgagggggactacgagtggagcgttcgtcgacttccctgccgattttcgaaaagacgaaaggtggtgtatctttgctctctgctttgccgagaaaacacgaaaacctcgttttcgttggaccactcaccaatctgactttttttcacctcactttttttcctgttgcccactccgttcttctcgtttggtggagcaggttgctcaggcacacctttccatgaagagcaggacagttccccgcttgccttcccttttggtgttccgctgatttttaccgttttttctgttgtttccactcctccgcggcggaactgccttcccttttctgcgtttccccggcagctccctactcttgtgcgtccccggaattcatcgtgttgaaaatttctctgtcgctcggccttccttctttgcgtgcacaaaagcgcacacttctccccatccatgtgtcaccggctctcccgtactttcccgcactgttgcatgtagccccgcctcccacgacggaacgctctgcagctgtctccaagttcctttcactggctggaaggagcttttttttcatccctgcaaaa

SEQ ID NO: 522 - DNA, 656 bp, Toxoplasma gondii
tcgagacgcatgcattcgaaacgctttgaaactcggaaaaccttactcgcttctggtcaacgaagaactgcggacccgcagggggccgaggaacaacgacatggtgtgttggcggcgggggaggaggagcagatggggacgcagctgccatcttttggaaatcgaaggagtcgacagagagcagagagctgcagagaggagacttctcttggcgacgtgagcgccttgttgacaccgctgcgtccggtgtatctcgcgtcttagaaatcaagaaaaacgcagaaactgcttctacaatatccagagaagcacacggagagcaagttcgaaagtggacagaaggcactgcgagagaggacgagagagaggcaaggaagggagacaggcagcaggaaacatggagagagaaaaagtggaaagccactgcggtgagagagacaacgggaactccagaagtttttttttcgcgaggtgcagacagagaggagaagaagacaaccgagagaagcacagaaagaagaggaaggagaggagggaggcctctttcagaggtcacgagcggccttcagttctgacttgaaaatacgacggcggcggaaacagtgaacgcaatcgagagagtcgaacattttccctgtgaacctgccttcctcaaa

SEQ ID NO: 523 - DNA, 4270 bp, Toxoplasma gondii
tatatgaatatgtgcacttgtatataggtgtatccgtaattacgtttaaacatacgcatgtatatacgtaaacttgtagacatgcatgtgtatataaatatatatatttaaatatatatatatatatatatttggtttggatgtgagaatgtgggggcgggagtcgaagagacgagaggaaggactgttgaaccagcgaacgtcttggagacgcagagaggctgtctttttcgagagaatgaagaaacgttttttttctgcgtaaacgcgcttttttagcttaccttcgacttgcatgccctcgacgaagccccgcttgacggtgtagcgacacgggaaattcggatctcgcgcaatgtacgctttctcctcatcgaaactccgggcgcctcctgccatcttccccgccatcctgtcaccctgtttgcctcgatgtctgtttcttctctctttcctcgtctctcttcttgtcttagtgtgaattccttcttctctgcgtcttttttccctgggcttcccgtcctccttcgtatctgctgatcgtctcccttgcctctgccttctgcctttccttatctcctgatcgccttgtttctcttcagacttccttatcccttgtcttcttgtcgtccgtctcgtctttctcttaatctccttatcgtcttgtccctcgcttcttccttctcgtctctcccttcctccccttgacttcgcatcgcccccttatctctatcttcgtctccgcatgcggacttcctaactcagctgtctctgccgtctctgctgtttctgctgtctctgaaggacgcctggaactgctcgagaagtgaagggaggtcgagggaaatcgtcgcggagcgcgtttctttcagcggcgtttctctgcaaaaagcggtcttcatcacttctcgcgttgccgtcggccgcgcagatgaccgctccgtcttggaagcattcgcctagaactcgctggaaacaaagaacgccggaagttccgcttcttctcgcgaggtgagttgcgtacaggcgcgcagagtcggagcctccacgcagcgtctccgctgacgcagggacgaatacgaagcagtgccgaggcggctgcagtctgttcctctgcttcgcagacggagcggttgaacaagaaacgcgaaagtctttctgtagaaaacaaaggcaacgtccttccaagttcgccgcggctgtcgagggtgtctgccctcgcttcgcggtctgtgcatgcaaagagaaacgcgaaaagtcgacccaggagacacggagacagaatcacgagaggaacgccgacacagacgaagaactggggaggaaaaaaaaacagacgcgaagcagagcgagagattcgcgactcgcgactcgagaaggggagaggtcctctccgagacgcggactcaaagaagagaaggaatcgcttcttcttctcgatacctgtctcggcctccgagggtgccaggtctacacacaacactcgactctctctgtactgcaaaaaaaaacgtcgcaagtgcaggggtgcagcgcgagtgtgcggaaacggagatttcctcgtttccaccgcgcgggcaaagaagcaaaactggcgaaggttctgcggtctttttgacgcgtcgagaaaggcgtttctctcaccgtctgattccgcagcaatcgaacgaaacggacgtcgcgcgcgagtcccgcctccgcagcgccccccttgtctcttcgcccaagtagaaaaccgcagaaacgaaacgcgtcctccgagagaaagagaaaggcagttgacttgtgtcaaaagacatctttccaccgacgcgtcttcagacccagccgcccgccgactcccccccccaactccctctcgtttaattcgcgcttcacagacacgcggcagagcgaaacggtgaagcattgtagtccgcagagaagtccatgagcgttgctcttgggttcgccgcaggtctttcgttcttttctctcgttctttttatgtctctctgttctcggcagaaagtcagggacgaaatcgggaccgcctcggcgtccgaaggtcctctttctcgtcgattcggatgccgcgcagctctgactcgcggactttttggtgtctggcgacggatcgctgaagcgaaccttgacgcgcgaaagaggattccgccgcgtggattcacgttccgaaaaactgccgagcgaagaaaaaaccttgccgtcctaaaacagaacgcagtggtagtaggaagcgggagcgcgcgtccacctgcttgagatccacgccaggcagaagaaaagaaacgtaaacaggaacgaggaaacgaaagacctgtgtgttcttttcaaacgctcgagcctgtcgatctgtccctgctttgttcagtccaaggtggaaaaccgaggcgttctcaggaaagactctcctcccctctcaaggtttgtaggagttcatagaaatgcggttcttcttggaaaaactgttgtagtggaacaaagtgtgaatagggttccccttcaagaaatcatttccacagcccaaatttccagcgtgaatgccttcccctgcacaaccacatgaaggcatacgcagcatcgagaccgctcgtgaaatgcgtctaaacgatccagggaggcacacgcgattctgtgaggaacgaaaagctctctccaccttcgaaaacgtcttctgaaatcaatggagcgcctccacggtacgtagggcgtggagcaagtggagcacaaactgaagctcttgctaaggtgctaaggaagtttttcctgccgaaattagggagcgaaggtgcggtgtacccctgttgcacgattaagaacagagagggctcctcacggcacttctatctgtttcttttcgaagctgtttccccacacaacgtcgtcttcgagtctcgctcccggagctcctgagacctgcagttctgctgcatcgatttgcgcaaccccaggcgccagagagaagaaaggtttcaggacgtccttgacgcaggccttggtgcagacgcaaaatacagcgaccttcgacactttaacactgccgttttcaacgaaatgctatttggaagagactcgatattttgaacctacagaccagaaacggtcatgtctctctgtcgtctagctaattccagtaatatatatacatatatgcatatatacacatatgtgtaagcttgtcaaggccatgatataccctttttatttgtcatttgaaaagagatttccaactcatcgtcttgggtgcgtgagtgccccccagcaacttttattttctgcttcctacacagttcataggatctctgtggtccctcaccttccttctgtttcctccccagtttagagggcgtctcggatctctcttcctccctcttgcggatcgtagacacttcctaggacgtcggtgctgatccgctttttcaaattgagcaatgattgctcctccgctcatcactggcctaccaccgacttgcccttccagaacccctcccctccccacactcccagtccaatacagtctgatagaacgaacgaattccgaacaggaaaataaaaggatatgtcgcggaaggaactcggcattcctaccccagtggatgcatttcgacacaccgatatgcttgcacctgcgatctctataccagcacaaacaaacaattgaatatcgtgtactttacacgtctctggacagagggtcgctggaaagagtttcttataccacagtatcatcccgtccgttttttaaagtgaattttcactaactcataagaaaaaaagttgcttgaaacagctcctagctaaacaggtgaagctgtcccgactcaacggtaggctctctcgctcgtcattccttttttcgagtcgaaacctcgccgaagcatttgccgacgtcacacctttctgtggcccctgagctcggggaaaatctgtaaaaatcaaataaaagaacatcagccttgtgtctcgaagttcatgcttcgtcacacatgttttctccccctttcgacaccgcagtgtctgctgagttcgaggcgccacggtggcgccttagctcttcgctcgatacacacacgaagactcctgggaccccctgaagaaattgtccagagaccccggcttatatgcgatgtgaaatgctggactgctttacgcagatttgtagcgagaacgcgcagcgaaaaggcgcccctttcgagttgaactttctcgagacaggaacgtgattcggcttatacaagaaaacacaagagcccacgctgcgccgggtgta

SEQ ID NO: 524 - DNA, 3215 bp, Toxoplasma gondii
aacacgagcggcaaatttcccgcgggcgaccggtttccttcgtttggcacgttccatagccaataacaaggcggcggaagaagcagctgctgcagccctgcacagccacacccataaaaatgaagagaaactgatgggcttgtctagccattgatggagctggtggttattgaagaacgctcccggcagagaggtgctaccaatagtggtttgttccttggatatatttgagatcatccgccagataccaaattctctaacgcatgcgagcgaaataccgttgagcggcacactgcaccatctcaataacggggcttcatgaagaaatcccagcccttgctgtcaccagtgtagcttcaccatcagtttagtattttgggaaccacgggagccttcctgcaaaatgagatctgttgatctgacatctccctcagtccagtaacaaacgaaacgcccacaaagagcactattttccacaagttatctgcggaggttgtcatcagcatctggtccaaattttagaggtctatgcgatgtctttgctgcggcaatatcgcatcgacagaaagtactaaagcactgtggcatgaatctgtgcctctgtttttgaaactcaggcacagtcagcacgaaactgcaaaaccggagggtgatccacacttttgctacgggagccttccggaaacgcgtgcatccactctatcgttgtctttgacaacgcatttgatcgggccctcttgttgtggcactacaagaatggctagtcagaagagacgagcatacaacttagccgtttctgcagatgtaatatgctccgatcaacgccgtcacctctcttcaacccatccccgcagcgtcctgtccccacgtagctccgcttttacgcgtatcggacaggtgaaagagcatatctgatgaactctcattgaaagaatggcttgtgtcatttgtacagaaatgaacagaacccaaatcatactcttttcggttacaccaaaaagatcagcggaaggcagcttaaacgatttataaacaacgctaccccccgtgggcaaatgtgactctgggtgctaggtccgcctcatttcgcgctccacagcagccgaaaccacaatgcagtatgcattagtcactggagcaagtatgcttctatctgggatcaacctcttggggtacttacaggatcatcaaagccaccaactgcgtgcgctgagtcttgcgccgagttaccaggacgctccggcggaccgaacggggcactggcacacgagttgtccggtgcacggttcgtcgagtgcttctggcggtcttcgcgtcgaccattcttgatcgactacgttcccgttgttcacgtacaactaccaggggctcagcgtaagcactgccaccaaagtcgcgccctttatactgcgcgacagcgatctgttcgccagcggcggctagagaggcgttctttcttatggctttagtgacgccatcataagtagatttagtggctttagtggcgccgtcatcagcagcttcgctggtttctgtggtgcggtcatcggcagttccactggcttcagtggtgccgtaatcagcagcttcactggcttcagtggtgcggtaatcagtagcttcaccagcatcagcggtgccatcatcagggtcgtcagtgatgccgtcatcagcagcttcagtggcatcagtggtgccgtcgtcagtaggttcagtcgtcccgtcatcagttgattcagtcattccacctacgtagtacggcggacgcggggcactgacggccgcttttgtcgctacgctttgggaagcgaaaacgatgtcgagcatgtgtgacgaaagtgccatcacagcgataagagccgtgacagaaagcagacgtgcggcaccatgaggccgcgacatgctcatcgcttgcctggttttcccgtggcacaccattgttttccgtgccacagtccaggccgtttggccagagacgacagactgaatgagtgatggcgccattccccgcgagggtaagtcaatgaaagaacctgcacctcaaagtgacctcggcccgggccaaagtgtgtacgtgttgtgtgcgcaccacaagaaacgcgagacccactctcagtggggggtggcacggaagcacgacacggatcccagacggtctttttccagacagcttgtgacatgaaaatgcacgtgtcctaatatcaataggaagcggctggggttcgtacggcccttcgcgcaaggccgttgtcttacacgtcgtcgtccaccacggcaggacagcagaggaaacatacgcggaagagactgtgttgtacttttccggcgaaaaccagatttcctcgggaaacattccaaaatctggcaacctataacgtctgactttgactctaacgccaaaaaagcgacagcaaggagaaccgggtcacgcgcgccgcgcccgctttcccagccgatactggggttccgtgcacgcaatgctgtgtgcttggctttcttgctcgtcgaatttagccgttaaccgttagaaggtcaatggcttcacgttcaaaaagaatgtctgctgaacgcgagagaacgttcatttacatttcagcgacacagttggaacttaggaacgcacggatcgtgtgtagcagctgcgacaacggtgtacgacacggaagtggacagagtctccgcgggcccagcggtaagatgtgccgagcggtttcccgcatgcgaccttgggcggacacagacagccagggcgagatctgttgggacctcctgagaccctcactagaagtagaggtaagtccaggtgttacggctggccagggtgcgtgaataacgcatctgaagcaggcgatgggaggagtacctgccacatccagcacttgtacgttgaataactcgtcgacgagttccgcttgcatgcagtttacccgccccatcacaaacaaagggctcagtcggtggttgccacaacccttggcagtcgctattgcccctttaatgttactggcagggaaacctgcctacaacgtgcgcgaggatgtggcgaaaaaactctccccactcctggtttgtggttcttcgcgccgtctatgattcgagtgtcgggggagctggctggttgttggagatggctgcaagttactcccataagcaaactgcggcggactgtagctggcttctgtgagctttgagaaagtagcgctgacggctaccaa

SEQ ID NO: 525 - DNA, 1781 bp, Toxoplasma gondii
tggaggaatgaaagatcgtattagtattccctctgtcctgtaggactgtgaaacttttgaatgtttgacagtctttttaaccgtcctggtgcagagtggtgcatactgtcacagacaaaagcgtgctcgcgacgagcaatcggaactctctgatcatggaagccacctacatggcattccttgctccggaatcactcgggcccttccactgacacaacccatccatgggactacattctgtgtagtaagcacaaatagaaaccttaatccgcgcgggcgtgtaatgctctctcggaggtgctacggcatgattccacgcacagcgactacgcacctgctggtgttgtcccttgctgcaaattctgaaagctcttggtcgctccaagtcatgactccggtgacattactttgcagcaaacatgtctgggacgcggccttgtacctggccgtgttcacctctacaagggacacagcgatagttcaaattcgacacgcggtcaacccgacactgacaaacctctacagcacatctgaatccttgttagcccttgtgaactgacccactacatctggtttcttactgaaactccgtggtctctccgccctcagaagtccttttccgacagcttgccgccttgcagagaacacaggtacgcctctgcaccgcttgcactatattctcacatctgtctccgaaatggtgtagaaaacaagcgaaaaaggagtgttattattggtacaaacactgcccagcgttttcccagtgcatctcgcctcggtgtggcccgattgctttctgccggtacatgttcccgcgccgcaaacgccaacccccagttctgtctagtgtacacatattcgttcatgcggatattccactagagggtgacagtgaagaagcacaaagaatgcaggaggccgcacgaaaggaaggtaaacttcttacaaaagtctccatctgtccgcctatgcgcatgcaggtgaagggaaccgacctcctggctacggacgacgtcgaatcctccgaaaaatggtcatttttcacttttcgcagtgagaagacacccaatttgtcttctatttcttctccgtcgctgtttcccctgccactaggtcgcttccataccctttgttttgagcagtggccatctccagtttgagtgaacggtcgcagccctgcgtgacgcttttcttgcatgcgctttgcgtacgaagcccagtgtgtgtgtcccgatgtttttccccagttgctggatacgttcctgagaagagcacgcggctcctctggtttgtctctccagtattctcttgctgcttctcgcaaatgatcccctttttcccacatcggtttttctgcccgatctgccgcacaacgtctgaggcattcgtgttaggggggcaaaagggacagggacaaaaaggcgagcgggtgcctccggtccaaacgtaacgtttttctctcgagcagcaaaagcaaatagaaacgcgtccctccgtccacctgccttcgagatctcgtgtcggtttgcttttctctgcatcctacgaattcacccaccctttccgggtgcacttttcgttcctcttcggaaagaacgcaccgtgtgccctcaaacccacttgtgtctgctgtgtattcttgcctctccggcgctttcctcgcctccctgtctccacttgtcccttgtacagctaactcagcggtcggggtacctctggtgccagccaggttctgcttccctccagtcttcttcctcgtttttttcacctcgctggcaaaa

SEQ ID NO: 526 - DNA, 1874 bp, Toxoplasma gondii
atagaagcgtaaatctatcgatgagctgtcggctgtatgaacctcctccgaaacgccactgaagcgaaaaataagagtttgtgtcttttgcagggtgtgagtttgatattgcacatgaactgcagtcagatttttacggaacccaattccactgatcaggtggtgaccttgactccaccttttgtttgtcgacagctgcccttgaacagatagggggggtgcttcgttgcgtaatgtacggcgtgcgagggacttaccttcgctaatagggtacttgtgttaacggcgctctcaacgtatgctgcacaaaatgtagctcatgtgctcgtaatccaattgtttgtcttaactactcggagaagatagtgttgaaagtccatcggattcacgcaggcgtaactctccgtttgacactcctggtgtttttgtggagaatgaccctctgaaagtgatcgtcttggcgtatgtggtatcattcgtgcttttgggtgcagtgtcgattctcagcatgaaggaagtaccccggtgctcttggaaaccttcagtgatgcctcggtttccgtggctccttgagtgctggcccgttcaaaagacgcgtgacaacacgtttcaaagagaaacacgtgggtatacatctggagatttaagaggcagcagagatgtcgttctaatgtgtcgacatccacgataaactgccatgcctcttccaaatgaaactaaaagctgttcctagcctccatgtgtgtcgttagcttctgttgtaggaactgttgtggcacaccatggccgaaattcacacaacaccatattccgcagatgttatttccgttgccgcacgtctctgaaacgcaagacgggtcatccaacacgctcgtggaatcgtgctccggctttctgaggccatagcgaagactcctacagccagtacacgggcaacgtgcgtaggtgactgtgtctgccagacccgctgcttcacccggctcatcattataaaggctctgccagctagtgttttcgaaaaatacttccagtgactatgactgaacgcactgatcagaagagacttaaagcaggatcaagttctgagcacccactccattatttttccgttcatcaactacgcaaacagatcagttttccagtttatgttcccgcgcgtggcgctctagtcccccaacgaaactgaagttcatggtgccttcagtggggaaacgctgcttttccacttatgatacatcctcaaaatacatggcagtgcttatgtgggaaacaacttagctcacagatccatccacattctgtggcaaagacaggcacaggccgcgctcgagaaaaccactggttccgctggacaagccggtcggtccacagaatcgctggaccgtgcaacttgactcgtcgctgcgcagtacgtcgtggtgtgcatttcctacatcgaaaagattgttgagcccatgtggcctttgcgcttgctcgcaagtttttgcagtctgtccttgtggttagcgtatggcttgctactggcggctctcgcaagtgtctacgttacattccctcatgcattccagcgacactggctttcagaacgcggtcttagtacgtgtatctgccattaatgcaacaacttgaggtggtcacagtaattctcaccggatgattgctatcatgaaccaccgctgttttttgagaagtccgcgtgcgtgtggcgggttcaccctcctctagcacagcggcatccggtggcgattccgggtatggggaatctacccacgttgcccatcgaaggtacacggactcaagcatttccagtgtatagctattgctttttcttgtgacgcagttcatttttgaaccccttcagctacgtctagaca

SEQ ID NO: 527 - DNA, 2327 bp, Toxoplasma gondii
gacactggaaatgctctgccttcgtaggtttcgcagcagttgcatgcgagacagtgcagattccattgacggacaagagcagaaggaagagaaggctggaaaggctcctcaaagctcgaagaagccacgcctgtctccccgggcgaccgaagcagcatctgctgaggcacattgctcttcagcggctgatgatccggtcgaactctcacacgcagaagactcaacgccaatcagcctgttcatgacaccacttcacattgtacctgaatggaatttcctagcggacctgcgtttgtttttttcgttctgagaaaagaatgtctcgtctccgtctctgtgtgccgaacgaaggagttctcgtctccccagaagccgcagagaaagcggctcgggtgcacaagggcggcgacaccgagtacccaggagcagtcgaggtcaagaagcgaggagcagaaggaaggcctgcgaaagtgaagacgaaaagatctctcaaaggcgcctgaaccgtgcaaaggcggaggctgtcgcgctcgtctccgtcgagcgcgacgccgcgcctgcaggagacgcgcccgcgagacactctgcgtcgccgtccgcgtcgggtgtacgtacacctggtcaggctggagaatgtgatacccacagacggagatcggagcgtcgactcgggtgtctcagtgcgttgttcccgaaagaactcttgcgcggagaacgaggatcgatcaggcagcttgcatgcgcagcgaagaaatgaaaggtcgttttcaagtggaaaaccacacacggccggaaagagagaaccctctgaggctccggaaaggaaagccggaaagggcgcaaaagaaagaagaagggggtgagacaagagaaagcggggcacaacggtggagaggaaaaggacagccgaagaggaacacaggaagctaaggcgaagacgaggtgcagaaaagacagccggagagagagcgacaaagtgagcaggggtctttccggcgagaagcgaagcagcgagtcgcgaaggtataggaagagaaaaaatccctccaagtccttaggactgcccagacagggagagacgagcgggagacgccagaggcgcgccgtgcacgctccaggacagaaagtccggtctgccgcgcactctgcatgcagtcaggggcgcagacacgaatcataagaacaccaaagagaccgaggagcgcctgtgaggccaatataacgacagacgaaagctgaagactaacgcgaagcagaaaagggagccgcgccgaggggcagaaccgaaaagcgccacgcggtgtctcgacaccgggcggtggcgcacggggtttccttcgctcgtctggcagagcagaaaccgaaacgaagaaagctgctcgcgttttggggaggaagaatccttcacatccacctgcgtgctctcaggagtcattgagatcgcttcctctcgctcaacagagcctccctctgagagttgtgcgacagtctgcctgccgagtacgcgtgcaggtgtctgcatgcagctcgaggcccgcgccagtctgaaagacagagttctttgtcgaggccgttcctgcgcttttcatggacatgtggagttttgcaagcgccaagagaaacctggaaacgtggaaatctccatccgaggctcagacctgtctggcggtgccgcaggtcctcgctctcctcgctcgtttcttcttcgcgaggcgtcgcagaagcagccgaggcagcgaaaagtttcagtgccagctcgctgcctctgcgctggttctcgtttcttcggcttctgtttgccctctctcgtcgatgtgtgtgtgtgttctccgaaaattttgctctcctcccttccgtacaccacccgcgggctgctatggagcgtcgattcccatcgaaggcatgactcgttccctctctactactgcactaccgctgtcatttctcttttgtttcctgtctcttccttccaatatcgtccttgctctctcgtcatcggtatcgctccttcccgttaccctgttcgcgttctctttctccctcggtatctttctttcctactacctcgtcttcggcgtctttgtccccgttatcgccctctgtgtagttttctcttctatctctctttctccgccgctgagttctctgttcctcgccatttctcgttactttcctctgtctctccgcttcagcctgttgttgtttgcggcgctcgttcttgctgtcttgattttgcactctcttgtccgcctcgacagaggcttgctggagcgcctgcagtgcaagagggcggccgaagccgaggggtcgacgcgccttgaagacga

SEQ ID NO: 528 - DNA, 2389 bp, Toxoplasma gondii
cagtccctccgacaatttccgctgaacttcctgagagtcctcacacgcgccgttcttcttttgcgtccatgaaagggaagaaggtcttctaaaactccgttcgccttctctcctgtcgcctcctccccggtctccgcagtccccttctccccggtctcctccatctccctctcccctgtctccgcgttctccttccccgtcgcctcctccctcgaccgtcgtcttttctccagcatctggcgccggcgggaaggtgccggagggcgtcgcgaggaacggcgacggcgagagaaagaagaagaaggcgacgactttccagagcagttcaggcagccgggggatgcacagacgcatggccgagcctcgccgcctgtaccagacaaaaacgaggtctttgctcgcgctgagaacagaaggaaaacctttgctggcggcatcgccactgccgtcgctcacagcgtcgtcatccccgcggtcgtcgcgagctctcgcaccggttccctctccgtagtggctcccggtaacgccgggtctctctgcagtgtcgtcccggtcctcgacgcttctcgctcgagctgcgtctccgtctgggggactctgaaccgctctgccgtcctccatgtcggctactgcgtcgctcgctcttgtgttggaagcagtcgcctcgcttcttcccgccgcggctgcgcaggagtcgcctccgacgcgcggctggccaggtgcgtcgagaggagcatctccaggaaggcctcgctctcggcagacaaaaaaccggagcgagaggtaggcgtcttcttcgccgcgatccgctaccttcgcgagaagagggtcctgagaaatcgagtccgaaatctcgcgcaacagcgccgacggcagataacgaagagtcgcttctcgctgcgctgccgccttcagcgacgaggacgaagaagaggaagacgcggaagcaggcaaggaagcagacgaggaagagaaagacgagcaggaagaggcagaggaacaagaggaagaggacgcagatggtttctgtagcgcggcgcggagatgctccctctgctccgcagaccgtttttcgcctcgttcccccctccgcctgtcgcttccttcctctcgctcttcatgccgaagccgattctcccttctgcgccaagtctcgccgtcggtgagctctgccgtctcacagaaaggcgagcgacagcgcggtgcaggcgtccctccaaagcggtgccgcgggccgaggaggctctgcgaggcctgcgttgtcgcctggcgagcgatggatctcgtcagcgcgccgccgctcttcgcggcgcggtcctcgaaaagctgaggcgttgtctgtacactccgccggccagccgagaggccgccgtcacgacggcctgcccccgccgcatcgtggagtatccagccgctggctcgacgactgttgtctccgtcggccagagaagcggcaagcgattcactgcggtggcctccatgtacactcgagtgcggtgtacgtacactcggccttggcgcctctgccgaggggccgttccgccgttggattccggagtggagatcctcgctttgccaagaggaagctctcgactgggatgtggggacgcccatggctttccatgttgcgctgttcgccttcgcgttccgtctccttttcagagtttcccctgtcttgccctccgtccactgtgcgccagtgcatgcgcggcagtcacgcgttcctgcgtcacagtattgaccagtctgcggctttttcggcgaagctccaagaggctctgcctcacttctcagctctacagattgcctgcggcgttcgagcggctctccccctgcttttagcccaaggctacacctccgttgctcactaactcttgtcggctctgcctgctgtccccgggagcaaggtcttcagcagctgcgagttcctgcggcgaccggcgaagaaatccggcagctggaagaccgcctcgaggaagagaacggtgcttccagtcgtccagagcagcacgtttttctctcgacaaagagtttctcctgccgtctcgccaagagatggttgtcggacagaactcgaaggccctctccacgccgaggcgtctggtccgcgacggcgaggagaagaggcgaggcaaaaaaaacaggacagggccggcgcctccagcaacgcgttgggagaaagtgaagacagtcgagcgagaaaaatccagcgttcctctgtcgacaggggcggtgtcgctgcaggatatacagtagcacaccgtcttccgcctggtcatgacgcgggcagacggaggaagaccagagtatccacctgagttaagaagagttcttctctctcctcgaactcttgcaacatttctaaaacaactgtttatttcttttccaa

SEQ ID NO: 529 - DNA, 2234 bp, Toxoplasma gondii
catcggcttcgttgtgacgtctcacccaagaaaaatacaagtaggagttgtccagggcctgggcacactctcgccatgtttttgttctcgaccaggaagtgtatgtgaaccagctctcgtgacaggatgggtgcagcgcacttttccatttccctgtgatcctgctaatgagctctttttttccccaatagacgttttggcactctgagagttacacaaacagcaattcataaaagcaagaagaaacatgcgtcatctcacggttgtgcggacacttggcaacttcagctctgaaaaaaaccgtaccccgacttaccgcccatctgcattaaacgtagttgccttgattcagccacactcgcctgattagggaagcgaatagccctatcaaaatcgagagacgcatttctaaaagtctgcaatctatcggagggaatcgccacttcgtcggatgggccgccagcctccaggattgacattcctgacacacagagcagtgacaagcgttttcaaatcttcgtagcagaaaaaacacacccctacatgaaaggtgaaaacctgataggctatagtctaggagaaaacatggaggaaggtctacccataggatactgaatatgacaccagttatgagatacagacaaccaagttctttgtggttgctataactcaccatagcttgtgctatccacagttgctggtggactcaaatcactcctcgacgttccgtagggatgttgtgaccgtgaaatagcttcagcagtgaaaatgacacataaagctaccaggcctccaagcgtagtacaacggcgacgtgtatatttttcgtacagaaattggcgacggcatgtgaagacgggggcatagactttcattgcgtcaggtggtcttgacctctgacgaccgagtcgacacgatatcaggatacagttccgttgagagagggcacttgacatcgcggtacagagacaggaaacaaccatcaactcctgtagaaaacgcgacgcacgcaaattgactactgccttgcattgtacccgtacgtcagtaccgagatcaagtgccttgcggtgatgaagacagacaacggtgcgcaattttcaccagctaaactccaccacctgatctacatcacgaaggaagaagctggatccactcatgccatgctaaacgagaccaatgacgctgttgttctcacgaggcggaacatgctataacctcaagattgcatagtacagcactcgcgcagaacgaagagttacccgagtttacgaaacaggtcctcacagttgccattcagtcacagcttatacgctgcacatgccgtaccctgacttgccatatctctggcagcgtaaaaaaaacgagcaggtgactcgacgcacgaacctcccgcgtgtgtcaaaaaaaaagatcacactcaacctactctcgctgcgttgcagagtctcaaaataaaatactcattcccgtacctgtggaaacttctagactgacaacgatggccctggacccacaaattggaaaagcaagagccatgaagctgaatacatgcctgcatgtcggtggacggtgtcacccgaagaaccttgtagcgtctcgtttcccctaccggaaggcaccgcccatggcagcgccatcgaaggtgtcgattgttccattcagcgatacgcagcaggtgaggtagcgtttcgaccacctggaccctgagggggtgcgctacgggctagctccgatgagcggcgccttctcagtccatttgtttgacattcatctgtttccttcacttattcccgcgacagcgagctaagcgaatgtgctgtatctccattttgggtatagcagagtcgcgtcgcttgagacgaaccgcgtcgattctctcacgtgccctcggcttggtcccgagctgactggcggccagggaagtgattgcgggggaaaaacgccgtggacttggcagcagaaatgtgttctgaacgtcactgaacactagggagggaggtcgcctggtttcttctctctcacttcactacacattcttcatatatgtagtcttcctcctgagcgggcgttttgggatacgttggtgatgggccactagaaacatggtgcacggaccgcatgtttcgtaccttgtagcttcccgtttctattagcagtacatggatttttgatttcccttgatttgttaccgttccgttatctctagtatttcttctggcgcgagtctgcaa

SEQ ID NO: 530 - DNA, 1484 bp, Toxoplasma gondii
cactccagttctcgacggttcgtagccttcctctcttcagctgaacgaggaagactgggctctccctcttgctggcgctcgccgcagctcaacttcaagcagctgaccttggacacacccgccgaagaacatgggggagcagaggaggcagaggatgaagcagagcgcgggaagccggcagaaggagaagacggagaggaaacaagagaagaaaaatgaggaggcgaaaagggagaagaagaagccatcgggcaggagggagaaacgaaagcagaacacgagaaaggagagagagaagcagaaaaccgacgagacacaccagcggcacccttgtgcaggaaggagacgctggacgctgggaagcgggcagctgaacctctggcggagaccaggagagaggcgcttctgcgagtcgccggcatcatgaagaagaacggaaaatctcaggtgtacagacaaatgaaagcgagcgagcagattgctgcagtgtcctctcacttttctcaggtgtgagcaccaaggcagtcgaggctaagagatagacagctgcgagacgaagctcggagaatggtgagcttggaagagagagaagcacaagaaggatgctttcgcttcagaaaacgtggaagacctgtggaaccacgaaggcggagtgtcaccctctccatcagtgcatgcgcgcgtctcccttcgtcctttccgttttctgaagggaatacgcagattcagacaagacgagaagagagagaggagaacagagcgcgcccagagggcgagtgcctcagaagcattctcgctggtcctcttgttcaaacagaagggatttcatgctcctgctttcttcacgaacctcttcgcaaacagcaagaggtgcgtctaaactgccttgaggaatccgccacaaaatatcggattttcgaaaaacctctccgttcgctcttccgcgatcattttctccgcttcctgctccgccgagtgctagccgccctcgttcctcgccttcgcagaaacggatctacctcccgttcttctgctacgcgtctcgccaatccagcagatgaggattttccggtggaaaacaagggaaaagaaaagtgcttctgcttctgtcgcttgcaatcctttgccaaaacagaagcgagtcgatcgagagaagtgacccgcttgctgcgtctacagctggcaacagcattcacacacactacggcacaagcagcagacactgtctaaatgcagcgagtgtttccagagaaaaatcaatcaaaacagacttccgatggccacctgagaatcagttcttcagcttagatgcgaactctgtagtttccgcctgctaaatcctactaaaccagggtagcgggaacctcagaaacacccggatcgacacctcatttcaacaccctcccccgtttctccgaatatacgccgaatcgaagcagatcttgcgcgctctagccccgcagtggattttgacggttttgaaa

SEQ ID NO: 531 - DNA, 2576 bp, Toxoplasma gondii
gactttggtgcgtcgcatcatggcgcatctgaacgagctcttgatgaaggccgagttccgcggcaacggccgcgaccgaccgcgagagggcgcgcgtccccacggcgtcgacgaggcgattcaccgtacgcacgatgctcatggcataggcgagccttaatgcgggtccggagagaaaggtttgcatgcgccgcgcggcaccggaggcggcgagctcgaaagacgaggaagaatctacagggtgagaagaagcacagcccagaagcggatcccgcagaaggacatccagcaagacccccgtgacctcgacaggcactggaagtctccgatctcgaagcctccaggcgccgatgtgcatcgcggcttcttcccaggacgcgcggacagaggccagcttcagcgttgccgagtctggcaaatcggcgccgcgagctgcatttccgcaaccgtcctctctgcatgtgtctctctgtgcactggtcggcaccccagctccgtccggagaacctcccctgcgcatgcgccccagaacgcccgcgttctcggtttcgttccgcgagctccctgacgctacatggagaagcagaagcgctacgcgtcgaagctgctgcaagttcctccacggagctgtgcgcagtttccgtcgaccgccaggctcgcagaggaactccgcgcagcaaggccccgtccgactcacgcttctccgccacttctccaggagagacagcgaaccttctgcgaggtttttttccgcagtcttcgccagctccaagtcccgcctctcctgtgctgccttccgcgctcgtgaagccgcgacggcggcgcgcctgcacttgacgccgcggcgcgcaggcttggcagctgtcgccttcttggacggctggcgctggtgaacttgggtgctgcgccggcccattgtgagcagaagactcgcctgggcgacccaagaaacctcgtctacactgcgtccccgtccctagagccgccacctcactgtctccccttcaaactgtgcattgttgacgaagatgcgctcaaggacgcgaacgatctcaggcaaaagttgacggagttaaactggaggggtgaagatcgaagctcaggacgttgtgcggtcggaaggaacgctggggacgagagggcagagaagaggagttctatccgaacaggagcagtgcctccacgtcggctgctgaggagtcagtccatgactgaaatggtttctagtaaatatggagagacttctcctgaatcgcgacgcgagagagaggcgtagatccgcccttgggacatgtcttcccttttgccctgcctggttacgcagagatcggatccttctgcagcgctggggcttccagacagtctgaaagatgcacacaagccgagacttacaagtacaaacgaaaggcaggaccgcaacagtcgccgctccggagagctccagttctcttgttcgttgcggacttacgtcaagaatcgaatttccctccatggattgagagcccgagaccgaggaaacaagccagacgggacgaaaacgcggcagtgcacggaaacaacggggagaggaaacgggctgaacatcggcacgacaggtattgagaagtttgccgacagcgagcgcatgcacgaagaaaaaacggcgacttcacacgaactgcatgccgtttccttgcagcgcgacagcttcgtgcaggctgatgacaccaagcgactttctaagtatttcgtagctcggaagaccggaaaatgcacttaccctgcgcatacgcaaacgttctccatgcgcgaagacgactgaggcgaactacttgtctctgcgacgggaaaatccgtgaacaaacgatcaaggacgtagcaggctccaccaagtgcacaggttctgcagcggatgttcataacggacaaccggaagaaagagtcggcaaaaatgggtgtaaggtgaagcctttgaaggcttaaggcagacaaaccacattcgaggccaaatctgtcaaacacggtagatgcgcgcggctttctgtgcgcgagacgctgctgaggacccctcttgagtgtcatacctctgcgagaaacgtcaccgaggcagaagacacgagtccgaagggcagaagcggccagttccaataaaggcagaatagctttagtcaagttgagcgcctccggtttctggacgcagataatgacaacagtcggcagcgtgagagtccggacgcgatgaggttcatcgaaagtgtctgtcgccctcgaatcgaagaacaagctgcagacggaatgcagagaacaggttttcccttgcttccgttttgacgcattcccacagttgattttgttgggagcgacggctgaactctggtttccgctggcagtttcaagaagcagattccgtttttcgcgttctaagcgatttcgcccgtgagaccctccctcggtgtctgcgctgctttccagtgggcgtgaggcgtttctgagcctaccacaggcagagtcaatcgagcctctcgggccaggaatcacagcgacacagccacttgctggttgcggagttcagaagagaagccgctgaaccgcagcaa

SEQ ID NO: 532 - DNA, 1585 bp, Toxoplasma gondii
actgttagctgtggtacgttatgaatcggcagtgctgcgtctttacgacaagtgtatgttttttaccatttaatcaaagcgtgcatagttccgtttcgtgaaccttgaaacggtttccaccaaggaaacctgtaaaacgcaaaaatgaagcagttctcaggcgctacatcctgcttctaggtgcctgctttcccccgttttccctacactgtctgtccgatgcctagcccccacgatccggttatctgggaacaacgtccttatgcaagggtggtacgaagtcgaactaaggtagttgatggggaactggttgctcaacataccttctcactgataatgctgacattagtcccgatgaattacagttctgtctaaacgaaagagtcaagtaggcacaaaccgtagaggaattcctaaatatttcaagacctacacactctaaggagtcgctgtgggtttttatgtacatgtaaaaatattcataaacgtttgtctttgcacagatgtttatgtgtgagtaggcgattcagggagtgcagcagtcatctggtggctctccaccttccttccattttgtgtactttccacgtcaagagtatttttcaacctcccctttttgccactgcggaacgcttgggtgaaccaggtgtatgtacactacggaccgtgggaacatatgagtccttgagtcgagcatcatacatgaattccccttgctggctttcttccttctgagatgggaaccatatgaccacaacaaaacgtcagaatgcacagatctggtttttgtcgtgcgtgttgtagggccctgattagggttgcagagaacgtgaacgttctggtgtctagaaccagtgtcttgaccattctagaacgatgggcgctgacgagggttttcaggtgccccatacgtgttgtttttgattcggattgagagactaaaggaaattctctctttatgttgaagaatttgacagagattagaattgtcgaggagcccgcccgaaaaactagcccttccacaagctacgccggacttgcacgttcaagattctgcgcgtgcagtcagaaaggactggaacattttacgtatccggtgaggtgaattcattaaaaaaaggtcgtttcgttttccggcgctggtcttctatagaatacactcttctatttaactagtttcgcgcgaacttgttgcctcggacgtcgatccgcggttggtggaaccatggcgagcttaattgcatgcacaccagctgtttcgtcaacgcctcgagccttttctgcaacatttctctcgcgtgtttcttcttttcagctctgccgtgtgacgaagagaaacactgccgatcacataccacccgagaaacacagctttctctccagtgtctgtccctccgcgacaccctctccctggagtcggagacttcgacacacagaagacacatgcacaccggtcccgtcagctccgccaggtgactcagttttctcttcagaccttgtcctctctgtcttgtatttatatcgtttagttccccgttttctcctttttttacgtctccatgatttgccgcgcgagtcaagacga

SEQ ID NO: 533 - DNA, 1755 bp, Toxoplasma gondii
aagactctatgaggcgaagaaggtcgaggtacaccgactgggtcactccgttgctgcggcccctctgggaacggcgagaaagtcgcgcagtgtacttgcgtaggagcagacgaaggcgacgccacagacgaggaagagaggaacgcagcagcagagaagggcacaagagaacgaggtctgcagttgtctctgaggatgcgttgtcgagagggaaaccacgacgcccctgaggcgagggaggccgacgaaggcatgctcgagaggagcggcaaggacaaggaggaaatcctttggacgacgggagacgcgaggcgcggcacagcgaggcgaagctcctgaaaggccaagggagaatggcgacgcttcgttggcgggcagcggcgcaacgaggaggcagggatcggcaagggagcggagacaactgagaacgaggagcgatacgcagtggaggagaagcacggaggagacgaggaagagaacggatgcagtgaacgctcccgcaagctcgcagcagaggccggagcaaacgttggggggaaacagagacacaaggaaagacacaagtacccggagacagttttaaagagacaggagacgcggcgcatccttccggtggatcctggcacagcgcgaacgtgcagtcgagaaggctctcgggcatgaacagctcttcgtccatcttcctcgacagacgcgaagccgcgccggaagcgaaggcgtacggacaggacggagaagaaacagagcgagcagcagagagacgccagccagcgaaggagggacaatgcgaaggaaacggagagggagaaccggaggaagagacaaaagaggagaggagaagcccgacgcctggccagagacccggcagccgaattcggccagcgaaaaggaaacgagcgacagccgacgcacgttggcctcacccgtgacgcgagactgcgcgagacgccagcagcaggaggcggcgacgaagccgaggaaacagacgaagaggaggcaaccaagaaaacaagagacgaagggacctgacggggagacggcggcgatgaagaccgaaaaagaagacaagacggagatgaagaagaacaagaaggagatgaagaagaagaaggagatgatgaagaagaagaagaaggagatgatgaagaagaagaagaaggagatgaagaagaagaagacggggataaagaatcagaagatgatgatgatgatggagaatgaagaagcgacgaggaaaggagagacacggatgtaacgaagttcgacatggacagcacaggatgaggcttcctcctctctttccagctccaggcttgttcagcctctagcggcgccgagccggagaagcctgcccgccgcgaggtcgtccccatctagaataagaagaatcggtgatcagtcgatcatatcatccggccagggtaagaagggggagtgcagggaaggttcacagacgtcagctgacgaggttgtggaaaaggcgattctcaccatgacagagagcttcaaatttaagaggaaaacgacctctcgcctgttgctgcggggggtctctctcgcgcgcgaatgttgagagttcttttgagactgcggtggtgtgcaccactgagacctccaggtctctggagaagtcggggggaaatcagtttcaatccttctctcgcgacgcttgtcaattcgtcgctttctctgctcttccagtacaggcagtcaaagaaaacaactcgtggtgtgtcggagaaaaagaacgccgaa

SEQ ID NO: 534 - DNA, 3098 bp, Toxoplasma gondii
aacatctgaagagcacccgtggaaaatccgtggttttcttataaagggacgcttcagaggctgttgctgttttctcagacacctctggtctgcgccggacaagccgctttgatgtcaagttgtagttgttttttcgtcgtcttgacccgataggtcttcggttcgttgctgcctctttcgatcgtattgagtttggttcgtttcggtttgcgcattacgaaaaacgccaatgaggtttcttccagaactgccagatgaccggccagccgcgtcccttggctgcagaagaaacgtaccaattcaggaaccgcgtgagtttcacgtgttctgtcgcttctttgcccgtgcctatgaaaggcagtgctgcggaaagatgcgcgtgtcagtgcataagcgttgacaaaaggtcttcacccgcgacaactggagaggtttggacacgaacagtagccgtatctccggtactccctgcccgtgaagcataggtatacggcgggacaaatccattcgacgagaatatgtttcgcacaaagggttactatgcttcccgcgattttaaaccacaggagccctggactgtgtacctggattacaaggtagacactccttgttattcgagaaggcaaacaacgcgctacgtggcactttttcaaagaaattgaaatcttttgatctcaaattccacacaaggtggccacaaaacctgtggtcccagaggtgcgtcagcggtttctgcgcaggtcaatttatgcttcggccagctgggctctgatgggaagttgccgtattcaagtttcgtgagatgtttgcgcgaacaaacttgattgcagcaaagcagaacatctaaatttcgtgcgcaagtgctgtacaatagcgaacacagatgacggcggcacagtgccgccgtgggtgacgccattccacgtttgaatgcagaacaagccactccgaggcatgcgttttttgtttaagatcccatactcgggctccgtagattcccaaattgtcagggcgcatgggccccaggaaactgcggtctgacacgcgtccgccacgtcgagaaatactataccgtgcgcggtagatttaactgtctacctctggctatgtgcaaatgcattcacctgtgctgatcgaattcccctttgcccagcagggctgaaaaacaggtctaatacaaagcctttggcatcccaagaaaacgtgagaagacagtgcattggatcgcctccaccacggtcgatgttaacctatttacatactcactggtacaaacactttccagaacctggagacttcccgtcgaacatcgttaaaacgttgagaggttgtgacagtcgaaaaaccagacaagagacgcacgatgatccggtgacacgcaaaccgtcgttgtcaagaaacaaaaaagcagactctcttatttttgacacgaatatctccgtcactctatatgacatagatcgtttcctatcgtcgttcaaagctatggcgactgaactcgttgcctattgcgactcttcaccccagacgcgacacacaggcgggttgaagccgagggaggaggaacgatcaaaattaaactccactgaacacgtttagatcgtgcgttgttctagccacacagttacgtacacttcacatttgcacagagccttttttctatatggatcctgtaccaggccagtgtgtctacggcaaccccgttctgttagtaatcgtcacacacacatttgacacgactcctttctgatccagcaagcacttgcctgtcatcacacgcaacattctttgacgtcatcgctatttctgttgcggaagggcacttgatacggacgcttctgcgcataacgtcacttgatgctacgcatgcagcggcgaagggcgcaacaaaaaccgaccggtgcccagacagttggccaccaaaaagctgtaaggaaaccgatgcgacagtttgccactgtttttacttcttttttctctgagagaaagacatttgcggagagaccttcatcttttgcgaatggtagttgaaggtttccgtgtgagtccgtcgcgtcgtgtcttctgcgagttccggcgtctgtatatggagaaccacccgccagaacaaccgctgctattcgcaggtcttcacacgtctcaggaagattcgttaacctttcgctggtttccatcttttttctgtgaacatcttacaagaggacgctacctctgtctctgctatgaccctccagtctcctcttctccctccgtccgtccgtcgctcggcgtctcatcctcgccccccttgttgtctcggagatttctgagctttttccgggtctaaatttccttttcctttctttcttacgctttctcctctttggccgacggcaacctgttcttcgaggcattcctacgtgggcaaacgcggtgtttcacagttgcgtgcacgtgcttcctgcgtgacatctacgactgtatgtgcggcgaccagatgccacataaaagggagttgtggaagtttggcgggttttcttgctcttttcctgttgaaggaacttgcttggctagcttcttttcagaggaaggcaacagaacttctagcggttcaaacgtgtccgcaacgtcgcagatgcgaacgtgtccactttcttcttattcgggaccgacattattgaaagtcgggcagcaagttgtctaagaagaagcgaaacgcaaatctctggtcaagtgctgctgctctttcggcagtgtgccgcgggtttctgtcgaagctcgtctcgtttcctccgtagctgccgagtcccggaaggattttctctcaggcgtactggcgacgtgtatattttagtgcatgcattttcgaagggacacctctgcatcttcgcgatccgctttctgtggcctggtttcgccggaaaacggcaacatctgactcgagactctgacggttcccgactgaattcgggtggcatcccaggtcgaccggctgtacctacacctggcgtagagcagcatcaagaccacgtgtcaggcttctgagtgattggaggcaggctttgaagaaggtacgtttttttccgcctgcgctgcggccaaactgtcagcaaacacca

SEQ ID NO: 535 - DNA, 1502 bp, Toxoplasma gondii
agagagtgagctcgatctatgatacacgagtctgagacctcttgttctgttcagacgagactgttcagagtctccctgttctcaagaaaaaacaaagcgaggagaggcagacgaatcagcgacctgtgggtgcctttgcagaacagatcctcgcgacgcttccgacctctcgctcgcgcgcgcttccggagctccagtgtcccagcgagcggctcaaggaccaagacgaccgacgacggcgaccgcgaacagaaatgcccggaagcaagggtgaagataacgcaagaaacaagaataaaacgtcgaaacaacgacggcgacaagggacgaggccgacaacgacacaaagttggcgaacgaagacgtggaggccgaagaaaaggcacacttccaaacgagagacagagggcgagaccgagtaccactagttacagacagaggcctgctgccgccatcaggcggttcattcgccagaagcgtgaacggagtccatcccgttcttaatcaggtggaaagccaccaagaatccgatccgtagattccagtgtcccccgttaagtttttcggagtgaccactggagaaagccggagtcgaagagaagcacgggagccccgcctacggcgaagagccgctgctggttgaccctcgaaagtctgccggctctgtggagtcgcgaaaaggaaacagcgaggcggggaaagcaggaccacatcattctccttcctgtccctcagggagttcctccatcgcggccttcacacgaggagtgccaggaaaggcaggaaaagtgaagggtggcagagaggttcgggggaaaaggagatccgagaaaagcggagagagaatcggtttgacgggggtaacacggaaagcggagaaaccactaaacctgcctgcggaaaagcggcaaacatcggcgcctctcttgagtttccgcgacagccacgaaaagaatcttcgcgcgtgtctcttccctgtattttggtgcttttaatcggtttcgtaaagatccagaaggcgtgaaacagcaggacggaaagcgaagaccaccgggaaacagctcctagagagatggtgtgaccaacagaaatcagcaggaacaatgcagacaggagagaaacgactaggttgtgtggacgcgtttctccagaagttcaccgcaggacctttgaaagcagaatcgagacaaggaacagcaagagcgtcacaaattggccgtttgcttttcacagcgttctctctcacaacagcgaagacaccgctgcagctagcaagagagacctaggttatgggtgcctcccgcggaaatgttttcaactttttaaaaagtggtaaacgagaggcagtcggtagcagcaaaccaaaaaaagaaaacttcgtcgcaaatttccaggccccaatcctttatagaacgcgaaaggctggtcatggcagagactagaaaagtaggacgagcagtcgactctccagatttctcactcgcgaaaacagcgtctgcgca

SEQ ID NO: 536 - DNA, 385 bp, Toxoplasma gondii
ctggaaagagaaagtcccgatcgatatctggatggtatttacgcgagcgactgggtctgtttgtaaagcgttttacattcgtacggccccagtcgtgttcttctgccgatatgccagagcgtttttctgctcttctccctgactctctcgttttttttcgactcgatttaaacagtgctgcagaaaacggaccatttgcgcagagatcctgcggatgcaagccttcgagacctgaacgcacagtccaagtcctgggagatactcaagagaaaggggagcttgtgaaagtctgaactcttaccatcgaggcgcttctccatgaagcggcggaggtccgcggcgggaccggccttgcccataacacccggcatagtggcagggaaga

SEQ ID NO: 537 - DNA, 2971 bp, Toxoplasma gondii
ctgctttcccgctgacacgcgggattgcattcatctgcttcagaagccacttccgtcgacacatgtcggattttgggtcgcccctcaggatcgtttacatctttgtcgatggcgaaccggcaggtcaaaggaggaagagacaagagacggttttccgcctctccgtcttccccctccgtctccgcgcggagcccgatgttccctggcatgattctgaccatcgcctccgtgacgggttcctcgtcctcgtcaccttgtagccgtttcttcgaggccgagtagtggtccgccagagcctgctgcacggcctttcccgccgcctggctaatgacctcgaggattgcggtctcaacattttccttctgcgatagcagaccgccggctgacgcctgaacctgtgacggtggcgaagagaacgtcgtccagatgggcggcatcgcagagcttttgtctcctctaccttcaaaaaagctttctccgtacggcgcacccaagggaggaaaggaagcttctcgagagcttgcccgagctcggggcctaggagcgacgcgagagtgacagcttgagtgacggagtcgtgatcgccgcgagggaagcagacactcttcttctgcgttaggtcgatgccgaacaaagccgcccttctgactggacatcgacggggcagacgacagagacagcgaggggtgacagcgctgacgtggcgtcggcgacacagcgtgtgtgctggtccacatgtcgacggacccgtggagagatacacaggctttggaggatcggagagaagttgaagacacggacaaacagagacacagaagaaggaacgtcgcgcatatatcttttcggctgggagagtgctgggaaacgcaccgtgcgaggcgccgggaaaaaagatccaaagcggtcagacagaagaaagcttgagggcgctgaataatgtctcatacagcccgcgcgttacctcagttgaatccacaatcttcggaagctgggaaacaaacacaactagggcagcatacggacatgcccatctagccggaccaacacgcgtagctacctgccagaacgcatcggtatgtgcagtagaaagagaagatcttcaaaccccgaaccacggcgcacgatgtaagacagtgggggcaagggcaccgggatgtcacatatgggcctgtgcatcggatcggcacgaagaacaaggaaatttatggaagctttaaaactcggaagccgtcacttagcgccaagacggcttctttcggccacgtctccgttgttaaaaggatggattgtgtctgcaagcgcatgcctgaccccaaacacaagaatctgatatcggagcagcagaaaaaggcagagaaagacttgcagattttagaccggaaatgccagctggtcgcttcaagaccagaaaatgcatcgacaagacattcgcaaagatccaaagaacatgacgatctgtaaggggagtgtcacgaggactgccctgaatgcaactcgcgagttggagactccgcagaaaaaacagtaaggcgttttgagcgcaaaaaaaactttatgggggttctcctgtccgttttgccccgattcggagcgcgaggaacagagtagctgcctggcagtcgcaggctactcacggctctgaagaggtcgtgggcacaacacaggtctggcgaactacaagacaagggggctcttctgcagacgactcgcttcgaaaactttggataaagcaggaaaaaccctaaataactggtaggttagttctttctctgttatccagccgacggaatatcgtgaaaatgtagtgacacaagcagttatgagcgggacaaagccgagaaagtgtgtcttgaatgcgatggtccgttagctccgaatataagccgagacgttttgccgttaggggagcgcagagacgcagaacctgtcgagacgaacgctccctttgtagcaccccgttcttccaagcgtaacgggaatacagcctttccttttcccgtctcaaagccccagcagaagcaccttgtgacttgcgcgtgaaagacgccttttcgttcaaacgccacacacacgtggaacacgggaatggacggttggccccgcctgaggcacgcgttcagtgtctgacaaagagtgggacgagatgtgcgaaaacgcgcatcatccacgttgaaacgtggctagcgagttcgcgagctttgagcgcgtttcagtcgcttcttttggcgggtcgtgtgtcttgcacacttcgccaaattctacgcctttccagctctgaatttttgcctgtcgatttcgccggatattcggacgcaaaataattgcccacgaagccttttcgtgtctgcttccctttcctgacatagttgacaccccagggttgttctgctgtcgcgccaacgtggaaagtccaaagttgcaagacgcacaccgctccacgcaaatcccggttctgcatcttccaggaaaggctccccgaaggacaattgagcaactactcagcgcgtgtttcgccgaggaagggaggtgattgaactggactgtgtgcagttcaggagtttcgacgaaaacccgcgttttgccagtatctgtcactgtgtggctgtgtccggccgtcaacaggcgacggcaaacccgccagtctgcctcgcgcctgctctgagggtattcagtgacaaaggcgtaggttgttttctcatctgtgttcactgaattcgttagtttggctgaagaggacggcagtacagttgttcttcaaccgcttttcttcgcactggtgccggagtcgtttctacgagcatcagaccctgccctctctccgtctcttgcctcgttttggctgcgatctaacaggtgtctgtgttggattttccagtgtcttgtccaagaattcctctggtttctcgcctccatcgacccgagtgtcgtgctgcacgcacatcagctgcgtgtatcttttcccccggcaaca

SEQ ID NO: 538 - DNA, 649 bp, Toxoplasma gondii
agaaagcagaaatcgcgtcgctctccttctcaagtgtgcgagacagtcgttgtcagggaactctggaatccgccgctgcgacggcctaaagcctgtccgcagacatcgttctagaaagacatcttctggaggaccgccggggacctctagctgggctcttcagcaatgaaaagccgcctccaaaaacctttcagaaaaggacggcgggggacgcgagacccaagctgtgttgcgagaatcgaactggaagcgctctgcgccgactctttaagagttcaaaggtgcgagagacaggacccagactcgaaggtacggcaagaacaagtcttttttcatgtcaaatgctcatggtctctcggcgagaggagaagctcttctcgtctacaggagaagctcttctcgtctacaggagaagctcttctcgtctaaaggagaagcccttctcgtctacaggagaagctcttctcgtctaaaggagaagctcttctcgtctaaaggagaagctcttctcgtctaaaggagaagctcttctcgtctaaaggagaagctcttctcgtctaaaggagaagctcaatgagtctacgcgagaggaactcctctacagaacaggacggggcgtagtgacaaccagcggcagtgcgttctagta

SEQ ID NO: 539 - DNA, 4021 bp, Toxoplasma gondii
ccttttgtttgccttcgcacatcgccactgttcaaactccttccttgttctgcgtgtgatgacggaagtggggctccttatcgttctggtttggcgttcgatccccgttgtcgagaatcttctctcgccccaccagatcatgaacgatacatacgactcctttcgcctcgttaacagttatggtcttttcggattcatgaccaagcaacgggaggagctcgtcattcaggtagggatgttacaaaacaggaacgttttaaggcgaccgtcgggcaccagcacgttgtccagattcgtcgaaaaacgcgtgcgcaaggtgatgccattccagacaaaaggggcgcgtagtgtcccactggatttgaatctgcagacatcacgaaaacggaaaatgcacacagaatagcatgtgcctgccaactagagcgctgcaccttttcgccacacagtagcgcaatctgcgatcgggatgcgattctacgtggcttcagggaacgtatgaaccagatcccccgtcggcacctgccaacccagcgtggcaaacatatgagttctactgcaagcccggagacatagaccggcgtccatgtttcgtctcgccatactattaccgcctagactggctgatgtggtttgccgcgttcaacgccgacttgcaagctccatattggctccttcggctagtcaaaaaaatgcttgccaacgatcccaaaacttcggctctgctcgcgcacaatcccttccgaggaaaacgccctcccacattcattcgaattctccgctacgactaccactttgcgtacaaaggaaaggtgaggcaagctggttgctcgcaagtcatcattttgcgttggatatggaccgttaccaaaactaccatcgttaagaataaataggcatacctatggttttccccccttaaccaaaatttcgaaagcagttaagtttgtacccctccgacccaacagttacctcctcctcgctctgtctccgatccggttcgtcctatcagcgtgtttggagtcgtggaaaaatacaggaaacgcgaattacgacgcgccgttttctctgctctcactaaagacagaacagtcactctaacgaaggtctcataggtacgttcatgcggtacgctttcctgcaggaacaggacatgtacgagcagggaaagtggtggcagagaaagtatttgtccgagtttctgccacctgttagcgccgccctgttccgcaagatttgatactgtgacgaggagaacgccgtacaaattttcttttgcaggcggtcacgaaggacttagagttgaccggcagttctccagttttttcaaggctaaaaagtaccgtttgtcttgcatcatacaaaacagggactggcaaaatttctacggtgcacatacaccaagtgtcgtcgctgcgaaaggggagctcttcagtgccggaactcacagcccttagccaagtgttggatagttcaggatttctcgagaactttttaggtggtatttgtgaacgacattttgtttttggggggcaaccggtttgtgtcctttggagaaaaggccaagatgctgtgtggcttactgccagtctgtggctgcagtcgttgaaccgacaacagcagacagttcagcaacaggcaaagggcactatgtctcgggaggacctcaatggcaaagatagcgagacttctctagatgcctcgcactgcaagaagcagtagaaaataaacgcattctcagatgccctgtgaactcatgacgttgggctaagaccgcaggctcctgcgaggcagctgctggcggtctgctctgttgacggcattatggggagttcactttaagctttgttgtgtcgaacttcattggttacaaatgaagttttatgcacatcactgtaagagaacaaacgggaaggcaatcgacctggccatgcgagtgcgttgtcgatcattaaaacgatcctttgtgttacatcttatcttgccttttataggttgtattataatagttttcgatatcttctacttacgtttaacttgttctagcaatctgcaggtattaacaactgagtgtcaacggaacaagaagaagtagcttctgccgtcaccttgcccaggctgttccagtgggctttgaactgcatttttaacaccaaactgcgggacggttcgccattcatgttgcaagcagtgatgacccatgcagtgcgcaaataatgaagagccgtgaggacgctttgctcttctctgtacactacacatctgatagatttgttcactggtctctgaacgcaggattcttcgtaaatgcttacagagacatctggtgtcgacactacgcacaacagggttcaccgtgatttccttttgaggcgcttgttctcaaacacggaaagtatgcgtaccacacggcattgctctgttgacaaatccacaattattatctccctgctccaccttcgtgaggccttctgcgcagggacacactaacctaggaaacccaagtcactcttgacacgagagcactgcagcgcattactcagcctctctgtgcggaaaaaaggggcaacaagttctaaaatcgggtggcttccctagaaagcgtgtctttataagttgctgcagtttaattcgaacgctttcccacttggtggtcacaccactgcctcccgacgagccggcctcgcttcggtgacaaggctggggcgactgaaaaaaactcatgttcccgcgacttgtacgccgctctttcagcctaccagcttccactgtttacacttgcccgctgctccaacacgttcagcttctcctttcctaattgacacgtagcgagtccttctgcgaacttctgcgtttgttttccttcgacgttacctcttctgtggctgaatcgcttgccttgtctcgcaaaacggtcgttcccagaaaacgcgtccgcggtcataaacccttcctactcacggcttcgtattaatccacgcacgaaagtgtcacacgtgacaagcggagcaacgccttcctgaaggtaagagttgttttcaaagcaacccgagaccatttgcttccacatctgcgtcgtgcaaggtcctgccaactcgaaactgtttccgcttaccgctggctcctcatttcgtcaatcgcaaggacggaacccggttgaggtaggccgtgggggtggcgcgcagggtccgaacgtgactcgaaccgcccacggcctttagccgccaaaaatgctgagccacgacagagcaccgcgtgccgttcgaactgagtccagacggcggaaaaaacgcaaacatgaccggacgaagttgtgcgattctcactttcttccaggtctttttcggtctacccagtttcttgtgttgttcagttcgtgtttcttttgtaactcgacgcaccggtgggcagtcctgcgtgcagcctctagcaccggcgcccgcgctctttttttgacgtcgatttctgactagacgctgctggtataactaccgcagactcgacccctcgggcgtaaccgtccaacggctctcgctttctaaagcaagagtaaaggcctctccgcgcggttttccctgtcgattcaccttcaaaccatttgttagaaagcgagtgtttcctcaaatacagctcagcccttgcccggtggccgctcacagtgaacgttttgaggggcgttctagtccagtgactatacggacgacggcacacaatgcgcggcagcgctgggtattcccggaagcggatttgtctcttgatttgaaggttttctgttcatgaggtatagggctgtacgttacgcgtgctgtgctctgtccaatgtggcgttgtcccagaaatttcgcaggtgcttccgatacacaatgtacacctagatgacctgcagctgtctctcgtctccgggctgtgcgcttgtccggactacggcggattctaaatgtgccactcatacccgcctttcggctttaatttccgcattttactcatctgaacgctgtatttgccagtgttgcgccggaaa

SEQ ID NO: 540 - DNA, 5032 bp, Toxoplasma gondii
aagggcgaagggacagcagacgtgcatgcagttagtaagcaggaaggcgaggctaacaggaataagaacgcagaggagaccattgaggttgggggtgtggcgtcgagcctccggtgtggggcacaaccaggaaaaggcacctcgccttgcgaagcggacagagtgggtgctgaatccccacgagagcggaagaaaatctcagactgtgaagcaggaaattccagccctacccagagtcgcttgtcaaaaaactcggaaaccttcccaacagaaccccgtcctgtagatgggtctggcggatacacagcctaagagcgtactcatcatcaaacgaacactggggaaacaatgtgcatttatacatctctgcacgcattggtgtgcgtacataatgcgctacaacatcgtgtagagctgcacgccttgcatgcaatggatgcagtacgcttgcgggtaacgtctccgtacaaatttgccagtgggaaatctatggtcaaagcacatagtttctacactcgagaagtatatgcagatgcatgttgtttccaaggttctgccacgtggaaaggatgcagacaggtatttcagtgcctataaatgacaggggccgttatgagaattaaatgcgccgctctgagggctaagatctcaagcgagcgttcttgtgctaaggatggctcgaatttggcgcagccacgtttctcagtatctgctgagatcatttgtcagatgcgtttctggtaaaaaatttcctcgcgaaagttctcgagtcgttttccatttcctggatttatgtgcccgttggatcttgtaaggcaggagccagtaaatgtgacgcctcgatcaagcagaggcagagcaatgaagattacaacggcccgaacgtttcaattaacgtgtcgaacgatttcgctgtcgctttcaggcgcacgcctctacatgatctttcgcgacactcactcgaggagatagcctctctggttggctcatcatactcgttggcaccgtatatacacatctgtgtttttatctccttgtcggttatatttgatacgtgagaatgcgttcggctgaaacactgtaggatgcaaagctcatcacgtgtaggcgtccacttctactgtggaaacaaaatgagatccgtagcagcgaacgatcggcaccggtctcaggaagcaccgtatcagtgtggggtgtctgcacacagttcgtaagagcctgaaaattctgagatgtcctctcatagtcgtagcctgcgcatgaaggtgcatgtcccacaaaaggaccggatcagtgacattgttcatccttgagaaatgccaataacgcatcgctggcgctgaggcaagtagcaggagaggaccacgtgaaggcaaatgccattgatatacgtttactttatatttttcatgggcagaagcaccccttcatcggagctgcgcttcataccaggtgcttcccgcctctgaagagcccgagctttggtagcaatttgggctagagttgagcattcgcagcacgttttacaggcggaatcgttgaaggcccatcaccacgaacgtcgcttcctgcatcatctctcaatctgcccgagtcttgaataccttttcgaacaaccgctgtactggccgcaactgtcagcatcatctattcgccgtcacgtatgtgttcttgtcaacgatgtgcccgtctgaaattagaaacttgcctcctgttgaatgtgcgtcagtaaattcgcgtgttgctacgatgtgtaggaaggagtctccggtatcgtttagtagcagaccgttgaaaggcgtggcctcatctgcttatgtcactgtcgtccacggttgcggcgatctcttcacaggccggcacagattacttcggttgttggacggatggaatagttttcgtgtctacccggtccccggtgcttaagatacacctggtatctccctccagatttcacagattaaacgtcggaatgctaatcgtgggggcagttcttcgctgccgactgcgacccactaaaagccggcaacaaaacgttagccactaaaatgggactctcaaaaatgttgctcagtgatgcacggaggagccccatatactactgcacctgtgggagacataagaaggtgtcgactctgccgtcaggtgccctgactagagattcaaagtcagactctccccaagatcctgcacctggaacccagctcctcgtccctcgaggacacggcttccgaagtcgaaagccgagtgaaaaccttctcgctataccgccgtataacacgattttgttgttccatggccgtctttcctttccagcgcagaagaaacgatgctaggaaaaatatcgacctctcggccatgtttcgtctgtccagctaggatgttcctccgcaaatcacctcaaaggcgcagaaaccaaagcagcatgattctggctgtaacgcaaggttgttggtgagctgaccaagctataagcttctaatgctccaacttctccgctgcccactaaaaagtcccgttgtacgttcaaattcagaaagaaccgcctaatgcatagggtttgtgccaaactactcaggtacacacatatgtatgaagctgttgaccgtgtctttctttcttgaaggcggtacacgaatgtcgccgcctcgcagctcacgttcggagacgcgccgtccctcccctgaagccgtgcccggggtaccgagcgcacacattcaggcggttttttgagaggcggctttttcgtgggtacaaaaaacaatgtggggcaagtaagagtggccgtcgttctcccttccctgaccggcaagaagtgcgcaggctctttttgtttgctcgattttgggtcatgcttgagcttcggacggcttttggggtgtgtgcttccgttgccaaggtcatgtgttctgccgtggctgtcggcagcccgcatatatcgctagtgctaggcttgctggtctcctgaactttctactcgatcaacacggatgcatatcaccgattggtggagatcctttccttcgcgtttctcgtgtctacgtgtcgcacatgaacttgaagccaccaggcaggtgtagctcccttcagaaattcctaggtgtgcagcgcagccgcgagccttgcatgaccttgaactgctcggcgtgccctctctgtgaggccggaccggtttgagtgcgtttaagaagtgaggagaattctgtgttctttccagcgtaaacaagtcgtatatcctcatcccctacgcgaaagttgagcgcagacacacttattttttgggaccttgctcaagtgtgcgctgcctcgtggcctcgactgtatctgtccgtatgcgagttcgtcttgctgcgacacggacacgagaagaacagtacagactagaaacgaaaagtggttttcatttttctctcgtcgcggtgtcgggtaaaccgctttcatgccactcgcgtacactaagttggccctgtgagtgccgacgctgtgagcccgggcaggctgcgtctctttggtaggcgtccattctgcgtgtcggattggcaagcgcaaaaagaacctccagtcaaatcacatcctgtcagtctgccatacgtgtggcgttcgcctgtcgcgattctctttgttttgcttttgttcctcgtttttgtttggtgttcacccgtccctggctcttcacccttgtcaggaggcgctctcccccagcggtcgcgtcgtcgctatctattctgtcggctgggtgaccgcctccattcgtgtctctcagattttcatgacgggcggtgttgtgtgtggcactggtgaaaagtcaagcgtacaagtgtgtatggcacacccttcttctgaggacgagttcatagaaaagtgtcgttattttagatgcttgagtcgaggacaggcccgaagccttggtctgtccggcgactcattctttacctccgaggaccacttttccccaacgggaagtttttgggtgacggggtaaagaagcatagaaaagactggagacgaataaggactgacacttaagtagctattgttgttcaacgggctggctgagaaagctttctcgtgggggtacacctaggaattgagtcggatgcccatgccagattcgaaagattgaggcctcaggcattcgttgttgttgttttacgtcacgtgtcatctgaggaagcgttaatttggggtgcgtccagtctttttggaagacgctgttctctcctacgtcggccgacccctcgacagtagcgttgttcggtcgcgtagtcaggaaccacctttgccgcatcgagagatcctgtgtcgtacctctcctttactttgaggggagaaatagaaagacgaagggaggaaatatgtgccgaagtgccgaattccgtgtgccgtggctccattcaaacgatgtcactgctctacttagcatatgtcctacaatctcgtgtgtgcaatggccgtgccgcttccgttaaaaattgatgattgggtgtccgtgacacagcagctgacttggattcgcgagctgtcacaatgattacagattggtgagtgaagaggctgcgtccagttccggtcataatgctgtgagatagggagtgagacgcccgtcccggtagaagtacagctccagctggcggctattgtccagtcatccgtccgacagcagctgtctcggttttcgctgatgcgcgtgggttccagttcttttccggagcaggtgcttcgtagagtttctcggcggccgttgtcgctcgcgtgacacccgcgtagcaaggaacagacaagccggtcggtatatcaacgctgcattgactcccgttccgtgcattggtgctgacttacctttgtcagaggaaaccgcacaagggacaggaggttcgttcggaacttcagctaccaccgaaggacgactcttctcttcggtgcggaacgcattcctaagttataaatgcgtttacctgcacacacaatctagatacatgcgcgtgcatagaaataagtacataccatttccaggcgacgattcttttagcga

SEQ ID NO: 541 - DNA, 2791 bp, Toxoplasma gondii
tttttcctttgattccgacgtaggaaggagaaaatgtggagttccctgtagtgggcgaatcaggcgacgggagcgaaggtgacacagagaaaactgggagttcgactggaggctgtacagcggcagaacacgtcgatgagcaacaatcaatatcctcaaactgtggagagaaagtcccgttcggtctcgaaacaacatagcctccgcctccacgttttcgagaaaatcggattgcacgccattccccattccctaaagaacactgccttataagaggagtggaagaggaaccaaagagagccgacgcatggtcgggacaatttgaagttacggccacagatggagggacaagaaacagaaggaagaatgagtagatacaaatatttagaggccgcatggagatatcggcgtggacggttttgccggaagtgagaaacttcgcaccaccagatcccacaaacttcggttgcaagaccgtcagagataaagagatgataggaatcaggggtgtctcagaaacgggaaatcccatgttcgttataagcggcgaaatcgcctttttgccggaggctccaacatgcagagaatcctcaccttgcagagatcaggaattcacggggaagggtaagtaggcaggcaggtgacgcagaattccaacgttgttcatcaaactcaaatactggagtagcggggctcattcccttctcggacttgcctcaaggtatattacgaggaaactttagctatccgctacgagacgacgacaacctttgcatccattactactgcctaacgaggctcaacaaaagtaaatctcgtaatttttttggattcgatctgcaattcctgcagcccaaatgagaagacaggcatgcttgcacaagctgtacgtggcggatccacaggcgtggcccgaaaggtaggaaaacgcctgtaatcacgttgcggaaagaaagggtaaggaagtaacggaaaataaaataacaacgcaaggcacagacgcattatccccgttgcacgaagccgagacagtgtctctgtcatggagtgcagatgcccgatttcgagagttgtcacccggattaccaaccaagaagagaaaagacttgcagaagtgcagagtgattcgaaatccgcagcgccacgacgtcaaaacttcgatctgtcggcagcgcgtaaatgatatctcctgggacctgctggctttcgccgtcgtgcagatatcgcggctggtgcttgctcgacaaacacattttcagtgcatgcgtatcacgacacgcggcagtacgtgtgctagagttcgcgcgacctacaccgctcttcaaggacaccacggaatcgcgtggcctgggattattatttaaagcccgaagacgtgaacatcttgcgggcgtcctgttctttagcattcgcgtgtgtatcatgatcggcctctgttttcagcccttatgttcgcggtagcttgtttctcgtcggtgtatcttgcaacagcggaacgcctaggagaaggggaaggttctctgggcggaagtccgcaggccctgcccaagtgcccatcacttccagtcatccctgcttacttcgcacgcccaacgttctgagctgcgtcaagacctctgaagccagaaagggatgttatcacgtatgccgtaccggatccagcaggcaacctaagagtgtcctccactgtaaggcaatgcgtactccaagccgttatgtggtcatccgggtccgggacagcgccctcgtgtgctctctctcccagcgtcgcatgcagacacatgtgtaaaatgtgctccgtcttctgtggctgttcgaggaaatgttttaacttccccaaagtagggagcctgttattatgacggtccacaaatcttagtgagtgcatgctggcaggaaactgcctcgatctgccagttgtccgaatcaacaccccgcacacagaggggggggggcggagtgggggggcaacgtcatgcctcgtaacgcttaccgcttcttaagccggaattgaaacccctattctagtgaatgtcacacgtctattagtgtcgcgctcgtgattggtttaagctggataaagaagagtcaacggtgaagtgacggttgtgttacgccgaagggcatggttccttcgtttcaccaaacctgcgagtactcgcctccaataggtttggttccctcctactcgccattaatattattgtgcaacacctcctgaaaaggtcactgagttttgtgaaaagtgagcgcattggtttcacagacggcggctttttctgggatgatggagcagagcgacggagccagcgcctggatggaggaaatcaccttgcgtacacatcggtgcggctagctacgctcgcgcgtcttgttaacatgtttctcttccagttttttgcgcgccttatcgtaattacaacttaccagtgaacaaacagtgggcacatgagcctcgtgattcgcaggtcaagccagttcacccgtgagtcacaggcatgcactgcgtcaatcatagctgggcaatccgacagctgaacgtgttcataattttgagcggattgttcttggttgggtcatgctcacatggatattctgaactcttattttacgaaactgtgctgttctgcttcacttgttttcgtcggcattggcttcctcgaaaagccattgttccgaaacgtgtttgagtggcatctggattaagctttgtgaaccctgctcatcattgtcgccttgccgaagacagagtcactttcttcgtgtttcgagtttagattactgagcaaga

SEQ ID NO: 542 - DNA, 4129 bp, Toxoplasma gondii
gacaactattcttattctttgcattccaaagccgttgcagaaagacgccctgccgccgaagccaaaggcagctatgcgcatgcacagcctgcttcattcacttttcgcaccgaaacactgatttcgtccctttccacctcgtacggagaagcacagtctcaataggtcccccggagcagaagaatccgtacaggcacttctagattcgctcccgggtctttggtatgacgggcagaacggacagaaagacgacgcggtaatacacctgtgcttgcggggacagcaacgtattcacacgttttctcattctcctggtgaccccgtcttccactgtcgcctgtcaacggcatgtgtatctaactcacgggtacgcggcgtacaaaccctctgggatccaccgcagaaatgcatgtcgagagcacatgcgagaaacaggcacggactggggccggcgagagcgcacacgcagaagtcaaacaggaagatataacggcaaatagagggctatactggaaaaagaaaacatcaggactttctgaggaaacctaaactgaacactgtgcgaaggctggttctgaacgcgttgccttcgattctgcctgctgcccacgctcatcccctgctgctgcctgctacggacgctgtgtgtctgactctcttccaatatgtttcctctcccaagaaaaaaaacgaaagggtgagtgaattccgtcccacgtgctgtttgccgtcacagcaagccagaagtcacgtgcggaagtccgtttactttctgcgcacgttgggcgacgcacctgaagacgggactagaaaagctgacgtatcgaggtcgcacgaaagtacgcggaaatagaacgaaaaacttttaaagagatcccgggaaactgccatctcttgcacaaacgagggaacgctctcgcgtaaaaactcggggaacgcagcgaagctccatggtttctgggccggttctctcccgtgtaatgcgcacgagtggacgccgcgcacgcaaacactggagggctcagttcgtttcggaaaaaatgcacgcgtgtttctccagcgttcgccagctcaagggaaattttcgacccttcgtttcgcgccggaaccgccaaaaatcctgtttttccctcactctttccccagagcgagactttggcccacggcgcagaaaacggacggttgaaccaccggcacgcacggggaagtagaaacaaatcgcttaccgggaaaatttgcagtgacgtcgaccggaaaatgaacagaatggcttcctggagagaaacctgggttttcaggtctgcagcacacaaaaaacaactggcgaatcgacagcctgcccagagaggccttctgtgcagagttgcgactttgtatgtgtacagctcagcgctgtgacacgcgcgacgcccgctgtgcggagatgaatgcttggcctgtgctctccagaattgggggtccctgcggacaaaaaccctaaatgtgcctgtgttcatgtaccaggtcttggtaagaggaccacggaatcgcgagagaccctgtttcgggaagaagaccgtagaacagtgagaggccggcgtcaggtaaagcaagtcttgtttctggagaatacaagaattcgaggacggctacgtcgcgcgggcagcaagtctagccattgtgtggaaaagagacgggccaatgccacagatacagaaaaagcggattttcgatcaagaaatacagtaaccgaaacgtcaagtcgggggcattttcggggtcgcttacaacgcttcccggtgtgtccaaccgcctgtgtgcatcggatgtttgaattcggttttcgtctagcaagctacactacattgaacttttctggttatctggctggccggagaatgcacagttcgttaccctcagatgtacccaggcagtcttttgaagtagcacagtcatgaggttcctcattcgcaagcagaatttcttgcagttcttccgggagggaaaactccaggggtgcttcgtatatccaccagttatcgagcacagaacctacgacgaggcaggcttccgggggaaagatcaaggttgagagttcgaaaagaatctgtgtgcggtttcgtactcacactgtcctgccagcgattttaccgggtttgtctgaaagtgaatttgacgcagcatgatgaccgtacatgattgtgtaggacgacccgatagagagagcgtttctcgtgtaaactattcatcacgagggacaagacacggcgtcaaagatgcggatgctagccccgcagtgccttaacagaaacccttctgaagtcaaacagggcttccacagcgtacagtcactaccctcaagagaactaaggggttggatcgttagacacaagagctcgttcaaaaaagagaccgccagtcggttcgtaacggggaaaccctgccatgtagccccttgctagctggctacaactttgcagaggaacgatagttctgtaacaccaaacgagaactgttgcactcattccgtggctaagcccgctgctggcgacagcagagctgtgaaacaaagaatagaagcatgaacgcacagcgacgctgcttttcttcacgcgtcactgctctgtcgtttgctgccggttccaattcggctgttgttacgtcaccgcgcttccctttagaacgagtccttttgacgtcggcttctttttctgctttaacgccgaacttccgtcgttgtttgttggctaaagctgagaagctgacagcacgcagaagcgccttccagctcgactgccgagcctccacaccatgggaacaacaacgaagcacagagtaacgcagcctttgcggccctctgtgtatgaccagggttctggcagcatggttcctctctgcaggagaaatgtcctggggagaggaacctggaaaaggaggcacaaggcaagatgaagtgccggctattagaggcggcgtgaaagcaatggaggggacagcttcacccgatgacatgcaggcagtgtccaaatgcaaagtagcaaggaataacactaaatgatatccctaactgcgacgaattttcgattgtgtagagctgcaatctacgtataacgcatatacatgtcaatatatgtgtacatacccatgccagatcacttgtatactctcacagggaatggggcttagtgttgttctatctattcttttttctggcgtacacaagccgcaacggttacacatgtttggctgagtgtatattttctgcgggcagacggaacgtacgcttccgaaaaccactttcccctcagcccctttagggaagcgatatcgcgtgtgccgcatatgaccccctgcaaaacatgtcagtggtccactcgcaaaagcctacctctttcggtttcagtagtcccaccgaccggtttttgtttgtgatcatgtgtgttcaaatggcaaaagttccttcgttaccaattccttgacgcgggtcatgtcctctcgggatttggagaatcttcaggcggaaagaaacagacacacatgtacggacgagtgtacgcctgcagcaaccaccccacctgtgcactgatccagtgacaagtgactattgctgttccttctcggctaccgaatcttttggttcctgtccatggactaagcaacatctgcaatagattcctcgcagcacatgcgactcctcctatgcctagctggctattctttacatagtccagcttcgttttcctctccgtctcttagagtccaccggtattcgcacaagcaaaaagctggaactcgaaggagtttcatattcatctgaaaacttggttaacgtaccgacagactaatagagtgattgctgtctttatccgtcgctgattttcgtgaatagcaaccggtctcttcttcacgtgtaaagtctcgcttctccctttctagtaggcttgtggtttcgtccgacaacaaagtaccggccttttgccagcggacgcattccgcttccactgttgcttctactgtctaccaagatacgatccctgcggtgttttgactttctaggcgttcgtggacgattgtccttccccgcaacaacggacgaggaccctagctccgcgcgtgtttgtttccagtctcgttctgccgtgggaaacaa

SEQ ID NO: 543 - DNA, 2711 bp, Toxoplasma gondii
ctacaggtcaatatgcggcgaatgtagatacttgcagatctttgtccagtcagtcggtgagagtggggaaagttctttttccgagagacaccaagagaaatcaagcattttggtgtgacggtttgagtgtgtgtgtctgcgtcgactggcggcccgctggccacctcgcatatacggcgatccaggaaggcgaggaagaacttctcgctcctcttgcgcttcctctcacctcgagactgagctgagaacttcttcctcgccttcctggatcgccgtatattcggcgaggacgtaggttcctcgcgcgatgcacgaaaactggaagagagggatgtctgcctctggaaatccctcgagttttcctctgtcggctctggagctgccggcacacgccccctccccagagggagaagcttctccacgggccgcccacatcgcgccgccttgccaattgtctctgcagaaagctgttcaggtcttcttggctcgaaagttcgacgcgtctctgcacacttggacctttcgcctgcgtccacttcgtcctgtctcaggcctctcaggagtcggatgggaagcgcgtcttcaacgcgaacgaagcgacagctgcactgcttgctcagtcttcatatctggccaaagagaaatgccgacaagagagaacaccacacacagcaaggcgacggcaacgaggagacgggggagacaagtcggaccgagaaaaaaagacaagttgaccgcaacggacggacgtcttcggaggcagaggagaagacgttcctgttcctgttttctctcgctttctcacgtcgcggcaaacgccgtgctcccgcgagttgccttcgcactttcctctggagagaaggaaagctaaacgccctgcagagtctgcaggaagagaagtctcaggagacaggcgtctcctcgctttcgaagcgaatttatagacgcggtggagtccggaaacgcgcaagaaccgcagagaggcgaccgaaaaggcgggcaggggccccctcgtcgcggctgcgaagaaactcctcttcagacgcaaacgttgagacatggaaagcaaagaagagaaccggatttctccctcgtgttccttgctctcttgctgcttggctcagaggcatttctcaatggagcggcaggcgaactcaccagagcgtccttcacttcccgggtcacttttccagaacgtgagcgagacgtcgagagacgtgagagctccatccggcgaggctgttttgccgcgacacaaaaagctgaattagagcggagaaagtgaaaaagcggagaaagtaaaaaagcggagaaagtgaaaaagctggcgcactgagaaagtgtgcttcggactgctttgctagcggagaaccgagagccgtcagcttacatgcgccctctttttcggctgtggaacacggagaaaaggcgaagaaaaagagaagaaaagaaacgaaagggaagaaaaggaggagaaaaagaaaagctcgcagcttgtccctttgtgtgcagatgtgcagaaggaaagattcgtgggaaaaaagcgaaataaaggttggtttcgtctatccagacgaggcaccctcgcctcttcccgtctctctgagaagaaaagactttcgttttcaattcttcgcgaagtccattcgctccttctgcaggtgctcatcatttctcgtctgtttttgcagcgaaaatcgacttttccagcattgcagtgaagagtctctctccccaaatcgctcttctcgaactcggacaataccaccgaggtctcctcatgcgtgtcgactcttgtgaaaacatatatatatatatatatatatatatatatatatatattcgtagtatgtctctgtgctcttcatagacaacggcgtccataaatatgtgcatcggtcaacatctacaaggaagaagagtgtgtgtgtagacaggtgcatgcaatacaagcgtagttcatcttcgatatatatatatatatatatatatatatttatttgcagtttcttgtatttgttttccttaagtgcatgtatgtcaatcacaggcagtggagtattgccgcgtttggatgtcgcggcgtctgcctagtctgttattgtcagaaattgcgtcgattagtgttttctcttagaactttggttgtcgccggtgtttgcgcacggcgtctccgcgggaactttgactttctgtctcctcgccatgctctgccttctgtctgcatgagaaggtggaactcttgaagactttttgcctgttgcatcgcagatttttccacgaaaaaactgttttctgacgcgtcccagttctttctctccgcggacgcctggtgcgtcgaacttgtttgatttgtccttgttccgcgcttccttgattggcgcattcgtgtctttttcgaagcctcacttcaacgcccctttgcccgatctgcattctcttgtctctccggtgcgtctgtcgctgctcgcgagcgtctttttcgcctcccttctggattccggctttcgtctctgtccgccgctctcgcgtttggccgagcttctggagagtcgcttctcggagtcacgcgctcgcccgcagtgcgcgtcgtccctgttctctgcgttcttctctctgtgtgctccacagtgtcgacgtcgtgtctccgtctccggagtttcgtcgtcttctgccctctcttcgactcttgaaacgcccagaagaaaata

SEQ ID NO: 544 - DNA, 4949 bp, Toxoplasma gondii
gagaaaacagacggtcgcgaaacgcgaaagtcatagggagcgaagaggcgaggaacgagacagacagaggcgcgacagagtcggagaggtcacagcaaggcagaggcgcagcgaaggaaaaagagagagccggagaactggagaagaacgcagcgaagagaaggggaacggagaggggcaaggctaagcggatggagaataccacgaggaaacggagaaaagactgggaatcaagacgcagcatgctctgcaagagtcgaatcgaagtgtgcggaggagcgaagtcgagacagagcagcacaggagtgagagcacgaagaaagcatctcgaaaaggaagaggtgcaccatcagtgctcatatagagagcggatatcattcacattagcagtcagcgaaaagtgctacaacgctagtatgatcagcactgtcgtactcggagtgatcactcgtgagacaggactgctggaccgccggttgagatcttgaaaatggaccgaagatgtcagggtcgagcctttccccagcctctcccaagcgccggctttgtcaggaacacttcagaggcatatccactgcaggtgcttgaattcgaacacagagtttctcctttgcgaaggatccctccccgaaaacgtggttggtcggccagcagcacagcgccaatccatggtcaagtgtctctggctcgagagaagttttgtctcaccgttgcgtcttgccgcctctctccctcgctggaggcgataggccctatacaggtcctgagcagtcttctggagaagcctgcggccagcgtacttgggcctgaagggcgccaggagctccgcaggctttctgcctccgggtgtctggctttctccgtctgtttcttcgccttcttctctccgctgactgtctctgacggcgcagagggtggcttcagccgcttcctgttcgtcagggtcgacggggtgtccggccttctcgcgctcgagaatcgttcggtactccgagaccgtttccctcatcaaggtggagagaggaaaaaacggcagagtcggccgcgttcctccctcatgatgtgtggagaagtccgaggcatgctgcacagcagaagagcccgccaaggagccggagcatctctctcccagagccgaagagaaaaagagagactggaggagacgcagagtctccgccgcccttcggggctcctcgtcctctccgagctcttccgtcagctttggcaacgaagaagctgtagaagcggaggaaaacaagaagggttcatccttttccccccccgctgactgtgacagttcgatatcggccatttcgtttattctgtttcgcagcttgtctcctttgcctgtcgtgccgcctgccgccaaagagtcttccgagggctggacgaccgccggcgtgttgcgttgccagagttgcgggtgcggttttgtgtacgcttcccttcgtttccaaagataggccccgcaaacgcgcaaaatgccaccgatctcatctcactgtacttcttggtgtgtgtcgaattgtgtgccaaacatcacagccaggtgacaagacatgagtcgaggaagaaacgggtcgtcggctagagttctctggggacgccgcctgagctggccggagctgcagacggagtacaaaagccaagttagaatctctggaagtgagggagagaaaacgaacagaaactaaagacaacggattcctgaggaaagaaaagctgcatccgcggacgcacttgcagttactcggacttccacagcaaccgctgcacttttcgtccgacaagacacaccgacgagagcggacacgcgtgtgcgaaatcgcgtcgcacgatggtcaaaactctaactccagttaagagttttggagtcaaagttaattaactacacaagaatacgaaagaaactcggtttcccagtcatggaacgcattttcgcttcgtccgctccccaacgaagatgcgtgttgacctcatttgcagttctttcactgtcgtccctccggcatgtcgaaaaaatgctgtggaggatcggggatctgtgaaaaatacgggcgtgcctgaagcgcgtctgtagagtttcaatgcccgaggcagagtacaggattggattccgatggaactgtacttccaactgtacttccacttataagaaccatagtctaagtcaccaggtttgcagtgccgattagatggtaacaaaagccagactccatgttaaagaatataaagtgggattcttaagcttctgtaaaccaccctttcatcaggaatatatactacatgggggagaggggttcggaacgaaagagctccttgccgaacattcacacatcgcggcacctacaaacagtttatgcgcttccaactctctcgcgcatcgcatccacgcagaaatgccggtattgtcgtccaacgggttgcgttttacaagtctatgtaactgcagctacatgtttgaatgttttaatgatgtgatatgaccgcctgcctagccctaaaacaacacttctttggtcaggccccccacttctacctgcgctcgtatcgaggtggaaatagaaaagaatcacggacacagggaagtgctaggtgttgaggatagcactgggaaagggaaatatacaggcaggtaagacgccacgcaagataccatatttttatacacatcggtgcacgcactgtcgctggtgagctggggccgtaatacaacggtaaagtgtttccggcttgtgcgagcaacgcgaacgaacgtttgcacacaaagatgaggaggcttgttagaccctacttttcaagtgtcaaaaggaaaattgagtttttcgcatgaattgtcatgcacagtggctcacaggtggggggtctttctcgtgtacagggtcacacgcgtggacttgcgtgtccacaggacgaagtcgttttgtgcctgtgcagcttcattgtgcagcttgttactcctgcacaaggtttgaggatgtcaaagctactgaggaaaaattggagcaacatcctggtgaagactgcaagaagttgtgaggtctgcacgcgtcggaacttctaatgggacggcatatggaagaacccatttcatttttgactgctgatattgatctccagacgcgcatcgaccgctccgtcgggtcggctgcagaaccgcgcggaagggtgggagccgggactttcatactgcaaattcactagccacgcagcaagtgcagttgatttttgtcgagacacacgtgtgggtggtcgccaccgaagatgtcgtcagggaatcgttcgtggctcagaagctgaagcgtgatgcatccaagctggtcgagcggacggaacgacatgtcgttcccggcctgttgtgccttgggtcatcgaagcgcgaatctcttcgacagacactctgttttttaccgaagccaagagtactttagtcaagtctatgactggagacacgaggctgaattgtcgggctttatgtgtacgagtccaactcgagacttcgtcctcccctggtactaatttgggaagacagctgccgttagctcaagccgctccttctccctgcgccccctccctttctgtcctgattcttgaccctttgcccacgtctgtaatctcgtctactgtggtctgttgtccgtgccttgccttgcatccaccgcattcctcatggcagctcgccagctgtgcggttctgcgtctggtagaagacaaagggagagcgatcagaaacaaaggttgagacgaaggctcgtgcggatgtcacgcagaatcgtcaaaagaggatagaggaggggggacaaagatggattttccgtggggtctcttcctttctctcattcccccgttgtcctcagcaatcaacattcgttctgtacatctatcgtggcactgggcatcgcattctctcatcgtcttccatgaaggcctttccatttaaagcaagatcaacacgcagctactacgtacgctagcaaagcaggtgacctcaccgccgcgagaacttggctggatcgtgtgggagcgaaatgtagagtatggtgagtttcctccggtgctaaggggtagaactgcatcaacagtatgcaggcagctcctatacttcacttactgaaccagaacagtgtctgataaatatctgtgtgcacacgtgtcacacagaagtctctgcatccattgtgtgacgccagtgtgcacatacggaaccagaatgaacttacactgagctaccacagtggtagggaatgacgactttaatttatagaagttgttggccacttcgcggtacactgtgcctctctattactttctcgctggcataatccattgttggcatacttctctgtagaaccactttatatccggtcacgggactctcggcgccaggcaatggttttggcgaacccgctgcagaaagacacgccccccatcgctcgacggggaccgtcgagcatacatatgaagctgacgcgagcaagcctcacatagcgaattcgatggctcttctgccaaggactcgattattatgtctgtgcgacgaaaagtccctcatcactcgcttgtcaggcgcaactctgtccctccccccgatgcagttgcatcactgtggttctggagaatgttccccacaaacgaaaacgtgcgtgctcgccgttcttagaatgacgacacaatcaccacaatggtaccgaagacgacatctccgttatcgcattgtcgtttgaatggggagcatcaacatattgatgttcaaatcacgcggacttctctatagggctatcatctcaaaactagcgctatacgccgacttcagcgaaatagctcgatgagtctggaggcttggaagtcgtgatttgctacagaaaggtgctcataggttgacaacttgtgctcataagaatccaacaaagaggttcaacgggcatatccgctgcatcattttgccggta

SEQ ID NO: 545 - DNA, 1478 bp, Toxoplasma gondii
gactgcagcgaagaggttttctggcctcgaggttgagagcgaagacgagaagcgagaacgggagagggggaaggaaacaggttccactccctctctgtggttcttcgaacagacgcagagaaagaagagaccgagcaggcagaaggcaacgccttcgtggctgcctggcgcgcgggtgcacggtgagatgcgagcgccattgctggaagaagaaagaaaagaatcaacagggaaaagagggagagagaacaaagagggagaggcaagagagagaatagaaagagagagacaactctgagtggcgtagaaccgagcaaagagacacacaggaaaagcgccgggctgtggaggcactttgtgacgcactagttcaggtgtacatacacctcaactcagccgctctctgctctccagacgtttcactttcgcgcctcagcttcctcctggccaggacgttcttgttgagtttctgcccgacgcagtccactcgcgagagagaactccgacagagaggacgcccagaggcatgttcctcgatttgaaagccgcgcgttatcctggatttctttctgacgagtttttctccccctcggacatgcctctaggaccaacagcagctccttccccgcgttgcaggagaagaagagacctcgcggccgtccctgccgcccgtaaattcgcactgaggaaacgaacttcctttcgagcgaatatgcggggggcaggagaagagacagggaaaagaagaaaaagggagaagaagaaatgaggaaggacgcgagaagatggacggccgacggacggaagcgaggaacagggaaaccatgtgtagggcgtatggtagcagcacaaggggaccgttttttgaagagagagcgagaaaagcgaaaaacggagattttgcgacagatgattttctaacaaagtcaggaaggcgagccgaaggcaactgttgctctcttcgcgcatgcacttttttcacatcggcgcgcgatgctcagcgcgtctgcaagacatcgtgtgtaggagagaaaagaatctctgaagagctcgtctcagtcgcttgcagaagaaggagaacaaggaacttcaaaccacgaagcaatgacgaagaagaacactgcaaaggcgttgacgcgtaacagtgcacacaaagggaagtggggtgcatgcgatacgacgtggaaacaggctgaaccaacgagttgtttccgacgctttctcgccacaggtcttttcttaacgttcgagttttccgagtttgtcgtctgcgccttctcctagacttcagagagagacccgtcttcctcttcctctctcctctcttcccttctgtctcctcgcgggcacccaccttccacgttttattcgagactttctgcctctctgctttaaacaagttttcctgttgcacacacacacagttctttgcctcgtctttctcggcgtctgccagcttccggcgtctcgacgcgcga

SEQ ID NO: 546 - DNA, 4729 bp, Toxoplasma gondii
agttctggtgtttccaagtccgcgttgcttggctgcgcgatccgaagaagccccgggagtatttcgtctctttcgggggagagccgctttcggcttgtctctcttgcggccacagtcgagctcgacgcggagcggcagcctcggatttgcgaagcgaagatggagcggggggaaacggaggaaaagaaaagatcgaaggaagcgaagatgcgcgcgaggggggcagcaccgcacccttggactggtgaaagagagagtcgtcatacagagagacggcagaagccgcagtcgggtgcagcgacgctgggtgatccagcgccgagagagaaacgatgcgacagtttcttccttctgcgtttgaggagagaaaaatagagaaacctagaaagacgagtaacagacgagggccggtcatcaggcctgagacccgggacgaccgagttgctttcctgggtggaggggaaggcggacggcgaagaagagaagagcgagaagagcagacgagaaaaggacgagagagactagaacaagagagcagaaaacaagcgagtggaggaaaagccggggcaagatccatcaaggagacgaagaacgcagtggcagcagcacggagaagagagagagcggagaaacagcgaaagaaaagaagagaaaaacaacagatcgcacaagtgcggccttcgggtggacgaccgaaatggcacagcaggacagactgcagaagccgaggatgaaagactttctccatttttcgacgcgaagaaaagagaagaagccacaggagagagaaaacaaagtgaaaagacaaattcgaagaaacccctcgactcggcagcagcgcgggtgccggcaccagcctgcccccactcacggggtgtacgtacacccggtgcatgctggccatagtgaccggtcgaagcctcttagcttcctcatgctccacaaagacttctcgatgaggagcaacaattttctgcagttcttgccagcattattgcgtcatgaagcattgatctacaacgggtctcggattctccctctgtaggtccacactgtcggctgcgcgagttcggcatccctttgtcacgagatgggggaggtgaaaaattgacaggaagaggaggacgaaaaggacatgaaacgaaggggatttgcagacagaagcgaactcggatgaactcgcgtcgtccgccttttcgcgcctcccggcgcagcggccgcacacgacgggtctgtcttgtcacctcgatcttcgatacgcggagtgaagctcgtcgcggcggacaggtttgaggtttttgccccctctagaggtaccggaaaaaggaataaaggttgaggcagcgaaccacgcgtcaagagcactgaaactgcggtgtaatcttcaactgtgcgccaagagtactgtgcagcgagagcatgcagcgaaaacaacagaaacttgtgtgctggactggggacaaggaagaatcgcctgtcgcctgtttacgacgattttctcgcaaggattcaaaggaattctcacgttgattcgatttgaacttctccgttgtccacaacaagttctcagaagctgcctgccccctgggtctctggagacacacaactccacgtgcatgcaagcgtttttcagcgctctcatctgcagtgtggcctgctgtgccgcacatctttttctctctttctgtaattgctgtttctcctcgatctcgtggagatccagagggagaagaggtgacgaaggaactcgatgaacctcaacagccatcatctgtatctcctctcgactggtttctccttccactttttccgggtcccaaaagcgatgccagaaacggagatcgctggtcgacagaaagggggatgagaaggagcaggtacacttcacgtttcgagctgttgttggggagacgcactcgagaaaatcaggtgaatccaacagagacggagggcgcgtagcggcaggagcagccggcacagtctttgcaaagtcgtgggcggggcaccttggccagcactggaaatgggtcgaaactgcaaagagaagtcaaaatggaagaattccagtggattccaagcacacagatcaagaaaaacacgaaggaagtctgcgagatggacaggcaccgcatgctgtcctactgcagcaagcacgacggtaggaaaccctgtgcaactagatatggcaatgtctttttaccaccggaattccgatagagacatctgccggttctggtcacctcgactctcacgctgtgtgctatgatgactcctgtgacgacacaggttcttcgtagaatcttgtagtttcatctttctatcgccggtcaaaaactgcgggaaaaacggagcaacgaaacactacgaagggcctttctacttacactcaaataattcgggcacccctgcaggtacatatatatatatatatatgtatataacttctgcttctccatttgtggactgagtttacggaagtagaagagaatcttaagttacttggagggttgatatgttccgcgcccacacttgatgctgtttatagtaaagtgtggagatacctggggagttgcgtaatgggttaaatcctctggacaaagtagacgaaccgttcccgccacacatcagacagacagagcaccgtgacacttcaaaggagacaggagtaaacccacgtctctctccgtcagaatcttcagctatcgctttttgttcaatattccaagcagatatgtatgtttctacaccagctggatgtgaaggaacaatcccttttttctaagcatagacagaaaattgtttgtgaatacatatatatatatatatatacgtcgacctatacatagatatatatagagatagatatatacccccctaaggggttggtcgcttctcatcccgacgaccagaggctttgcagaaaccagtgcgtgtgtgttgagaacgcagcagctgatgtgacgcttgcggttccttgaattataagtggaacttttcccttttttgtgtgacactcgtcagtgtcgcaggtgcctcctaggatctgggagtccgagctgcttccaccttcgctttcgctcgacaggaaacgggtaaggattccggaagtcgaacacacgagccgagaggatcaggctcttggagaggaacagaagattaaaatgctcttgcagggacatcaggaaaacagattttgacaccaatcgaagacgaaaggtctcgtggagaacggaattgtcgacaggacacatttgaggctcaagaactgttgctggccctgaagcgacgaaaaatcgactctcgacacgaacgaatttgcgttaggggagttacagacagaatgtacctgagcaacaaaggtccagaagagttgtttccccatatagatgtttcccgacatgtgctgtggacgtatctacattcctactgtggcttaatgtatgccggtgtacaagcgcctttgtgcgcgttgattccttttcgaatcggatggtaagtaaatctgtgaatccgaatggtcacgagcctagcgaaggcatcgtgaaatgcgagcatccacaccatactcactctggattccaggtgttttccctcgagggggctgattgacaccggtgatgcagaagtggagaatgggtgaagcagattctcctgtgagaagtcgtttcatttttagtgcaaagctttcgcctaaaaagcacgattttcgccgagtctccaaagctgaaaacacagcactccacgtcttttccgacgcattcgtgccgttgcgcgaagcccagacaaccctcgaggtggagtttcccttgtctggacaaatccaaaacaagcagtacacgcgaaggaatttctcgtttcaggtccacatgcttttcttcgtttcccctcgttctaaaagttccttcacaggaagggtggagacgcttttttctttccgtggagctcgtcgctcgctaccaacacttcacagaaaacaggaatttcccgagtgctagcacggaggagctggactcggcttgctggtcacgcgaggtgttcggcgtgaccgcagcctcagaaaaaaagacatgcgtgcctttctaggttattcatttgaaaatgaaacaccgaaagaccttctcactgggaacaagggtggaaaaccgattttccctgccagccttccagggaaaaggcgccatcgactgctccgcttgtctggccggacctcgatgctcctttcgcggtgccggagaatttgtgcaaacatcaggtgtttagctggtcggttgagacggaattttttattcccgacgtcatttgtttctttgtgttggtgctgaagttggtaaggggtttgtactggttgttttctccagaaaaacgtgcacttttcaggtcgagcttgcgcttgtctgggactcggggtcatgcaactctgcgtgactctcccgactttgtcgtcgttttgtttcggcgaagaggatctttgcctctctttcgttctcttggagcggaattgaccccgttcacttggtttcgtccttctcgccccctttttcgctgcatttaggtactcttttctgtgcatctgtcgtctcggccagcggctgtatatagtagcggggcgcgggcgatcgtcggcgaccggctcttttccgcgccagcctgcctctatccttcctttttagaccagattctctctttcttctcggctttgctctgccttgtctcctctcccgacgcaaaa

SEQ ID NO: 547 - DNA, 2988 bp, Toxoplasma gondii
gtggactgcttgagaagcgctccgttcgctcatgtttcagagaagggaggacgctgtcgcagatctctcgacagtgtgggtgcatgcagcgattcataccgcatgagtggagactagttgatctgcaggtgaccaagggttgtgaggagacaggtgatgtgtagacgaggcggcgcctgcgtttcgcgcgactggagggggaggtctacacaggagggatcgttttgggagtcgaggagaaaatgtgcctcgcggtcttttgtcgtcaaatgtatcgagcaccagtgaacgtgctcacgaactcctttggaaactcgcgagttcaccggcggcgcggaatgggcgaactcgcgaaaactgcacaggagaaaaaacagaggagagcgcgacaacgcgcatggccggtgctggttgtctttgtggtgaccgcaactttgtggcagcggggcgaactcgcaagcaggtcggaatgcgttccatcgctgttgcagagggaactccgccggacaaattccggtgctgtgttcgtcgattcgcgtggaaaaaggaacgaagaatggggtcatggaatttctcggccgtgtgttcttccaatgcagatttctctcggtgccccatgcgattttgatgggtctgtccggtcttcgttgcttgcgattttggcggtcggatgttttgcgcgtctttgcgagattgtctgcatttccgttgcctgtgggagaagtcagaaaacattgacatttcggttgtccatattcctttcgggagtctatacccgcgttctgcacccgggactggaaaacctccgtgactcttcgcgctaaatgatcgcagagttcacaaaagaagaaagaatgccgtcctcaaactgctcaaagaaagcgaaacaagcgaaaataaagaagttcattgatcacctgtcttcatctcgcgctgcaagcgcttctttgctcgagacagcatgtttgcatcgcatttgaaagcatttctgcattgcacttgaaagcagatggaaaggaatttcgagcagcgaagacgaagcaggcgtactatcagttaaagcattgagatcgaatgtgtcaaaaacgtcgaaagctgcgcttctgtcatagcacggcattcctcagtccggtccgtgtggagccacaacgaacaatcacctctgttgcgcgtcgtctgagcctccttgtgcagacatatctatatagacacgtatgcgtacatgtctctcctctgacctcgactctgtatagtgtaccgctacaatcaggagcaagttatcatttcgatggttggatatctagatctccgcagacgtacgtcggtaccttcgaactgtgaatctcaggcgcggtttagatgagcagaagtgctccagtgtcgcggattatcttccgtgtgtccaggtcgattgttgtatgccctatttacttttatttcagtcttccttggtctacttctcagggcggatatccgggaccgagagtctcgggtccgggacatctttccaccgcggctgtttaccctattttccctcgaaaacaccatatacgccatcctcttgaagtcacttccataaagttacgtcttgcatttctgtcgtctaacgtatgtcgtcgaggctctgtctcgtctctctccccaagctgtcaccccagtcaccgcctaggaacgtcattcgctgttccccccactcactcctcgcgtttggtgctttgatcttgaataaaaagcgttccccatcatgtcttgtcgttagtttccgcgttaaaagtccattcgttccactccttccccgccgttgcggccgtttcccgtggacggcgtctttccgaccctagccgccaagaacgcgcgacaacgaaggccacaagttgccttgagcccaccggaccggctcctcggggcgggagcatgcgtcgcgacccccccaagacgttccgaaactaagattgttaaaaaggcgttcgaaagtcttacacagtccactgtttgcttcgttcaactggctagatgaagtgctgctgagtaaggaactcgagagctacacaaccctcagaagtctctcgtgcaggcaccgttgcccccaggccggtggtcttcgagaaaagaggacgcgggacggggctctgcgggcggagacgacttgagtggacgacgagaactgacgtcgcctgtagggattcgcttttgcttttgcgaacttgtcagaaaggtagcatctgctttttgagtcgattcgacggccgtagcctcaacatagcgaggactcccacacaccaccgatttcgcttttgtctacaccaggccgcggattgtgctgggacgagggcggcgctcgacgctttcgttcccagttgctcgcgctttgcatttgtatgaaacgcagaagttgtcatctcgccttcagaaaaaagttggagcgcgttctcgagggagcttccaggttggatctcttgggctgcagtgttgtgtcaaaaagagaaaggaacattgagaattgccggcctcctgcagcaatcaagcggtcgacgttggtcgtgcaggtgtttcgcgggttgtttgtgagcacggaagttcgtacagctccagacggaccgcttcttttcacagttcttgcttcggactcaatttttgacgtcgtccgtcttctacgagttgcaggggtagactttccccggcaaactctccgcctcgcagaacaggcgtgacccgtgaccgactgtttcgcggctccttgcttcccctctcctcgcggggtttcttgccaccattctttcttcgtaaacccactgtctacggtagcgaccagagcgtcggtgtttttcttccacgaatcctttggcaagtaccgtgtttcgcttggcgcttcctggcgcacccaaccgcactgctttccttgctttaccccttcgcatctggacacattgagccgctgctcccttcgcctctgcgttcggcgcgccgttttttctccgagctccgcca

SEQ ID NO: 548 - DNA, 2567 bp, Toxoplasma gondii
gcagtgaagtagagggaaggcaaaagagagtgaacggagagcagaagaaacgtagacgacgaatgccgcatcaagagagacaaagaacgagagagaagaagagagagcataagagagaggagaagagaggagaagagagaagagaggagaagagacgaaagtagagagagaagactaaacggagggaggagagaggggcaacggaggagagcggaaggttcgagagagacagagttctcactttggtgtaatctggagcgttgacggcgaattcaaaggcaagcacacctcgttcaataggaccgagcatgacggagtcgaggaggtagtcgccgccgccttcttcctttttctttgcattttcttcttcttcaacatccatgtctccctccacgcgttctccgtccgcgagactctggtggctaggcagcccagaggaggagagcgccgcgagtttctccttctttctcgccttcttctcgcactcggcagagcctacgtagactactcgccactcaatgtcctccttcaagggcgtcaaggcctcgaaacaaatttcgaagacgaacggcgaagaaatcggcgagggattgttccccagccgaatgttcgtcacattaaccaccgacatggcgccaggagaagaagagaggggagaagaagagaggggagaagaagagaagcgagagcagagacgtatggaggatggaggggagaggaacgcgaagagagaggagaggcggacggagacgcagactgcgagaacttgacggcggtttgagggcggcgcgcgagcggagaagaatcgcagaggaaagagctggagagaacgcggcgagaagagagaagagaagcaggctaaaagcaagacacaccagaggctctctggtcgttgcgtacgcttcacacaccgcgccgaagaagagagacgtcgagcgattcgaggtcaagagagaaaacagaccaagctccctacgaacagagagaacaggcgcgatgaccgagaaaaaaggaagaaggagaagggaggacagcgcacgacggagagtcccaagacatcttcacccagccttgcgcagttcttctgcacacaactggcagagaaacttcttcgtcgactgtctccctggaaagaaatcgacgcagacgcctctcgggggaggctgtctctctcctcttgcagggttcttcctcgaacgcttgcgagccgagagaaggagagagaaggagagagaaggagagagagatggcagaggcaggcccggcagatgcgtgtgtagcgcctacgttctgcgttttcagagaccagggcggaggcagcacctgcgagagtccgtctctcgtcctggggggcgcggacgttttctccgacaggagactcgttcagctttttctctcctttcaggcgaaatgggtagaacaatgcacactcggtctccgaaccattcgctggtgcaggcgaaacgcaaggcatcccgaaggaaaaacgcgcttttctccctcctctctgcccctctctacagacgcgctagcagacacacacctgccctgtcgcgcgctgttttcttgctcggaaggcagacgccgcaacctctctcgcgccgcgcagggccaggaagaaaggcagaaggatcgactgcctttgcgctctcgctgtagcattttccactgtcagacacacttcaaaaagcctggtcttgctcgaggaaagtcctattcaatctccttctccacgaaagaagactccaccttctggtccatctgggtgctgtgcggcatctgacaaatcgcgcgcggcaacgcgctgctttgcttgcgcggtccgcaacgtgagacgccactgcagagagatttttctttcctcgatttcctctacttccccccagttttctccactcaagtgtacagaaagagggagggcgagaagaaggcagccaggcgaaggaagagcgagcgaacaagacggctcgcgccggaagaaggaggccgggtggtgccgcaccgcgtatatatacgcgcgcgcgctggtgtaggtatatgcttacacaaggggggctcttttcttctgtttgtcttcatttctcttgtggttttctctcgtctttcgcctttcgcctttcgcttccctgcggatgtctcttttcctctgaactggagagaggagggaagacagaacacccgtcgtggcagaaggcgcgaggttccggcagcgcgacaagaacagagagtcgtttcctttccttcaattttttcatttctttgttggccaaacgtatccaggaagaagtcaaaggactcagtttcctggagtcgcttctttttgccgactcgccggaaagtccctcttccctcctacccacctcccttctcgaactctccctcccaccggttcgttgcggctttcttctccgaacgactccgtcaatcctctcctcgtctgccctcacgcactcgcccatctcgtcgcgcgcctgtctcgttcttcttttctctcttttctcgcttctctccccgtttttcgctctctctcttctctgctgaagagatctctggatccccgcacacca

SEQ ID NO: 549 - DNA, 1752 bp, Toxoplasma gondii
cccctctattgagagcgaggttcgttttcgctgtcctggaaatcgccgctgttcgctatcacaccattctagtgcattccttgtgaaccaacaagagatacaaaaacctaattttcattattatgtcagcgtaccgcctgtgcctccgaaaagactgccgccttgctgctgctgggtccccgccccaccgaaaagtcccccacctcctccggaggaaccaaagaggctacctcctccggtaagggacgatgacgtattagacgagaacattgcgaagaccacgaaatacgaacagaaggacaaaatgaatttccaggcgaaatgtgcctgctgaaaagaaaataaaacgagagtagttctggccaaaaacgaaagctagtgacttcggaaacaggagcacgagaaacagccacgtcgcttgataatgaaacgatttccacaccgggagcctacgtcaactaacacgaattcccgcagaatcagcttcttgaattctgtagttagtgaagaggtcccgatgttcccagtcctgagtctagcatgcgacaaggaccgtctagactggcacgatggagctggtgcggagcggccaacacaacagaatgctaccccaacagacgacggatgcgcgacgcgcccgccaaaagaaaaaaccaatgtgaatacttggagaaaactagaatgaacacacgcggaatgactcagtggctggcttcgatatggtgttgggattgttgacctcagaacaaacacggcgaagaacaaaaaatcgggcgaggcatggctggtcaaagagattgttccactgtctcggcacttcctttgtgtgcggaaaaagtagactgtttacgggaagaagacacgactttttccacgaagggaagaagacgcttacacatctcggcagatcagagttgcctaccctccgtcggcagtgaccaagtcgtttcccctgcgcggcacagatgcaacatacggcgcgggttgccgcgtctcatcatctgcatgtcttagagggagaaaaaatacgtcagcatgggaaaaaacttttttgtgcaccctccaagttctcgtcgacaggccagaaaatgcgcatgtattgttttttgcatgtgagcatgcgcacggggaccggggagtatgaggccacacacggacaggaaacgtcgcactgaccggaagtagaacgtggcgcaagcgtgctaccagtgctaccgccttagccccttgttggagacagaaaaaaacatgatttcaaccatggaagcttaaagacagcgtccagatggtgtaaaggaaagcaaataaagcaagacgaatccccccaaattgtgccggtcacctgattcatggtatcccaacgcacacacattggtcttgggaaacgactacgagcaaacacgtatgcgcgggcccttataaaaggcgaacttgagtagcaacccgagcagcgcgggcaacggctaggaacccttccagccagaggattgtcgacggcccggcaagatatttcaccgtggtcaagcaaaaccgaacactttttgagtcggtgtgaggtcgagaaaggagagctcccacttgtgtagaacttctcctttcagatatttcatttcccttgacgcgaagcaattaacagccatcattgggtttcatttcctggtatatatatctgtgttgcttaacattttctacgcctcaaccgcttactttgtctccgttgcaccgcggtcaacagactgtttcctgccacaa

SEQ ID NO: 550 - DNA, 2005 bp, Toxoplasma gondii
aaatcagagttgaggcaaaaccgtactaccttgcaaaagttgttgccctcaaagcagttgactcaacgtaagatggcatgatctccaccttgaaactttattgtcggtcgcggtgtcatgcagtcatctgaacacctctcatctgtaactgtgtcatgcttggcgcttttcagcaggagcacatgggaacgacatgaagctgttctctcacaaatccggcgacgtagagaaaatgaatgtggtcggtaggtactggcctgttaggtaacagacttcaggaggtttttgaaacgacaaaactgaacggaaactgtcataacggcaatcctatctccaaggctacgtgagagaatcgtgctcgttgcaatggaagtaactaccaacatttcgccatatggatccaacatgtggtttgtaagacctggtctctcttgtcgggagccataatacagaaatttatttctgtaaagaagggtgtgtcacatctgtgtttccgttgaaaacgagcgagctaaattttttccaccgcgggttcgtgcgacagcaacctcgtgttgtggttttggtgctgctttgtggaaattcgctctgtggtctttctgtgcattcgctcagtccagaaaagaagacccgctatttttggcagccgtctgacgaccttctgggcggagctgtggctcttaacgatcttcggcaaacggtgattgaaaaacaggcccggcggttgcgcgatttgtctgcttgttaccaaaagtgccaccatctgtcagaagaaaacaattacctcaagtgcagagagcaagctcttgttaagcagctgaaggaagcagaagaaacaagtcgaatggatgtgagtgacagggaattacagcggcggagtagtgtgtctgatcacgctgtatattactgtcttatgacactactaacttcgatgtagggcgccgatgtgcagctctacagtaacaacctgttataagacccatttcccttgcttgtgaaacttacattgcaactgagaacaatatgtattgtgctgggaagtgtcgttaacaagagcttgctaggtttctgtagccaccagccattggtcgcctgagagaaaaccaccacatgggaggcggcggcttgggagctttcgttattttggcaaggcagcagaggatagactacccaaagtcattcgcattcatttaggcgtcatagagtagaaatcagagggcgcgtgtccaatctgtatttcacacgaatccaacaagtgccgccttaccacctcgagagtgacagtcaggtgtcgggattccccagtcctcttttgtggcaagacatcaaaatgcacacggacacttattctaataaaccctctcgtcctgcttgtgaattcttgccgtatcaacgttcagagaaatcgaaaagtacagaagctgacatcactgaacgctcatctgcttcacgacaacatgctcctgcacacgtcactggccctactgatcgacaggcaaccgacaatagttactggcctgtatgagacagacatgatctgctgggtggtaccgaatctagcattacttgctcgagagggcaagctgccacgtcggatcgtgagtccatggttgcgaagcgaaaatagaagaagctgccaactgcagtttatcctgtacccgtttgggacaaaacacaaacaccgcgaagccgtcgctgggaaaagtcacaccggtagcacccgcagaaaagcctgcccggctttgctcgtccggtgagtgtagcctgaccttgctttgcttttgaaaataacctctgcagcaatagcatttaagatgatgctggggttatcgcattatgacactaccaataatgtttaacaggaattcccgctgaccagcagaatcggcagtgcagattaggaaagtcgtgtgtccacttgttgagtggcgggccggccaacaagaacgatgacattgccacgggtagagctcttcaggaggaaactaaagtgttgcgtaaaaaa

SEQ ID NO: 551 - DNA, 2512 bp, Toxoplasma gondii
gccgttgaaaatgcagtggaggttcttgattcaggcgggtgcaggtccgctgtcgctgatgagcaggcaagattccctctgctgtccccttgagactggccagacctcctacagagctgtgcctgaagctgctggataagattcatctggagctggagcttattttgccgcccttgcaggtgctgcaggagtttctgaagaagaaccagctgttcttgcacaggagacggtggcaagccgtccgcggtttccgagtgggccggctgtgtggaccgactcaagcttctcatgacttcgacaaggtgacaactagtgtgcgaaggcaacggggacctcaaccaacaaagaagttttcaagccgatatcagacggatccagaatgtccttgctacaacttctcggtacgagttcctccttccctcccggagctggaaccacacccaccggcctcatggctaattccctgaacgcgacaggaggccagaagaaagaagatggcatcggtcatgtgcatcgtccgcggtacccaacgtcgacgtcagaatccaacgttcagcacccgaagctcgttagcacactcacggcgtggaagagctgcaatagatggcagtaacaggaatcgtcttgagccacgacaaaatggtagaatggatagcatggcactttgatcctgcacgaatcctgtgaagagccaaaaaattacttggtaagcctgtcacaggtaactaaaaaagcggccgctgacgacactgcggccaagtagcaaaacgtggtgtgcttcgttcaggatgtaacggctaaaacggcccttcatgtaacatccaccggtgtcagcggtggcgagaattcagagaggtttcagcctgtattcatcggaaagaagatcgataggggcttcgccaagaggaaaacagccacagaaagacaaacagtgttagacaaggaatcacgctcagagcatgccctcagcagaatgcccagctccgcagatcgatgagctgtctatacactgcaacacacatgcaagcaacaagcccgagacaaacagtcgtttttgagaccaggcagctccgtttctgtttccgagcagagtcatcagtcaacggcatgcgaacggcatgcacagtgacttctgccatctgcgctgctgagcccgttcccagcacaacgcaggacacgtacgtcaaaagtaaatgacttggattgacagtgattggattggggtgccttcctaattttcactgtcaacgcgtttcagtggcaccacagcagcccttgacactctgaagacgctagttcagctgagtgcttgggaacgctgggcctgcttttcgaagcggtcatcgacccgtctgatcacgccaggcgtctgcagtgggacagttgcttgggtccacgtggtgtggtgtccgccagtttggcgcgtgaaaagtagccacagacagtgaatgaaagaaagattatgtcttcattttttgctggttttgctttgcctttaccgaagagccacggtgcgaatacggatggcatttgcctgtggcgcaagaacctcttgtagtcactggcggtggtcgcacatgcgaacaggggagacgcgagcactacgtctggcaatactggaagaacggtgccgttgacattcgtcatagtcggcgttctcttgtttcctggaacctctgcaaaaggcattcacccctcaggggaagtggatcatgccagcgtttctctggctctgagaaaccaatcttcgtgaacagcaatttcatcttgtgaacctgcgacaaagcagtcgcacacgcccaaaacttgaggcccaacggttttctgaacgatagtgatatcgacattgtcgaagagggactttcaattgtcgatgcaaccatccacgcgtgaaaccgagtcgaactgtgtgatgacaacacattgctgcgtactttttcatggggaaggctttcaccggattttctgtgctccacacaccgaatcaatagggtgcgtggagcggtttgcagaaggaagcaatctagcgtctcttcttggcaatgatatcgagaggaacagggggggacgacgacgtcgaggaacagttagagaaattctccgacgaattacttcttgccagtgtccgaactaagcgttcgacggttggctcctattggtctgcaggcgcctctggtagcaaccttggaagtaggtttcactcttgccatgtctggcggacatatacatgaagtactcgagtgcttttgagaacgcccttttggcacagcactggcaagctctccgccaccgcgcctgagccacccagaagcgctcttctgtctgatggtcttcaggttgccactttgcttcgtttaccagtttcaccggcccggtgggcgttctttttgaagaacttgtgactcctcttgcggagtgtgtggcccgctaccaggaggtaccgatggtcttccgggtgccgtacttcctctctcagcagcagctgacagactgtttccaccctctgtacaga

SEQ ID NO: 552 - DNA, 2568 bp, Toxoplasma gondii
atagagtaaggcaagactgcaggagcagaaacatgttaaggaagagccacggagtttgtgcagcctttgcatgcagcgtcggtaaaaaacggtttttccactggcacctctgttacggactgcagcggaagcgcgccttttcgtttctcgtcgtagacagggaagaacgaaaatggacgaacagtggggtccgggccccgtctaggctcgcgggaggcagcgcaaccgcctgcagagtcaacggaggagtgtctctcggatcggcaccatgtggacgtccccagacactgtgtcttttttggatcaactgtttttgcatgcagagctcatgacgctagcctctgcggccgaggcggcggagtttgcggcgagagcttcccgtgatggcacagacgcgagtcgtcaatctgcgtcgtctgaagacgaagagaggccgaggcgcgttttgtgtgctcgccacattttggcagctgccgcgcaaataccctctttggactgatattgttggactcctgctgtgtctctgctttcgctgcgccgcaacagttttgtgctgagatgtgacgttttcttcgacatccctcgcaggtctgctcacactccgagcgatgtgtgtcgagaagcgctactcagaaagacacggggtttcgcgtgagaagggagagaagaccgaggagagactctgccgttttgcaggtctctcaaagttgtgtgtttctcaagagtttcatgcacaccgaaggcctcaagactcctggttttccaccacgcgagggacgtttctgtagacaacggtgccgcaattaactctcgttccgcagacggagagacgcagccgcgtcctcgaaaagctttcgctgtggtgcggggctgttccaccgtacacgagagttgcgatagagcgacagaaaaacagagccctactcaaacgcgatctgtgagcctaggaattcgtagacagctgatgtaccactttggagttttttcttttcgtgttgacagagagcagacggtcgttttcgctgaaactagattcacagctgttggtttggcggcttctaattcgacagcaaggacgcacgtgtgtcggaaaaagaatctaaatcacgaattcaaaaattttcgttgtcactcgagcgaagagtgcgagtcttttcaggctcattgtgctggagccttcaagatgtaaaacagcagttgaacagtggcgactcgagaatttcaacacagcccatcgtctgccgttactgctcatattttcccggtcagaggagtgtttcttaaagtggttcgaagaagctaccaggtcctttgaagaatgccggcactacgcgcgtaagtacagcttgcggggtctgcattatcggctacacctggcctgaggaaggcaggggctttacaataactccagggaagtccatatggtggaaaaacgaggaatttgacagggagatgacgagtattacttcagttgtacggtcctcgagtctgtgaatggcatgacacaagaatatacggaggaggctgctgctgcacatgcacagaattccaaaaagtcccgtcctgttcctgaactgcaagcataccggatggttagctgaagaaggccttgctgtttgtggtggcaggggcgacctcgaactgggtatagggtctccggagttgggagtttcagtgtggtcttccacgtcgttgttttaatcagacgcgcttcaccgcgcggatctttggctcgttagtgacacaagttccaacaagacacggatatcccaggactttcaacaccgcggagttgtcagaaagtccccgccacgtaaacacttccacgcacccatcctgtgcacactatcgcgttgtgcggaaagcaaacatgtgtatttttcggggcttttctccgaaactcttcgaacgaattgcgtaggcagtctgtgtgtgagtgtgtcggagacctcaaggtgggcagcatttcagaaacagacctcaaggaatgccaggtattcagagaacagagactatcctgtgcaattgagttgcaactcagatgcaccgatcgaacagttccttctcgtacgtttgtacttttatgcgtcgtctgtgcatctgttttctaaatttttcacaagccgcatgtcacaaaacggctacgtcagctcgtgcccccccgcgtggacgcccatgtgtcggggtgaagtgtgcatcgtcgtctccggaattgccggcccgtgtttattcgcttttcaagtctttttatgagtctgaagttctgccacaaacgtttagcaacgctgttgctgaaactcccgtcgaaagaaatcctttgagcactccagaaagcacgacgccccgttcccgtccctgtcttcctcgacttccgtctctctcgttgcacacacacacaccgacgtgtgtctccacgcgtttgtctccttttcttccagacagtttctgttgtatgttcttctccttcgcgattcgcggcagtgtgtagataaagtgacggcgaagcaaggcgagttgcgtttggaagtcgtgcctttttcgtcggtgaaaaaagtcgtgtctccatca

SEQ ID NO: 553 - DNA, 1212 bp, Toxoplasma gondii
cgtgcgtcaaagttggtccgactcttcacatgtcgtttatctaagactttttaaaatagaattatctttgaatatgaggatcgaggtggcccgacgtttagaccctgagcgactgttcactgcgcgtaaggtatgttcatatatataatatagttcagacggcacgcatggatctgaaataggctcttgaccttacaagaacgggcgaaacgctgaatccgatgcgccaattgtgtagacaggtggttaatgggaccttcgtgaatgtgaaacaatacagggacccgcaagggcttgacgtgtgcatgacacgccgccactaatcacgcatcgatccgtataacgctgatacccaacctgctactgtggttgctctggccgtctgactgcatgacacaacatagaacaaactgtacctcaggcctattgctcaatgtaagtaccaaaggactaccgtcttgaagcccttcgcacgtggacgttcggacgtcacgcttcagcgcatcaaagtgacgacttgtcagttaacagctttttaaatcatgacgcagacatgaataaaagtctttgtagatcctccggcgaaaagagccccctcttcttgttccaacttataaaggactgtgtttaatcggaggatggcttaatcagttgaggcagtgcgttgcagccggttctctgtcggatacgccaagggccggctgcagctagcaaccgtatatcgatctactcgctctcacacttctgtactacggagaggcaatgcctcgcttggaagtagtttgactgccattcgatatagacggcataagaaatcagacggagacaactccacaatacgaactacaaactttgaaaccttcctacgtcggttgtgcctgctcttcttgcatgctagcgttgcatgcggagctacgttgtggggactaagtttccgaaatgaactccggcgcacggcgggacaggagtcaaatctgtagtattgcgactgcgttcctgtggcttttttttgtctgcggccaaagaaaagtacaggctggtcggcgttatcttggtggagggcgcccgttatttacgtttcgcccaagttcaagcctggcccattttttttccttccagcttccggataggatttgctttgcactggtatcagaagccggtctgaacagaagactggttgcgaagcttctttttcaagcacaagcataacaa

SEQ ID NO: 554 - DNA, 2102 bp, Toxoplasma gondii
tcagtcgatgttcatgagttccttcaatcgtaaaagggcattaacattcttctacaaatatggcaatctatatatatatgtatatatatatatatagagagagagagagagaagggagacctttggacgtcgtttctcttcacgagaggtatctcgcgagccacacgaagcaaagaattaatgatattttcgtgcgtgagatccacccaggcggatctctcgaatctgtcgggtgtatgtgcactttacggtcggaggcggcgatcgcattttttcacgttctgtttctttaggaaagctcccaatttggtggggaaagtgtaaagggagggcgtcggcttgagagaggaaacattgactgactgaaaagtcaagcagttcgtttgaaaaggataagctgcacagggttattcgaggcgagagagaccgtctgaaaacgacacacgttttttgggtttcgatgccatcctggatctgcgcactcctcttccgtgcagtgctttttaagcttctgggcgcacaaaggggttcctgggggagtattcgtattaaccgtgagagacaacgccgcctccgacggtaggatgagctgctatttcataatcgtgctcagaggcatcccgccacaggcttgtttatcagctctttctgagaagcaagtgcggcgaacggacgacgggttaacagctggacggtcgtttggaaggctgcgccgtttgctgccgacacagttggagggatcgccttcggaaatctcacctgagtctagacacaccgttttctccgtttttttacgctctagacaaacagtttccacccttttccattgcgctgtcccgacactctggcgtccgagcgagtcctttgtgtgtcgggatgtttggagttgcttgtcgttttgccaagtggtactgatcagactagcatctgagtagcagttgtctctcgctgttactacgagtgattacagaaatgcatatattacgcctagaaattaaccgatgtccttgatgcatggacgaggaggaagcaagaattgctttcatgtaaataaagagctcgtttgcacacgcttgtaattactgttcacctgaagtcgggtcccatggaaaccttgttcccgactcacagagtctgcctttctgcgcgcaacgatgttcccgcagactctccgtccttttcatagacaatcgaagttgtattctctcttttctcggagagttcttctcattcttcacgtgaacagcgaaatgcagaggacaacgcacgacggaagagattttggaaagtgaacgaccgtcccccctcaactttccccggaggagacacggagcagcgcggagagacacccgcgaagggtgccgcgtcgaggctttgcctcccggttctcgcgttttttcctctcgtatccttatcgtctctccagcgtcagttgtcgacgcagcaggaaaaacgcgtggaatttcaaagaccgctttgttgctttcttgctctgtcgcggctggccagatggcgctgccggagaagtcgccgttccggagagacaaagtagcacgcgacactcgagagacgtcgtccacttcttctcttccgtctctgtttccccgtttcttcgcagtgaaatgcagtctgtttgcatgcgggggaaaagaaactgcagttcttttcctcagcgtcaggtagctcagtggtcctcgaaacggtccgcgttcgaagtcgagacacacacatgcgcgttttctcgtggaatcaatcacctagaaagacatctggatctgactttgtgtagacccgaggtctttctcgcttgcgagtgcattttcagaaaactgacttcccgccgacgctgaaaaccttctccccgtcctctgcagtaccgaaggagaatccgaattagcagtcagccacagaaagacacccccagcgaacgcagcgagaagaagaactagcggaaaagagacgaggagaaggacagagacacgaggagggctgttgcacaatcgagaaacgaaggcaagagaagagagaagaacagaggagtgagaggaaaagaagaaagcatgcaagtggcgtttgcctgtacacctcgtctgaggacagaa

SEQ ID NO: 555 - DNA, 2122 bp, Toxoplasma gondii
accattttgctccattatggttctgggtttagcaatatctgctgatccagaccacgaagtcagacagcccgtgcgctgctctaacttgaatggagtcttcttatcaacgtatctcttcagatcggctggactgcacgccagagctgacttcattcgcagctgtatcgcccctcttgtcttaggccgataccaaaattactctacacgaaagctaggcctcccgcttcagtgtgctctgaaatgctttaagaaagataaacctggaactactgtcgaaagtatgtagtcgaaggtagacagcgagtccctctctgccccgttgaccataaataccctccacatggtgcatccactaaagactaggtaagtcggttattttgtggcagcagagaaaaatgaaataacgcggttctgatgtccggagccaaactgctcgctcctagcttttgcacaaaaaggccagcactataagtggcgttacgcgtggccatgagcttaaaagagacccccccaaaattgctcagtgactgtacgggaacgtggtcccggtaaaataggtcacatctgttttgtggttcccacacctgagcagtgcccctcaacagattttaggcggaggacggatagccaacatccgccagtctcagggcggagggactctgtaagaaacgcctcagcaggacctgtgacagaaacgagcgactgtgtccatttgacaccgctgaacgatttcaaaaacccgcttgtgtggcgccggaaagcgtgcgatgtgtagagtattgataatgacaccaccgctttgcacacggcatgaaagtcagcactgatgtcaagcatcggagttgtactggtcacatcactccacatgaattagagctttaagagcatagggacttttctgtacgcttcagtgaccacacgaaagatgccgcgtgtcttgaaacgagacacgggagcgctagtttttcgtttatcgcgcatcaaagagccaaaccataaacgactgaatatgccgctctgctggagtcatcccggaaactatcgtgatgctttgtaacacaggaaacacgttattatgcgaggacgtctgtggtttacgtcttaaaaatctcgttagcttgagtcatccgctcttttggatcggctgcgtggttactgtccatctgttccacaggagtgactatatcctggctatccgtgtgtgagtgcccgatgctgtggaacaacaatcacgccatctcaagaacgatacacacaaaagtgaggggaagcagctcgaggcaatcctttaggaaaagtttgatgagcagaagattctgttgcaccgaaggctgccatttagagcgtttcgggggaggacggctaactttcaagcattgagcactgcatgtgcatggacagggacgtttgtgtcaaccagaaaccgttgccttgtatgccactgcttgaaccctgcagggaggtctacaggagagagaaaataacaatgttggttctcaaccttgtgtcccagtactcttaaaacggccgtttcaggctccattaatgctattcgttagcgggacgagttcttccaccacgccaccgcattatttgcgttgttctctgtttccctctagatcatcttggtgtcttgcccttccggcagcgtgtgcccggacttcatgacgtgtcaaaatttgtacctttcgggagaggcagagcaactcaatgaaacctgcttgaatgaacggcatgctgaaagcattttaggatttgctagtggtataaactgttggtcccaaggaacgcgaattgacgaacgcttgggggtgcatcgaacttgagcgggtgaacaggccgctacgggcgtccagaactctccgtcgcacagtcgtcgcctggagttactgtaacgggcgtttgcggtcaccctcatggaatgttctttacttcagtgctcgcttgtccagagttgtagaagaagtgtttatcgctttgtgaggctcacttttgctgtcaaactgtccatgtctggtcgtgttccgcgcactggttcattctcgtgtgcggcctttcgtgatgaccaggactcccgcgtgaagtgtgtcgcgatttctagcgcttagttcttcacgtcgaa

SEQ ID NO: 556 - DNA, 4744 bp, Toxoplasma gondii
ctctttctcgagatgacacagcaaatgttgcctaggcatggaaagtgcacggctcccgtttttcttcagagagcccctgaaaagaattcgccttctctgacatcctgggtggctcttggaccgtctgaggaaactgaacttaccttaaaaatcttgttcagttcccgctgtcggaggtgcttagactcgtcctcgaggagatacgcatctgcgccttgcagccaggattcgtaggaaaacgaaggggaagaccaagaaactgcatttgacgagggggcgtctccggccttgccttcctttgaatgctgaggtcttcctgaagcctctgtctcctccgcgtcggaatttctcctctcttcctctgcgccactgtgctctccatctgcccggtgcgtcatgatcgtcctgtcccgctgcggagggtcgccgccctcgtccttctctgtgtgttctgcatccttcatggcgccgtctcccgtctgaaatataatttttttcaataactttctcttccgcgccctctggtcactttgaacctcgaaaacgtggacgaaaggaaggcaaccaggctacgcaagggctccctccaggggaattgtgacgcgacaggcgcttaagaggcgcgtcgaatctgccttcagcgcaaccggtggcaggcggaggtcagtgcaaagcgggtcgcgatttttctcaaaaaaaccaactcgctttgggagaaactaaaagaaaacaagaaaacgctgggtcacgttgacacacggggccagcgcgcactgccaccggcccccgggaaaagctggtcaaccaacagaaggagagcgttctcctaccttcctcagagagaaatggaatacctttgcttgtgcaccgcgctgaatgcttcgagggaaaagttcttgagcgtcttccgccgttttatttgccggaaacggcagcgtttccggaacccaaaggcgacggccttcgaaggccggggcaggcgagtggctcgggataaaaaacggaaatggaaaaccaggccggaaagcagcagctaaagacggtacgcatcgaaggagaaactttgttatttggaagttcagcacctggaggacgacacattcagaggaagagcgtctgcggaaagagaccaaaaaaagacgacaaaacaccgcttccaactatgtaggccctcacgggcgccacgaacgataaccgttcgttgataagatagccaagtttcgtaacgtcgcaagcgcgcatcataaaacatagaaaccagtctttttatcgagaagggtcttttttccatgtccatctttccagacaaacttgtctccgtgcatgcaacaagcgaaaaaacccagtcgcatgccgcagccgtccgtagcgctgcctcactccaactgttggtgtaagacacgcgcatgtatgttttttgtttcttaatgagaaatcccgaaggtactttacacaaaagtttgtgttattgcagctgtgagaggccgcgaaacgaacaagctaatggaggacagtttcttgtgcagcaacaccgtcgatgcctgcaaaaaacgagtagatctctatgcagctgtgtatacgcgcctttcaaaacatagactctggcgggggggggacacgtgccaatatcgatgtgtattccagaagcccgctgtttccaggcaattctgtgtctaatgctttagacagtgtcagccggccctttctggctgacatccgtgggcgacgcgacgagtcatacggcgtggatttgggaactcgaagcgagtattttcccagaaagagtttaagcgaacttgtcaagattagtgcacaccgttacggcgccaactgggagaactcgtgcctttttttcgaccggagtctggtcagatctagtacggcgtactggactacgaaatgatctctggtacatttgaagggcggtgactgtctaaaaaaatatagtgcaaaactgaagagcaccacaggaaagcgcagactccactgcgctaaattccgcctgaccattgcactcacgtgcaaaagtgtttttttttgtcgggacagagaagaagtgccaccacctgcactgagtgctgtcaccaggcaaataatgatttcctcacgtactttggaactgactgcatttcggttctcacacgcaaacgtgtattctattctaccatgactttgcctctttactgccttgtgcaacggtgagagaaggcaaggtaggcatcctcttgattgaggtcccctcgcggtgtcgcctgagacagggaagacgcgtagagggtgaagacgactctccacttcatatacactttttacaaaatttttggtcttccgccggagtccgccggcatcgatttgaagattgggaatctctgtgaggataaacactttcccggcaacggaagaaacacgggagcaggaaacagtcttgaaagggaatggtcgtcgcctctcagtttatcggaggcgcagcgcaccgcagtattcacatcatcgggggactctccgacgctgcctgcttttggcacaaagtaaagaacaactaaaagacacgatgcatgcctccaggagtgcgtttaatggtgttagaagaaaaatcttccgttcacttaaccaaaagtgccaatgcctcccacatgcacgcaaactcggccactgttttcagtgtcgaagtcacgcatgatattttccatcttacggaccagcactgcaacttgcggcaacacgcgtttctaaaggaggtcgacgtccgctgttcgaaaaagtaattttcctgcagcagacgctaccagtagaccacgggctgaccactggccttgttacagttggatacatgctgcaaatcagagtgaccattttacacgccagacagacacgggatctgcagacgtttatgggctaagactgctgcaaaatgccaacgcatgcccataacacgatgaggcaggtgagttgttattgcactaggttgtacgctgtctcacgtaatggcacgaatgagcaagagcagttctcggatttactgctactgcagtccctgcaagacaagccagaactctcgcttcagagttggctgtcgccatgattaaccactgcatgctgtaagaggactttccgaaatgatacacgcaggaagcctcgactcctcgccccgttcggagcactctgtgtcgagtctgattcaaacttgacaagctcttttgtccaatctcttctccatctggcaccttttcagcgcggccacgtctccctcgccactttttgacgcaggacaccaactgagcaacctttttcgctgaccacagatgaaaacaatccaaaacattgtgtgtgctctgcatggatccgatagatatgggcatgcgttaaaaaatggtttgccttgagaaactgttgtctgattgccaaccctcacgatgcaacagtctcggcctccactaggaggtagaatacagaattaaacggtggtcgacagcgtaaaacaaactttaagatactgacagtctaccaaagaaacgctgttcacttgagtcgccctcgcttctgaagaattcagcatactatcaccacatgctgatttcccgtggacagttctctccttcgaggcctacttcgccgagacttgtcatcgatgtcgcagcaaaatagactttctgttatctcgtgctgcggacctatcctcgaacctttcggcgggacctcaccagttcccttctttatccaaagactcaagaacagaagttactgttttatcaaaatcacagcgcgtaaaacacctcgttttcctcttgtaagcgaatcgtgtgactcaacacattcagcgaagtctcggaagacgagagtaacaccaaacacgacacgactcactggatacaagtaagatcaagaagttgagagcaatggcagcccgcctcttacgtaagggaatctctggtacctcgcgagtgcctacggccgttgcccctccgcggggcagcggttgttgcccgccaataaaggagactgcagtttcaaggcggcatcgaaggtgagttgcgagtagaccattggatgtgaagactttttttgatattcgctcatccttaatcgttctttttcaatgttttattgggcatagcgtcgaacagggagcatctggcacagcatccttgcctaggtgtttctgagagtcgaaaccaccgcgtacgggtccacccggcgctcccgttgcccggggccagctttctcatccgagtcattgccgcgaaattttagcgcggctgatattccccgccgtagggacctgacaatccctgtgtatcaacactctctgcgcttattgtgaagttgtcccgctacgcagggtcgtttggctgggaggcctgctgccgacgaacagcgggccgtaacatgtttctattgcctagcacagccctgcgcgaagggaaaatcgtcgctgctccttcagccacttgctgttggaataggatgtgtgcgtgttcccgatccttcctctctttctatcatgtcgcacgtattggtggctctaccgtcctgcggagacccaaaaccttgatctgcgtatcggggctcgagtgttccatttagtgtgggcggtttccatctcctgcgcatgcgtcaagtggggaggtttgaacaaacccaggacttcaccggaagtcctttcctcccgtagaaaggtacccgaatatccccccggaaggcagactgctgaaggcagctgcttcagaccacgatttcggcacca

SEQ ID NO: 557 - DNA, 1884 bp, Toxoplasma gondii
ctctgtcctctgccatcttccagtttctctttccttcgcttctctgcctccccggaaagccggctccgtagctctcacgtacgaccgccaaaagtccgcggcggctgccagcgcgaaagacgaagaagaggcagagagagaagaagaagacgaagaagaagaagcagagagagaagaagcagagagagaggaagcagagagagaagaagaggtcctgtggagtttgaggtttgagagggggacctgcgtgtggggtctcacgcgagactgcggtttcggcgagcaaggctgcagcggcattgcggaggtaggggaaaggcttctcacggagtttgcgccttgtacagcttgtatgaaaaaatacttccgggtggagacttgaaacgcgtttatccatacagctgctgcagctcttggcgcgacatgtggatccgcaagcagaaacgtctgcgccgaaaaacagacgatgcacccatttgctaccttctacagctactgcatatatacatatatctctagatagatagtcatgtatatagatgtatatgtatacatagtcatctatggatttgtgcatgtacacaaaacacccagaaatctgtgtccctcttcatacgtacacttgagcatccatggtacgcaaatatacaattatatacatatacatatatatatatatatatacatatatatatatatatatatttgtatatatttgtatatatttgtatatatatgcatacacatgcgagatttgtctccctttgcacgcatatctaaatatataaataaatcgataaatgtgtaagtaaatcgatttccgcatccgcgcacagaagggtgtgtgcatggagctgctcagtcacagaggagggagggcaggcgccctggagagagagggaagttttgtcgtcgagaagaatgctgcatctgtctaggtgggcagaacaaacgtcgctctgaaagagagggaagccgctctgttctctgagcctgccttctggaaacgcgtagctcagtctgttcgtgaaacgtcaaggctgcagtggaagggcagatcgagcggaaaaagagagaaaaaggaaagaaacggagaggaaacgaagggcactggcgctcggagtcttcaccctcttgaccatcgccttcttgcgcgagtctcttcgttgaagagacgaaaaatggagaaaagacacgaaaatctgcgttttctgcttcttcttttcgcaggaaaaaatctcggccggtggcttctagcgccagctgccccccccccccccgcgtaggttcggagagacggcgaaggcgggagaagacgagaaaggaggaaaagagaggggagaaagaaaaataaaaggtcattaataaatacacgagaacagagagagatgcatgactcacaaacagcgctcgaaaacgaaagcgggtgtcttacgtgagcgcttttttggaagacaccgaggcaccggcgaaaagcggactttggcgtcttctacacttttccttgcatttgaagttttcctttcgaatcaattcttttgcttccttcttcgcttctgatgaaacaaagaaagccgttcctcgtcgcctatctccatattcgcttccgccgatcgtcgtcgtcctccttcgctcctcttctgcccgctgctgccattctcttcttctctttttctcccatagtctttcttcttttgtagtctccctcattctctttcttctctcctaatttctctgcttacctctctcctcccttctttcttgtcctcccgtattccttcgttttctctccggatctctctcttgttctctcctcttttctctctttggaggaatcactcgccttcttcgttcctctaccttctccctaagagagcgacaaaa

SEQ ID NO: 558 - DNA, 4838 bp, Toxoplasma gondii
ctgctcacattgcaaaagatattagaagggagaaatgggtacggcattacgccggccattaacgggggtcagaaatacgttgggtctacctctagttgcgctatcccatttgacagaacgctgagaaccttgaataaaggccactcttcagcaatttccggaagatcccgggtcagttcacggagactggtacactctagaccgcgcaatttgcaataatcatgagtctgcttgtcgatcaacaccactgcatcctccatggcttcattcaggggcatgcccgcgtcgacgaacttcttcaaggcgatgaacagctgattcgtcgcattctcattcacagacccaacaccaaatgcaccaccactgctgggctgtgaatacccatattcagccaacggtcgagtgggcgggatagacccagagccttgctgtggcggttcctgtaggtgggtcaagtgtggcgctatagcaccgagcattgaacagtggatatcggagaaccacttctggtggtcttcgtttgcgtggtgaagcagcgacataatatgtgtcttgtccgaagacgctcgtcctgtctcgagcgtagcctgagagtaccgcggcataccgctgagcaaatatggtaaagcggcaagtaagcatggaggctgctccactggcaatgtcccaccggggaggcggctctgaatgtttcgatacagtgtggtcaggtggccggggacgagagagtcagagagtgtattggggccagtattttcgtcgcccgtagggccactgcggtaaatatgagagggactcatactttggggcaatatcaaaaaactgccctccctgcgtactccggtccatggcattttgccttctccgagaggatgacgagccagcacgggcagcatcgtggattgcagttcattgctccatgtggtttcttgaagcgagacaggattggaaggcacatacgctgaccaaacatggtccgaaaaagcaaaccccgggtgcacatcgcgagatgccctcatggatgatgctgtgcatgtggcgaacgagctcgagaccattaaaacgatgagcacgatattcagccagaccgctggtgtagatgtccttgcccgtgtacgatgttcggaatccgcaggtgtcattttgcggacaccacctctgaatgaagagtgggagacggcaagcttgcaaggctggatgcggtttagaagtcatttactgagccatggtgtgaataaccgatggactgcagttcatagtctgcaggtgtgccagtcagtcaaaacaaaaagcccgagctgcggaggccggatacgttcatctcagtagactttacgcccactgttttcccctgacagatactgtacaaagaaagaatggtgatatttatgtgattgaaatgacgactgaccacaaattacaagcaacaggctcaacggtctggcgcagcaggggcacacacagctccgcaggtgaccacgaaaagaaccgttaaaatggtgccactggtgactcacggtggtcttacgattttcttataacagctgtacaattccctccaaataacgtgcaacagggcagcagagacaaaggaaacttcgtcgtcacgaacatgaacatgtggaaacaaaggaacacaaatgccgggtgcactgcagcaggttcctgtcgagtgatccaggatactggctagcggcggcggccggccccaaacgtccagctcgcactgtttacggggtaggatgggcaaaactcgggagctctagcgttagtaaggaagaagtcacattatctgttaagcgcgcgcagagctgacctccacctcctcatctgtgaacacagtggaaaaagaacaagtcagggatagcggtaatcggcttgcagagacatatcgcctgtgactctgtaaagcagtgaacacacagtcacctcattcgcgcagtgtccaacgatggccaccttacataaatcgacgctccccccccgacagccgttgcgggcagactgttgctgagacgtccgtgcggtcaatttgattgctctcgggtatgacttgacgagaaccagccacaggactcgaatttcaactctcagatgcatggcgacctgaggctttcctgttgcagttttttacttttttgtgtccccgttgacttaccaagctgccaaaagtcatgaagagattgttttagttcaaaaatcagtttgtcgcgcgacatcgtcgcgatgaactagaatcctgccctactcatcatctggcaccacatttgaatcagatcatgatccttccactgcgtggagaaatgtgacgtggtgaggtagctgccagtaagttcggtaagcttcatcgttcttcgacgcagatgtatgctaactcttcggaaacacatatcatgccaaccctgcgttacgtcagtgttttctccatcaggaagtctttttgcctctggctaatcctaaccgacacctcagcagcgcgcacaacacatccctgagaaggtcgtgcgtgtcccgacgctgctcggagtccgtcccgtttgtttctggtgcacactgtgttgtgcctgaggggttgactgcctcactgcagaacaacacacctttttccaggtctaaatatcttcaagttgaccagttccgcttcgcgggccctcgtgtgtgtccatcatgagcggctgccagcaaaacgactggcagcgaaggaagtacattcttggtgcacacggtctctctcattgtcgctcatggaagcaagacttcgtggacagccgcgtgctgaagcccagcgtcgtcggagagaaatgtgatcgagattgggttcgcgttctcgtactccagccagtagatatcaagacgaaatttgtgcaagttccggtggtgaagaaagttgacagattcgttcctaaagtcacctacgaagagaaactcgtcgaagtcccacggctgatccataagacagtagagaagttcgtcgaaaagccatatatcaagtatgtcgacaagtatgaagaggttccagaaactcggtacatgtataagtacgtaccgaaagaggttattcacgaacgagtttcgtacaagcgaaaaccagtgacatttgacaaggtgacgtataaggagatgcctcagataaagtacgtcgatagatatgtggatgtacccatgtttgaagaagtggttcgttatgagccggcaccgcatatcccgcctcttcaccaggacgacgtcagtgaatcaaccattcaggaacacagtcctggcactcgtcaaattcctactgatgaccaataccgcgtcaggtgatggaggcatgctggaatcagcaaggaatgcttccgagaagagcgtgtcgtccagcgagttcaccagtcagtacagtagggaactgcggatcgtgccgtgctgctgacactcatggtccgaaacttatgaacactactttaactgtacataatgttggtcgtgttggatatgctgcagcgaatcccgattccagtctacattggagaaatccacatgcaagatgcgctgcggctgctgcgcggcgctgcatccaacgtagtgagtgttcgtgcatgtaaagtgacaagaaggccactccctgtctgtaaagcatgagctactgaatgtagtcacccacgcgagcgttgtttctccatcactttattgcagtatgttccgaattcagccagagtgaacccggggtcggagcactccttattcttcgaacctgttttgtcgcgagccggacataacaagaaagtcgcctgctgtgcctggttagagggttaagtagaccccgcagaataaactactagtttgtcagtgtgtcacttttctcatgaacgggacggagtgtacatcattcgcaccacttgctgctcttcagcgactacgtgaagaggctgttgtgcgtttcactaagccatcagcgtaggacgtattgtcatctgagcatttcagagaggaagggaccacagctgcacagtctttttacgcgcatgtatttttaccatcaatcgttaactgagcgatgggtgcgccacgacagcgttatggtcgtgtagttgccaccagcctggccacacactgcatgaaggtgtagcatgttaggccgctttgcagcattgtttgaggcgtcggtcgacccaggcatgcatggcacccgccggcatcattagcgccgttagtacgagaccctgctgcgtcttgaagttcaaggccatcgtctctttcgatattcgatccagcatgacacacggagcacttactcaagaagcaccaactgtgccgaaagcaagtatcgttgaggaacttcccctgtgagtagagaagatcccggtttacagtgggatttgtcagcgaggagccgtgtgcctaccagcagagccgtaccttagagcaacgatctgttgcggtcgttccgcacacactgatggttgcctttttgattcaagagttattcccgtttgtcgttgttcagacccaagagatgcacaccatccttctcttcctcaggcagatagtgtgagccgtaaaaagcaaaagaaatctctcacgggcaccgatggatgcattgggcacgctacgagtgcgcgacagtgcgctcgaatttaagccggtcccccagtacaacatgcccgtcgccagctactcttcgtcggcgcatgtaaaatctcgcgtcgccgacgcttttcgtgcgacctgtatgtcttctctgtggcaaagaggcttctttggcaacattccactgtgtcgtacccgcagatctttcgtagttaggttccagatttctctgcccgctctcttctcacttcttctgtcgatttagaacagaa

SEQ ID NO: 559 - DNA, 3727 bp, Toxoplasma gondii
cgtctaaaacatctcgcacccgcttcgacgacacagtcgcaatcttccattctttctgctgacggagtcacctagtagattgtcttcactcctgttgcttggtggatgatggcattcttcttaaattcacgaaaggaccgacttcgagcagaagcagaggtggattgtgtgggctcaccgaaccacgtacactcttctacgtacacctgccagtggcggtgatgatcgacgcgacattctctttctaaactcgggaagcaaagattctcacacggacgcggggcttccgcttccgacggtgccgacctgtggcacgagcagcactttgtgtgtgggtccgacagcggaaattccagattttctcgcgtatcttttgcaacacgacagtagcgctcctcactgctgtctagccacttgcagtttgcagcgacctctttctttttttttattgtgtttcgactccagaaagctgagagagaaaagtcgcacacgcccgacttaacaggatctcgtcctccggtcgtgctgcctgctggcggcaactgtgaagaaagacgcatgaaagagagcctctagtggaaagcaatttctgaaaagtgtgactttctgtggtagcccgacgaaaagtagaactcacccgtttttcgccttccctttgaggttcgttattcagatctccgttgctgtccatctcgacatttcacgcccatatcttcctctccaaaatagccaaaaaaacaaggacaccccaaacaaaaaacaaacgaaaacatctctctgttcaccaggatacgacacctgtgtggatgcacacatcctttgccacccatttgccccggccgcatttagttgcacgtatatacatatatatatatatatatatatgcatacttatcgattcatacaaatatctatttgtatatttatatctctgtatggatatggttttttacacggtggaccattacgagcaagggaaggagagcgaatacactacaataccagtctgtgtgtcgaagcacggtgttcctgctcttgttcgcacctgacttccctggccatttccagctgttaagtcactttgtgagacacgcctaccgagaggtccgaagaatgtatcaaagtgtggactatacaagaaaatgctcttaaaggaaaggcacagaaaatggttcttttttgtaaagggacagaactggggatcccctgcaataagtgaaaggttgcgagagcgtcgcaacttggaaaagggcacatcgttttgattcgtggccagtactgctctggtttcagagcttttccttgtgttgacttcctgctctttgcttccttttctaataagtaacgctctagtacattcactctcgtgatagcaagggtctgtgaaagatctcgtcgctctcccctgtttttccattgaacgagaaactggcagaccgacgcgactcttacgcgcttgttgagagacacagaacatgagacgcgattcttgtaaggaagccaattcgcgggcagtccaatcgtgttttcgagtctggtggaaacttcgctccagagaaataccctgaagaaggtggggagatcttcagcaaatgcggtcagaagcgcagcccacggacagatgccgagatccgcagtcagtcgagaagacggttcaagttgtgtctcgcggagtgcgccatttcgacagagagaaacaagaatggccttgcctgtgtactttctgtcgtgaaaaaccttcatccagttgcttgtcaggcaggccaggcccacacgaatccgaaccgtttatatccgtgcagtaaacgaagacgtcgtgtgctatttccctccagtagataaacagaagcacgacatcctaatggccgtctgcccaactgttcaccagaaactcaacaaagcaaaagaagaccacctcacgactctttcttgctggacaagccccgattttcacgacttctatgtcattttagtttctagaagcacttcagtgcagatttccttttcaatttccttcgttatacctttttcgcaacgttcgctcgaaagttccgagccaggagtgccacagaccagttagacagaaaacgcgcagccttttcctctttggctcgcgacggcaaatctctcaactttctgcaccatccgcagccccgaaatcgctttttctaggccgttcgccatcaatgacttctttcaacgtgtggaaaagccagtgccggtaagtctgtttgtttttgtgacccacgcacgcgcgcggattgtgtcttcgcagacgaaagccgtgctgcagaggccatctcgtgtctccataacgctctatcgactggcttgtccgtctctttgtcgctcctattctttttcctctcttcgcgaagcttccttagccatttttcgccgaattttttctcatttctgtcctcaaaattccgtcattgcctcgccccagccccgagagttctgagtcgagcatgcaagccgctagctcatctgtgagtgaagagcttggcactggctgtctgggcttttgaggaactcttccggccctcgcgtcttctctttcgtgtcgatcctgtggattcttttcgctttttcgctctccttttgttgtcttctgcacagaacgcggcgctagcatcctgtcgagcgcgcgagaacatgcgcggggtcactcttcctcctttgactcactccacacaggaaaatagacgttaaaaatactacacaagtttgatgggaagtgccgtacgacccagagttcttttcgtcccgtggaaacgatgaaactgtcgtttttccgcgtttgttcacgacactcgcagcatacccctctcacggaggctggacgacacccttgaaggtgactcaacttttacgaagtgtctaaaatgccctgcttctttgtcgtttcacgcgcaattgagtcgagcccaactgcgagtgctttctctctgaaggatctgccgctaagaacagagactgcaattgtcgccgactttcctttgctctttgtccagcggctctgtgcgaacacagtgaaagtctcgcatcatggtctgaaactcgactgaagaccgtttctcgtgaaaacctttcatcatgtggcttctgtgtgcaccactagaactcgttcctcctcttcctcgagctcacgttccttgtgaaaggccgagagatctccgcgtttacgccgtctgcgtcgctttgtatcgttcgtgtctcgccctcgaaactcgcaccgccgcctttcgcctttgaagagacatggacggaagacagcgtttcccccgtctttgcatgtcctattcaggagagacctctgctttctgtttgtttcctgccacacactcccccatcctgtgctggccttaggcagatctgggtccccaggcgatttcgccgttcaactgactgctcgtttcgattagggtgtccgtatttcctcagcagaactgctcttttgtttcttcctctggttgggcaaggtccaccggcctagagcgagaccctctttgtctcttttttgcggtgtcttctttcggctttccccagctatccttctctgcttcggatgctctttgccttctcaaccgcgcggggcctcgacctcctcctttttttcctcgcatctctgtctcgtcttctgtgcctccacctgctcctcctcctccatctgcccttgttctcctcttcgctctcattcatttcggcgtctctctctccgcga

SEQ ID NO: 560 - DNA, 2863 bp, Toxoplasma gondii
gaaaactcatctccttcagctttccttcccttcacgcgtctatgcaacagcgaaacggtgagcgcgacgaaagaggcgagagagagagagagactgtttcggcttcgtcgtccccccaaagatctgcgcatgcactggcacccgtcacaacggcttcgagtgccgtcttaacgaggtacatctctaccgaaaccgggagaagcgcgcccacatcggctgcatctttcaccattcttctctcgttaacgtgtctggcttctatcgaaatcaaactctcgtttgcccccctccctccccctcttctgctgtgaacgggtcgttgacgcaccgaagaagagccgcacggcttcgggcgcgagttgggctccagtccgtgcaggagacactggagctggagttgcggtgggggacggcggggcgccgtcgcttgctccaggcacctcacgcgcagtcgcgttctctgaagcttcgaaaatttgaagactcaaattgggattgtggtaccgaataccaggaaggaagaaagtgcagaaatctctgcgagaaaaaagagaaccaacaaaggctccaacgtagctgttcttcaccgctccccacaaaaggtggatctggcagttacggcgaaaacagatggacataaaaaagcgccttgtcacagtctctacaggaacagccgacggacttgtacacactgtgttacatccttacatacagatatgaatatatataagcatgtgagcatacacacttacacaaacgaagagggctgtgggcctctgcattacaaataccgaatagatagacatacacacccggatatatatttatatagacaacaagcgaaatacacaaccgtcctgcaaggtgtaactggacaactctgcatacacccccgacaggtgagcgaacaccgcttacacgttcgctgctgtctagattgagagaaacaggaagcatggaagacaacaagtacgcaaacgagtacgttctatcgcatgtatatcgcgtggacgcagttgcatacacatctccctttctcccgaccagtaggtacaggagtatatgcgtatgtcaatatatttatacatgtacatatacatacatatatatatatatagagagagagagttaggcagagaaagattgatgtcgatgtgcagcggattttacgggggtccacgaacgttgggagtgtacagaaaagacccgacacctggtcgatggtggattcttcagtgaagtgagagtacgtcttacttgacgagtgcgttttccttgagaggcttgcaaagaaaaaactcgacagctttgatgttttggaaggtgctccccgcgcccaggacgaggcgctccagtcgtcgcgccgacattctctccccaattcagcttcttctactctttgcaacttccggtctccgcatcgatccttcgtccttcgccgtcagcgttctcccctttgcgttgttctgtcctacactctctttctgcacttgttctgcctctgtctccccacttgttctcctcgttctctctctctttctgctcgctctgtcccctcgcgttctccgctggctctctgtcttgctttttctccgccctctcctcctctctcctgttttcctagagggtccgtcgtgtctcccttttaggagctgtctcaatccagcgcctgtctcgctgtgcattcacctgccttcgtcggtcggagcgaggcgtctccttttcacgcggatctgcgcctgcgaagaggactgcccatcgtccccttctgtgttctgcgaagcgcgacggagaagagagaggatcgccgacgcatgcaggagctcgaacggtgtttctttgcaaaaaccttctttttgtcaacagggaacgctctctacagcgatacctctgcaggcgccgacggttgcgcgggagcgctcgtccggcacttgtccttggcaggaagactttttggaaccctcctgtgttgttcagacgatcgcgtcgaccgagagaagtaaactgtgcaaattgttcagaggcgagtcgcctctctggcggaaccttcggtgccgttttgtgtcgcagtgcgacagcgcaacgcccactcctcctgtgcaacggtgtttttgtttgcatgcacccgttgtcttctcgccccgacttcattcgccgctggctgacagacttccccgaaagctctcctcaaccagcgtcggttttcgccggctcccgggtgtctgtacactgcagaagcacgccagaggacctcccgttccaccagtttctttcgtctctgaatgttgcgaaagcgttgcacacttctccagcttcccttgtccttttgacttttccgacttttggcttccccagggcgcagctctgcggtccggtgtccacacacctcaccgggtgccaaaggacttcgccggcgaaacgcggatgtcccgagaatcctttgtcgaaccttgacttcctcttcttccgcagcgacggccccccggacgcggtctctgcgcgaccttcaccctccttgcctccgttctgtctctccggagcgccttcctctttgctgaattttctcgtcgctcttcgactcggaaaaaaccaaccctacgtgcagagcgctttcacgcgcgcttggcacctccacagtttggggaaagcagtcctggctgtatctcgccctccccagtcgcaaacagccggtctttcaactcacacaaaggcttcttctctcctcgcctttcttctctctttctccttcctcgccgcggtgagagctgtccgccaagtgccgagagctttccgaaagaacgggacctcgaggagaaccgaacttccttttcttctgatcagactgaaaaacggttcgacgcca

SEQ ID NO: 561 - DNA, 2002 bp, Toxoplasma gondii
aagaagggaggaggtacacgtcaaccttccaagccaggagtcctcgatggagaggggatgatgtaggtactaacggatcgccggctttagacaacattcctctcctcatcccctcatgcgctaaaaaaggtcaccaaagtaacgctgatgcgtcggtttctgaaaacgtattacgccaacggtcggaatgaagcaagcatgcatacaccaggagtcgtggcgacgacagatcggcctagaagattcgtctgcccgtgaatgggctagggacgccggcgagggagaactggctatgcattctacttcgcagctctttgcagagaagctccggaacaccaatctcgaacaggaggcaagaaaaattccatacactccccctgcaaggctcgcctctgcgaaggcgctcgcgacacagctaccacccttctggcgcgtttcagcgcgacaagggcgaagcctggcggggtgtagacgccgcggcaagtgtatgtacactacagcaggtgaggcatgtacgcactgcttggacttccagcctcgcggtcacgcagatggagtctcgggcctcaccactgagcaagaacggcggcgaccgcccgcctgaagacttcgtccttgtctagaacagtcatcgtgccgaagttgttgggaagaagtggaaaaaaacgaaaggcgagggcggaaagaggcgacgaagacaagaagattcagacgagtcgaagtcgagagtccgggtgtttcttcgatgaaatggatcactccgcgaaaaaaggcagtgacttcgacaccttccctagcgccagcgggtgtctccgccaccaatcagaagtattagcggttctgcggtgtacatacacctccaggaccgccggcgctgcccgcgggatccgcggtcttggttggaaaggcggctgggcgcggagaaaaacgcccaggaagtcggagaattgagggcggcgtccgacggagaaggtcgcgaactggaaaagagaggacatgcggcccagcgcctgagaaactcgctcgaactcgaactcggttcctgtggggacctcaaaggtccccaagggcgcggcttgaggcgtatttacagcaaagcgagtgcctgtgagagggtatccgcgagacacgccaacgcggaggtttggcaggacgggcaacctcgttttccgctcgacccttgcttttttcttttcgagctcaggccagtcgaccgcagccgcgagaaaccttcagatgcatttcttgactggcagaaaagcgcatcaagtcacagcgcagcgagcgcagcgcgaacgtggagaggcggtcaagctgcatgcgcagagtgagacgaagtatagtccgattttcgaagaggcctgctgttttgccaggcaagtccccctccgcggctggaacgccggtagccagtctttttcttttcgcactcggcgcgtagacttctctaattgcgtgatacaaagtgcaccgcagtgtgtacactcggtcctcgttttcccctgactttctgcagcgccttttgatttctggtttcggcgcttccttgtcttgccggcgccgacactgtcgcctctttttcatgtctttttcgccgtgccacttccctctcccgtcttctacggtctctccactccgttttcgactggtcgcgaaaagaacgcaacggcgcgtttgctttgtcttctgttctcagagaccgacgactgccgcccgcagctcgcaaccgtgtctatcctgtgcgttttcttcctcttttcctctcctttccgcctttttctctttgctttctctgtttttcacttcggtccaccctccgtttgcgtcttctcttccgtctctctctttccctccgccgtcgccgccaagtatctgcccaggttcctctctcggctcaccgcctgtctcttgtctggcggctccgcaaattttctgtgaaaacctttgtttttgttcgtagctcctgttcctcttttgctctctccttttccatttttcttta

SEQ ID NO: 562 - DNA, 4286 bp, Toxoplasma gondii
gtatggcggcgcttcgccttctcactccagttgtaggttctcttcttagcgttggggtatcctgaaaagacgaagaaaaaagccagatttcacaccattcattgcctgtcgcctctcgaaacttcccaatgaaaagaaacggcaggcgcggccttcggggccgcagcagcgaaaacacaaacgtctgggaaaaagggagtggcgcccccctccttttagttctccaagtggcgacgcaaagattgtgaaaagatatttcttgagtgagaaagcgacagagaacacgatacgcgaacagagcatcacacggagcttaagaatcgtggtgcccagcgtatacttgaagcgcccagttgtgtatgcgcaagctgtacatacgggtcaaagacagcactttgacagtcttgttccttgaacgacaaaaggcgtcagactggagacaacggataaatctacatcccaaagcacaaataaaccgcagtgtctctcccaacaggattccgacaccgcccttcttccccttctccgtcaacgccatcccttctcacacctgacgcccagggaagttcacaaggagcgaaatggcgaaagaccctgttgagagcatttttacgcgtacggatgaaaacgagggggagagaaaacaaagggtgaagtaggagaaactccatttgcagaggagatagcagtgtacgccaggtagacacactagaggtggaaagctcagacaagcagagggagtggcgatgggctgacgtccacctcaaagatgtccacaattgagagaaataagtgcgaggtcacagagaagagaggcgagagacgaaaagagactctttgagcagagcatgcagaccagcgacgttcctggagaaaagcggcggtggccgagcggcgtcggccgacctaggtcaaggtgcgtggaaggtgtggcaatttcccctcgactgaaaaaggcgtttctggttcctcccaactcaagaatcgttctctttgctcagtcccggcggtcttccaggtgaagtggacgctccccacacagcaggcagcactgggaagtttaggcggctttgcttctttatcgactgcagtctggtgcgacacgggcagccggagaagaggtcacaactgtcgcgaatggctcttcactctggacagacgacagaacgactcgttcttttgagaaaacactcaccgcaagcgccgcaggtcttcttctgggtgtggtacgcacggcgaccacaccgaatgcacaggaagtgggtcttcccatgcctcttcccgaaggacccagttccttttcctgctttccccattttccttgacagcgatacttcacgcgggaaagagaaaagaaagtcgaaaaggaagaaaaaaataagacgccttgcgtcgaaacggcaaacggctgcggcaccccttctccattcgacccttcacatataagcgtgcgaacatcgccggtctctgtgtcatagcacagtcgcagaggggttcaagcatgttgcggaggggcggtctatatccggaaacggtttttctcccacagtcacccgcgtttcgtttctgcccgcttttcccggcagagtgtgcagcgtctggcaaagtttcccggagatctaaaccggaaaacacgcgagtcgtctaatcgccgccaacacagccacatccggcgcgagacactttgctgctagtcgagagaaaacgtgcaagagcggggaaagtcgggaaagagttgaaactcagtaaagcctcccatctcggggagaggttaggtactttcactgccggtcctgttaccgcgggaagaacggcgttcgatgaaatcacacaaagcagcgagcctggcaaagaagacaacgcgccaaacgcaactcttcagagagtgacgcacgcagagagtgctgtagagcagccacactaacgagtcccgggaaagccaatccttcagaattgcttgctttcctgacagacccggaagcggcgggacgagctgtctggttggctactttcttttcaaatgctttccactcctgcctagcatcgaggggggagctctcaaaagtcacatgaatgcatgaaatcgtcataagcggtccagtgaggtggtggtgtacagcaatcataaagaactcggttgcctgtaactcataactggagtcgtattcagtatcctaggtactataatgtctgtttattcggtttgacgatagaacgggttgagagctcgtgtcctttcatacacggatcgaacagcattcatatctggcacaactcgtcgtggatggcgttcgcagttagagctacgttgagattcctcaacagaagcaggctgcattaccgctgtgttttctgtggtgacagaattgcgcactcgagcggtgtgagtcctttcacgggagcctgagggttggctggtgtcggcaagcccgcctgaagtcaggcaaacttcctgagaatctcactaccaagaaggaagcagtgtgactgcacatggacgagggaaacgaaggagccttcttagagcgaggtgatgctgccccgggcaagcgatctacgttcccctgtgccttgacggctatcggttattcagtgtttttctccatgcagactgaatttcatcgacggtcattgcatgcagggagccagagggcgttgagtgaagggatctagggttctaaaacaaaaaatcgcgggaaaaaaactgcaaacggcagtggttacacatttgaacagagggtccaccacctaggatctcgcaaccacatttcttctatagagcttacacagacacatgcgagcacacgactccgcgcgaacctgcatgacagtaatcaaaacggatgacagtttgtgatttgcttgctttgttgtcgtggagctcagagggttgaaggcgccggaactggcagcctaaaatagaagaagcgtggctcaaagtcccgtgcgaggcacctgcaaatcctctgtcacggttagactttacggcgaagccgtcacaccttgaaaccgagttaccgttttcttaccgcagtttcgataacctatccgagtgacagaactacaagagcgagtggcatgaacttctcagcaagggcaccacgcaatccctagttatgatggtagactgctggcggataccagaaagattcgagagggcagagttctttcagaggcattgtctgagcgcggttcctctcacaagagagacgcacaaccataagacaagcaggtggagttttgcgaacgttttctgattgatcctgctgcatactgagatcctaaggaagttttcgctggcagttgtggagcagccattcacaacagaacgttgtctccccattgaattctacggaagagttgcagaccaataagttcgctgaaaaaagttgcagcttctgagaggaagggcggtgctggcgtaactagtgcatctggcaagacgtgtcaatccacttccctacctgaagccgcaactctcaacaccactgcactgactgtgcccgcgtctgaggagctgtttctcgattctactacgagcgaacacaggagtccatgcatgacgcccacctttacagaatgcagagactctgtcattgtgagtcgtttaggatcacgagacactaacatcagggcggtggcaaaggcgaacgcacgtggaattgcgtgctgggcagcggcttccaccgacggcggcaaaagagtacgagggttttgcgcgacacagacggggtggtctgaacaagtgcgcaaagagaggaaggaaaaagatgctttaaaaactaaagatggttgggtttggtgaagaaaccgaaggaacgcaaaaacagcagcggcgctgcggcgcgtagtgaaactcaaggcgtgcaagacaccgacagccgcgaggtgaaagtacacataataaaccgaacggcccactttcgaaatagcgtgggcgacacctatcctataaatggtcttttgtactttcccccgttttctcacagggtaatcccccttttttcttctgcaagctagcttttttcatcgaagcgccctgtctccgcttttgtctcgtctctctggctcaacccagggacatcgatgggattcaatagagaaatgtcgatacttacttctgtcttcttggagtcgtgagtttccctttttctttcggacgaaacgggcaaaagactccccgttcgaagagtgtatcgggaaggcggccaaggctgcgtgtgtgttctcttcgccgtttagtgagcatcttttccgcaggttgcattcctttccctcgaggctca

SEQ ID NO: 563 - DNA, 2156 bp, Toxoplasma gondii
gttttcccaagaaatagcgcgatctccaacgtacgcagtgagctaaaaagatgcccatctgtgcatctacgttgatactcggttatatatattagacgctaacttcccggctaaacatcccttttctttgaaacacacttcccttctcgccgttagtgtgatctgaaagtatcagaagccctgccgaggcatcagcggcaccctgtggcgttccgtcattctggcttcactgtaagcaacgtcgcaggcacgaaacgcgtccgtctggggagatttttccgagactcttgtcttcaagtctcgaacttacacactttgtggtaacctgtcctctcggctgtaacctgttcatgggcgtgcggtttccgacgcctgcggaacgtggacacggtaaaacacaacaacgctccaaagtgtttcccgttcgagcgacgaaaatgcccacgagtggcggttgaaaactagactgacgagaggatttagccacagtgggccggcgcgacaaggtgactctccactttctgaagggattgaacggtgtgtagacacggctgtgttacagctttatcacgacgcattgcggctgaggagctacaaattggcgtacattctccgcggccaacgcggtgattgaagggacaaggcagcgatgctcatcgctcagtctctctacagaaaagacacgtgaacacctagcaacctcctttctcgcatgagtagcaaggagtccgggatcagtgcagaggcgccacaccaacaaggatccagggattccgtgcagacgaccaccatcaatgagcctaatgaaatccttcaagtggagatgtgcgtgactccagctgcctcctgcaagttgcatacactatgaataagtgaaaaggatcagtccgtccgatttatcatgcaagatgcattctgcggtgtctcttgtttccgactacgtcatgctgagaatgtttttttatgtcagttctcgattcttgctgacagcgcccatcgtgtgacaagtcgcgttcctcctcaagcaccatggaacatcttttcctcgtcattggcgtcccatgtctctgcctattcaatttgagttatagcgagctgcactggtacaatggactacttcagcggcaggctctcggctggagaactgcaggtggttttccgtgtagcgtctagcctccacacaccctcatctgtggacagcgtttcgaaaagttcccgagaaaagaaaaccactttcaggagcgaggatgaggaagcgggttggagaccagaaaaaccgtgaaaaagaatctcgagtggaggaaaggaaatcgtcgccgcggcctcgaagaacagtggcagttcgactccacacttggagacggaaggcggcgcagggaagaactggcaaacgtcaaggaattcggacgggaacaagcggagacttcggtgacagcacgggtgaaaaaaaccaagacaagaggactgtcgtccaactcgcgaacccctggagctgcatgcgcggaaaacctgttcggtcccgctgggcacatgcaactttcttttgagatccttcctcgatttttcttctcgtctttcgcttcgacttgtcaactcttctctccttttttcgtgttgtaaaaatcctcccttctctgaccatccgtcgctcatgtgcggcgtcgcctcttcctccagctttcgtgcaagtgcgtgaaattcctccgtttcggggcgtttccttcctcaactgtgtgtctgtatttgcatcctgtcttctttccctcctcaatttttctctgcagatttccggattttcacgttccttctcttgtccgcgcttctgagtcggggccgcttgcacccttcgtggacaacttctgccaatgcagcctagtcctgtgcatgtttcttcagtctgctccgtttccctcctactcttctccttccatcgacatctgttctcatgcttccgacctgcagaagagtgaactccaagttcaccgagtgtcggtggagtatctcgtactccaccttcctcccctctcagcttcacactgtctccagttgacttccactcggcctgctctctgcggtcaaaactgtctttgcactccctcccttgctcactcttcaactctcacgctgctcttaatgcgagaccttgacagacagga

SEQ ID NO: 564 - DNA, 1618 bp, Toxoplasma gondii
atgcctgagcctttcttttacacaggaactcggaaaagcacattcagcttgcggcgttccgtggagtgtgcaacccacggggagacgaggctccttcacaacatgtcaaaggccgagacggcacaacacagaggaagcgctgtttcggcctctagctacagagctagcagcaggatgggacttgaggatggcgcatgctacagcatcttgattcgcattcttgtgtatgctgcaagggtctcaaggattgagtgcctggagttctagttcattaactacccgtgtcagtgttctcgcctctgtggtatctctttttttttcgttttgcgccgtgcggttctggatcggattaaagcacaaatcgacccacattcacattctgcgtactctcgcgtttcttcaggaaggtgaagaaatgtgctgcggaaactgaaggtacttcctagaacttgtgtcccgacgtcaggtgcagtgtaagcagttctttctaagaacctccgcctccactcactgtcgtcaatccaaccggtgacccttaaaatgaataaatcgattctctctctgtgtctcgagacgaaacgatggtttgttgacgccatcgcatgcgtcgattcacttccgaaaaagccacgtacgagggacatggttaaaccttgtacggtttgtccctacttgactcctcagtttaaacataactgtagtttatcgggactcaagtcagagacaacgtcacttggttccgtctctaatcttctcatcatcaccgtctttcagcccactagtgacgaccgcattgttgacgacacctctttctaatcatcgtttttccttttcgtcactctttccgccagttctcccttttcaccggtactgtccttccgcggcttcccgagctgccgtcgtcggcgttcacactcgaagctccttgagcgactttctgagcgtctaccaggatcgtttcccgtgttttttcttttttcgccgtcttccctgagggagaaaaataccgccttgcaagcgcacgcgaataccgatagagggttgagccgtccactggcgagtgattggcgcgcacgagacacctcaatccctagaacctcatatctctttatgtatatgctggataatttagtttgaaatactagtggaaagcaccgtgtgaagagccggatcccctttgcggcgactcggcgctgcaaggcctgtctcgctgttattttctcgctgcatgcatgcgcgcgggtttctccatctggcagctgcagcaaacactgtgcgtttttttgttgcatgcgcaaaaaaccgtttccatacaaacattgcttttcatgaaacccacccgctatctggcttacctgcatggggacagccaccggtttttttctgtctctcggaagctgttgctgctgctcttccgttcctgtctccctcgggggtatacaaatacctcggctgcgcgtgaccgcgcttagtgtcccgtcggtcctcgcgccgtttcgggtcgtttcctacatgttctgattccgcagcctttccacgcgttgacagaagatctgtccggtctaccctcttctcgcggccgtccccctccccgttttccccgttcctctcggccata

SEQ ID NO: 565 - DNA, 2419 bp, Toxoplasma gondii
cacaagacacatattggagagtgtgagtctgcgcagagaatcctctctgaccctgcatgtctctgtccagctcgcgcgtcgacccatgcctctgtgtgagcttctgcatacatctgcacgcatctgcatgcatctgcacgttggttcgtctaccgagctgggggcggctcttcgccgacgcccacttcgcgcaccgatgcagtggagatggaagacgtgcccgcacgcgccgaaggccgggggacaggcctcgccaggtctgtcgcatgcactgcagtgaacttcgaaggcgttgctgcagatgccacacttctcgtcgggaggcacccctgcccatctccagccgcccacgaagtggacgtgccggactcttacgcgactgtggggcgagagacttgcggcgcgcagcagcagcaagtcgttcgcggagccagccgggaactgtctcttgtccgctgcctctggagacgcagactccatcctgagaggcgacgttgcctcgcttcctcgaggccttcctttcctcgctcgtcagccgaatcgcttcagcgcgcgacgcgagcgagaagaacaggggaagaaacccgagcgagaagaacaggggacggaacgcgagagagaagatccggggagagaacgcgagagagaagatccggggagagagaaaagaaaacataacagaggggaagaagacgaagagaagggaagagcgtagaggaggaacagaggcgaggtagaagcgagtagaggaagaggagagtagagcaagaatagaaagacgattgtagagtccgtagggactttgggaaagtggcggtctggaggagacaagatgagagtggtggaagcatctgaacgaggagaaaacggcaagagaggccggcgccgagaagagagagagttgtggagaagattgagaaaaaagaacttctccctatggagtggtggcttataatatctatccggaaaaaaggaacgaaaaaatgactccagaaaaatgaattttcgctttctccggggaaaacactcagcacaagagtcaggaaagccgagcacgatacagaggccgttgatcttgatagccgactccccaagcgatatacacacatctacatggatatgaacgcaaacatgcatgcatatatatatatatatatatttatatatatatagatatagatatataccttcatgtatgcgagagggcacacgcgatacacacacttctctttcacacacttctgtagaatacattatggagacattgtctcttctcgagtcttgtcggaagcgagaaacggattggtgtgaagaaaatcgtgcgtctctggaaagcttttgtcgcgtcagagtggaggaaagatgacaaagggaacccgggcagtgaaattcagcaaactcgagagcatgcgtgagacacacgcacacatcgttcttctgtttcccctcttctcccttttcatcgcttctctgttattccttttacagggaaagggtgacttcttttgttctttctatttcctctctttcttcgcttcttcgaccgtagctacagattccagttccactctctgctagccgcgtccgccgtgtgctgtttttcgcacgcatgcgcgagaaaacgggccaggcgactctgccttgttccgggacctctttcttcctctctgagcacaaacttctgtttctctccgctgtgcggttgagtctgtcagtaacccgctttccggcatctctgcttgtgtcttgtctcgccgctcttgtttcctgaccatcccccggccagctgcgccgcatctgtccgcggttctcagaaagctgcgtctcgctgccttgtttccacgaaaacagtcaaagttcctaaagagggcgcgaggacccgccagggcggcgctatcgtgtgtgcacttttaccttgtctgtgtgtctcgcggacgaccagagattctcgcagttcttgtgcgccgagcttcttttggacagactcccaggcctgcacttctcagctcctgcaggtcattccaaacccaccgcgtgagaggtctctgttgaaacggagccaagcccagtcagacgaattgcgagaagacttcgtggaaacttgcacaaaagagcagcgcgcttccggccacaccgcgtgtctagacaccgcggcgggccggactgcagtcggccgctcacatcgctggcaagacgctgacacagtaacgtaaatttctggagcttctgttcttctctgaggagcctgtagcctctttctcgttttgtcgttctgggtcacgcctctcccgtttctgtttttgtgcctctccacatctcgagtggacttcccgtttcgctcgtgctctgtctgtcgacgcgcacgtccccccctgtcgactcggatgcctggttcgtgagcgccgcgtcagcgccttga

SEQ ID NO: 566 - DNA, 2379 bp, Toxoplasma gondii
tctttcttttcttctgatgtgtttgagtccttttgggctcgcagctccctcctcgcaaccatgtcggggtggcatgccttcgctttctgtctgtaggcgaggcggatgcactcctcgctgctgtcagcggggatgccgaggacctcgtacgggtcgaagtacaggcgctcgctcgcgtcttcatcgagatcctcatcggtttctgcgtctgcgttcccgccaatgtaggacgactttccatgcgccttggacgcggatccaccatgggggcaactctgccccgcgcctcctccaggctgcacttgcgcaccctcagtccccgctctgcttgtgcctcgggaggtcgatttgttcggccgacgctttcgaggttcgtcggacgcgaagaagagcgagacaaagtcttcggcgtcgaaggacggcctgccgtgaacgggagggatcttggcgcgttcgaggcctcgaatgtgtgaaacctcgcaggaggacggcggctgagaagcaatgtgacacacgccctttttcggaggaggcgaagaagccgacttccgcgcgcagttcgccgacgaattactcgaaccggacaaacattcgtcagctgtcgatcgacgggactcactggcagcttctgcgaaaagaaacgagtccacttcggcgttgcaagtgtcgcagagaggaagggagggcggtgaggtgagagagagaagtacgacggcaaaaaccgtgaagaaagtcgaggcgaatcgaaagaaaatagacgggaggaccgcactcggcgctcctgattgagagaaactctggaaagaggtggaggtaggtaggcgagacagctggtgagtaggcgacgggggcaaggcagaggaagttgagacagagggagagggacagggtgaagaaagacaagacttcgaagaagcaagaaaagaagaagagtcagaggacagacccgagggtcctccctcgcctgttctctgagcgactttcatcttgcccattcttcgttttttcggaaacccctcagaaaactttaaagccgacgcaggtgcgactcagtctcgctggacgatttgcgaagtgccatggacgtccagaagaacgactcgatgtacttgttagaattcacgtcagctcttatttaggtattttagggtcttcatattctttgcagtacgtcctgaaaaacgaagctgacacaccaggcctgcctgtaaagctacaaaaaacgcattgtgcgacacgactccaacctacatgcaccgtgtggcgactctccatccacgaggcgccatttccgcgttttaaggaatgctttgtggtatctattgcgaacaagtgagaaacggaacgaaaggaaaagtgcgtcgagggccggcacaatggcctagctctcgcagcgccgcaggcgctcgcgtcgtcggtccacgagttcgatatccgaggtagaaggatgcccgcgaaactctggatgcgtcttaaaacgccggacaagaaaatgtgtagaccgaatgccacgtgaagcattcgctgttaacgcccagacgcatgcaaaaaattgccagtcgcctacccgaccgaaaaaagtcctattcccctcaagcagacagtgcgcttaaaagttcgaactcgtctgaatcgcaggcattgctctgaaggttgccttgctgaaattcttccgcgattcccaccagagcacactacgaaaagacctagactcgtggacttgctctgcagctccagtgcaactcctgttaagagattgtgcgtctctagggcgcctcttgaggccgtctcgagcagcccccctcttcaaagcgtgtgcagatgatgtgcgtagattgctcaggggatatgttgtttgattgaagcaaagaagaaaaaggcgtctgttccctcatttagcgtgatctgtctgagtcgactgcggcggggacaacaccgctcgagtcttcctgcacgtgcgatcgcggacgcatgcttgcatcgatcgtcctcacttttgctcgatgcgtctctgtttccctgaaaacctcggttctttgtgtctcctctctcacgtctcgtctttttcgcgatcggttccctcccctcacggatcgtctgcagctcctcagtttctccctccctgtaagtgtttcccgcctgtccacgagtttctccgcgcgacagaaaaaacgcctcccgcagtcgtctcccatgtctattcggttggacctgaagcgtgaaacttggaaaaggaccacccagacatctacgcgaaaggagagaagtgagaaccgcctcgtcgaaggcgaggatggagaggcggcgcgccattcgtcggctgttccagtcccgctagcccctcgttccgcaacttcccgctgaagagaagtcccacga

SEQ ID NO: 567 - DNA, 3674 bp, Toxoplasma gondii
tctttcatgagttagttcaggtccctctcgctttttggacgtacgtggcttgccccatcgaaagaaaaggaccgcctttgtggggagggagaagtgagagatgtcgagtttcacactggcgtgctcggacgcagcgacttcccgttcagtttcttcttcgctggcctccgcggggtcctgtcgaatctgcggttctctgtgtcccgcgagagcgtcgaagacgcttccttcccccgtccgtttctcagctgcttgtttgttgcggcgattttccgtctctgcgtcacctgaagactccgaatccgttcgacttccacgctgacggtcgacgggcaggtgcacctgcatgctgccgacggcgacagagcgatgaggcatgtttatgtttctgacgaggatatccaggttgtcagacgaggcacctttccccttctccttctcggcttcgttctgagaaaacaaacgatctgacccgcgtccgcgaggcggggcaaagagagctccacatgcgtgctgcccctcaaggtgcgaggagaatggattgtgttcgcgcaacggagaaggtacagatgcaggtaaagtcccctgattgtggtcgttccatgttggcggcatgctcttcgcagaatctgaaggcggcaagcgacgctgcgtccccgcttcttggctgacagcggctgcaagacccgaggacagacgggcgtttgacggcgccgcgcgtccgggaggctgtctgtcattttctccctcggaaaaactaggagacagccgagtcgcgacatctgcgaatgtggatggagcgctttgtgcagaggaaagcgaagagaattcaggaccggcgccttggcgtcgttctccagcttcgcgagatatcggcgagctggcaggagctacggaagccgcagcatcgcccaagacgtttgcttctgacggagaaaccgagttggctgacggaaaagggagggcgggggaggtcgaggaaaacaaagagaaagggtcctcggagccgaaaaagtccagaggagtgggactaggacgttgccatgggaagccgccagtcgctgcccctgtccagaggagctggtacagcagatagcaagacgggacgaaacagcggaggggtccggcagccaggaaaaaagacaggcaagccaggaaacgcagacaatacgccatgcttcgacggcgaagaaaacgcgtcatcgttccggggatcgcggaaacatggatcaagcacgcggcacggggaaatgcaactgcatgacacagtcggtgctcctcgggaaggcacccgtcccccaaaagctgttttgcgttatcgaagaatcattgctgcctatggagagcgaaaaaactttgtggaccgccagctcaggtgtggcgaggttgaagaaaagcgacaagcagtggtaagttactcgcgcgtgatacacgtagcgttgctcaacggcacgaagttcgcgaagggaaaatctgggagctgctggggacagagagagaggggggctcggccgcacccacagatgaagaaacgcgacaaggcacagcacagtcctttcaggagtgatactgcataacagcaaaccgttgctacacaacctgcaaaccggaaacgcaccgacttctccgagacagacaagccaggagacagagagcatgctccgagttccccccgcccgccacagaaaaggcagggcgtcgttggccagcgatctgttcaagtgtttacagacgtgtgttttttcttatccttctgaagtgacacaaaaatagttagagaggaatcttcccgcgatgaaacaagaagcgtaccttgcacgcgtgcatatattttcacgtttctttcgaggcaagaaatgccacacggcattgtactggcgctagtcagctgacggcaccttcctcagaatcaagactgcacccatagtcaagggaggcaatgtgtctcttttggctttaggagcagaaatgaaggttgaaacacgcacgcgtgtgcactatctctagaaacactgaatatactcaatgactgcacaggacgcgtcgatgtgcttcttgcggcgcgaaagtgcaccccgggtgacacttttcagataacaggtttgtcgttaccggagttcgaaagcttcagtacgaagcattaactcaaggaagcgaacaaaagcatagcaatagaagaagagatacgatgatttatactaaaaacaccgtctcgcaagctgccctttaagccaggctgcggttcaccgtttacagccatgcgaatatgttcttggctggcgttgtgctgaagttcagcagagttgcggcaggagcctgcgtgttacatgaaggagcgtgaaagcagaagaatgggaaatccagacactttggcacaccactactactcagcgttatccgaaaggagctacgcttactttcgtccacgctcccgataggccactagaaaaagccgccagtcggaaggacagttgaaagtgacagggaatgctagatggaaaatagataattccgttccgcagtttggtatgcttctggacggagaacaacgtgcgatagtagcgcatggttgtcgagaggcactcgaggtcctaccttcagtgataagtgggtagttgtctagctgaaacgtagtctgaacaggagttgcggtcaccagggactctcacgcaagcattccgtacagactaaaatgcagatgggactactaaagtgaatatcatgatatttgtacagcttgtatacaagtgacggtttttcacctctacgccagattcctctacacttatcgcgcgatacttggtcatgaaagtgcacaagagatcttggatctgtttggaactcttcagttgtcagaggatcgatatcacttacagcaggaaccacctgttgtgcgtcgtttcgtcacagtgtgtcctgaatcgagttacgtatcctattggaggtgttcttgcgtcgcttctccttcgtgcttttgcggtacgagtccaagaaagagataccgccacaccgggactgcgtcgtccgtagggagagaaccgaaagtgaatcttgcaaaaacggttacttggtaacaggccccgctgcgatggagtctgctttttaagttttatgtcgcaaaaaaatacggtaaattagcggaaaccccacgagcgaccccgagagaatcgacggcaaacaaccttcatctggcattccgcgcagtcacccgagtctctcttccctggcaaatcgttcctgctcgtttcgctttgactaaaccctgcagaagctgcctcttcccccgccgcttctttcccgcaagcggagaataacgttgacatttacgcttggagccgtttctgcattgcaagtgttcgacacaccactgagcgcgacgccctcacagctgccgcgtctcttctctgcaacgtttgcgccagtgtccaacagcacatcagaaccctctgcttccgttcccacgctttttccccccggcgcagcttttgtatctcgatatcgaccaccgacattgcccgttgctgtagcgtaaacgcctgagtgatgggtggaatttccgctgctggggtagagctccagcaggatcttcgcgctaccctcacaaaggcggtccggtctgcagactggctgacagtttcttcttgcacatgtgtttcatacgaacaaccacgcca

SEQ ID NO: 568 - DNA, 4672 bp, Toxoplasma gondii
gagaacggacaaaaaggtgaagacatctgcacatcgattgtgcgtgtcggggctatcctgagcgtcttccacgctcttgtttatcagcttcctctccacccttctcggggtttgcatttctctccagagtttccgctcggcgcctcgtcgaagaaacggaagcgcgacagaaaggatggacggaaaggggccgagacggaagccgatgagagctccgtccatggcggatctttattcttttcagaggcacatctcgaacgccttctgttcttcgttatcgacgcggcgtatcgatgctcgacagttattcgaggcggcgaagagggaggccacaagaaggaggcaaggaccgactctctgctgcttcaactgctgagtaccgaacgaggtgaaggcgccttcgcagccgacgggggctcttccctcgcggcgctgtggcagggcctcgcctctttgtcgccgaaggaacagcaaagagaagtcctcacgggtggcatgttccttctcggcgaaattcaagaagtgcttaaagacgggggacgcgaggaactggccctcggcctcctggctaaagtgcgcacgtctgtgctgtcctgcaggttgaaacggaaggtcgacagccagcaacaggccttgctccagccgcagaaatacgcagagaagcgacgccggcaacaatgcaagaagaaactgtcaaaaaaaagaaaggtcgcgctcctcattgcgaaaaaccgaggcggaaaacgaagagagaaatcctgataagcagctaccggcacgactcctttgtttgcctttttcgaggtgtcctcttcttgttgaggaaagtcgggtttcctttgccgagcagtatgttttttgacgtgagtgttccgccgatggcctgattctctggacgtctattttttcttttgcagcgcagtggttctgatgtgagtgtacggataatattgacgcaccgtcgctgacgaaccgcctgtaacactctggaactgatgtctccagtatttgtagacagaaacgtcgctacgcaggttcccgtttgactccgtatccggaacagcaacgtgatttcggtattgctttgagaatattggattgaagtcccaaaatctactgttggccagggcatacacacaaacgtgcgcgtttcatcgtctcgaggcggagttattcctgtttcttgtgtctgacatcttcaaagcgtcaacccgctaatcactctcgtgttgagatagtttctgcaatatttagttgacatttttagtcgaatatttccaggaaccacaggttaccgcgacgaacggtagctgtcttcactgttaaatcaacactacctctcattaaccgtgggaaacacggcacaaacagagaagcgaagcaaatgaagtgacgtcacagcgttgcgcggctccatggcagcacatgtaaagcagcgacagaaattacaggctcccatattttgtggtatagttccgccgcttcgctggtttcgtcacgctttggaaatcatctttccgaaacttctgcccccgagtctggtgcatgccgagacatcagactgatgaaccgaattctctacgaaagagacaaaacgcgtacagaaacatatctggtcggggtcaaaggtgcagccctgcctttgtaaagaaaatgaaaacaccctctcggttttgagggtcacgaggtattccggagctctcccaaaaacccagtgacgttctgtcaggtgttaaaaaaagtcacctaatgagaattgtgatacgcaattaattgagcacacttcaagaatcccggagtaagcgttaagtggccaacatagactcttgcgggtgaaagaattcctctgcgttgccaaatgcttggggtaatgcccctgtggtgacctccatagagttggaacgaaggaaaagcaggctttcgtacacgccgtttccttgtccagggaaccggccgcagctacgcaactctttcgaccctgaagtgtcgagttattcctcatcatctctcaaggaagtcccccagctccgctagacacaggctgtctcggcctcagttacacaccgtgggtcaaggtttttcacctgcctaaacaaagttacaaggcatagctgccggggcacccgtgaaacgcagagtccaaaaaagtgaatcgcaaaaggctgactgatatttgaccgcgagaactcgcagtattcgctaccgtgtggagcctcgatatatctctggttcttcgagcaaatactccagcccggcactctccgaaactcttatgtacacttggaggtcaagtgccgcgactgaagacgtggttccattcattctgcagctacggttcctgactggcatcgctcggtttgtcgtccgactggcgggcgccattggaacgaggcgtcgcttgcaaaataacgcccccgcagcccggaacagctataacattaagagcacttttttcagcggggtccgccgatggcgttaaccatctgttggcatgtcacgatgacgcagacgtcgttttctttccgtgtcgtttgggttgtttggggttcgaggcatgggcagacacgcgaagcccctgcctccaccgaaacggatcggtacgccggacttgaagaaaagcgcggctcgacgggatcaccgaaacccgccagtcgccaatccgtgaagaggacccgggcgcctacacgctgtcggccgttcacccttcttagtcttggacggtggaaccgtgtacacaccaggtccagtactcacgtgacctcgcgtgacctcttcgccgattcgcttatggtatatgaacaccctaggcgaggcgtacttgtctggccccccgtttgtgcgtctgcaagttttgtgccaagagaggtcgctggtttgttgtcgcggttggatcttcatggaattgtgtccgattttttccctacagggctgagaagaattgtgggaggaggccgaagcaacgaacctccgcatcggtcgcaccggcgatgttttccgccgccgctccattctcacccattgttgctctctggcctggtaggattccgcagtgactctcggggagtttgtgcctgtcacctgtacaagtcgacggatgcctgtattttcgaaaaacgacgtgtcgagcggagagaaagcagggaaactggtaagaagcgtcggaggtgcacggccagtagcgcctgagaagagactggtcgagactggtccggtgtcgcgccgtccgagggccgaaacggggccgggcgacgcatttgcgttgtctgtttcggcgctcgcgtcccacctgtctcttcctttctctgcaggcggtgggtaccggggcacagcgacctgagaagagtgtggggcggaaaacgcctggaaaaggcattctgtggaaattacttttacttcttgggaacgagtggccaagggacacagctttttttttcaacccgtcgttctcgtcaacacttggcgacactcccccgactcacgggactgagcgcaggaatccttgtatgcggcctgtcccttctcgtagatttggaacggcaaggatcgaccggaaacgctgagcacactacggaggcgtatcgtgccttggcatcgtgttgccccccgcatttttgccagtttcgttgtcagtaggggagatgccaggtcgtttaaattggatgcgtttcgtgatgttttccaggggcattatcgagtcgatgggattcgtggtcgcgccacatcgcatgcaacgggcgccgctctctgcctcgagtaccgacggtgctgactgaaaggtttcgcctctcactcttgtggtgctgcgccttctttctcgttgcttccacggtatttcgtcgcgtcccacggtgtttatctcttgttcgtggtgattttattggtgcgtggttctttttcctcctgcgaagcggattccgcgcctcctggctcctagacgttcctactccctatgcttcgccgggccgtagccgacggtgtccttgctagggaacgaggagttttccaatgagcaagcttccggtgttgggttaaccagtgacttgttaaataactgcagccaatcctacccaactgttttgagatgctaccgtgtttgtcttcgaccccgtttcctgtgtctggtgcgggacggatagccttgttagggtgggccttcccggtctgagagtgtcaccgagtgcttgtcgattgtgtttgtcgtctcctttctcatttgtctttcgtcaatcctattcgtacacggcactcgtttttcaactgtacggtccttgtttgacgcgtcttgtcggttttattttcccccacgtgcgccttcgccgcgggtgaatgcgcggcggggcgttttgtcatgcgtgtactggatacctccaaacggcgttttgttcgaataagttaccatctagtttttctcctgaggtgtttcagtcccgcgaaaggaagggcgattcgttcatttgcgttggcttggtaacgttccgcgtctgatttgtcaagcgttttggttcaggacagcgtttttgaaaggttgagcaggcttccctgtcgatcgtagggatttgtctcgttctccatcggtgtgcgtctctgtgtgtgtcggtttcggtggtggctccccttcggagagtctgcctcccttgtcgtccctggctgtcgtaagcaggctcgtccacta

SEQ ID NO: 569 - DNA, 1635 bp, Toxoplasma gondii
gagttcagttattcatttcagcagaagcaaatacattttatggtgccacgaaagaggagagcccacaggaaaggctgacaacgttgtccgctgttctgcgagttgcatacgcaccatcccgactgggacgcactgaagaggtgaccttgcttgtaagatgggttcagcatttcgttctcctttacttttcagtgcataatgtcaggaggctgtgctcaagacgagaattcgtctcataattccacggagaaaaatggactgtttcttggaacagtttacggaaagcttctgtattcctgaatttcagcgtgtgaagtggacccacaccgagaagcacggaagcaagtttttctcccttatgccaacaaacaaagagcactcaataccatgtaacgagcatgttggacacgctcgctgaataatcatgctctcccgtcgcaactagttgccgttagcgcaagcgcatcagcgctgcaaagttaactttgttcgttccaaaggtaacggtggatggagaagtggttcgtatttcttctgcaacagctgccatgatgtttccgtggcacgtttgtggcttccagttactaggtctggtgtgcgtgatgaaccggtgcgctgtatgttgtggtacagtcctgcagtgtgacaaaggcgtctccgaaagcctcttgtttcctgaatgaagactgtactgcaaaagagttcaacgaacgaatattatgaataggtgcaggatcttgagaatgatcaataacatcaacgagtaagaaaattcgaatggctcgtagtccgtcaactaatgtgtgcatgctaatggtttcgtccgctgagttactggtgccttgtctttacaaggccccgcagccaaatgacttcgacacgagacagaatctgtgactcctcgtagttagtggctgacgaaagaaacatatgtgtcaggttaatccgcttctgaatagcggtgcgaggcactaaacttccagtttggctaaacaagactttttcttttgcatgacccccctttgcatgcactggcgtatagtgccaactggcagccttcttcagaataccgactttacggaggtaaatgtttttgcaggccagtgttgtatttgacaaagctttagaaaccttgccgtccactgctcttcctgattaaggtccgtcttccgtaggaggacggcgaagtgtcgtagctgcgctgtcataatctactgtttggaaatccgaagcctcaagctgctgacaggtgtcccgtagaaaatttcgttgtaaccttcggtgttcatgctttttttctcgtcgcagtggcaggcaaccaactacataagtgtttatgtccacaatgaggccctgcggcgctcgttgagtcgcgttgtgattttcctgtcctcagaaaacttccagaatctgctattacgtctcgtgttagtggaccgatgtgagccatttgttttcaattttgtgagcttatgggtcgaaaggtgtacgctttatgagctcaaattattgagggaaggaagtgcgttacagagggtggatgcttgtgtgtttatgattgagagagcgcattggcttttgtgtcgatatcatctggtacataccacactcgcatcttttacaggtgtttcaaga

SEQ ID NO: 570 - DNA, 3330 bp, Toxoplasma gondii
cgtttctgcctcttgtgctcacagttgcttctcctctactttcgtctgcttcttctttctcggccttgttacttgctgtgtgtccacggacatctctttggtggttgtttgcccgcctgtgagaagtcagcgcgagcgatccctctcttccggcttgtctctcctccggaatgttcgggacatacaagagaacgagaggccaggaagcttcgtgcctccgcaagagcttctcggcgtcagcgtcggagaggtgatacacgtaaaaggagtcgtccgtgttttctttcttccacttgaaaacgctttcttcctctccacagtgaggacccggtggcgagcgagacgagtcgctcggtctcgcagtgggagaacaagaaagggggaaagaaacgacaggagaagcggcaggccggggggggagagagcgggcgggatcgcaccggatcactgctaaaggaagtccgtgaggattgaagtcgggagacggaaggagaggaaaagaaggacccgcctttgaatcgctcgcccccatagtggctggcgccaagcagacgagtgagacagagctgcggaagagacttaacgacgaaagagcgagaatggcgtctcgacggcaggtctgtgctggacagctactagagcagagggagaagcgggcgatatcgaggtcgccgaaaggcagaaaaaacaatctccagaaaggagggatcgggaccgaacacaagagaatcgagtttcagacaacatcggcgtaagctgtctcggggagaacctgccgggtgagaagacagcggggaaacgcggagcgtggcgtcggggagaagcatttaatggaagccgggggcaacattgtaggcttttttatgtctaaaatgaaactgaaaaaaaagagacccaagacgtctctctcgtctcaactctccacgctcgctcagacgcacaccggaacagccctcgctgcagcgggaaacgcctttgtttttcgtttcttcgtgagattcaggtagtggcattttctctaaaaatcccgctagtcagacagatccgcaattgaagcgaccgcttcctcgtgtgcacgccacgcgaccaaaggtagaagcgtaaaaacaattcaggctgacggccgttacaccgccgcagactgttttcggcgccttctgcgggtcgtctggagaactccatgagaaaaaaagaaaagaaagaaaaagcaagaggggcagacagcagacgcggtcctcgaggtcgagtctgggtctcgctctctccacttcccagccacacacccacgcattgtcgatgtctggagactttgctcgacttcctcgatgctctctgtcgcggttctcgaggagtcctcttgaacggtagcgaattaaacaaaggggcaccttttcttctgccttgttcattttcgcgcgtttctgtcgtttgctctgtgccctctaacgagcgaagggttctttctcgaaggaggagcagcaagcgacgggagggcacacagcgtttcactgagcttcgagagcagtagagaaatatgcacgaagacatgattgcttttgccttggctttcccgtcggctctttttctcgtctgggcttttcctgccctacctctcaagattcgcgagttcgcagttcatgtgccgcgtgaccttctagccaggactctccttgagccccagaacttccgccttttctgaggttgtggcgcgtcttctctcagtgtccttctgtcgagagacgcgatggcggcgtcgacgctgggtatttctgctttttctcccaaacggaactataatcagacacttcagggctacgatctatcgtcatgaattccggcttgtggttgtgtggtgtttttgtctgttttcccgtcgatttgtggtatcctgctcttttgaacgggcgacccccgaatataagccgagttctccctcgcggtcccgttgcctcaaagaggtcaagggtgccgccgcagaaacgcagagccctctcccctgtgaggctcgttcgcccaactccctcaactggtgagaaggaaatttctggaaggctttcgtttcctgtgtgtgagataaattagaaggagcagtcacggaacacagaaccggagagccaacgaaagcgcaaaagccggcacactcccgtttccgcgggcacacaccttgcaaacagccgtcagcaagggccggtgcgcggcccttgccatgcgagtgtcgatctggcatcttctcgtataaaaagagcgatggagaaaacgaacttgaggcaaatgcgaagccaatttcgtttgttttaatcagttgcgcgcgagaggaagttctcccggcctcaaatgccgggtgccctgtccgcttttcgcagcttagccagtgctctcggcgcgcgtccctgtcaaagtgacccggctttttgctcgcagttttttgggcttttcctcggcgaaaacacctgtatttctttaccgagcttcacttgggataaccggggaaggcgatgacttgcacgccgaatcgcaggaacgagctcgcctgataagcagtccgcgacaaggttcttgttcatgccagacctgtggctgtttgcgaccgaggagaagtgcctccgattccggttgggttcgcagctcttctctcgcaattcatccacagccagctctaatcggcgtaaggaggcaccgaagaccaagtgcacagcgctcgtcttgtagagcgcggccttccaagcttgtcaggcttctctttttccccgttcagcggcgcacctcggtagcaaccacacagacaaagcaaccactgagggtttcgtatcgaggcggctgttcccagagggaacgctggatttcttcggcgctcctccacttcacgaggcgatttcgagcgcttcgagcacgtcgcgggcgttcttgcctcgccgtctcctcactcgatgatgactgccccctctgttggatttgctccagtccgtctttcggaagaaatccaggagacagtgtcagtggtggaaacttgcggcctcaccggttagacggttctgtcgaacccactcacgttcctctcgcgtgtatctctgtgtcgacaatcgcctctgtcgccttctccgttctctatcctctctgcatctcttaattttctgatttgctccattctggtgcttcgcgagcccacgcagctccgcgcttcgtctccccgctttgcctctctctcctcaactcgtccgcaattcgatttctacgtcccaacctctctgtgtcgtgggatagaagcctcacactcctctcgcttatctcgtccgtcgtccgtcaatctgcgtttctttcgagaatcaacca

SEQ ID NO: 571 - DNA, 1721 bp, Toxoplasma gondii
tacacgtaatcatgcccgtgcgctgaagctttttaccagttgtgacgggagtttaaaaatcatatattctgaaatgacgtagctgctcacaatccgctacgcttctgctcgggtgaacaccgagcaaagccttcacacgttgtctttagggtcctatggatgtaagtgtgctttgcatgcatggtcacgctcgactaagtttctgcgttcatagctgcctatcggtacgtacatgccggcgagttctcaacgcgtgagcggtacttttggaggttaggaagcatgcgaacgcgagtcttcgatgtgatactaagcctgacagggcgccaaaaactggagaggatcccgcttgcgcggagcgctcgccaaagtggagtggcattatggttgaccccagtttccgtaatcgaatgtgcctgaaacgccttatgttttctatgtcgtggaagaacttgaatagaaaggacggaagcggcatctgacaactccgacgttggggtagcgatatttacacgtgtggaaacaggtcggattacagaggcgctctgtggcatttcacaaaaacattgccgtgtagcttcgtagaagctttgggttccaggattaacacattttcgatacacggccaaacgtagaggaaagaaaacctgtcccctcgtccgtaagtagaatgaagcacgcagcttgcaatattccaatcaccggcaccggaacacactatgaaaatcactgttgaactggtgggttcgtatgaggctaaacggaccgccgctttcgaatgcgcttattgggggtgatgtcgaatcgttttttttacaaatgatataatcgaaaaggatgctttaacggggctgagtcggcgactctcaacaggcgagtcggccgtacaagcggccattgttgctggaacgaggttagaatagtgaagcagtgcatatctcgaaagcatcgctctaaaacagttcattttgttgtgctacttttaaagacgtacaagtttcaccttcatgtggaacgcaaagatgcaagcccgtatgattttttttctacgcctacagccttcgagcggggatggcacgcttctagacgagtgtgctcgagtgcctccatgttgatggtgaatcgagtgttcgaagtggaaattcgtcgctccccatatctagtttttcttgtgcaaaagtctagttcgtgcgtttgccggtttgtgctattcgagtgcgcgtcggttcccaggccaagtgtgcaaggtactcacaaactgtggataaagctagtctcctcaggctttcccagcagctagtgtgtccttgtgtgcgttctgttaaagtggaacgccctttgggtacctatcacagtgcagtttctcttgacatacacaagtcgggaatttcagaggctcagttctacctgtagttcgtgaaatcacagacagcatgtatgacggaacaaaaatactaattctggccgttgtggccatcttctgctcgatggggacggcagaagcgcagattatgattttggaaccgcctggcgcagttctgaaaaacaattccacaatgattgaaggatcgacggcgtcatttggggctccagtaggtgtctgcctttccttatcactcagacaaaggttttgtaattttcggttccgtgcaaaaccaaaaacgactgttctagactctggctttttctgcggcatccacgtagcagtcaaactcacggaa

SEQ ID NO: 572 - DNA, 1967 bp, Toxoplasma gondii
ggtttctctcatttctttttaggcgatgcctctgccgacggcttgtcctcgtacgcctccgagtacgtgtgatcccaggtccacttcaacagaggcggttcctgagaaaaaacattttccatgagaaaccacggattccaaattgacccctcgcacacactgacacagaacacaatctagtcctggatgcaaccttacacacacgtatcagcatacaaacaacatatatatatatatatatatgcataggtgaatgtctctttctctacacttgtatatatggtgagaaaggcgaggagagtttctggctggctacgaaaacttcggttattgttacgtagttccactgtgtggagcgagccgagacgcctggccgaggctggacatgcgctgacgggacagggaggcatgcgcacgagcgcggagggctgcttctgagatcgagagagtttgcagatatttcttacgacgaactgatggagaggggtcggcttgtccacgacgtcgagaatgtagaggcccatgacggggatgcatgtgccgtctctcagacgggtgtgcatcttcacgagctgcgagtccatcacgtggagaactctgtgcgccaagtcgtccgtctccttgaaacggagaggctgtttgaagcaagaaacatacagaggagaggcaaaggcactttgacagcaaaggggaagctcctcggaggtgcgcgtcaccacgggaaggcgacgtggaaaggagccgtagaccacagaagcgaaagccagcggtagccactcacagagtacgcctgtggacagggcgtttagctttttcgcttcagaaaccgtcacgttgctaataaacgagaacggggattcaaatgagacctgcaacatctgaacctgtcgacctcgtcctagacgacacaaattcagcacacaccttatctgtctcgtgtttgctgtgtgtcgaaaacttgttccaagtgggcctcttcctggaatgacggcaggacgaaagtacacgagaaacagccaggaagagccacagaaggatatcgagtcgcatctggcgttctcaaaagatggatttccatgccccgcggattgagctcttcctgccgccctgtgcttcgtagtatctttccccggcggatcgactgctgccaacagtgtttttttctcccggtgccagctgtgctgaaactgcttgtcggtccttataggtcaatgcagcacaagggatggggggagcagttcccgtgctcgtcgacagaaatcgaacgcattaaggttcatcgtaggtgaaggccactttacggcactctatgtgatgtgtgagtaagagcatcgaagctggcagtttttgccgcacccaggggtctcgcagtcgcggaccagacttaccgcagtgcgcccaagacagaagtttgtttcctcgatcacccagtcgtcagactttttgataagttgctcgctggtcacgggctggccatcgtagccgctgaaaggtctgttgaagacgcgccatgcggagttttgcgcgagcagagtggcggccatgggtttgccgaccgacccgcgggcgagggcaggtagcttggcgcagacggaagcgaacgccatggtcgtggcgattagtgggaaaaaaacaagaaagaggaaatcgaagagacgcgaaggcgcaggcacgaaaaacgcggaaaatcaaactcagacttgtgcgatgccgcgggggtgccccagtcggctccggcaagatacgcccaggagatgttcgggtgtacagacaccgcacgactgacttgcggtcctctcgggaaacaagttgagggttgttgaacggtttttacgagtggaaaaacgcaaaatctgccggggaaagaatcgtagaggataggcgaacttaagggcggccgaacgaggaagcctgcgtggaaggcttggccaggggcaagacttcttttcgtgaaaaaaccgagtgca

SEQ ID NO: 573 - DNA, 1947 bp, Toxoplasma gondii
ctcatgaagtacttgtccctgctcctgtcgttaggccttcgaagagcctacaatgatattggcggctcacctttttgtacaccgagactcggaagggggctgctcgatgctgccatgccgacgacgctctctcccaaccctcttcatcggcgttgtgctgcgaacgatgcgatgtagttgagacaatcttacgattcgtagggaagtttgcgttgtacattccggcttgtcttctgttcgcacgttcgattccacttcgagtctttacagcgtcctcaaattcccggctggctatttcatcgtttgacagggaccgcttgtcacgttcttttgaatactgaactgtggaatctctctgaagagtattcaagtcacgagaagatccacataccaatctctgtcctgctgaccccgattcttcctcacagccgcagctgctgtgctgtacggagcaactgctcgctggatctggcgcttcatcgccgaaaaggcagacatcgaggcagtggcaatcatttgaaggagttagccgttcctttttccagagcgacgaaggaagacgattaatgctagattggctactcgaaccggagatcgacacacgagcagaggtgggacgtagaagtctggaaaaggcagaactaagcgagcccctttggcatgccgatagagacactgaaggcggaaacaaagctgagatgcagttcggtggtctcggtacggagctgccgccactgctcaacaacagcagtgccatcccagcaactgacgtaaagacaaacgaccgcggtgtttgacggagcatggttccacgtgaacagcacatcagagccaagcgagtcggcatacgtaggaacgaatctgcaacagacacttgcctaaggatggggaggcgaaaagcagtgacaagcgatcgctttacgcgcgtgacagggtggctgctgattaccgcgacgcccccgaagccacacctgcttcgcgcacacgcccatgaaaccagagacaacgaggcgggaagttcacgcgaagcctcacgaaccagcacaaaaaatgaaatacgtctgcaaaaacaaaagccaacttctcgggtcttcgtaataactactttcatcaatacagaaagactgtatgtaaaacacagctataccagccatgatggaccgcagagcgacccacacgaccggttctcagcacttttcatacgtgaaaaataatctcttggcctactttcgcagaaatgtgcaccacgagggaaatcagagtcaagatgagcatcaaacaggagtgaagtgtgcagcgtgcatgttatttgccctgcatgcgcgatggctctcatcttcgaaactgcatgcttccgattagcatggcacatcgtccacaacggagaggaaagtacagaaaccaaagaatgaaagctctgttttgttgcatttattctcagaggcatttccgcttccaaggaggtgagctccggacacgctgtaggctaccctgcggcagcaggctcgtggtcacagcaacagcagagtccagctatttgccaagagctgaatacagtttcgttttctcgtacagaacgatatggtgaatccaaacagatctctcgcacgcgactccgtatttcgcaaacgtgaacagaggccgagggcgctcaaaaccgacgaactgccgaatattttgttgatccacccggggccacgaagaccctgaatgccaggcaagtccgcgagtctcgcgagactgttgccacgtcttggcgttttggtaatgtctctctttgtgcatcattctaaactgtcggcatcactacctgaaagtccacaaacacagcaacccggctctgggcgcccttctgatgaagtcaccatgggacaattgcgttaccggacgaggaaaacttccctggaagcacagtacatgcgaactggtggctctttctttatataa

SEQ ID NO: 574 - DNA, 4739 bp, Toxoplasma gondii
cgaacagattttgtttttgcttaccggcaatacgtgttggttttctcctagctacattagaaaacagcaaatgagacgtgtaccgcagctcccctccgttgtgaagcatggggcatgagatacacgcacagaaaactttaccaaccttccaaattctgtcggcacgatgtagtttgtcataatgaccggtgaagcatccgaaaaaacagtctggcttggaacatcttttcgtgttgacattttccgctcagtgtcttttctccgctgttgagagggcaattgtgcctcaactgaatatcgtgacggcggggtccattcttgaggcagcagagagatgcaaggcactgaacatcacttctgcaggtgcgtcagggtgtgtctgcaaactttcccagtgcattctaccatgtttcccacagttatcgcatttctaccgaattcatttgcaaacatatcgtttctggttttacaccgcaaaccaatcctctcctacgttgctcaggcaccaacaacacaagtgatggtcgtgggcctctttcccttattttttgggtgtttttagcttcttccagaatgcgttttcagacgtcttcagtcaaagtagtcgaaagtgcttttgtgaatatagatgcatttatcggtctcaagcctgcatttatcttctgtatgcagtgcctgccttgagaaatgcacttcctttgcttttcaggacaaagatgcatacctaccggtacaatcgcacccagttgtccgcgtaatcatttgcatgcgtactgtaccacctacatggacacccaattttgcgtatacttgattgccttcataaaatgtaattagcaatgaaaactagatagcgaaacgcgaggtgaaccctgtaatgtgacatgccttagccttctccggttttctgttttcagcgcgacgagtcatgggcttggtggagtctcccgcatccgttcgccaggtgggtttgtgccatcggccggaggagattcaagaggaaactcacgtgtctcatggtgactcctcagcttccatacctgatgttgttttcaaaagacaagacacggattctgcggctagcagccactgtcttccggacggagtcagtgccggcggctgcccgtctcccgtggtgtcgcactagaagactaactgtacagtgtgttcctattgtctacgataaaacgaggcttcctatctgagtttggtgagatacgtgtgacctgaaaatgtggctgttcccaaggccacgcggaagccgtgacatgcgtgtacagcgctacagactcgactgtaatttccattcgacacataccaacagtagtgtaaaaccacccatattttccctttaacgtaacgaatacttttgacggagagatgggtgtctttgctcaatctatcagcgggcgttcgcgaggcgaacgtgtaaaggtgtggttcgagtgttttatgggaccatttgcccagagtttcgacctgcgggaccccttaacgtccaactaacgggtttactttcctgtttcgttcatgtagcatgtatgaattgcttacatacatgtatatcccaccggaattttcttatctcaagattatccacgttgcaaagagctgccgatattccattcgagcacttccttgaaacatttaaaacagtcctgtaaaggatcatgtatgaggaaggaaacgatcgagcgacaggtcgctccccaatgtcaccaaacgggacaaagtcaggatgacgaccgttgactgcctctgagtctttgaaaacggttgtcctcgttagccgtaaggtaatgtcaaacgctgttacgagggatcccactttagaaatactacttatattaaatagtatccaggagcataaggagatgctggcatgcggcgaaacttcacaaaatgcaccacggaggcccgtcgtcgacaaaagagacaactggcggcagcatcatacctgacgggtacacagaaccgtcaaatttgccattccctttgcaaataattgcaataattgttttcttccgcattttagccagacggttctacgacacgaagctgagtcctgcagggaaacaaatttgcagacaccctcccgtattctcagcctgatgtgaaaacaccatgtgatccctgcaagctagggttgccgacttcgactggctaatatcaaatatactatttctaagactgccacgtaactcgctgttcgtccacaacttagtacgtgttcttccacttcttcaggtcattacacgctctttatatgtcggttccgtgagggaaacgtgcacttaaccaactcggcggcgagcgtacatacaccacaggagttggatatgcagcaaaaacttctgttgctcgcataggcgcgagtcacagcatcgggattcgtaacctgaaacgcaccgtaggcttgacagttacgacgaccaactgtcccttttcaagtcttggttgttctttctttgccttttctcaccaaaagacacaacttgccacggtacaaaagtgtgcgccattctgtcagtagatcacaagaggcggatacgatcttcaacacagaaaagccaactatcagatgccagctgcctcgaatggagaggtttctgccagcatcctccctcgcagcgttatccgaggtgataaaccatacccgtcttccggtggatctacagaaagtctcaagccgctggcattggaatcgccggactaccacttccacatttttcgtacatacctcgtcccgcgacccgcatgaaaccgtccgacctcagctacacaaccgtgacgctccacgaaatccactcgcgactcgctcttccgccttctccggcagtttctgtgcctgcgtacttcctgccgccttctctctccacacaactccaccgtccaaactgacaccgctccccgcctcaaaaatccgcagcttcctccgtcctctatgtccatatttaaccaactatttccctcctctggtaccacgctttacatcggttccctgacactgacgccgatggtttcgaggcgttgcatcaagtctcggccgttgggcatgcggccactgtcgagagtggaccacagcaagttttctccgatgaaaatttcgaacgcgttgttcggaatcaagacagaccggacgacctgcacgccaaagaaggccgtcacgatcgccgccacgcggttgttctccagcgcctcagcccacggcgggagctgctctgtctgtgcacctctttcttcgcctctctgctgagtcaaaccgagagtagaacatatcggccgcacaaagacaacgagggcgagtgccgcccaactcagggcgtccagcagccgtcccagagcctggtgaaacagcgatggcttgtactcgacggcaacgaaacggaagccaggcaggtgacttagctggaagctgaggaactccgcgagctgcctcaacgctcccgccgaagatcaggacgtgcagagttggaccgtcacttggtgtggactgatgccagtgggcagagggttgtgtggcgtgaagaaccggtcaaccaaagtcgagggagcgctctgcatcggtgcgtgattccccgacagaaacagcccatcgagcaccgtccccagaggcagcgacagcagcagaaccaccgctgcgacgacccacgtcgaagacgaagacggtaatggggaagaagtaccgggagaaactgtcgaggcgcctccccctccagagggggcggcgccctcagaaggcaccatggtgtctgcgggaaggtccacagctgagtgagaagtgcgtcttttgaggactgtgaaggcaagaattcagaagggtaaaaatgaaaaacgacgaaatcctgagaactctcgggagaaacctcctcacagctgttgtcgcaaccgccggaggaagcccttttgacatcatttacacaagcagcctacgcatgcaccagccgtctcgcttcgcttttcgaaaaaaaaccctgaaaaacgactctcgtccgcggtttcaaccgttcccgtttatctttctctcattcaaatcatctttcgagtcttctctagggttgtgaggggcgccttcgaggagtgttgacagcctttccgttttgtcctctctctccctgaaaagaaggtttgcctgcgagacaaaggacctccctctagctggctgctctgcccagcgacttcaggtggaaagagtgtgtacacgtgcgttgccggcgttctgtttgtcgctttccccaatctcctgctcctctgactctacacatacacagagaattgcgtttctgcacactgatcactgaagtgcacaggtatcgatgtaagtaaagcctgtccgtggtgtcaatgtagcgatgtgcacacacgcctgtacaccagacagcacgtatgtggatatttctctttcgcgactcgtcttcgagttttctcgaagaggagattctgactggatcagtaaaataggaagcgaccgggaaaaaagtatgaaaatgagttgagataccacacctcaccggccttgccgcgtgggtcctctgctgccctctcgtgccttcctcatccctcgccttccccttcttctctttctcctctcttagtcgttgctattcgcctgtttctcctctcgctctctggcacaatgacacatgtctctgcgtgggaatcataatcccgaccctctccctcgcttctctctctgtcgcttcctttcttctttctccgggtgtctcttcacctcaaga

SEQ ID NO: 575 - DNA, 1918 bp, Toxoplasma gondii
acgcagacgacagacggacgacgagagagtgattgtcgtgcgtttttccccgttcaggcaatatttcatgcgaatcgtggagtggtttagttgcgtcagaggatcttgtggctgtggtcgaggcggataggcattgctaccatgtttctgtgaagagaattattgttaattttccgcgtcagttgggctcacgtgcgtgcatgtgtgtgctttggcgcgaaagcttctttccgaggccggtacgagcaactgggttttacgtggtacactctattcccgcttattcataaaccctggttctttattaggttattgtcgaaggcttgttggccaagtgctgaggtcagcactgaattctccttaaaacgctgtttgtgaaacaatggacagttgaactgccgttagtgccggatcttgctgtagattcattttaaagccaaactttcacggaagatgccgtatcggataacacacgcagatgcctgacgtattactgtcctgctctccaggaattgtaaatgttcaaagatgttcgcacactttcgcttaagtagatcgtaacgcacagatgtacatacacagagagaatactcttcgcactggcgaaactttctgcgaagcagaacacatgcctcactagggccacataagatgtttcgcacacgtgttcgtcaatgcatatatcgcgaggcaagcagacatattttcaagtgttgaaactgacaggtcaagcgaaaaaaaccgtaaaaagataaattatgcccatctctgcatctaagttgatacttggttatatgttagacgcaaacttcccccctaatgccgtagttattgaacaggcgtgggataacaaaagtgatacgcgtgctttaaggtagttttcctgccactgtcttattcgaggaaagtatgtcacacggccgtgtcccttcgaactcttgtaacttggtgaaagtcgcagattcctgggcggtgttgcctcgaagtcagaacaaacccagactaaactaacacgaagtaccgtgatcaatcgttccaactaagcagcctgcaagtcggtgtacgaggcagaggtttcttgttgtcagtgtgaagtctccggcgatctcacttcatagggcgctcggtacgaggtggccccacgagaccgcgcgaatcgtttatgctgaatttcgaaataaggcgggaaagtgcggagaaaaagaactatggaacctgtactgaaaaccaccttaagaacgcaaattaaggcaagacagaaattctctggttacacgagagaggtacagtaagcagcgtgacaaatcggtgtgctgtctcgtacatgcccgtgagcggtgacttcgcgaatgcggtttctactcaattctgcggacaccaccttcctcaaatgtctgcatgctgtagatacagtagccgcactcaagtgttgcttgaaactgcgggagtttcttcgattttctgaaggaaacgcaagcgaaaagagcccgcttcttgccacgcttcttgtccatcgtaatactgagggttgcacctgccgtgaatctgcgtagacatttcttcgctgagttgtaagccgtcgctgcacctgcacacacacagcacctgttctgcctttgtgtccttcgctgcactgcatggctccaaatcgacaatgcctacaccgttaacccgacatcaatgtggcaagaaaaaaaccgatggatctttcagacttagctttcccacgtaggtctcttaccgctttctgtccatccgcctgaggctcaaagccctgttttctcctggagaggcgaaaccctttccgacccgacacactgggtactggtggaagtaaatgtgtggtgtagacaccatttctacggcttctctgcaacgttctgatcttttggactttacacccgttttgcagcaaaaa

SEQ ID NO: 576 - DNA, 3078 bp, Toxoplasma gondii
gaaggatagagagaagacataaaaccgtggaagggaggagaactttgatggtttcggcaagggatcattccgaggggaaggaagcgacttgtttgccccgagagccgtctttgccgcggcaaatcaggactctttgttctgtctctttggcacgaattcctttttttttctctcgacaccactgcctcttcttcctgctcaaagcaacagagagaggagactgtgataagcacagcatcctccgtctctggaggcaatgcactctcctccattctcacagttcagccgtgaatgtcagctggtgtagttgacatccgattggacattccgtctgcgcagccgccacagctttgatcgctccagcctcttaaaatcgtccaacttctctcttttctgaggctcgctctctttcagtccgtttctgcttgacgccacacagcaagagagggtctttctcaggcttgacgttccctgtttctctccttctcgcgacctccgcggagccttctctcccgactcgcggttttcttactgaggaaatcagagaagccgacgacagcagtgacggcggagaaggacagggggaagaggagagccagcgacgaaaagaaagacagagcagaaaggacagagaaagccggacgagagacagagcaggagaggagagggcagagcagttacgaaaaagacgaaagacaccgagcgaggggaaaaatcaccccactgaactgccgaaaagaactgaaagcgcttcgtataaattgcattcagtttatgtccacatcgtctacgtcccagacgtgaaactacgggcagttgagagaggacaaggaaacacaggggagacgattaacgattaacaggttgcaaagaaagagtgagcgcaactccgaagctgtccggtcgtcccaagaaagaaaattcgcctgagaaaatggaaccttcgcgggtcctctgccacccagccttcggcagaaaagaggaaatcgaccgactccgagactcttaaaaggattacaagaggtttaaaaggcgaatcgcgccatgctttttcctcgcttggacactggggttgacgcaaacggcattcacaatcacaaaagaagactttgttccttgtgaaaagagaaggcgacgatccttgtgcttttctcagcataagactgtgactttgatcgcgctctgcatgtgcccaggttggtctgccgtcggaatccggcaaccaaatgtccgtaaattcggggtcttcctggccgtcgcaaaagaccttttttcgttttttcccttcgacgcaacgcgttgagctggagcctccgtctccctctttgcttcacagtctccagaatgtctccagcctctctctcgtttccctgtggctgctgccaggcgacccccagaaaaagtgacttgcagccttcgctgcacccgccgtgctcttcccgttcttgactctcgcccactgtcgcacctggcgaaacagggatttccacgtcgccagcagcgcctcaatcgtccttgaactcctcgaaggacttattcatcgtggtggaagcatcctcagcaggggcgctacggggctgaaactgtttaaagtgacttcgcgagtcgcggacttccaccgcccggggggtcacgagctgagcagctggcgactctttcaccgcggaggcgtggaggagggaggcagggtcttcgttgaaaaaagctccgaaaacgggcatcaacgaactcagcaagaaaggatggagcgttctatactatcagagacgattttgacgcacacagagagacacaaaacagagtttagggacaggtgagggctgccgccgcgttggagcaacacccggttcccggggagctctgagagacacgactagcgagggagacaggagaagcctgtgcctgctgctggggtaggaaacacagacggtgcagacgaggaactccaggaacgaaaacgcctttcacaaaaggaactagcggaacttttgctttctccattctctcgccttttttctgcggcaactcctcgacagcaatggtcaccgattcccgggggtgcgctccggtgtcgtcacacagcagccagatcgagagttgatctttgatttgtggtgtgcgtctttggctcttctgtccattgaaagacagatttaactttgtcgaaaatctcccctggatgttacctcccttttaccgtcctccccgttcgccctccgatctcgctgccgttgacctccgcgcacacaacaccgtccctccccaccgcgggccagggctgcagacccatcgcaggcagactttttttcactttttcattttcctcagcgttctgtctcgcctttgtcgcttccgctgagttagctgcccacgaaagacggtctggagtttcgacgccgcttccctgtgctcgctcctctgcgggatgctctgaaacggccgttgacgcccgacggcaagagctgactctgatttcgaccgaaaaagcgcagtccaggacaagctggcctgggtcgcaatcagctggctgtccaacttctccgggtgagctgaagaaagcctcttctctcccgacagacgcggccttttcctgggcgtcgtcgccgagggacgccggggcgagagcgagaccgcacggcgagggactcgaagacaggaggagcgcgcggaaaagtttcatcagatgcgaggagaaaggcgcctttttcatgaggaaggagcgagcgcgtagggtgtgatcatcagggaggcctgttctgtccagtgttgagtgggcgcggcggcggagacgccgcggaagagcaccgaagtttcctgtcagagttcagaggcactcttcttttgcttcttcagaagggggtttgcttttttggcaggaggcgcttcgatttcttccgtttcctcctggacgcagaggagaggaggaggctcgaatttgcgccggaaacgaaacggctcgtggagaagaacgacgccaggacgcgaagaagtaacggtggaaccgcctggtagagaagaagagctcacgaggaagctacacgagagaagaaagcagacgccagtggagatcaggaaaga

SEQ ID NO: 577 - DNA, 1674 bp, Toxoplasma gondii
tcaagacgcttgataggactgcctcaagttcctgatacatgtctattatacatgtgtacacatatatatatatatatatatatatatatatacatatatgtatatatatacatatatatatctaggtatatatggatttatgattaatgagtatcgtacatatagacgcacataaaatatgtatattcatacatatctatgtatagatctatatctctatatatgtatatgtatacgtacatatgtatctacaaataagaagcctgtgaatgtatatacatcaaagtggacaagactgtttaccagtaggtaggttgtttgaacatttgaacaagagttagttttgtctcccttgtcaagttcgattgagaggtcaagaaaagggatgcttttttacagccagcgtgcccctctctctccggttaccagagtcggcaggcgggaacgcgagatctctctcgatccgttctcgcgagctcttcctttgttgtgactctgagatttcagcagaggaagaattcttgcctcgctctccttgcctgccctctctgctgtcttctaacctcgctgtctaccttgtcgcctttccagcaggcggcggagacgcggtggagagaaaaagacaagatgcgaaggcctttcgcctttctctgctcgctcctgcgcttttgaactcgcggcagcagaacatctggggtgtatgtacaccgctcgcgcctgcgtgtattattttttcggcgcttcttcccgcaaagctcgcggcgcccagcgcagcttcgactctcgcgccacagtttctgttgcatgcagagattttcgtggactcttcaacgtgcgctttgcggagaaacaattgcacctgtttctgcttttcttttttgcgtttctctccttctccccactgcttcttcgctgcccctccccggcatctcgctacggtttcttcgactctgcgtgtctgaaaagcgcttctcggttccaaagaggcgaccgtcggctttctcgttctttgaaaacctctgtttctcgatttctctggttctgcacttggaaagacatttcttctttctgttccgttgtgcgtccagtttcaagacaagccgaagactttcttttctctcgcctccccagtctcgtctttgttgcctctctctccctcttcttcccctttcttcagttctccgtttatattcccctgcgcctgtgccgttctctcgtaattacctcccctttgtcttttcctcgcgttctttcttcttcttcgtgtgccttcgttgtcgtctctctcgccgcgtcagtaaaacggttcttccggtttcctcgcttcgccgtttccctcgagaacgacacagagtgaagagccagttcgtcgatctacgggtgtggcgtaccctctgtctctccgtcgctttccccttgtttctggtcttctcgccttcgctgctgtttcgagttctcggtttctcgctttcctctctctttcgcagcctctccattttccaatttctctctctcctgcaaccgccaaggcggcagtctttcgcgctctgtcgaggccagaggagcccacatatgagggcagtctagaacgaggccaacagggactgcacgacaaatcccgcgacggaagaacaaaaaacaaaggacaagaagcatttcgcgacaagagcaaga

SEQ ID NO: 578 - DNA, 3319 bp, Toxoplasma gondii
taagcatagatacgcgcatacacacatgaacagggtacagagacagagggatcgacgcattagacacgcaaatatacataaatatatatatatatatgtatatatatatatgtatatatatgtatatattttagcatatgtggtgtaaagcgagtttttttgggtgtacgtacagtcggtagggtgcctggtttcggtccttcgcagcaaggacaagtcaagtctgtgggggcgttgacgacgaggcaaatagggcatctccattcgacctctggcggcgacccggttgtcgttttttcttccttctccccactttctttctctttttccttctcgttcagctcttttttttctccttcttcttcatttcctctgggcttcaatggatcttcttcctcagccagctgcggcgctccgcgacttgagtccccagacgcgggtgtatagacactcggagcttctggcgcgatgccctgggcgagcggacatgcatggccttcgcctccagtttcggctggccctgagagcgcgagtcgctcgacggatgcgtttgcgtccattgtcggcgtcgtcgtttctgcagctcgtcgggagaggaagagcagcgaagcagcgagggaagacccaaacgaacggcggacacagagaactgccggcgaccagacctacggaggagcgtgagaaagcgagagcaagcgagcaagactgcgggaagatgttgaacatgagaactggagagaagccgagaaaaacttgagaggagcgcgaatcggagagacgaagagccggaaacagtgcagcttctgacaagaattcgcgcgttcgttcttccttacaaaggacaagtctgtcgcttctccaggacgatgcagctgcgaggtcgtgatcgtctccagcggctggggtgtacagacgacggaggagagggtgctttttgaaggcttggaacaggaaggaaggccgcttttctcgggagaagcgcgggacttttctctcgcagaacagcgcgtcggcgctgaccattccccaacgcttcttctcgtgtcaaccgatccgtctggaacttccccagacaaaaagactgctttgtcgactttccggaaacgccccggccagccgcaccgagccgagagagagtgggaaggagtggaggaaagcaactggacgcaagaaggaatggaaggcggaaaaacggagcagaacgcgaatgggaggacatgaacgggagaaaaagcagagaaacggaaagaaacgcagagaaatagaaagaaacgcagagacagccgaggagaaagagcgaagcatgcgcgcccctgaggtcctctccagcgacaagtcggcagacacacgagaagcgaagccgcgggaggagactttggacatgtttcttcgattcaaacggggtgctgtggctgccgagcgacaggagaaaaacaagaaatagtcggagagtgaggtcagttctcaatccttcgaaaagcgaggaaagcgagggaggggaacggcaagacccatcgcgccgcagagaaaagcctcccttctctcccaggtgctgctcgctgctggaggccggcgaacagtccgttctcagcaggtcggaaactctggaaaacgaagaggcgaaccttccacctcgaacgttcgaagcgcgcagcaagcaattccgagaagcgtcggaacctgccctgcagcaggaaacgcggagaacgtcctctctggttccctcctgcggaaaggctcgaaagaagacgcagaaaacgccgcgggggagggatgagagagaggcggcggctcaagcgacgacacccgcggagcggagctggaaactctgctgctcgcgcgagaagtaccccccaaagtgcagtttcggtgctttatctgaccgcctgactacgcgttggccgacgagaacagagaacccgctccaagattgctgcgaaaaagcgctgtagtcgacatacgaaaacgcgagaaaccggacgagcgcaaaaaccgcaggcggccgcgctgtctggacgcacaccgcctcccgagggtctcgcagtcacttttgcttccggttcctccggtgcagccaggctcggacgttcgcagtgaagcgagccaggcgggagaggcgcgcacaggcgagctgaactgtgtcgtagaaaacgcattttcccgtcgaggcgtccgttttcatggaaaagggacaaaaacgcagcgaatctgaaccgccagccaactgccggttgactgcgctgcggagagcggcggagcgcagctgtacatatatgtgtgtgtgtgtctcgcttgaaactcgacgttttttctctcgcgggcagaggacttccgcaaagtccaaagcctccacgtcgacagatctccggcgaagaaaatgtgaaggacgcgtcgcgttcgacacacaccgatcccaaaaaccggcgccctcaaccagctccggcctgtgtgtatgtatctatacgcatgcaggaaggagaaacggccgccccattctcgcctcagcctgtcagtccatgctttctgcttccgccttagatcgaaaaccgtctctctcaatgtccgagaaccgccgcagaaatcagtctcacccagctgtgcaactgcagaaccggcgaggtgtaggtccaccggcgctgcagcaccgtcaggctcggagtggcggtcccctccgcaaattcttttttttgctgacagaaaacgagccgtttcatgttcgtttcgtccatgtattgcagaaagtaagaggactcaaaactaatcaaggttcctcgttctatcgggatcgcacagcgccgcgctgtgtctcgtcgtcttgggcgttcctgcgccggtctgtcgcctcgagagagtttcaggcgtccgcctcttttcgagtttctttcctttttttctcctcacttgccctggtttctcttcctccttcagtctttctgcttctcaagatcctcgggtgcagcttttcgcggctctctcctccagaaccgcgcatcatctcgttgttcctgttctcctcgatccctgaaacgtcggttgttcctgttctcctcgatccctgaaacgtcggttgttcctgttctcctcgatccctgaaacgtcggttgttcctgttctcctcgatccctgaaacgtcggatttccatcctttctcgtctatctctgtcattagtcttgcaccttcctctctcctctcgtgatccttcgttctctctgcatctttgtgagagtcgtcttctctcgccgtggagaagcgaactgttctgcagtcttctcgcacaagcgttcctgtcgtccctcgcgtcctcgccgacttccaaca

SEQ ID NO: 579 - DNA, 1278 bp, Toxoplasma gondii
gctactgttgactaaaccagactgtgccatggagcatccaattcgagagctgttcgtacactctacaaccgcagcccatctgacggaacagtggccgtttagtcggtgcataaagcaccgctgacgaagaacggtattgaccaaaactttgatcacaatgaagtcggttttgattttccctctctctctgtgggttgtcggcgcccttgcacacgctgccattcctttgaatatcggggaaccttgctcgcgaggtcatcgaggaatcttgttccgtgtcactgacccaacagattttgctcaaggatgccaagtcactgcagttttgaaaaaagactgccttcagctttttaggtgggtcatttgattcctgtaccttggttgtgaactattcactgaatttctcgcagaggcaacaaggaaacagcacggatcgctctcggtaggaaccgattccaactgaaggcagtcgtcagcatttgttcacgaatcctcttcggtcagacgccatcgagactccggtacacattgtgccatatcataagacttgtctgtcaatcaaacccgcgtcaagggatgccgagatcctgtggtaacgtgtgcctccttggatactttttcatattaggcgtagctattcttattttcagctgtgacaacgagaactgcagagacgcatgggtaaggctattcaccaaataaggaaaaggcatcgtcattaggagcgtttgcttcagtggatggctctgtctgaacaaatcctctgcctgcacaaaggtgccatgcggaacgaagtgtccggtgaaccaaccgttgaggaagaggagcgtgaagtaggtggtcttacttgatgcttcttcgtagcatgtggatgcagctcatgcttgctgcaacaggtcctagaacaagtcgttgagaaaccatcggagggtggtgttaccattcacgttgagaaggtacgccgccctgtcttgcatgttgcatgtgggtttgcatgtgaattattttgattctagagtcccgagggcgtcgaaccggttttaaccgtgcaccccagtttcaagcagagcgatgttcacccgcattaaaagtgtcggaatagcgacggcgaattttgtgaacctgcagaaaatgtttgttggtggttccccagtgaagtttcgtttcgatgcacagcggcatgcgcatgctctgacaactggccagctgtggccttttgtctgaaaacccttcgtgccccctttcctagaaaaaatgtcaattcactagtcatactaa

SEQ ID NO: 580 - DNA, 1973 bp, Toxoplasma gondii
gggtaaaacaggtgtactccctctctctgactactgtcgctcttctccttccctcttgttcactcttgtctttttctctctgctcctgccctcttttccttttttctctctcgtattttctccactcttctacttctgttcttctccacagaaaacgacggggaagccgcccgtcaggcgtcctgttgcgcagctaacccacctgggagtctgtgttggactccgacttctccaaactgctttcgtctctattatctacgcaacgtgtaaggctgtgagtatcagcttcgtgaagacgtggattcggatccttgactctttctctcttttcgtgacgtccaggagagatatttgcaaacgaggacatctctgttctgctgaggtttctccactgagaacagaaagttcatctcttcacacggaactcaacgagagtctagcgcttcgtcagaggcctcagaatttccctcacaacacagacacggcgaggtgcgtcagtcccctgcctcaacaaagaaaaagacagagaagaagacgctgacgcaaggagcacaggcctgcgctcacgaagactggaagcagacttggaagagtgatgaataccggagactttgggggtgtcactgtgtaagtgtacagagtgcttagtgcatcaagttctcctgcgcgcttgactttcctctggaaatctaaacgagaaacgcttccctgttaagttccgagctcccaaagttcgttcgtctgcgaagacgtcgacaaagtaaacgtcctcatgcagtggctacgattgcttgagcgaccagtcaaaggggaactgtgaaatgctgcagagcatcgagatcgcgaccgccatccacgtacgattcacaaagactcaatagcgagcgtactggccttcgcactgcagccgttaacgatgttcgtctcgtggaagctcttggtgttttctactactccctatacagacttcgacaaggcttttttttgcggagttcttcgagccatgcactgagggcgaggaatgtccgcggcaggagaacgcaagacgtcgagaccaccctcgttggaaaaggaaaagcctcagaaatacaggggcagagacgaaaaaatccaatcaattttgctgtgtacacgcaccgcatgttcgcgggcgggcgttgcaccgcgcttcgtagacgggagaaaagtcgcatgcctcgtctttctcaaaaagtcgtcgttttctctgcctgtctcgaagttcgcttctttcctgcagctttcttcaggctttctctggagtcctaggtccaccgggtattgtgcgacagccggcgacgaaggcgaaagaagcgcggagactcaggccggtagaagaggagacatgcgttttcttccggcagcgggaaagtgaagaagcttttctttctcttgctttgacagacgaggagccgctttcctgcgcttcgaagttgctgctcggccgcgcattattcagatgccgacttcctgttggaataaaccggtcgtactttgaaaggcgattcttcgctgctgcgcggaatcgggcaactctctctcgtctcctcgcattcttgaccgctcttttctcagaaagtatcaaacggacgctatactcaccctgtcggtgtcgtttcttcgtcaacggcggcggcttcgtttctccttctccccagtttcttctctttccggctcatctctttcgacgcaaccgcgtctgcttctctctccgcctctctcgttgctgacgccttccacccgcaaagaaacaggcgcagtcttctcctttgcctcctcctatgcgagcaggcgcgtcttgcccttgcagctcctccgtttctcatccgacctcgatctttctccctcttcctcttctccagatccttgcttcctctcctctgtctccttcccccctctatcccttttcctttctgccttcttcttgcttttcttctgccgctttcgctccgaga

SEQ ID NO: 581 - DNA, 1833 bp, Toxoplasma gondii
gaaacatgcggttctgatgctgtaaaacagttccacgacaatggcgaactgctgcaggtttgacacgcacagctaccatgtgtaatgaagtatgcatatgctggattctcagcaagcgggatgtgcgcatgaatcgttatattatcgttccatctcggttgtgcttttttgccgcatgtctgtttcaccgctaagacttcctcgagtctttcgagccaacacacgtgtcagggtcagtcagcttcatcccgagtcgttgagggaggtcgtgtttctcaaaagcagagcggtcgaattctgtgctctccgtcagacttctcatggagtttaccagggccacgtttcttctgggagagtatcatctccgcacaaacggcatacaaaaaagttaatttttcttcttgttgagcggacactgtaattcaagcagcgacacacaggcggctctcctttgctgttttgttctgcggtctgtggagaagacttactctttcagacacttccacgagcggaaatgttgggcacactcagagtcttaccgcggagcagaactgccccacacttttgtttaagagagctcatgaaaagggccgcggttaagagcacagaaaacagcacaaacccctcgatagctttaggtactacgtgtcacacgcctgactcctggaagaggagaataacgctccaagatcggggttctctccaccccaaacagtgttggtttcggtgagcagacatttctcgggaaccgcacatggccggagaaaggaagcgagcatatgccaattgcgaggattatgacgtgggcagcctaaaacactagagaggagccggaggcaacaatttgttccactctgttgccgatgaatgactcagcttgttttctgcagtactgcgttaagaaatatgtacacatgtgtgagttgggtaacacatgctgctgcttcacctctttatttgcatccgattacgctgaaacatccccagggtctcgagcctcgttccacgagttgtcgcgagacctgcttctgatgcaaagggggaggcgtaccatttgtctggccgccgctttctcgcgattctgctgatctgcccgtcgtttcggaaaatggccatctcctgcgcgagaaacaggcttatacgtttgatacatcacacgtgattaacgaagtgggttctgtgttcttctgtctcgccgctggggcacagagacagagagacaatgcagagaaacaccccgctccgccggtgttgcgtaaaaacattgttttcctttctacacgttttgcgcagaaaaagaggaagttgggtggaaaacagtcgggggaaagaacgtttttccccgtgggaccgttccttaaggttttcgtggggacacgggagcgtttgaatctgcatgtcgtcagcaacaggtgtgcgctcgggggcagacaaaatgaccttgagttcttcctttcttcccaccacgacggcatataaacagtcgagcagcttttgactacgttcgtgctcgccgactctgccccggtgtgacttttttcctcccgttttttttcgcgtccaagttgcttcccaagacagacaggcatgccttcttgtcaagaggaagcggaccgcgtggaaatttcctttcctaattttctgcgacttattcccaaataatccttgtctcgctcgacaccgcggggggggacgttttgcgtgggggctctccatctgctctttcctggttctcttttcgtgaaaaaggttttttctgcggctggttttcttcgctttgcctgcgccgctggcatttctcgaaacagacaaaggaaccaggcatcgtcgcca

SEQ ID NO: 582 - DNA, 1858 bp, Toxoplasma gondii
cttctctgtgctgttcgtccttctcgtttccactctcttccctcttcgcttgtccctcctctctctccgctctttctttagtctgttgtctcgcctgaaacttctcgcggtcctcttctccaccttgatcctcatcatcatcttcatcatcttcttctgctgctgcaaaggggaagctttcagagagaggaggacgaggatttttctttccagagagaaggggagagggacgcaggcgaaaggagaccgcagacgcagtcgaggcagaaactgaaggagaggaagagaggcttggcggatctgccatcgttccagcgagaagagagaaacagaagagaagcgagaggaagaaaagcccaggagaacagaggagagaaggagctcaaggacagcggacaagaagaaggaagctggtgaacagaaaaggcgggcagtgtcggagagaacggggagaaagaacgcgagacacggagaggggaggcaagaagttggtgacagacgactagaagaggacggagagataccgagagggagacgaagagacacaggaaacacaacggacaatatctacatgagtaattcgcaggagagatggtctcctgagacaagctcatgaacaacgagaagactgtttctagaaagtaaattcagaagcggcgagatggaagccgcgacagcggccaaagtattgggccgagagaaccttccagaaaggccttcagcgaccgcggggaggaaggcggtcttcgctggccaagaagacgacttttcgaagaatggtctggcagagaagacgaattcctcgaaaaaaatcctttgtcgcgcggcctcactgaaaaaagaagacctgccttcgctggttgcatgctcgattttcactgcccgcgacaaagggtgtctgacctcccgagaaagggagccgcagccatgtccttttgtgccttttcctagaaaaaagagatctgttctccattcaatactccattcaacagacagagaaacgaagagaaggaggaagaaaggcgagaggggaagacgaggctttcaccgtgctcagctgtctcgataccccgaggggggggggtcacttcatgctctctctggatttgacttttttctggatgaatcgacgtctctccgtcctcgacgcggccggaaaaagagttttttttctaaaaacctgtttcgactccccttgtcttcttcttctccaactcttctcctcctggaacatttcagtttttccgatttttccgcgaaaacgtcgtctctctgtcgtggagtccatcctcgcagagtcgcgccttctgtgcagaaggagactcacccgcgattgcacaggctataaacgtaacacaacttcatcttcttggaggaacgtctcaggaaaacctttcagaaaaacgcgacggaaacgacattcccccgaaaaaaaaactggagaaggactctccacggccctcgctcgctgcagctcccgcggcacttgagagtcgctgcaggcgcggttcgcgaaaacggaacaaaagacgctcggagaaagtttctgaagccgactgtggcgcgcatctctccatgcttgtatacatgcgtcgtctcgacttgttcatgcattttgcatgtgtaagtacgtacgtttatgcatcttcatacgtcgaaagtccacaaatacatgtacgtttgcttgtttctctacatagcgatgtatatttttatttgtacggatgtcgatctgtagagatcggcacgcgtatgcgtggagggaggatttcctcggactgaggaggcgttgctctccgttctgcatccttttccttcctttttcgcgtctcctcctttctccctgaaccgttcacca

SEQ ID NO: 583 - DNA, 4639 bp, Toxoplasma gondii
aagatgagacagaggcggactcgagcagtgcccatacacacaagttgcctccacagagagtcgttgtggggaaaggtggagacgcccgaaccgagtatagagaccccgttgatctctctgtgctttcccggtttctcgcaggcgagaaggcgccacgagggatggatgacagacgaaacactcagggtattcttcaggattgaaggaggcctcaacctgatgctccaggcgcgcgactctggcggtccccgaaccggaggacattcggcacacagacgttgtctctgacgcagacggggagacgcggagcaagcggcaggcggcggagtcccgctgtttggagtgcgtcgaggaggagtcgacaagactctctgcctcctttctccgtcctttcttctgactcaacagagaagaagacgagacggagagcgggagagcagctccagggcgagacgacgagcgagaagaggagacgacgccactggacgggcggagggaaggcgacgcagaggaatgagactcagtggcagagtagtcgcaggaagacgagatcggagaggtgcatgtgccagacgaagagtcattattttgtcgggaagggaagttgactctcacagtcgccactcgctcggcagtatccgtgtctcgtcttacacacgagtctctgaacgacgacaaatcgtccggatgcgaagcgttttctgtgcgattcggctggtgagagctcccggggaagcttagcaggcgactcctacttgtgccggacacagagaaagaatctctgtccaccctccacgttccccgagaaaccgacgctgaggagctgtctcgtgatccccgacagaaactggagctgtcagagctcgcgctcccgctgctcgacgagtgactgctttggcaccagtcatccctcgctctccgcgacgaggaagactgagacgaaacggaggtactgttcacctgggaagaagagagtcgaccgccggcgacgtgctgctctgaggaggaggacgacgaagctgcggagctcctggctgggctgctctccacgctgcgcgaggacgcagaactcgacatggtggcctcaagaaaaggcgagcaaggaaggcagagaaaaggggacaaagaggcgaagggagtccgttacaaaaacagttgccttggaagaaaacggagaagcggacgccagtctgcactctcctgttggcggcgtccgagttgtctacagtgatcccaactgaggggcggagcctcgccggcttttgaagacgctcgtcagcgagacatcttccgctcctggagtgggcagagagtcagaaaggagagagacgaaatgagaacggttctgcatgcagagagaatgtcgagagggacggaccagaccaagtcgttcgcatctcatccgaagccgttgggtcgttcggtgaagtgctcatacaccgcagggccggtgctgcaccaggcaagtcttcggtcctcaaatctgagagcgcgctaaaacgaaacgctgaacttgcatacatggcattgtagtgttcaagagcaagacatcaagaagccgcacaatttgtatctcgttcgcaaaatttttccgtccggcgaaagacggctcaaagcgactgcggcacacactgcttcgtagcaacacagaagaacttcagtaaaacgaaggcgaaatcgccgcttcccgtttccacaacatagatccaggaccctccttcgaccgctcgccgacgacgatcatgtgaggcgtcgaggaggtgctcggaagcggttgaactgcggggcagcttcgcctgctcagacggcggaaactcgaggaaataacaaacacccgagaggaaaagcaaacagcattctgttaaggcagcaagaaatacaggagccacaagacgcgcgcacctgctgcgccttgaggggtacatggcagcggctggccgctggtcacactgctgccgcgaaaccaagacggcagaagcgtcaaactggaggtttatggatttttaaaggccactgcggtctttgcatctacggttaaggcgagttcagcgcgctacgctgtcgagatgaatgagagcatgttgataagaatctcctccggcttccttcttgaatcgccgcatcgatatgagttgtagattcgaaagcgccggaagggcaaaatacggttgagcgaagacgaacgcggccgcccggctctcctccgcgcgagtgcgtagcaagacaaggactccgtagtggtctttagagatttttggaggaacacgaagaccccctccgaggtaagagaagcggaaatcaagcttaaagccgagggttcattcttatttgctgcagacgtgggccatttattgtttcagaccggtgaccaggcaaccgcgggacgctgcacgagacaaaggaagtcctagactgcatttgcgggtggtcgctgggggcgaaacgaggccgagcgcaggaagaaacacacaatttcccgtcggctttccctcgttctgtttcggctttttgagacgaaagtaacgggctacgtagttctaggttcgtaggccaaatcggcggggaacaagacacacaatactctggtttagcgcacagtcgtggaaaactgtacgcttttgcaaagacactgaagaaacgaactcgaacgcggcttcccccacgaaaccgctttcgttcatgttctcgtgcacactgcattctgttcgcgcctgacgagattatttcgccgactagaggccgatggaccggcggttgccgtgtcttcgtttcttacggaggtttccgtcaggaacacacacacgagtagaatcgctgttgaggggcaatgtgcatcaacgctctttgaacagggggggattcctgctctacttcggacgagaaaagaaacggagatgctcttcgcccgttgataaatgtaccagcgacaacgcacagatttcaacggaattaggtttggtatcttcccttggacaagttgtgatctgcgtgtggtcggcagacaaatgcagtgacagcaaatacacgcagacaaaacagcgacacaccctaacaaaacatgtctattgtagatgagcgaccatcgcgctgaccagaatcgcctccgtagcgtcagttggttttctaaggaaaagtgcgcagcgatcagctagcaagaggccttgcaaaatcaaaaagaaagcagagaatgtcaccctcccctcggtagtcttgagtcctaaacgaacttcgcactacgtttctttttcctctgttcacaagcatcaacccagtcatatgcatagcaaggctttcgccgagaaatgaggacggctttgcagattcaacaaacaagctccaacttagatcacacgcctgtttgtggatgacagcttggggggcagatcacctgcaaatcctcctaagaggatgtccggggggtctcaagtaggctacatggagaccatgcagaatgcctagctaagcagtggctgaagcgagtctaataaccaatacctcatgtggacacactcattttcttcggggagcatggtgagacagattcagggtcaataggggacaagagtgcggtggaaacactagacgcagttctcagaaaacgtcgcaacagtcagctgaagagggagcagcagttggcgaggcagcgtgcatcagcctcccggcattcccaactgcaatggcggggcagtggcaaacagtcagtgacagagcaacgtatgccaggggtcaataagaaagtgtctgctgtattcttgccaaatgcccggtgcctttttcctgtttgccttctcgataaatttatcagcgaggccgtaaatggcagagagaggcgaacaggaatgtaaaaacaatcatcgtctgtacaaactagccgattctactgcaggctaacccacaaaggtatactgaggttggaggtcgaccgcgagctgcctgtacctttctttgtgttgagaacgcagcacagtctgtatcccttcaattaagcgctcttttgcgtgcgactgtgcggcaaaaacaaaccccgaatggagtcacacattgacagcgagacaaaagactgacaatgtcagtgttgtcgctggacgacaggcctcgagagagaccatgtttcacgagtgctgcaaccgtgaactctagcataaatcaggagtctgttttgccttaccagcttttcacggagacgccggaactgttgtttccgtagccgtagctgcccatttgcctacaatactttttttcggcttttttcgtccctccttgccgcccgccacatcgggcagtgccctgcagaatccagacagaacagcgcagccaccagaacggaggaaaacaacaggtcgtaccgtagtcccgcgccaatccgttcctctagacggcacagattcagcaagagttaccggcatttccaaagggtcccttcgatatctcttccgtacatgccagttttcgccctgtcggcagtccctccctctttgcggatgcctgacgagacaaattaactcaaaacgttgaacacacctgtatgccaggcagatgcaatatgacgattaggatctaacttcggcatgcatgtgtatctgcagatgtcacgagcctggtatcccagtctctctgccgagtcgaaccgtggcaggca

SEQ ID NO: 584 - DNA, 2311 bp, Toxoplasma gondii
attcgcatatgtatctcgtgcgcttgtcagtcatcatgtgtatgagaggtagaggcgcggaacagtgttcaggtgaagataaaggagtgtatgtgcatttcttgcacccgtctctccctgtccggggtgcgcgtttttaagcatggcccgcgcaatactagactgaaatggatatacgcttgcgtattaacgcaccgtccgtcatcggtgacccacgtgtagacgttaggattgcgcccacacgaacgtgaggaaggatttctgggtttgcgaaggactgcgttgagtgtttttatgttagacgccgcctctcctctgtgtcttttcactttccaggcgtttttcgggagcagaaaattgctgcgggagagcacgtgggatgttgtgctctttcaacttgagaagaaggcgaaaaattacctcaccgacggtcgccatcggttctcagaagtgatccgtttcccgtcgtttctccgcgcatgcccgtcgtctccgtgcggttcgcgatgtgcgttgaccgctgccagcgacggagcttaaaacgccaagcgcatgaagccgagacctatgccgagagacagcggtgaaacgagaaattcaggaagatgcagtggaagaaaagaggcacaggaaacggctgggaacgctgtggcctctctcttaccactggctgtctttttttctgtcatcaacgcaagaggatcggagagatctattgtcctctcttagcagagcagcttcatacggtgtgacatgcagagtcattacgtgtgttttcagagacacgtgaaaggagtgcctgcacatttacgttggagacgagatgggttgctcatcgaaaccatgtaaagcacaaaccactcgaattttacgataactggagggatcttctcccacagtacctcggcacagttttctgtgtcgcagacatgtctacccggggtagataccgggatcgatcatcgcacgcgtgtgagagaagctggtgaacagttaagcagacggacgtttgttcacatctgcaaaggcgcacattctcacggccgcacgggggattcgcaggcgccgcaactgccgaaacgcatttcttctcgctaactatcgcatgcggggaaggtgtgtggcgatattttctcattttccagctgtgaatgctgacttgcttcttgtgagctgcttctttcgtccgtgcaaacagcaaggacagccgttttcgccaagtgtaggaactcgagtctccgatgacaccacactgggcacggggaaaaagaagggtggagacaatacgccgccgatgttgtcaaaaggcgaccaaccgaaacggctgctgatgaacgcactcacactcgcttttgctggctggtttccttggtatttaaacacactggaacgttgtgctgtcttgctgagtcactttacgcaaatgcatacaagttccgacgcgcgaggctaacctgctccgacttattgactccccgatcaagaacgactgaatacacagaggaaatgcctcagcccgaatgtcctacatgcagttcgctgcgtatctgcacggcaatccggaggggaagggggagcagcgggtgtaacgttgtcaccagacagccgcccttcacattggtttcgctgctacgcgttacccgcacaaactgtttaggatagcgtgtctctcccgccaacgcgggatcgtggagactgcgtatgctgcagcttatagaagcgactttctggtgtcttgtggctaaatttcgaaagaggattgttgacgcctcccaagttgtggctgcgttgataggccgcattcaagttttccccgtcaccacaacctagcaacagacacgtacactttttcctagttgaacccttgcggcgaccggttgaccgtatcacgaatacgtcggactggtctaggtgaacgtggtgcgacgagctgatcaccaccggagggcgttggctttcgtcgctgaggatgcttctcatcttgttccaccggctgcgacgcggagcaggaacggccggacctgtacgaaacacgagtctcgcgcgtctcagcaaatgcccactggctgactcttccccattagtagaatatttgcgtcgtcgaatgctgacggcaaacaaaacgaagtgtctacagcgtgttttgctgtgcattgcaggctgctttatttagacattttggccgcaaaagatttgtgtttccgagcaggtgacctgggtcgcttttttgaaacagcaggaaaacagcttcgtggtgccacgtagcgtgcttgttggcgactacctttttttcttgggagtgtcggcgaaa

SEQ ID NO: 585 - DNA, 1445 bp, Toxoplasma gondii
ctctgtccacctgcaacatgggacccatcttctgtctgtcaaactcttcctgtgtattgctcgtagtttcgtcaggtgccctcatttgagctaacatagaacgaccaggatcgtcactggtggcgtcatctcgcttccgtcgcctctccggcccaacaacggttccagaacagctgttgttgcattgcgctttcgaaacccggaaactctcacggtagattcgttgacgagcttcttcacaagtgggcgcatttcctgaaagacaccaagtgcaggcagcgggcacaccgctctctgtaaacacggtgtcgacgcagaaggcactctaatttgaacagcatgttgcacacaaccctcctgttccaaacatctcctacatgcagcaagagcacactttgctcaccttcattcggagatccctgaaagcaagcgccactgttcgtcaaacaaccaacttgcttgtcgtccagatgtgacactacacctgactgcggtgaaccatccttgaaagcaagcgattcattctgttgagctcctccagacagaacgcgttgctgttggtccattgctgcatgaccactccaggaagagagttctgagaaactgtgttgtacaattcacgataaaatacaaccgaaggtcctgttgaacatgaaccatgacagtgctcacggcggcgcgatcatggatgacccgctgaaacaaaagtccccaagtacacggaggcggtccgccgtaaacccttctactaccgatgccacgaaatgaccaaagcgtccatattctccgagttgcacgatgaaaaaaactctatatgctgtcggtgaatgactgtgtacccgcgttacgatgctgttgtacgccccgctctttgctggcgttggggctggcgcttcagggaaccattctcatcaacttttgtttccaacccctcctcgaagcgaaggggtgaagacggtaggctccatcgagaggattgggtaagatgaacatatatggtcggatgagtgtgcagcagacaacaacgattaatgagcacagttaaaggtctctaattttgcgtcactttgctgatgaggtgcatgcacggcgtcgcttgagggaatgtttgcagtctgcatgcgttgcgttcaacggtagcgtagctggacaccgcggctgatgacctcacctacgggttcgccatcgttcatcaacgcagtgtacgcatatttttctcaaaaagataattcttcggaatggtttcacgttgatgttgcataatttgcctttaaggctaagctatcctgccttgttttgcggataagcccgacaaactgaaggagccagacggcaaagccgtctgggctgcaaactttgcactgaattccttctgcataatcgcagatcccgaagagtccctctcgaagaccaaaactgccagatctgcattataacactgagaa

SEQ ID NO: 586 - DNA, 1454 bp, Toxoplasma gondii
gcctacgacctcatttaggagatgaaaagtgaaattccgcgtataaaaagtggaaaaatagcgtgctactaaatcacaacggtgcatgcacacattagatagagctactgtacactttagctagtgagaagaaacatcgttctgtcttgtcaaacgtaaacagaagcgttgtctcgtctctaaagtgtggcctctgttttgctatacgcgagggtggtagttcgactctgagatcatgtttataggcaaaaggcttgcaacggatgcatgatgatttttacacctctctcatccttgtggactacagtagtcctgctgtcgctgcccacggcacccttataatcccaaccggccagagaactggcggcagcgaagccaaaaagaaaaatgtagaagaagagaaccatgcacgccacatgacagaacgctggagtggaaaaatcgggcaacaagtaaatgaatcgtgctctctcttggtcggcaacaggaaaattcgcgcgtaaagcgacatccacgtgctcctcaagataaaggctgtgtggcagtccgccagacccaccaggctgcctcatcatggtggtttcctcttcttttgcatagtcatggaaaagtccgattcgccaacgtctatgtttgggaacggaagggcgtgggactttaatgagagcaccaagccagagcgcctagattcctcgttcgaattctatcttcctcccactgtcatcctagtccagagtaagctgatgaggaccgagacaaccactactttgaaaaacgcaccggggattcgcctaagaaacgcgaggaaagtttgatatctccggcagcgttatcctgaacgtatcgaatacgataatcagactctactgcttctcagagttgcaaggagactttgtatgatgttgaactgccgctcaccacccgacacgctcactcagattcaaatactgtgcgatatttccggaaaacgagaagcaacgcctatagagtttcacctgaagacttccctcgtataagaaggcggcctcgtttaataaggcgaatttcatcagtttaacaaaccagcccctggagggcgttaagcctgaccaacctccgggccggcagcctgtggctcacgcgtctgcatctcttctaagagaacgcccaaatgcggaccttcacctggcaaatccataccccttggacgaagcatccgaatctgtattattgtgtaaaaaacgtagaagggctatgtgaaggttgaactccggaacaagggaacgagaaaaagcggcatgaagaggaaaaacgagcacatgcacagaccctcatacgatggaagaacgagcgcatgcgcaaaccctcatgcgctggaaaaaaacggctgccgcgtacgccgtgcagagacgacggcagtggagcaagtcacgcgttaaaagaatgtgtcattcgcgttttctcccagtttgcaa

SEQ ID NO: 587 - DNA, 4370 bp, Toxoplasma gondii
taaggttttgaatccatggttgtggagttcctccagcaacccttcctctccaatgacgtaaacaagtgaatcgtcgatttccactttctcttccttcgtctcgttcttctccttcgccgcgttttgcactgttcgcattttcgctttttcttgtcggaaggcagcgcgtctcttctggaggtaccagctggcgacgacggagctgcagacgacttgttcttccgttgcatgcacaccgaggctctccagtttcttcaagaagcctctgcggctcttcgtgctgttgttcgtcagaaagtagatcttcttttgctgcgctccagagccggacgccgaagacctgccggcgtcgtctgggagttctctctcctcctgcttccctccagaggctccgaacgcgttcagcaacttcgcgactcctgggagcagcttgtcgccatgccacagaactccgtcgcagtcaaagagcaggacatcgacatccgcgagaaactctgcgccggtctgctgcccgcccacatgctttccttcttcgagtgcatgcgccggagcaagaggagtcgcagtctccgctggcgcgcgcgaagcgcgactcggaacaatcaaccacggcaaaggcgcagagaggagcgacgcagagggagaggccatggtggagaaggaggagcgtagagaggagggcagatggcgaaaggaagaagaacggcacgaagcgagaggcagaggaaaaggggagacgcaaaacggtgaggaggaagaagaagaaaagaaggaggaagagaaggaggaagagaaggaggaagagaaggaggaagaggaagagcagcaagggtgttcgagtgagagaggtttgaggcgaggtacagcgaaggcaaacggtttctgcagacagcggtggaaaggagacgaacaggtgaggcggcagggaagtcgacgcgcgcatatgctgcaggtcattggtcgttcgccgaagaaaccttgagagaaaccgacgcactctcgaagaaggaagctcgcaaatgagaaaaagagcaggacgtagatagagagtccagagagaccaatgacaccgaaggaaacagcgttgtctgcgagagacgcagagggccgcgtcgaccgtctcgaggaagaaagaaactcgcgaattgaggaagaaaagaaaaagatctctgcgctgaaaaaatgaccgccggaagaccaaaggccatctcgcttttttctgctgcacactgcgaaaagaagacctggcgcggtacccctgtgacatgggctttgctcaatggctttttaattgtcgcttctttcgtctccatttcctgcagaatcgcaagcgttttcgcggtgttttctttcctaaatatgcagagcgccgtcacttctccaagctctcgtggaggaagcggcttctgtcgcggtagcgcggttctggaccgtctgggcgtcttcctcgcctcccctctcctgcgacacagaaatggcagtacagatgagtcgacttctttttcttacgcttgagccagaaaaacgaaagatgcaggcaaaaattgctgctgccctccctccacatactcttcctcactgctctgcatgcaggtcagagcacacacaaagaaagtcgagagagacagccgagagacgcaggcgagagacacaaggataaacgcgaagcacaggagcggcaaaggcgagacaggagagacatacttgagataacaggagaacagggaagaaggcgagtcggatagatggaagagaaattggtagacgcagcaggagctaaaggaagcaagagaacacaagtgacctaaaagaaacaaaagaccgagaaagagaacacgagactcacgttgatgtcgttcgctgtgaacaggccgctagaagtttgccggagccagaggagaggagacaggggattctgttttctcgttttctgtccacgaaaaggaatctacgctttgttagggagaggaggctgggtgactgccacagtgctcctgtcggtgcgtgtgcgttcgtctgttttccttcctttttcatggcggaaggagtcctgaaagagagaattgcatgtctgatcaacgaagaagcgtctggttcgccgcactcagaaggaacaggcaagcggggagtgatgctgctgcctatcgaaatcgctcaagtgccagaagcaaaagagactttctctcggccccaagcactcaggaaaaagaatccaaaaaagatccaagacgctccacaatgtcgacatttctcagagtgctactgagttgcacagacaggccaattgtcatccacgcataaaaacatgtatatgcagatacatggagaaagatccacccttcaaagggcgtttcatccgtatgtgtaagatatatgtgtgtggagagaatccctaacttctagctatatacagatgcatgttgatctacagacaccaatacactcacacataaatctgaacaaagacataattatatatatatatatatgtccgtctctgtctctctctctctctatatatatatatataattctatattggatttttgtataggtattgatatatatatatatattatgtgcatggaatctgtgtgtgtcggctttgcgagtgtggagcggggagtctcgcagtatgaagttcgcttcgacaagaagctggagaagagcgagaaacatgcgaactgtttttggacggagaccaagagcgtctggacggagaaaccgagtctgtgaattgtcttggggtggagtgtagccaactgcgcgtcaaaagctagcgagtctgaggttcgtttggaggcgagaagtcaagtttgtggtttgttgaaagagaggagacttgcggtgctgttttcggcctacttccccgcggaaacgcgtccgctgtgttgccccaaggaggtctgtggacgtctgttccggccgttctcttgctgatgcgcgaggagaagagaaggtatgcgaagacgacaggagcggggcgacactctgcaccgagcgaaagtgaaaaagaggaaagatcggcagacgcgctttcgtctggaacggtgtctctcggcctttgtcttgagtctgaggaaggatgagcagtgcgtcttctttctcggatgtcgattcgaaaaagttccctcgctcccaaaaagaaacttttcctccacctcttgataaaaaaatgagaaaaaaaggaaacggtggacgagagagagggtcctgagaggaacgcgacacccaggactgttcgactttcctttctctctctctggctctgtctgctctttcttgtgtgtctccctctttttcttcctctccttttctttcgctcttcttctctctcgtttctccctctctccctctctctctctctctgccatgatgaggtcaagtttctggaatgtcctcctttttctccttcccgccgccttcttcgcgcgcgttcctctgtcctttcctctcttcttctccccttctactctgttgctttcgacgaagagaggcgaaaagagaaagagagaaaataaaagtcaataaaagtcacctcccgccctgcgtgtctgggctcactcgcgacgcgcggtgtcttggtccgcgctgcttctttacatgaagggtgaggacgctgtttgagaagcgaagaaatctgtttttcgttcttgccaaatgtgcaagacaaattgagagctcgcgacttttgaaagcctcgaggaatccatacgccggattcagcgcgtcaaacttttctgtctcctctgcttccaccttccttcctaactcagcgccgttttttccttgccaggtattctgtggtctcggtctcggcagcaagcttgaagcgcgcactggcttgtcttcctttcgcgcgatgaaaaccgttttctcctattttttattttttcctgaaatcgtctgtcgcgcgcagtctctgtagagggaaactggggtcctttgcaggcgggagggaacaaaggcttgattgtgttgtcgggctcgttgacatttcactttgcttttcgagacaggaggacgtctcctgcgactcaggtcgcaaacgaatgaaattccccgctccttttcttttcaacgcgatgcaagaaatcaagaaacggcgcacaaggtcttttctcacctagccaacaagcccagggaggggcgctaaaatgcgctctcttctttcttccactcttctttctttcgcttgctctctgccttccacactcttcctccgtttttcgcttgctctctttcttctctctgcgtgctttcttcgccttttcctagccggtttttctttttctcctttggctgttttcttttcgtcctctttcccctgtgtctcctccgctcattttcctgcagagagaggaggaaga

SEQ ID NO: 588 - DNA, 2988 bp, Toxoplasma gondii
ccgaaaggtttactcgtacacctgctagaaattctgttgcagtctttacagaacatttcttcattctctctgaacgctgttttaagctattgcaacgcaacacggatgctactggtgtaaagctggccgtcgtgccgacgttagtttgctgcgaagcttgtagcctgcatgtgaacttttttgcataaatcgcgaagcactggcgatcggtaggagcttgctttaggggtcaacggttgcggccgctgtagccgcgtcgttcccacgtgtcccacgcccagactcagatgatgatgactatagcttgaaaatcacgagagtagcagagatttaatagataccaacgatgtgttcttcagaaaaactgcaacgctggtccctacacgaatagaaacaagcagtttggtgaagttacggttttgacatactcacgtgctgcgtgacacgttcatttgcggcaggttccgctcatgcgccgagacacggttgcctaaaagcacatgtctctctcatcctgttgtagtacactacttgctgaatcgcccactaatcgataggctgtgagggaaagtgaatttggacatgatagttcagattaggtggtttccctgtctggagtggctctccctgccaacaaataatttgcaccttctatgttcacgttaaatcgattaaacccatgtgggtgactcgagataaacttgccatcagcacgaacgccgtgagggtggggtcaggaaggaagctggttggtaacctctgtgactggtgcgacaggagtatcaaccctaccaaaccctgtctggctggcgagtgagtccaaattaatgcggctgttgagcattttctcggtacgcggatcgaacgtgagcatcagaggaaagaaaatcatttcgcctttggcgaagacaacgtgagcatacaccacatccgcaaggtacctctgaacagcactgtctttccacaatgcccttcaggcgtgagactcaaacactgccacgtacggatcgatttttctcagcggtgagaaagcctcagacgcagctttattcaatcatcaataagcgctttccgcttccttacaaacattcatttgacacagttttttccaattcgtcgtgatgaatcaaagtacgttgactacgctgggtggccaaactgtagtcgcttcacgttgatcggtcgtctcatccttgggtaaccgccaagacttctttttaacggatatgcaaagtgtgacctccacgcatatgagtcaccgtgactgcgttgttgtttttaatgagcttctcaaaaccttgttgaagcaacatattcaggaccgcttatctttggtgccttttcgccgatgtggtggagcgcgaggtgcatggtgtgtgcgcgcaccacatgcgaacgtggcacagtgcactagactacgcactgttcgcgatctgggacgaaacttgttagaagtttaagaaagcaacgaaacttcactaattgctagctccggaaggcgggagattcatggaggcgcggacgatgtcgtaatctgtgtgttctttccccggctttcccatttctttaagggttggttatcccgttgagatagctgttctcaagtcgtgctcgctattagagcctggagggcggccccactattggcgctttttccttggtgtcgaatgtgagcccttttaagaaagggaagcgaattcaatttaaatgtgatccgtgtaacgtttcataatgcacacctgtcaagccattttctattcgtgtctaaaatgcgataatgagcacccttggcttagacttgtcaacgcccggttaactggcagcttttcaaaaccttgtcacaaacacaaaaacccgtcttgtcagttttttaactatttcgcgctgggggccaaatttgggaaaaagtgattctccctttagattcgactgctggattgactgttggttcggcctgggatggtatttttagattggtgcacgagatcggaaaatgtttgcatttttaaaccgaaagttcaatccaactgtgcacattttcaccctctttttccggctggccacccttacttttccgtcctccctagtccatgtgctctctgtcttccatcattcatctttgatcatgtctgtttctgctcgcaatttgcgctgcaaactgcgacgctaattgcttggaatggcccggtggttttcgggctaaagggaaaagtgaaaaagacacctaaagtcgtcgtcaaacctactggttcgtgcgcataactcttcttgttgtgaagccacaaagaaaggggaaagacacgcgatgactttgactgcgggttccaccggcctctggcatcatttcatacggttaccgtcactctatgcattcaatgaacgactgtttaacttgctgattccagccccctacccgtgttctggagcgatcctgcgttgatgcagctgtttcaaggaggtctttccagtgccaacaacttccgtcaaaaagcaatctgaccccatatatcaccggccgggtatctcgtcggcgcacctcccacaccaactcagtattgttgcttccaagtttgttcaacttgccgtgctcgtttttcttcacccatacagggcttttttcagggctttcgcagcttcatggtttggctgactctcaaaaggtgacacccgtcacggtagtcacgatcagtcgagttcgacgaccgtcctggagaaccaccgaggttcttgtgttctccagtgcgacctttattggattcaatactggacacactactccgtgatcatgtttgtgtcagcaagttgttttctgctggaacttataaagaattgcggcagcctgatttgcgttacgctcttgctttgagggacttgagcttcggtatctgcgtagatcgatgccccttctgcgtggattctccggtcgtttgtttccgttgtttctaatggttgacgtcagtcgcaattgaacatttgtatctgtgacca

SEQ ID NO: 589 - DNA, 3517 bp, Toxoplasma gondii
gtttgttcgcctggagatgcagaggcgtcgaagagagctgaaggagaatcggttctccgcacctttccactttcctgaggagctttctccactcttggagagagaaacgatgatgcagaaacgagggtcgaacgccgcctggtttcgccaacgtgaccttgacgagacgagacggcatacaaggggtgagacggacccacgaggttcgccgctccacttcgggcttggagggcggagacgcggaaccgagaggccctgctctgcgtcagaggagcctccgcctcccatgttcgctgtgctccaaaagatatttcgagaggagtggaggcaatctgaatgaagagcggggcgagacgcctcttctgagaaaatggaagaacggagacacgcagatccttcggcgaaatgtcagcaacgccgccagagggagctagacggacagacagcggacggggggacgggggctgtacgggtgtggccttgaacccagaggtttctagtacatgacgagagaacacaagcaggaggcaacacacagagaagagaaggccgagcgacggagataaacccgcgaaaaacctcgcgagaaaggaggaaggagtgcgcgccagggtagcggcgacagtcgagcagctgcgaactggggacggttcagctgcctgcctctgagactcccggatctgaccaaagttctcccgctgctgtagcgtagcgatccgacagaccaaatggttttgagaggccacagccttcatggtgtcaaacactcgacacttaggagagacataggcgggaaaaggacaaagtggaaggttcatttgcagcagtctcttttgggggttccgaagtcgtttttctaacaacccgtgaccttttatttcctaggactacgcgtttttgcgtgggaccctgaaggaatgcgttctacacgaggctggcgaggctccagtctatgggaaaacaaataaacgaaagcaggacgggcggacgacaacacgtcagtctctgcttttcttctcaatgtggaactcggaaacacacgcggaggagagaggagagcggcctgcatccctgcatccagtcccgtagagtgtgccgagaaagacgcctgtttctggagttcggccacgaaggaaaggcaggaaatcgtagctgaaaccccgtttcatgcagacttccatctacaccatttttaccggccaccgactttgtgtggagtgggcgtgcggtttgaaatgaaatgcgcaacgccagtaacgaaggggaaaggcggtagcggggtagagaagagacaaacagtgggcacttccccacgaaggaaaagacggtgggaggggctggagacgtacggagacaaattgtggatatttcctctgttacggtgagggagcgagactaaggaagggaaacagatcccgccaacggtgtgtcttgccagccggaacgcccgcgccggcgggagaacaatgggtgtctgttcacttcttgggttttgacaacacacaggcggaaagaaaacaaagacggagaacaaagggtgtagttgtctccagggcagcttgcgctgtgcgccgagacaaggaaattgcagcccgcatggaccaacggagccccctcgcacactgagacgtgctccagcccttgccggagtgagacaactgcagaaaaatgcgcatttctgcacgaggtggtacagtcaggaaacgactggctgaccgcgaagagaaactgagacaccccagaagacatatggcaagaaaggaaaccccagagttttatgggggacgacttgtgtggagtttcgcacctcaaccagccttgaaggcacacagggattgcagccttgcaagtcgatgtgcgccttccctagtttcggcctcgaaggcggaagtgcctcggaaaatctcgcctttcagaaaaatccctcggatccgcaaatccgatccgttgaaagcaagcagtgcgtcagaaatgtcaactccaacgcggagacagagaccacttgtcctgtctccgttcgctagagcacgttagcgtccctcactaaaccctgaagcttaaactgtaaacccttttcgcctaatgtttgagaaacgcagaggcgcttggtggtcgggctcgcgcgcgccgctgctcaaaccgcgctgctgagggggtggaatttgactctcgcccccgtgcacgggcgttcctcggcgcagtctcctttttttcaaacacccgcgagcgatgcaaagctgcccacgaaagttcagcagaacatcacagtggtgtttgaaacgaacagtggaaagtgtgcaaaactgtgaatgttgcgaggggggctgtctccggtaaactaacttcttaacgatcactcggccattgatactcgacctacagctcgagaggggggaggggcgaaccgtgcgtcgacaaaggcggcagagaaacgctacctgctaccgtcctcggagttcaaaggttttgcctttgtgaaaagtggcgttaccttttgaatgagttgccccgcttccgcgaagggtctgaaatttttgtgtcctgaattgctctcctacgaaagtgctttttgccgcgaagcgccgcctggtccagggccccgttgcacaagcgcacgagccagatattcattcgcgagctcgatccggtaatttctccacacctgtatgcatcttcgcttgttttgggtattaaggctttcctccgactcacagaggcgtagcagaaagagtgaaacacaacgagtcgcgcggagagcgacaggaacggtgtcatccgtctctcgagaattgaggctttttgtgttaagcgagccggtaggaatgcccagtggacaaaaagatgaatctgtcagcgatccgaacttcacgtgcgggggtttattgctggaactagagggtttccttgctccagcgagacattttccacggcgagctcaaccattaagtgggcgccagacggtgttttgaattgttgcccgacgctggcgggccttgacacccgtgttccggtcccgcgcaccgagctggaaaagtgtgcttttccgcccgctgtcggccgcgagaaatcactggaattttggcctccaggtttcttgtactctctatcctccagaacatgagtcagttcaacggtgaagtggctattttcgtgtgagggtttccgatactgggtctctaccggttaggccatacctcagtcctgcagatccgtaccttcagtcccctatctaacccccccccccccccaacacacacacacaaatgtgcacttgaggctaactttgtctttcgtgttctgggcgatacacagcgcggccagccttcgtgttcggtcctagtgtttggtttctgttagaggggtagttcttgggaacacgaagagggtcaaactccaagtgctcgtgcatcgtggctaggaacgcaaagctgcgatatcggaattatgtgccctgatgtactttggctttttctcactgcccgtccttctgctttctcttcagctaactcaagcacca

SEQ ID NO: 590 - DNA, 1595 bp, Toxoplasma gondii
aaaaaaggtgcgacgtttctgcatggccaaagaagacgcgcctggaagaatcatcagaagcaagcgcggtcgcggccttcatacattcttattcagttacataatgaataacggaagagacgcccagaagattcctcgtatcattgcacgtgcaagtaattaaaaggcgaccttcgcgtctgggatgttctggccctcacacaggaaggtgcttgcatccagcacgcctacatctacgatgcaagacttctcgaggaatctacgtgacgcaggaatgtggcggcgggcaccacaggagacacagcagtgatgctccttcacgtgaaagagtgttttccgcctcccgctacgacacagatctgtttaaggcgcgatgaatgatcatttcacgagcgtaccgctgtatgactccttagaggctgcagtgggagcggtcacggaaaattacctagaaaagaaccagaatgtgcgctagacagtacctttcacaaccgccctgaaagcgacctaacgtacactggctcccgcgttgtgttctcacgtaggttcagtgacggcacctattctcccgtagcggcataccggaaaccaccagctgcaccatgattactttcccgtcatctggacgcacacaagaacacttccatttggcatcgacattttgaccgtaaccttgattgtttttagccaaggtcttgaaccgtatttcatgtcgtttgacaactgggcgctacgccaggggcttggctgagcccccgcgcaggagcgggttgtcactacaaaagagaaacctgaatggattcacagaactcttgacactgcaagaaataaaccattcgcaaagacatgcttgagaaaaaaggagtcggcacgtgacgtcagtgtagcttgtccaccttcccggaacatcttctcacgggaaaactccgaacctttcgatagattttttcaaaacgttcctcacgtaaaaagtgcatgtttgcagttcaacatacgcatcttgcaatgaaacctgaactcgtaaaaccacaagcacactagagattgtttccggcatctcacgcatctaatctaaattacgaagcgatataacatggtcagcagaatgattctttccctcacagaacagccagtttctgaggcggggcaagatacagagtgcagctgcagtggtcccttgcacagacgaaacgctgcgccttcactctcgcgcttacgactggcgtctcttggcgtcgctttgccagaccgggttgttggtagtataactggcgtatgtcgcaattacaaagcatttcgcgagcgttgcttgcacagagcttctacgacggaatgagcccctttcattcatccggttttctgcacttgtgttttcatgaatgcagcggcgggtggcaatcttttgttgttttcttcgttccgcatgccggccatattcgttggtggctcgttaccgtgcggtgcaaagcgtgaaatttcttctgattttcccgaacggtgtcacaattatactatctgcgctgccatggcttgtaggaatttacgaataaaacgtattcagtgcccagactgagtgactttcagcaggatcaaca

SEQ ID NO: 591 - DNA, 3919 bp, Toxoplasma gondii
ttcaaaggacgtcgacagtgatgtctactgataatgcagacacaggccacagattcagaccgaagcatacacatacatgcatatatagatatagatgtacagatatatagatatacagatagagatgtatactctggcctactcaagaaggcgccttctctcctcgagttgttcaaaggcttcctggcgactgccttgacggattttctggagaatgtgcgtcaccgcaggtcgcgcggctcggccgtttgcgtccctccactttctgcgctcccgcttcggcagggcctggtgaatgcgaaagagaatctctgcaggaggcacagcgccctgctgcacgtagcgcgcggccgcaagctgcaggcgaagctgctcccgaatttcggacgaagacaagatggagtcgtcatcgtctccagaatgctcacacgacgcagaagacgaagacgcagaagaagcagaagaggaagaaaaggaagaagagttagaaaagaggttcgcgaaggggtctctgggatcgccaaagatgccgttttcctttccaggagagagcagcgggggcggcgaggcgaggtctgcatgcgacggcggaggtacggtggagagagaaggcagagccggcagaggagaggtgacagaacagtcgccgttgattgccgcttccacatgagaagaagccgagtcggtgtgcaagtgagagaagaaggcgttctgctgctccagaaagtcactcaaaggtccatctgtgtcaagacgagaggaggcggacgccacccgattcttggagctcacctcaggtcttgctgagggtgaaaccgccaccggaccccctccctccatctcgcagtggagacagcacgaaaatcaaaagagagaagaagaaaggaaactgccgacgcggaggtgcatctacggggagactcgaaggcagaggaaacaggcgaagaaacagagcgagaaaaagaagaagaagaggggaaggttggatgggcaggcggcgtggaaaaaccaaggcatgcagaacggcgagtgcgggacagtggggtgtctctcgttacagcaaagcggtttctgtcttcgtggatccacttctttcgcctcccgcccctgcgcctctcgcgaacgagaacgcagtcttcactctagaagagcgacgccaagagaaaagggagtcgggtggagacaggaaaagacaaccggtgctgcatcggcaccgaagctcagacagaaactggacaaggcatcccagaagctgaagccccggagatgtggagaaacagtgggaaacagtgggtcgataaggaggcagacaagcaggcaggaagagagtagtcaagggtgaggaaagggacacaaaatttcgaaacaaaagggcatgcatgcacacaagccgagaacggccgggtccttcctcctcaaccttgggaactgggaggctctttccagtcctactctgcttaccggtcgaggcggaataaagcacgatccgtacaaagaaaagatggccaacgagtttttcttgactaagcgtggaagacaaacgagcgcccaagcgagaaaggaccttttccccgatcgcgttcagttattgtccgggcgcttttttgggcaggacaaagaggatgactcatctcttctgccttcactgcatgtcatttttcgaagaaggcagaaaacctgctcgtggaaaaagtgccgagacacccgaaacaccactgtccgcagtcgaaagtagacagcaacgactttctctcggcggcagaggtaacggcgccagaaactgtggagacatggatcgaaacacgaaccagcgacgaaggcgaacggagaaaagaggtccgaaacagaaaaaggctcttattgtcatgggacatgcggtctttggcccaacagagtggaagactgaaccgaggggaacatgttgttctccaccccgcctagcgagtttctccgtcaactgcatgcagctcgtcaagataactaccggtgaagagcaatacgcgacagaacacccggacaacttcttcttggtgcaagagaggatgcgtcccttacacaagtggaaatcgttatgagaaaatcgggaccacacaaaaaagcggcggaggaacacagttcgctaccaaggaatgccttcagcaacagggagagggggcacccgccaccgggaaaaggagacgagagcttttctgaaaacaagctgtttgtgtagcgtactggaaagggcagaaggaaagacaatgcaagatttgctctcggccttgacgcaacttctgtctgaagacccagggggactcactgtcaagacctcggctgatgtgtttggccgatcttggtttttctccgttccgatggagcgtctaccgtggcgataaagatgcgggcatggcccagaacggtggcctgcagcaatgatcatttgctcagtggtggagatttccagagtccatgtggcaaagacctgggacgaatctgtcttcattcaaggacagtcacctatcttcaccgagactggctgcctacttagtgtgttactgcacgtaaatctgccttttctgaacggtgtacaatacgggtcactgactatcgctctgttgggcgaagctttttggagtcacaaggaaccttgcttgacggccgagtgtgaactctctgctcgaaaacattcagcatcatgatgccatgtggggaataccaagaacacagccacatttaggcaggactccgaagtcaatctaccccacggtctgaattcgatctttctctaagcggcctgcgttcttccagggaggaaaatgcggaatcgttgcatttcgcatttgctggtgaagaccaaaagtgcagctacttttccttaggacttaactgtgtgccaccctatcctgtcttgttcgttcagtagtatgcgttctgcaacttgaaatctacactcataccagtcatcaatgctcggtacgcagttgtcagcacagttgggcgatttcctggtgtgtgtcacagttctgctcaatttgagtagtgttgttaagagctttatggggcatcgggaatcaaggacatttcttctcaggatttaggtatttcgtatcactgaaaatagtcctgttcagacgggccgaagaatgctttactttatctctacacgtgtcgccctcgactctgtttgctggagcacgggaattgcgaaatactatctgacagttttcggtgaggagtcatccgctggtacaggctaccggatgtcagcaatgttgcctcctgcagttatctttcaagtccactgccgagcgttattccacacggttgcacggaactgtctaaagaggaggaatctcaatgtcacttgcccctgtaggaaagttcacaacaaatccgtttgataatagcaggtacacgggatccgggtccgtaagaagccgcgttctgaggatgtggaacttttggatgtcgcactgcagttaacactagcgaaaaatacgccggctgtgtcaaacgggtgcaaccagaagatctagcatgagtatgagttgtctgagaaagctttgcaacacgaattaatcaggtggaccaaatcctgcccctttgactccagggtctatgtagccggattgtcttcctgaacgtggaagcttttggttgccctgatcaaaaacatgcgagtttgcacagccgcggggaaactcggctgcttaggtattctgtgcatggttcgacttgctgctgcgacaacagttatggaaaagctaggataccaacgggaaaatcatgcttttcgtacgggctcagtaacctcctgtgctagtctattttgtgggcattagcgttgtcctaggactgctacacgcgtaccccgcgtaccctcactgacatcgttgaagttgcttcatcgacagcttcactgcgcagctgaacgctaaaa

SEQ ID NO: 592 - DNA, 1970 bp, Toxoplasma gondii
ccacaggagggtcgatacgctcgaggaagaaattgggtgcgaagtgtcaggcgacaatgcaaccccttcaccatccgaagacgtgtgcccgtctgattcaaaagcgactgctgatcgggagaccgaagcatcgtcttgcccgtgtgttggaggtttggacgatttttcagtgtcatcgtacggcgacgcaagggatatcgcggatgaggatgaggcgacccgcagcgcttttgaacgctgaaagagtgccttcaccgcatgttcgacaatttggacgcgctggccttgacttgaactagaagataagtcgcctcgggcatcttcaggtttcaacgaggcgaaagccgaagagttgcgttctgcatttgacggaggcggggtgtgtcccgcactatctggcggtactgcgtggtgcttctttttcgaggaaaaaaaactcttcccgtcttcagccattttttcaagggaagacagggggcggctagttttcgtcagacgggttgcacagtcgaaaccaaacgaagaggttacggtctctctttgagttccaacttcgacaaagtgagggaggggatagcaaattgtctttctgcttgggcaggcctggctccactagattggtgaaacctagctggtctcaaacacgtggggagcctctctgtcacacatctaggagactgtctgtacctgtgtagccaagaactttcgctcttcgtatgtcgggctcccgagaagaaaaaacagtgcgtacttcacagaacattcaggtgctcgtgtaagattgctggcaatgcttcgatttgtctctaaaagcgatacgagataggatattttcaccgcgaacggcaagcaagtgcccacgagatgggatttggaccatcccaaggtgatgggaaacgagcgggaaagattagggggaaatggcgcatatcggaatggtcaggaacgcagcgacgtcgcatgttttgctgcgatcgaccctgaactggcctgcctgttggcttgcatgcaaatacaacagcactgggtcaacgttggcggcaaaggaaagcccaaaacttgaagatatgtgaatttagaatgaaatgttccccctcgaatacgatccctctgtcggagcagcaactcgcatcctagaaagaagaatctccatttcggtggtgaaaatagtgccgccacgatatgcatgtaacagacaagaaagatgacggtgctggggattttggcgcttctgcagttcgcttagatgttgtgggaaggaaagcgtcaagcaaaaggtagagaggagaatactatgaacctcatcatttggtggtggataatcgtgtgcaagctggggactgagcagacagcttcttgcctcgagacatgcctgtacccgcttcacttttgccggcgacgcccagcgcgattcgctacatggttcgctcatcgggtgagtgcggtcatgcaacgggttttggttaacaccgacagacacactattctgatgatttttgagaagtacttttctgagaaagttgaaaagaaaatgaattttgcctcctgtcactcgggtcccttgtgttgatggagttggaaattgagacggttgacttctactgtcttcagccctaccggtacggctggtagtccacggcggctgcttcgcctttcccatcgaattggtttgtggatttcggtggtttcaccgagtttcgcgccggtgaaagagacagagcagagcgagtgtacgaaatctgtcccttcgcgttctgagattgttactcatgtcttgcaagcttgtggtgatgtccttatgacttttctaagcgtgccacgcgccaagatcacggtggtgatgcagtgaccgcgtttccacattgttcagacacttgttcttgcaccgctaaactcgcttccggggtgtcattcgcgtgtttaacttcagcgtagaattttgttttcaactggtctcaaacccaagaaca

SEQ ID NO: 593 - DNA, 2478 bp, Toxoplasma gondii
tctacacactcagcgacataccggtatctatgcgtacttacataaagacatctgtatgtgtatatatatatatatatatatgtatgctcaggtagagacactgttacagatgtagaagggatgccaatagagattttttgtgaatttcttgtggtctgtgtagactgagcacaccatcgagttttggcagaaatcaaaatgaagaggtgttgttttttctgcatctttgaagtcgcacaaaccccttcgcgcccgcagtgacgcagcaggaggcccccttctgctgcgtttcagcgccctcgtggaaacgcaaggcatttgctccggcattgaaaaagtctccccatctgcctatggacgttttcacatcgtttttgagcgtatagacgaacgtatacgcctgcgcggtgtttgtgctggaactgagtgcatgcagcgcgtcgtacgtggaatgcacttttctttgcacaccacgcactcaggagttttgcctgcttttgatgcctgggccgccacagtgccatcgcgtctacacgtttctaaaggaaacgttgttaaacgcaagacgaagtagatagttttttccactatcttttgcaggagtttattacatgtgtttgttttataaaacagtaataaaaattctgtgacctgagtacgtaggtactggccctgcaattccagcgacacacggtggaagggaaactgcacggcacacacatcgaataaacagagatattctagttcctcggatgttgaatcggactcgagtcatgacatggacggtatgtctggactacgcctctaccgccgaatcatcacgatgtcacttgtcgcgttgtgcaagacgctctgtcttggtttcagtctttgacacagttattttcaggagagagttcatcaaccagaagctccacatcgttatgccgacagggatccctttgcgtttttctgagtgttaagtgtgactgcgatgtacgccgacctccgtcgtctgcggttttctcctttcctcgtttgtgaggcttgcagtctccacagtggtctctagcgtcttcgtcgcaacgagaagtcaccttctcccgtggaggtgatgtctgtgtgttcgtctttctctgtctcgagtctccaccagaaactctggagaagaagcgctccgagtttcgactgtttttttctcgagcctcaagactggcgggaaggagacgaaaagccgtcctttcttgggggcactggggctggcctctcctcgtctcgcataggcagctttgattcatctttcgaatcaactgacaagagacagatgcgcttttttaacgaacaacaaagactgagaaaaaacggactttcaacttttctcgctcggcgaaacgacgcaccagagcgacgcaggaacctcgcgaggcgttgcatgcacgcagagaagaaggtactgcggtttctcacaccgtcttcagcgcgcatttccaatcattttcagtcctccgatctctctttctctctctcgcttcctctctcttttctcgttctcatcccgcagttacgccttgtttcttcgtctcctctcccctctttctcgccgcctccctgccagcgcgttttcaggaagcgaggcgacgaactgcttctcctttctttcctttacacaggagagaccctgtttattgttttcacattgcctgtcgttgttcgcccgttcaaaggcgtatgctttcgccattctacactggtccggctatctccgccgctggtcgtctctgggcttccttttcttctttctctctcgcatggagacgcggacagccctgaagagaccgcaaacaaacgaacgaaatagcaacaggtaccctcgagagagttcagactttttctcttctgcatcttctttctgctggacaccgagacctcttttcggtgcgcatgcagaggcggtcttcgcttccgacggacaggcgttctttcgcgtttttccaagaaaactaggtttctgtctttgctgtttcctctggacggagggaagaaatgtggacgcgcggacggcgtatcgcttcttcgcgttgacagacacccgcagaaaacggagtcacagaataacgactttcgtctgaagtgcagagaattcgatccaagcgcgtttccagctgtatttgtccccgcgcctttccgccgtttgtctgtttctttcactgtcgcccctctgtttgtgtcttgtctctctttcgccttctctcacccctgtcttcctccgtatcagtgttcgctgttttctctttctctcctctctgcgcagccttctcttctgtgtcgcttcgtgcatctcttcggtctcctttccgtgctgctctctgctttttcgagggcgaagccgtctgcgcgagcctcctccgctctaccgaacatctgttctgttccctcttcgcgtcgctggaaagcgtcagtttcactcgtcgagaacaggaagtcacacgcccggcaaga

SEQ ID NO: 594 - DNA, 4936 bp, Toxoplasma gondii
tctatttagcgaggcgatttgtcgtcacctttctcgctttttgtagcaagaagcgtcgtgagcagcccgatgctaaatgctgtgtcttccgtccgggatcgtttttcacgccgataacatgaaacccctacccgggtaggaacgtcatgtgtatctatcacaagattgtgctcacgaattcccagttgctcgagcggaagggcagcttctctttcgtgtgcacaactgtcgagagaggcacttcattgtcaacttgctgcattcaaaacgcctttctacgggacaccgggccgccgctgtgcaaaaactgtctctgtcacatccactttctggagagttggccagagaaggagtaaacactcgtacagttgttcgcctatagaggctaagcagcacattaactagatgattgctatgtcaaaaatagtggtgcatttgttgctgttttggattgcactctgacggatagagcggagtggtgctgccgaccgttctcgagggttactatcaagtgggagagcatcgcattccacctttcacatattgaataatatccacccaaacagggatgtttcagatgaaactgtcagctgcaaggtttgggccagctcaggcatgttccgctcacaatacggtgccactttacaaaaaggccggcgtacaaaactccggtgaagaacagacgtcgactccgatcagcgtaacgggatccggcagaaagatcactactctccatgttgcggcattgaagtttccctgttgaagacatcagtaacgctgccgcccgcggcgaccctctagttgtgagtttctatagcttctgacacacctcattaagattcgagatacgagtgctgctaggccgctcgagtccaaggcatctcagtgttcatttcgcacggcactacaggatggcggcaaactggaggactctcgggtcccgcgccacatcgtgtgtgacgtcgctaggctgttgtgcgttcgcgtggttcaccggcaagtctatcgctctctcggtgattattggttagttgagctaggcccctactccaactcttctcgctaagacatcgaagcctttgctcttccgcttgacgggttccatgtgggaccgaacgtagtcagcgtgcgattgaacttcttacaggtttgttcccagagactctagatcgaaatgcacataacccatacgtaacacaaactgcttggattcaactgcatttcactttccgacagaaacaatattccacaaagtgtcaggtgaggattcgagggaacggtacctatcgttgtccttgacaagcctgcggaagcagcgatcaaccgtcaccaagaagggaggaacggacgagaaaataactcctcggttcacagattaatgggcatccgagagataaacatactttgattacattttcgtgcctcttactgttgctgccgatcggtcaaggatctgagaaatatcattgacgttgccgtcaacggtgctcggaccgccattggcgtggacacctgtgtacagcgatttatcgtcatgaaacttgttgggaagggctttcgtcccactatacaccggaccactggcagaagaaatctgcgctgcaagctcttgcgcagagacttttttcttttccgcgatgagatcgatagccgcctcgaactcggcaaaagtgatagtcttggcgcccttcgccttgactttcgtgaagataaggtcggcgtccgttgtcgtgtagttcttgtcaaatgccttgcaatccttacacaacttcacgaaggtacgcccgtccatagcaggcgcatcgtgagtgaaggacttgaacacggcatcgaggcccgacatggttagctcgctgtcaaagtacttccaacggttctgcgccaaggacgtctatagcaaaatgagtctcggaaaaaaagtgtcgggttcgagtcgatgttgtgaacaagagtcttgaggggccccactcgacttggtgccaagcctcaggggtagagtgagtgtccagagacggggagtttgaaaccgcgcttcgcaccttacgggccccacaaaagtgccgccgtctattattcatactgcatcagcgtcccagagatcgatgctgcacccactgcgacctgccacctccgaggcactacaccagcttcaaccacaaactgatatgcagagggacatagtgaggaatcttcaccctactgagatgccagacaatcgaagaacgtcccttttctgtagtagtcttccagcagcgtcggcggtaaggtttctgttcaccctttgcctagtgactactggcatcactgtccacatcagaagtgttccatcagtggggcactgggagggttggtcaagaagctgcacttgtcttcacaggagcccttgccacgtttactctttttcatcagcgaggcatggtcacaccaacatcgtgctgctggatttggagaagcttttattgagaatctctgtgtatgtggttcagtgaggccgagcgagtgaaacagccgagtttgtcgatgatgcccctttctgcattccatatgacagtagcgtgttctaaaactaatggcaacgacgtttacgcctgtttggctaccgtaaacttacgttcatgtttgcagccttgctgacgcatgaagccgtatcctaattcttgtttccagtcactttcgcataggtgtctcattttatcggctgcaacacagacactgatcctcgtgtgtcatgcggaaaccctgcgtggtgtctggaggctgcaagttctgtccaggacttcgctacaagaagtattgtgccgaacgagcttgttccaagtccacacgagatagtttgatataacgtggttaatgaaacatccgaagtccgtatcgggacaattacgcgttagagacaaacaggaaaaacttaccctatctgcgtcaacattaatctctcataccaagcgaccacatcgctggaaaaggaaggacgttgtgaggatacccagtcaacttcccagttactgggaatgtcttttgcagcaaacattcgcaattccgtaaatagctgtatcctcataccttcttccttttaacatatcaacgagatgaacacggcatctctggtctgacaagtccaaaatatgagaatcgttgtagagtgaaggtcatgccgtgaacttcagttggtttttggagaccggcgagcgcgactcactatattcgaggttaccggtccatgaacaatataacaatcaactgagcaagatgcgtactctttggcagcagcaagtctcattgtctgatgcttccggcagttgctgaagcaccgcatgccacaaacatttagatacctacgcagatacaggaaaaaattggtttatgagacccatgaacggaagttgcactccactagcctgacagttacattgaggcggcgctggttcccatcaaccgggcgcatgaaactgtgtggattctccgatccccgagagtccgctttctttcatgtacgcctgacgtgccacacccgctcgagctttggtcgatgctcagtgagccgaataaagagtgagtcttactcctcgaaagagcatatcgttcaggatagaaatacgtggacggagctatttttgcaaacaaagagtcgttctgttgcacttatatctctcacctcgaaaatagcctcactgaccaggatatctagagcttgttccccgagccacttttggcagcatgatggctttctcgaaattgttgagcaaaaatgtcctatatctgatatacacagtcatcttttgagagagtttcatgccaccgtgaggtgtgctggcaggcacgaagaaatggtcggtatctccgcaccgtcgcctgaggcaaccgccaacaaagcacaaatgcacaccacaatctgagacgatttacgacagatgaatcttacacggagggtgcgcggacactaccgtatgacaaataacgaggaaattcgtttatgccccaccgagttgacgaaattcctaatatatgtatatatatatatatatatccactagggctactggggcttgtggccgctacggtggccccaggtgactttgcaaagtgactgggagtagaaaggggtgctcacggacggtaggcatctattgttcggctaaatccacaacagtacgcaagagtaaaagtgttcgagagttctgaaaagccttgctatctcacaaaaggtctactggtctctctcttccaggttgtggttcactgtcccactgtcggcgggctgtttttggctggcacacagcagcttttccggtggtgtgtgtcctttcactctgtgctagtgtttgccagccaaccaagtcacttagtaatgcaaaagtgactaagagattcaacgacggttgcctcagagtatatttgcggtgcaacaactcacgcaggtgttcgcaacgaattcgtgattgtgtgactacttttctcgtctgagcaacacggaccactgcttagcagtgtgctttttccccgaaatatggcacggtagtgtgctgcgagaaggttatcccttcttgcaactttttaggaattttgttgatcatatttctcttcctggcttcaacttagcaattgtgggcaccacttgggtgtggtttcggcgaacgcgtgtctttggagtgagtggctcgcgcttgctccccggtcgaggacggaggctggcgaatttcagagaaaaccaaacatggatcagagcttcatttcataggcactccatggcaccctggtccatgttttgctggagggatgcgacagccagcatcggcttcatcagcggggaactgccctgtgtctcattcaagacacacaaacatgcctccggcgggtggttcggaatcccctcggggagaatctgccctctatagagggttaggctggcctcagagtcgggaatcggttcatcaga

SEQ ID NO: 595 - DNA, 2493 bp, Toxoplasma gondii
tgatgacggagacaagttctgattccgtggtaccggttgagttattccttcttgtctctgggcgccagcctgtctttccacacagtgcagcgaaaggtctctctgatgtgcaagtgctgaagagggagaatcgtttatcgggatggaatccgtggcggcggccaccgatagctgggagggccctcgcctgacaccactgaaatttgggggggatacacccgatggttttctcctctccacgaaatcttttttgacgggaaatttgtgagatgaacaaccctttgcggaagacatccgaaccgatgcaagcgagtgtgaagttttctccgggtggtcggcctgggaaccattcagttgtccagatttgctcgaactgaaagactggagcatttcgttgccgttcaatccgcatttcggttccaacctctttgcagctgtgggttctgtgttttcttggtctccagagaagaaggcagaatcatctgccgtttcgacaggcaaactaggcactacgcaggccgtgtccgacaagtaaccacggctctcagccggtcgcgatacgtcgccgttcattacgaatagcggagggaaagccacagaaatttgcagcccacaacaggctatttagggcaaagaatgttttgccgaacagaacaagccactcggaataaagaaaaagcgacccagatatgttcgtcgctgccccgtgaacgtatcctacagatttgaacagcaggaaatgtttaccgcctgcccccaatgcagtggccgtaccgatatttttcagtaactatccatactacaaagtgtggagagcaaaagagatccctaggttcattctggtgaaaccggatgccaacggtaaacgattctgagccgggggcacgcgggcttgacagagtgcaccgttagaggtcaggaacatgggccgtgttctttcgcagccagaacctcacggtgggcatcggattaactctaatatgaaccatgcatgaatcctgaaaccgcctactataggactctacgccagagttggattgagccgcaggtgcctctcattaagagaagcgtggaagtgtgcaggtgtccacaagaaaagccagagtgcacgaaacactgcgtcactttcgcccacaaaaaaacaaaatggtgggtggaaagtccccagagacctgtggaaggttcctttggtgtacattcgtgacgagcttattcgtttggtgtgtgtaagagaaaatccaagaccgcccgcgatggggggagacagcgttttttccaggcagcatagtgtgttgttgggaaacagggtcgttgtcttgcgtgagagtggtttgacacgtgacgtggtacggcgagtggcgctctgctattatctgagcagaaaccaatcatgtaatacatcctattgtttttgctagcttcaggaactacccataagactatttacgtgtcctacgcagaggctgaactctgtagtaattcggttttctgcgccgaccgcggattcaacaacaagaggcttttcgcacgtgctgttcgtaaagatcgcgatacggagacctgacacacagcgcgccttgattgtccggtggctggtattccccatcgcggccaattacttgtggccgtgcgagacgggcgcgaggcagcacctgtcgctcaaagccattcgagaaggcactcaacgtcgcgcgttgtgacgacgtatgctacccgtgtacggcagcactgcacagaagggcttgtggtgcaaatgagtgtgccagttcaaatttcgagtgacttccctgcattttgttgttgttttccgcatttaagactactttgtagctaagcactcggttggttatcctcgccgtttgtacgcgcctgtggagccgcaacagaattcacctctgagggccggaggtaagaagatgatgggagctgcgctaggtatacgtaattgcggcgaagctttagcaccgtgcttcgatgctagccacgtgagatgggcatcagtggtcttcccacgttgacagtgtcgttagcaaaaacttagctctgcacgatagactatttttcttggcatctgctagggtgcagtgggcttaagggccgcttcttttctaagtttttttcctgtcctttcgactgagttcttcgagagacggccatcgttgcaaccgttccacacgccacgcatacgttcttcgggttgggtggcgtcgcagctcacccgatattttcaatccgttctctttcgtttgtaagtgtttcattggaaacttgcgtgtcttggtggaacaacatcggtgggagtagtagtttagtagaacgtgttttcgtcgaaggcagggcagctgtgctcccgctgtcgcggcagcgtgcgatgtcgagcttctggcgcgccataccgtttcgcttattcacattggtttgccttgtatttgcttcgcagaacactcttgtcgtttgacagactctggattagacgaattcatttcgtgacga

SEQ ID NO: 596 - DNA, 2492 bp, Toxoplasma gondii
tcacaagtgattccactgaaactgcaaaacgtgatattggtggtgtatctccacccggaaatctatagaggcctctccgcgcgccggcaggtcggcctcggatttcgatccctaccaggaggcaggttgccgacgtagaggcgtttctgtttgcgatcgaattctgtgtcgtgccctcgcgtggatccgagactctgcgccgcagccacggcgctctgcagggcgctagcgacgggcgcggaagcagccgccccgacacctgaggctggcggcggcgcggaaggcggcggcggctgcaggcgactgttcagcgtgctgctgatggccgctgcggtggccgtcgcagcggctacctggtcttgagctgcgccgaggacaagcggcgtcaagtacaccgtcggtgtgtctttcacagtgggcatgacgaagcccagcgaagagcacgtcggcggagccgcacccgcaggtggcgaagccgaggcggaggccgagggcgaaaccttgctgtcccacttgcttctccgcgtcttctggcgctcggtgctgccggacctgagaaacgcgaatacctcagaccagctctgcatgtgaatttcgtctcaagacaaccggagaaaacttgaacagacaccggctcgcaagctgacacgagacgtgcgaactcctgaacagctcagcttctggtgcgcgcgaggagaatccagtgggataacggccttgccgcctgcgggtcactcccacactcgggaacggagagcgtttgagaggaaacaatttctcacgatcagttgagttccgaggacaaactacaagagttcaccacattggctatcagcggacgccaaaggcaaaacgcgcgcaccactctccggaggaggcgagtgaagagaccaacaccgacgaatcggtgtaacgacatgcaaaaaactctgcacgttttggcctcccttactcttcatcgtcactcgacagccctccctgatttttccaacaatgtgaacatgtgcatagcgagaaaaacatataaagatatatgtatatatattcgtatagatagatatatataaatagttgatgaagagatagatagacataactatatataggtaggaaatgaaagagtaccgggggaaagacggcgtacgcattcgcagtgaaaaacgtgttcctattcccaggaacgcatatatgacgtcggcgacaagaagatttcccgtttctcttcttcgtgctttcctctacagcggctctgtatgtcgactgggacgatgtacttcacagaaatctcacatcgggtgttacgacacctggtctggagcctcactcacctgctgcgtctgtgtcgccccgagtctggacttcgagatcttcgggatttcgagtcctttttcccttctttgctcgagcttcttccattgctctggccgacgctgccagagcggctgcgggaccgccgcgctcgcgacgctccagaagactccatgatcctctctagtgcttccccggtagcagacgatgtcaattgggaagaggaaatatcgcgcaaaacgcccggttctacacttattcgagataaaaaaaagacaaatctgaagaaaactcaggctgcgggtgcccgccgcgaagaaattcactgctgtgccaaggcagcggatctcttgagagtgagagggccaagatgccgtgattctgcgcgtttcccgactgtaagcatgaagagactgttttgaaaaagaaagtttccgaagatacaaacgcttcccaaaaacatggaggctctgctttaccaaaaaccgcctcacatacctttcggtgtctgagatggcctgacagcatccacaagccccagcgactggaacgcgcgtatgaatgactgttcgttatcttttgttcgcgtgggatcccgattttacgtggaagaagaaagatgtcgcaagacattgcttcgatgtactcaccactgcatgctcatctgttgcggaaaaaacgggacgtcagccgcccgtctgcatgcaaccttgtgctgtcgagtgcgccgagtcacaaggcccgctaacttgagaaagcatgtggaatttcctccctcgtcacctcctccaaaaggcacactatcttataacaagtgtgcagtctgttttgtctgtagaacgcaaggagaaaacgggggactgttatccccggagccgccggcccggatgtatatgggacggtctgttcgtcagtgtgaatggcgaagaccacggacgagtcgagggagcacggcgtgcgtggcttgctttataaaaatcggtctgtgtttatcttgtgaggctctgcagctctgggaaagtggaattgtgtctcacaggctgcctcgttaagccattaagccccggaagtgctcgcctctatgttgttggttatggaacggcgcttctcctcatagtaagcaatcgtgtagtcgcgcaaacccaaaatctgtcaccctgcttctttcaaccatataataaaca

SEQ ID NO: 597 - DNA, 3675 bp, Toxoplasma gondii
agcttctctggaaaacccgagagctgcagaaagcgtggacagtttgcgaaggccccggtagatgcaaagcgtctcaacttcgtccgaaacgtcagctctcgagactctgtggaataactctccatacacgttgtgtttctgcttcctgcagctgccgagaaaagggtggctaatccaatacgccgaggctgagtggggaagagtgggccttgaaagaagccacgttcattcggtacgccagcgaaggcggagagatccttgcaacacggctgtccacacagaatgagaggaggacagttttgagagaaaacagaacaaggagcgagacagtggaaaaaaggccttggagaggcggtcaggtgggacggacatgctagatacagtgcaggtgagagggagtacggaagggaagaaggcgcgaaacacggagagaaagacacagaagcggagaggcaagcggaagaccgcaagagtagacaagggaaaaatggaatgtaagaaggagagagactcgacgcacacacgcaacaaagaaaggcaagaaaacagagtcgccatgcttcctgccaacctatataggatggtgttcccttgaacccaacgaatgggaaaagaaaacgtcgctctgctccgtccatagagatccgaaagaggtccacgtagagacgggcaggaggaaaagaagagattgaaaatgggaaaacatgacggctgaaagtcgagaaacactccagctagagacaagtcatcaccaccggggcaccggctgggcacctcaccaacaaaaacagttaatagatgaagaattgaaaagagcaaaaaatgctcaaatggttgtttcttcgatatgattaacggtgtagctgatgcacatgtcagtacccggcatgttagtcgccgtacaggaacctgttgcgttgctggaacgcatttatcgttttgatagactcacgaaaagtcaaaaaggaagttgggtccatatgaagttggtgtctgtgttttccaccatttcagaatacatctgtccaaaatgaaaaacccaaattgtcttattttggacgagtttaaagccgaaactatccgcgaactgccctcctcaggagacgtcgacgcggggtaagtccgagatggtaagtcacatgccgcacacctgtcatgaaaaatgtgttttctataaaacagaaataggagaggatagttctagactagcgaagtcactccgagtcgtgaggaagcagaggtttctcagttcttagcctggactctcggcccaaaacgcatgcggacggacaaaatcgccaaggtcacctttcgagaggggggttggtgtacatctagttgcgttgtgccaactgatgggaaaagtggaacgatactgatgttagcatgacacctgtgcaaggataaccagcacaagtcgagaactgtaagcacttgtttctttcttttccggtataactcttccaaaacgcacaagcagttacattagttttcacggggggttttcgcaccggccatgtaataaacctcttcgtggcgttgttctgttgtcgcacttgcggcaagatcagcttcgcaaccagcgaaaattgacggcatggcaaagtcaaaaaaaaagtcacccgcgcgtaccagttgctcttaaaacacatgtttggggttcctccttcactgttaagactgtcggctttttttcataaggcatgggtgccttctcttgttacttcacaactcacccttgagaaggaaaccatggatttgaaaatcaccagcgactccaagattcattccttccggtgcggcacagaccttacaaagctgaattctgaaaaggcttcataagtggtactcgattagccgtgccacaacgaagcggaactctcaggaaaattgcaatttgctaaactgttgagcaagaacatgctccacacgctccctgtggaggaactgcctgagcctccgggcccgtgctgctataattgttctgctaccgatgactgtggaaagaataatgcatcagggacggacggaaccagatgcacggtcacgataagcgtttcagctgctaatatcggcaatgctgtctcgatccccgccagaacaaggtcactggtggcctttctctttatactgtaactatcttctcacttttccttttgatggtcttgtagaacagctctgatggtagtggacggcaggagatgaaacacttggttgaagtccaccaagcctttatgtccagcacacgagtgatgagagagataaacctagcgagaggacacgaaacagtacgtttttttcgacaagaaccatacagcgctgaaaagtgacagggtgactcgtgggcatgacaagccccgtgcaaggctagcgactgagcacctttgttttggtcccggctctacaacgagtagagacggcattagacgggagatctccaacgccatgttcaaggttaccgctaccggctatatctgtctagagaagtgaggatgtcaaagtgaagagcgtcgagaaggcatggtatgaaccacgtcgttcttaaaagcttttgaagggagatcctgttcgttccacggacaacaaacacggttgtttctaggtcacggtggccggactgttgtggtatagtctcaccatctcccttatgattctggtgggacggagcgatatcgttctttgcagctggtaattcgtggtctccagtcgggcaatgaattacactacttacgacatggggccgttcagcggtgtcgtaagcccatttgcagtcaacacgtgttccggaaatagcttaggagaaagtatctgatgtttgtgtttcggctctgtgaccacgctcggttatttttacgaaacactgttctggagcagatgtctgcgggtccagaccgctcttctaatcaatctctggctggcggtgtgcaatatttccagtccgcttggcaccttgtgaaccatctgattcaccatgcaccttacatatcagtgaaaaaagatgcagctcttcaaaataaaaactaaagttgttcataggttgagggatttgatctcgtatgattaacgcttacatatcttgaggccttctctcgggtaagggctcatgccgtcttgcgggaaaccaccgatgctgcctgtctcgatgcagcgcccctagagagattgtcttcaccgcagccgtgcagtgtgacggtcaagacagcgaggatgatagttacagtcaaaacgatgttcttacggcgctcactgtgaggcaggtttccgcggaaatctgccggacaatttcttttttgtagtcagaataggatcggggcaaaaggatttgttgtatcagttagtgtcgtcgactcagagggtccagactgctttcatttctgtttttctcgacacctgtcacggccaagtcttgtggtaaacttcgttttgatgtatctacctccctacctctctactcctgtgtgagctgcagttgtatgtgtgatatggtccaggttttaagaagataccgcactgccccttgaaagtcgtctccagtcactggaaaacggtgattgtcccaccggagtttaggtcacaacggcaggattctgctgaaaagtctgctttgaagagtaactgttggcttgttcacatctgtctcttctggaccaggtgtctttacggcggggaagagaa

SEQ ID NO: 598 - DNA, 3042 bp, Toxoplasma gondii
ggcttttgcgtgtcggcgaaagcggcccttttccattactggtggcggggaaagtccatttagtgcggaactcgaaagtgtctcggctgcgtggggtgtggacgcgacgcagctctttttcccgcatcttccatcccacatgcacttgtggccgccagcagagaaaattgaagcgtggaggcgccgggacgaagaggctcggactgagaatcgcagctttctccagtgcaaattcgtcattggggtacgccacgtgatcgcgcacggcttgaaaagccagcaagagctgcatgcagcgatgacagagttttggccgattctccggttcttcacggcgccttcacattgccggttccggagtgttggtccgtcgagagcgtcagaagtggatggcgctgacccgaagaaggcgcaaataccccgcgcgtttcgacctctcggggaggaagaggcctggccgagactggaagaagacctttcgacagtcggtgagtctttactgaaaaacgacctgctcggggaaccgcgaaaacgccgaggtggaccgacgctcaaacctccggcgaccccgccttcccagcctgctgtttcgctgcttccgcccggactttcggccgggcgaaacgagctggggaagactcgggcggaacctgtctctggaaattcacctggtgctcaaaacggcgcgcgaaaacggactgatatgttcaggccgactgccgcgggcctgagcgacgattctgcgagtctgcagccgcgtgtgagagttgagagcaaggcggagaacgtggactggaactccgttcacttgggtgagcagacgagcttgtagaaaagggaggagaacgggttatgggggggagaagggctttcatagcgtgtgacaggggacggaaagggagctccatgggagaatgtagcggacgtgaagcgcacaggttgggtctgctggccatcacgccggagactccacgagcgtctgctcgagttgcgcggatggaagaaatggtggcagcagcttttttctttggaatgaaatcagatgggaaacagaaaattgtcgcagataaggctgaggaaagaagggcggcgtgactgatgaacggttcagttctctactgtggacgtggacaggagctgcagagccgttagaaaagaagtgcagtgtcagtgcctccatcgtttgcgaaaaaaacgaaacgttccccacacagctgcgacggagtgtgttgtgcaaaaccgaatgcgaaccatgtttctaatagacatgtttgtacggggttctaggtccccggtgaatacagatcgttctttccaaaccgaccttcggccgtttggacttttttaaacgagcaaacaggcatcaaacagatgtccgcggagtttttcatgcagctagaccacaaaacacaccaactggttacttctggctagggggtatgaatccgtcacggacgcacgaccgggagtacaactagatatccataacaaccgaagcatacgatgagtttagtaggaaacttcggtgcaggaattgaacagataacttacgaatctctggatacgcgtgatatcgcgttttaattttgcccctgctcgcattgtcttccatttgtcgcctactgaaagagattggtagtgaaccttcagtgatgcaaacactggggggttcacagtccctcaacaaaacgcgacggagaaaaattacaagaaccggtgctgattctctaggagacgttttccttatttctgtcctgcatctaacactgaaagaacgtggttatgtggagtccacactggggacatgcgttacggtcacaatgaactatgtttcttggaatgatgtaatgcttgcatgctcgtggtcactggcacctctttccgtcgtgcgcatcaaacgagtttgcgctttgagaactctccaactcctgcagctcaagcgactacaaatctttattccaggggtttggatttctgaataatagaacacgcttcctcaaagagcgaatgacatcatgctcgagtgtgtccttgcttgtgtgtcttctcatctgccacgatacatctagcgactcttcctttaccaaaagaagcaagtgagatccgacaaggactgccggggtgcatgtctcgttctcgattcagcgaccaatacccctgcactagtctcgttaaatatatacgaaaaaggtttagttgcactcgacaacttaggcgtgtgattctcgctccccgtctctgctggtcctcaactcgacaccgtgcttccgtgtatgtggaaaactacagagactgtcgctcctgagaaacatcgtcctgcgtcgagtcttcgagaaagaaacctgtgtttgaccgtaccctcgaattagcaaccgcggacaaggtgacaaagatcatagctaaacgatggtaattttcgcattgaaagtatattgcctcgctgcattgaggccacgagacgctgaaggcatgcgagctgtgaactgcaagtatatgatcacatgcctctgccgtctagtatcggatgctagtgaggtcagcataccatcgtactgggatgccagttctccacaaatggaattctacatattgattcatttacataaacgtgtatttacaaaacaaatggtactcagatgctagtatggtccgcgccatcgtaccgagagtcatgatctatgcggactatttataagcttttcaggggagcatgaactacgagttggactacgggttgacagctcaggcttttccgtgaaccagaaatcgcaccttcacgtcgttttcctctcatagggacttcggaccgtcctaccttatcgacaggttgtttctgtttccgttagagaggcttttcccatgcactttccgtgcgttgaaagcacgcgtccagtctcggcttccggacggcatgcagttttgactggcgttgtttgagtccactatctgtggggcatcttccctgcccgttgccggtgaggactgaaattcgtaagtggtccctggttcctcaagtaagatcgtgtcgtttttatcttcaaa

SEQ ID NO: 599 - DNA, 2096 bp, Toxoplasma gondii
aggtctcacagctctctgcatgcgagcgcgaggctttttcgtctgcgtaccgaggcgtcttgggaggcgtgagacatgcgcgagagagaaagagcgccatcacgacagctttcgagttctcctcggcgacggttcaccaagtcctgctgtctggttgctgtggacgtcggagcgagacaggggaacaggcagaggactgaggcttcgtctccctccgtctctctcgccttgttgatgagtgttgaagagtcacgaacttgttcgtttctgctctagctcgtcttctcacactctgcgtcctgtcatcccaggggaaggcagagaaacatggagtaagacgaccaggtcaggagcgagaaaaaaggtgaggcgtggactgcctggaagtccccctcaaattgaatctcttcctctcctcagttcgacctccctctcaatcacttgttctcaacctctctctgccgatctcctcctacttcctctcctcgctcgtcatcatcttcttctgctgcttcttcttctgcttcctgttctcctcttgattcttcttgttcttcctcgtcttgtcctttccaggcgtcgccacctgcctcgagtctggtaggttttttgaacgcgttcttcacatggagctgacggagacgggagagaagcgaagcagacgggagatagtgtctggtggataccccagagaaagacagacccaccggacgccaagagagaaagaaaacagatcagtcgtcgccggagagcatgcatgcgctgcagcgttcgaagaaagcctttgcaagagaagaagagcctgagatttcggctgtccctcacccgtcgtcgacggccgaatcgagacagcgaaagcgagatctctgcttcttctcaaacgcaggcgcgcgtctgccctcgcgccgttcacaagcctctgaggactcgcgcagcggcccaggaaaaaaacggttcgtcccggacactgaagagtgcaggaagtcgttctggttttttttcgtctatcgaccgaagcgttgggatggaaagcacgaacctcgccgtgtgacgagctcctctcccgagatccgcgttcctgcgcgagggcatcttccgggagaaatccacgagtctttgcggaactgaactgcttgagaggagagttctggtctctgtattgtgtcctcctcgtccgtgagggatcaaaaaacgcatgcaatgacgcccgagagccttcgcaagcgagacaccctcgacagcagtcctgcctccgccctgtagttccgtcctgcttcgccttggatcttttcggcttccttcctcttttcctcacgatctgcccttctctctcggctgccagccatttctttctcacagggtggaaacgactgcggcgctgaaactggcctgggcgcctttccgcctcgccgcagctgcagttgtgcgccgctgcgaaaagtcgaactcgtgacagacacaccgctgtggcgtcctttcccgacagatatctgcacacaggtcccgacggctttcctccttcctcttcgcttcggcgcggcttttgctgggagcctcgccagttttctcggaagaaaaagactttttcagctgcacactcggctgcgacgggaagagatgcctttgcggaaaccgcctgcatctcctgtgtgtgtaaatacagagattcggtcctcgcagacactctgtggaggcttcttcgcgtctgggtgtctcgtttcttcgtttctgcaccagcggaaaaatctcgggtgtgaaacctctcgtttttccgatatcgcgccgcgttcttctgtctgcgcgcacagctcaagcgaggcctccaagctcgggtgacctgacagctgctggccgccgccaccctccggcgcattcggaaattctttttctgcgccgacacagtctgtctggctcgtcgtccagcggaacagccgccgttgaaattccttgaaagtcctctggaagaaggccgcgtctccagccggtgcttggatctgtcgactcagccgtagtcctttgttccttgcactcccaggtgtcgactctttttcctgtcgtttccctccgccgtttctcgccgtcattcttctttcgga

SEQ ID NO: 600 - DNA, 3730 bp, Toxoplasma gondii
cgcgtgtcgcgcatgcactccttttgtttgctgttcctccttaggagttggactctgcctctgctttcctgcgtgccgcaggtcctcgagctgtccgcctgactctgaagcgatgctacgtgggcactgtctctccaccttgtttacgcactgggtcggtttctcactcctgaggcgacgaaaaacgtctttgggggccgttcgagacgcttgaaggtgtcgaccagaagccggatgctgttgacgcgactgtccatgatttctttctttttcgcgtctgtccacgcgccgagggaacgaagccactcctcgccactgaggaatgatcgaagcttctgtccaccccaccctcctgagaagtccctcgtcgggacctcgtcgtctgggcctgtctccgctccttggccttcaacgccagacacggcctccgaactttgcgcgcctcctcgcgaggaggccagtgacgcgcggtcaggcgccaactcgcctgcaacttctcccttctccgctaaaggctctcctacaggggaagcgaaaaacgaaagtcacgcgagtctaccgacagaggcatcgccgcaaatgcagaaaatttgtcgggcgcatgaacgtctctctctgcgtttgggtcaacagctcgtggtcacgggagacgacgtggacaaaggtatacagcgtcatcaactcataattcgtgaatattaaaaacgaaaaagcatgcaactcgtcacgcattccaggacacacatacacatatacaagtatacatataaaagtatatatatatatatatacgtatgtttatacatgagtgagtatgtatgcggatgatgtgatgtctggcgcacccgctaagtggatgacggcgtcgacaccttcgagtttctctgcttcgatccattgattggggatatcccatagaatctcgtcctcctctgtgttgtttttcgctgtatggtctgcttctgaagctgcctgccgatctgccgtcgccccgcgtgtctcttcagcagacgggtctgccgggacctgcgcgtcttgtagctctgagggcgacttcgcgtctcgtcgcagcgtttcctcagacgaggagctctctgcggagtcctcggctttttctgcggcgtccacaaaagatgcagacggaagaaacgcaggacgagggggcagcggagactcgccgggagccgtgctgctcttcgtcctcgaccgcgagaacgacataccctgcgacgaacgccgttttcccctcgtacgcaccagccgccggcaccgcactggacggccgtcgatcttcacgttgccatctggaggcggaacgccacagaaaaaactctggacagacatgcggagtttctgcagtccgatccgaagcgccggcggcggctagtgtttcttccacttcccgtttccgaggaacgcgactgtcagtggcttcgctgaaatatcggtttctaggtgccagatgagatgcgcaaacgcttggtgggaacggttttcttttcgttagcaactgttccaaacacggcgcctgaacgcgtcggtcgggccgagaaacagtgcatacctacctcggaacatgtcgatgagaaagccgcccagcatgccatgggatccgctgatgacaactgtaaaatattcattttccccgtcactcccgtcgcggaaaagcggcttcgcaggggaaaacaagttcgaagctgccttgacgagagccgccatcgggctcgcgtgtccaggcacaagaggaaggcggcgtctcggtttggcgcagattagacggcgagaaagaaaagcgaatggcagttggcaagcactctttttcagtcgcgttcggctcctgaaaaaagcactctctgcgtggccggcgttcgccaggcttttttgtagtacacaagaggaaacagcctcgacaggtagccgcgcgaacgcgcagctagaccggcagtggtgacgtttcccttttggcgggtccgcttggcggggaactcaattgcatgaactcggcaaagacatgcgggtcgtggaaagtcatgtggaagaggcagagttgcgaaaaactcaagttcagccttcgttccggtgtgcgtcacaggctcaggcgaaaaacatcccgtgcctgcgccgcccagctgccggctgcggcggggagaatcgcatgagttttctccagttcttgcaggcaagagcgcattttgactttcagcaggttcgctgaagcagaacgcgtgaccgaaggtaagggaagactctcggaaactcgaaatacgttcgagttcgtctacctcgactggagcgctagcagggaggcgcagcttccgggcggctgtgtgtcctgtgcgaatgactcagcacggggggcagagccaggaccagcgtcgagtgagctccctcgttcttcgagcgccgccttgcctcgagtcagtttctttttcccctcgcttttccccgagaaccggcgcgtgtctgacggccaacgcctctgcctctcgccacatgttgcgggggagattttccaggaggccgcgcgggcgagatccgtccgccggtcgttgtgtgcacccgccaagtcgccgttgcttggaacacccgcagaatcgccgtttctccccttcgaaaaatcttcacttgcccttcctctgcaaatgaactgggacccagacgcgcatgtttttcgagctctccagttaaacgagcgaacacactgattgctttcaacgttcttcgccgtgctgacgaaaaacagagtggcagaggctgtcgcgacatgcgcgcgaacgacgctctctctgctgaaaacgttgtttgaacgccaggggcgacgcgacactgggagtcctctggagagtggacgttttgacagagtggcgactaagtcgagaactcttgccaagtgaagtcatcgagagttcgaggtctttctctcaacttgctctttcacggggaagaacaagtcggggtcgagtctccttcttctccagctgcgacagcgtccgtcgtctagatagagtcctcgagagagagttggagtgtcgcgtcggcacacgaggcagacgagacaagccgcagagcatcagcttttgcgtccatacctttttcgcgtttttcctgaacaaaacgcgtctgagcgttcgccgcatgtcggcgtgtgtctggacttcctcaatttgtccgtctctcacactgggccaaccagctgaggtaaaggatcagggaacgggagagcggacaccggagagaccctcgaagtcgagagacagcgatgttttttcggagaagagcatgtcgtcttctgtctgtctccggaaaacgaaagggtgtgcgtttctctgaggacgctttgctgctttttgtcgcatgtcccgctccccgtaaaactcggcttttttttctctctctctcgtctcctctctctcgcactgtatttcggtctcctctctctcgcactgtattggcacgtcggtttctctccttccaccgtcttctttgctctccgcttcagaaccattcaccaccttcttgtctcgccatttcgaattattcttccggccgtcctccctctcgttgtcaacctgtttcgcctcttcagcagtctctcaagtgctactgcagtgcctgcgcgtctcctctccgccttgccttcttctgcacgaagggagactccaaacgcttctccctgctcaccttcgtcagctggcttctgccttctgcgctctccgcttcaccctcgcaa

SEQ ID NO: 601 - DNA, 1422 bp, Toxoplasma gondii
atacaatgtcttgccgtaatttctgcgtacaacagatgttgtcgtactgcacgcccatgcaaggggacgtgacatgttgatgattctcagagaagaatcagcacggtatctggtaggatgtgtatttcccttcttcaaaagatgtgagcggttttggcaggctccaaccgcagccagtctctgccttcaaaacaggaaaagccaatccgagcaccggatgcatttggtattgctgcagtgcaccttgatgctgctgtgccgcgccaccagcaaagcgctgatttcaagagtcgagtgcctgaagtgttagtatggcgccctttgctgatcgtgccgcgagtccattgtagatggaacgactagaatgggcactaaaaaagcaaacggtcgaatacaaatttgcagaactcagtctttctgtagcatgctgacgaatgaacgcactccgtgatggacaggctgtcctagctctgctatattccaagcaaacgcagtacacctgagatacgattgaggaggcgcgtttaagtttcgttagtgacggagtccagccaatctcgaaacagatcgaggtcaaataagaatccccctcattacgttcgcccaacaacagaacttccccttgctaccaggggccgcgacgagcgtctcacatatccgtatgctgagagacatagcaggctttttggagctttatgagtgtgcgtgctcggagggggaaattgattctgtcatgacgcaaatttaccgaaaacgcggcctcgccgacgcggtgatgtctgcgcatcatgacaatagactcttttataccaccgttgaaaaagatcgtttaaacgttgctacgacgagcaaccacagagacagatcatttggcatgaatcagaacgccttgtccactgtaaaacactttgcagatatgatttacactactctcattattgtgtggagatcgagggcaaaactcccaatcatccctacattgatcgagtttcgcaatcactttgctaggtacgtttttttcagtaggtcgaatatctatgaggccgtgggcctgtttcgttaatgtctagcaaacggtagccgtgtcatgacgttacatgttctacgtcattccccgaaagcagccgtgatgggagcagaagacgtttaacccatgagagtgtttgacgacaatatgctagcgtccacaatatttgagatgcaaagttttctccgtagcggcaaggaaggagtactcttggaacgttgtgtgtgaagtggatgctgttgtatgtacacccttcatgacgtgaatttttgggcggccccctgcctgacgactgcgtgtctttcccttttccgtaaagttagttctctgttccgcgcgtaactgcaaatagcagacgaaaagcagtgttgagttcctccatgcaacagtcaaca

SEQ ID NO: 602 - DNA, 3459 bp, Toxoplasma gondii
taaggaaaaacttcaggcaggctgcaagtaggtacacaccactcaccatgctgcggtccactgcatgagaaacagaaagacaaaacgtagatgaaatgtatatatatatatatatatgaaagcatgcattcgcgtatgtggaagggaaatacggagtggttgccctatagacacttgcccgtgtatttttcattgcgaccatctgtatgcatgttgggtgaagcaccgcaaaggacgaacgcagtgaaccgtcacttgtacccactgatgccctacgaagatcgccgaatcagatatgagtacacattcgcagagtcccactgctctctgagtgaccatagaatagtgtaggaactcctagaaaaaaagacctactcatgcaggtacataactcgcattgggaggttgcgaccttcttcggctccgcctgcggccggcttcttgtcggtgaggtggtccgtctgcaggctcccagcactggtggtgtttgtcccgctaggggaccgttcgggtggcgttgccattgctgttctacgtcaatcacgtttctggaaaaaacgacaaacgttgtttcttccaaagaggctcagggagcaagctgaagcggagaataatgacccatgaaaagtctgcgtcgtgtggcgggccgttgtctttgacgatgatgtacagaccctggaaaaatcgagggccggtcgcgttccacttgatgcagcgtataccgagggaaaacggacagatttctttccttgctgaactacgtttgccgaaacgcactagaagagccgaatatacgttcgtgggcctattccctggtgggtctctccttagtggcttccccctggcttcccctctcattcactgtcgagtcctcgcttccctttcctgtgtcaacgtcgttaaaaatccgagctcgccacacatgcgtgccacacagctgacggggtacactcagtgtgacctcgcgagttgtccccggtgcagcagaaaaaaagttgcgcaccataatacaaggtctccgtcatttgcaaaaagtggcctctttctgttatggtcgcggcacagctctttttttgtccgggaagcgatgcggcttgcacagagcctgtcgttgcgaaggaggggctccacaaatgtcggagggatgaaaacacggcaggagatggtgagaaaactgtgtactagaaagaactgtatgggagagatggaagatgagcagacgcgcgcctaactaggccctgggctcgaacgtcaagcacggggtcggaaaaaacgtcgtgttcgtgccagtcttcttggggagccgtcgcgtctccgctttagcgggcagactctgcgtagaggcttattgtctctcccgtggtcgcctcgcgaactttttctcctcgcttaccctgcgtcttcttctctggaatttcatagagatgaagcgatgacaaacaagataaagtccggcaagatgtaatggcgcggcctgcacgttttcgattcaagttcaagctgttgggctagggctagcgcggctgagaaaactgggctagcttatccggtcagttttttttttgcatgtcagctggccagtttctgccttcttttctcgacttattaccaaaccgtacgacttgtatgcgagatctctcctttctgcacgcagggggaacaaaggtctcggatattcgcgtcaagaaagtgcgcgcgcaacgggagatggtgggccggcacaacgcgccctttcctcgacctcctctgcggcggaggcgggtagggtggccgcccataccgaccctctttgcgctgctgctgacgcagactgcgaagcgtttcaatgtgcgcgcgtcgacaggagcagacaggcactctcccccctgagaggggcggtcgggtgtatgtacagcctagctgtcacatgcagactcacagcatcatcgaggaagtcgaggttcgcggtgtggcttggctctggacttcccaggggaggttgtcgagagacgtctaactcgggtttttgctgtactaactgtctgtcttccccaagagtttaggcgctagtgggagcgagaggagatccattcagacaacgtttctaggcctaagttttctctctggagaaggcgggtggctggatcctgcccttggccgtgcctgcttcccgagaactggttgtccccggctcgctcggtccgtccgtgtccatcggaattgtcgattttcggtagattagaacttgcgcagttccgtttttttgcgtgaagagacgcggcagctcctgacttcgcgagcagatctgaccggtttcagtggaatgtgccgagattttgatattgccagcgcgcgaacctcggtatctcgctcccccccgacactctcgtaggggctgtggctgtcacaaacccaagcaggtcgccgagctggaggcctgtgcccaagggttttcaagttagaacatgtaattggtttcgaatgcttattgcggattgtaataccggaggagttacaggcctcttttttcaatacatcgggtcgtcttttttaagagactgactgtgtccgaacggtccagcttcggtcttgacctgtctttgtggcgggtgagcaaactgaagaaagcaaattacgcaagtctttgttttgtttagtctgtggagatctcgtgtagcattgtggacagcgtgtgccagcagtgggtgtaaacgacgagaatgatttaagccacggtatgtctagcggtctctcgccggagccaccagcgggcgcgccctccagatggaggacttcttccatttaaaaaaaggctgttaactaccgtttgtgacgttagtgtttttccgaggttcagaatctcagatgcagcatcggagccaagcatgatatagacctgctataacgcgtataacggtgataaccgcatgccacacgccagggcccggcggtggtgggcatgaacagtactagattacgtcacagaatacgcaggcatctccatcacagtggtgtagaacagatttgtgcagaactgagttgtagaccgtttggggcggttgaagacatgtgtaggtttcacagactggtctaaactcgcagttccgtaggttgcggaaacaagccagaagcgcccgttagggggagatgaggtgaacaaggcgggggaggatagatgcacgtggagccttttcattaagaagcagccgcatgtgtgaatgggaagacgtgctgattgtcgcaaggacgggtaaatgtgttgtgttttggcagattcacagtcaccttgcagggttcagtcgccaaggtccgggcactgtgaggacggttaaggcattctgcccataatgaaggtgcaacgcgtgcgttcttctctttatcagattcacagtcagaccgaacactacagaattccgttgcctgggtgatgacattcagcaggaaacaggagactctcgcacagactgcacttttccacta

SEQ ID NO: 603 - DNA, 2158 bp, Toxoplasma gondii
gctaagctgaaatcctcgcgtgagggaggaagcgattaagagagaaccggggagagagacaaaagggaatgggtcggggaaaaaacagagaggaaacattcagaaaacgacgcctcgtcggaggtagcagcgaggcaggagaactttagagtgaaagacgcggccaagataagtaggaacaaaagaaatgtgatgacggacaaaagagacagagctggaagttatgcggcgggacagagtgggcgaatacgggcagaagtgaaccactaggagtgcgtgtctttgtcacccaccagttaactcaacatcgagagcaacgaactctgcttttgccaggacctcgcgtagcgcctctaagtgcgtcggccatgattctctgttggtggtgtgcgtcgcatgcaagggagattcttccagtcggtgttcgcgatcggtctcagagttctgtcgcggaagcgtcgagaaaaactggagagtagaaaaacgaaacgcggtttgtaagttagtccgggcaacctccctggtgttcaagaggctccgcgacagtggagcattttcgcgagaaacctcccacgaaacggccgatgaggcggacgaagagaagacagaagaagacgaaaaggcacaacacgaaaaagaaaaggggaaacgaggcggacaaacccgtggaaatgaagagacatcacgccgaacagaattatgagccggcaggaacgcttccgtggtaggctccgagatgtatgtacacttgaagctttgcggtaacgggtagcgttggaacgagcgaccttcgactggacaaaaatggagcggcagtcgccgcccacagtgtattgctttctccattgatccgtggcaagaagatgcagtagaggaggaagattcgcacagccgatgtatgtccgaatcaaactcgagagggttttgttcgttagtcactgcccactgggttgttccagctccaggagcgcctcccctgcgggggtttggggtgcagctgtgaccatgtcgcgttcttgacgaagacgccacgaaagatgtggacgcggccacagcagaagaatgcgttatgctgtttgcaagtcggttagcatcacatcttttttctgaagccctggtgtaggtgctgagaaagccgctcggcacctgcccttttccgggcaaaatagactctggggaaagagattcgtgccgcgtttcggtcggaagcccagaaaaccgaggagatacttgccggaaggcagggattctctgcgtcaacgagcaccgggagagaagcgggacggggcaaatccctcgagcgagcggcgtgttccgcatattttgcgggtgaggttagaggaaccagaacgttaacagagggaaacacagaataacttcgcgaaaaggaagagacacggggaagatcgagcatctaggcgggaaacatttggcggcgtgaggaaaagagaagtggatgtagcgggcgtgtgtcgattgctgccgagtttgcgtgttggggtcattttttcgcttagggtagaagcgaccgcgcatctgcaccattaagcgaacgacatagggttgcagctttctctgaatcgtggagagaatgatagaattgcaagcagtttggaggagacccgggtccctccgtcgaactgtgggtcaaatgtccctcgagagaaaagtcagcttgtcattcttgcaagcccgccgtcaaggaactgaaaaacgcgtcccgcttgccttactctttttttcgcttacatcggctggtaaaacagctacgctagggtgtcgctttcttcggagttgtagatgacgcagatgtggttatttgtctgttgagacacgcttaaagccgcgttcctaaggagcactgtgtggttgtgcaagagtcatgtcgagacaagtcactttctctctcgatggtttaactgtctgtagatgtgcgctgttcggcgctgtttattagggtgcatgtgccatgcgcctctcggctctttctcccgtcgctccgtcgccgttcctcagtattagttcgtggcgccccacaggcgcaaccagaggttctgctctctccttgcgcgccgggcgaaccagaggcgggcggtagttgccgtcgaaacactttcctcgggaagtttcagagtagaatttttctacgtttgcatta

SEQ ID NO: 604 - DNA, 1900 bp, Toxoplasma gondii
ggcgatgcgtttctcccaagtcgaggacttctttgcgctggtgaatccgtccttccctcgcgggtcgcgcgagagaaaacgcgagagagagacgcctcgcctgcgacgcgcactgcggcggttcaggcagcgcgaggcggatcgatgcctgctgcgtctcctgcctgactctgcctggttcgcgaggcaagtctgacggccatgcaagggagcaacttcccggcagaggtccgcccatgggcaacgcagtcgcgaggtgccgacccaagcctcgagcgcgttgtgccatggtgaaagagaacgcagagaaaaggagaataagcgagagagaagaagaagagagagagacgaagaagagagagaagaagatgagggagacgaagaagagagagaagaagatgagggagaagaagaagagagagaagaagaagcagatgagggagaagaagatgagggagaagaagaagatgagggaaggagagggaaaagaggaaggcgagaagaatgagaagcaggggacggatgaaactacggggggcgggaaagtaaggaagaggaaacagaggatggaagaggtgctcgagatcctggcgaaggaaattcgaaaaggaagaggcgaacagaagagaaacaagaaggatgagaaagaatgtctgcaaacaacaaagaaagacgaaaaagtctacggcaaccgccgaaagacgggaagttggagaggagcgacctgtgtgacagacagcgacagaaagaggaaacgactgaggaggagacgacaatttcgggaggtcgaaaagaggttttacgcgcattgctagcagtcgcagtaaaatggtcttgacctgagcgcacagctagaaaggcaagaagtagagagggcaggaggcctgagaaaaggttttcagagaagaaacgaacgccaggagcttttattgttaagaaactcggttgccggttcgacggccgcggagcgcgacgaactctgaggtgtacgtacacgccatgtttctcccgcagatcactcttcttgtcgaatgtcgaagatcatcacgacgattcaagacgctctgcagcctctctgggggcgaagcgtctctccctgcagcaggtgagaggcgcgagacgcctttgtagatttccgatcattttctgctcgtccgaagagcgctcgaaaaacgccatccagctggcgtcgtgaatcccagcgtcgattgagtgcatgtgacctgggccgcgctcgacatggcggcggcgccgaggcaagactccttcccttctgcgtcttccagcagaaacagtctcttctctctcctcgacaaacagtgtttgcgggatacgaggcgaggaaaaaaagattctcttttcgccgtctgccaacaaaggagggaaggaaagtcgagaaagcacttgggcacagagccatggtgtgtctctgcatgcgcggggaaaacgcggatttcgcaagaatttttcttgcatgcacgcgagaaaaagaaaaggaaaagagaggtcgctctcgcccctttgggaaggcgttttttgaccaatcgctcgtttttcactgtcaatttcaccctcagtttctctccgcgacggtgacacaacagtgcgagcctgcttgactcccgattcacacgaaagtctgtcaactttccgtcctcgacatcacgattttcgttccctctgttagtctttctctcttcttcctctccccctcacccgcctgccgtagccatccagcaggcttgtcaccggcgcctcgcctttgtctcttatccacgctttttctatctttcctctctcgcgcctcgccactcactcgactctccgtctgcttctttctcctcgtttttctcttcagttcctcgagctgcgtgtagaaacttccgcggcgccctctcta

SEQ ID NO: 605 - DNA, 1911 bp, Toxoplasma gondii
tcgataaagaagcatttttctcaatggtgcttaagttagtttgtgaacagtcgtgtgctgctctctctcggggacgaattgagaagtgcgtgctgcctcctatttcttctttactcttaagaggttcaacattcttgaaagatcatgagcgtatctattttgaccgggaagcagggctcgcgagaaagaaacgagggatagctccatttcggggtttcgttgtcgtgtataacgcggtacaacagtcggcgacggttgtgctgcacagctagggactcagttttcgacagttgcacaacacacagaaaagaaatgtgcttgccaggtaggcaagcgcctgtttaaatattgcaatgttacatccgtccagatactcttcgattcagaggactgctacagtaaccgtaggtctataaataaagcgatgtcggtatgtataaaatacggcttcgaaactgcgacggatttaatacgccacaactaactcctaaataaaatattaaacagcgctcataaagatttgcacaacctaattgttagtttcctttcagcaggctgacagtcactgttaaattccttacggagatagacattactttacagccgggcctccatcaacatggtgtgctttggacgtatggcggactagtatagtttcacgaataccatccgtaacaggttgtataaatgccagtaaggaagtaggtgtgagtattcatctggtcgtatacattctcctgttgttgtgcctcatgatttacgataagaacaagcattacacttcgtgtcttgttaaactgagaatttacagttacggggccattccgtgtcaagactggggtcggcgtaacggccagattcgcgataatatactttcaatcctgattcgctatttttctgagtatgttccgtctgagcattcgtcgattgctcaatgtttatctggatagggtttcttttttgccgctttagaacacattttgtgtcgcattattcgccgcagagaaatatgagatgaaggcttccaaaacagaggtgccacagcaagattctgtacaaggatcgaagtagttaactccaacggattgtatactcgccaggaggacagccgatacatccctctcaagcaagagaaaggtacccacagtcatcaaaaaaaaccgataccggttcgtatggaataatgcgtgtgcttggtaggggaacgtgggcagcagctattgtcgaactaagatgagttccgtctaaagtctcttcaaaaagaaagaccagccttcctctagcgtcaaacacacgccccccagcacactgacgcaaagacagcggaacactcacagctgcctttagtggctcttgtgcgtctcatccgcgtctctacgtcgtgttttgttgacaggtcacgcaactgccatttctttgtggattaacgtctgcaaggtccgaagttagctggcttcattctccgtttttgctacgcatccgcgctgcggcagaccatagtttaagagggaagaactcagccacttgagatttcgacgtcttccgttctgttgaaatgtgttttgaacgatttatttttcgtacagtacgacgtgtatttatggctggtacgagaactgttgagacaagctcacccattcgggcatggaatcagcacgcttcttgtcgctgttcttctgttgctttactacggtcacggacagggcactagtcacatcgtttacagttttctagcagccttttaatccacagtcacctcttcttctgggaagccaaagaatctccttgatttgtcacggatgctttatttttactcatacgtaccactctcaacacccgaaagctgacacactccacgacgtatacctttttttcctttctcgaggtctggctctctccccacgtaaacga

SEQ ID NO: 606 - DNA, 2528 bp, Toxoplasma gondii
gatatcggcctttggttcgggcacttcagaacgaattttcatgagaaagtgagcgacttagtctcgccgtcttgcgcgcaactgagcgctttttttacggggacggaagctctgtcagagtcgtttctggtttcctggagaacggacatgacgagaagagaaaagcaggcgagagaatctctgctgttgatttgcagaggcagcgaaagagacgtcgcttcaccgtccacacggagatgccatgaacattgcccacacacttgtcgttacgaagagaatcgactctacaagagtgagagcccacctgcacatgaaggcaacactgcccccgggagtggaaacacactgcgaacaacggcgagcgtatatcgataaaaacagtgaggggacgggtaaagagagcaaacacccgcaaacatgaagaccgagaaagtaagatgatttcctctgctctatagaaaagcaactgtctacttttatcgttcctgaatggtactttctagcatattatttatgcttttagatcggttggtacgtcacagcaaaaacttgacgctaactgagcgaggtcaggggctcctggatgaacacacacgcggagtgtaaactccctattcacggatgccgctcacgtttatggaacttgcaacagaatcagctgagccgtctgttgagacaaagcaagaaagacacattacggacccagaaatccagagggagacatgattgtgggtgactcatgcctacacctaatgcaagaatgggttcctccagtggctccacaagtgtcaggccaccgaaaatccgtgtattccgcgaagacgagcatccataaggagactgcccaagtgaatgctatgatacctgttcgggtttttcgccgcgtgcgaacaccacaagaagtatatcgcacgccgccgaaaaagaaagaggaacatttcaaccacggcgcttctcgagaccccgaaaactcttcaccccagtttctccatctgtttacaaatgcctccggggtggaattgaaggcttccgtttcccgtatccaagttctacagtgttagcagagcaaagttaagatgtcaactattgtagagctagaaccaaccgaataccacgtatcagtgtaacaatgtaacgaaagaagtcatggcagtctgcagccccctctagtctcacactcgcagccggtaaaaacgctgctctgtgtatccactctgcatcgagatgcctatctgatcaacctcttttctttgtgtacactttgtacacttccaccgctttctctaatctttgagcgttgcctgaggctgaattgaagcgacctcttgtttccgagtgtgccattagtgagccttttcaatccgaagcagtcagaaaactggacacaacgaacctgacaagtctttttttcgatttctatggcgaaaagacatcaccccttcccttttgcgggcagtacactgagcccgttgcagagtttttaggctgggtgtgaggcagagtgagagcaggaggaagtcgtttgtgagtagaactggagaggcttcgtccgttccattctaggagtacacacacgtcgctggagaacggtacgcgcagaacttcacggccgttttgttgaaactttacggctgctgacaacgtaggctactctctgcacagcatctgttcgtggcacagcgactacacacacctctctggttggatgggtctgcttttctctaagaattaggaagacacgtgaaaaaaagttgggtttcaacagggaatgagacatttttttggccagcacccttcctgacgacgaaaccgacagttttgccgttcctgtgtcttgcatgccgagatttcaggtgtcgcgttcctcgtttttctcgacttttcgcccgctgccgttctgctgccttgcgctcgccgccgtttcccctcttttcttcgtgcctacttcgaaagctcgccgtttcctcttttttctccgctgcaacttacctctttcctccgcgctctgtcgcggtgtccgtccctgttggcatgcttgactcactagcggaagttcgggtcccgtacctcgcctccgcgtctgcatctttcttttaggtttccacttttttgtacaacttttccgtctctcttcttccccgtatcgacgacaaccgcacctcttcttctgccgatcttcagagtctttgttccctctcgcaactccgcgttgctgccctcttccacgatttcacaccgacgcagacgccaacacagcaaaaagcgacttctgcgtgtaagtcagtctctgcccaaccggagtgcccctcgcaactgcacgttcttgcatctttccgcgtccaaagagcgcgtcgtccctcacgtctctctaggacgctcgcggctgtttgcccctccgcccccccggtagtctccgtttcttttcgacatttcactgactcttccgttgaaccggcaaactccgctctcgccgcactcagtctctacacaggtccttacactcgagtcgctcgcttttctattcaaga

SEQ ID NO: 607 - DNA, 2189 bp, Toxoplasma gondii
cgaagcaagtctcctgacaagtctttttccgccgctgctcgtcgacgcactcctcctcgttgtcgatctccagcggcggcaccaggatcagcgtctcccccgccgacgcgactacgccgccacacgaagcacagacgttcggtcgactcgacgtcgactccgcggaactctctcccacagtctccgctcccgccgcgactccatgcaggctgtcgccctcttccacgtcggcagtgctgaccgacggcagcgcttggcccgccgacttcttcccctgaaacattgatcccagacacgaccgcagaaggccgggatgcttctctgactctcccttgctctctgcgctcaacatggagttgcctgacgcttcctgacagctctccgaagacgcctgcgagcaggtacagtaccgcatgcgtaggcgcgcctcggagccgcctcgacagctcgcgcttctgcctcgaccgaagcaggtggctgccagggccgccaccggattcgccgacaagcagcaggagagagacatggtgagagaacggagggacaaagggggagctgcagaaaagcctctgaagaactccccaaagcaatgggtgatgaataacttgacgctcagacagacctgaaaaaaaggcgagagcacctgcgtggcgcctccggaaaaagaactgctcttgcgctgtaaagaaacttccctctagaaacgcaaataatacgagcctcagcgacggtctctcgacaaaaagacgcggcgattcacttccgctgaaactcgaaatctgctgcgttgcgcaagcgctggtccggggaagaacggagggggcgcgcgcaggccactggcggcggctgcgtcagactgttttctgcgaaggagcagcgatatataggtagccacccaagaacaaaaagcgctcaggcttggattgaaaggaatcccacaaaagaaacgagcagcctttttcagaggcaagaacagcgtcgccaacggcttgcgtctggactcaagtgattcgccatcgtgacctgtgttgctggagaggacgacggagcaatcgcctcgcaccactcgaagatggctgcttagaggtgactctgaacgccaaaaatatcgcgaaaaatacgttccctgtgaaggcaacacgctgcaaaaggcgccgaacggaagtcgcccgagagcaggcgcacagcagggagtgtgaggaaggcgcaaaatgccgaaaaatgcaaagcgaagcgcggcggggagggcgtagaactgtaacaagaatccgcgagagacaaatatgcgtttccctatatacaagcgcgctggctgatttctgcgcgatgcagagtgtgggccagacaggagaccaacaggcgataagacgtttaactgcttctaaaaaaatgcaagggccaccggccagaaccacgaagggcgcttgaccatccttagaggcaggtctctgaagctccacgagcgtcaagagcacacacggggtatcagagggtggtacgcgacgaacgcggggaaaagccaaacaatattgtacaggcagacaacgccgagataattcaggcaacgccactatacaaaagactggagggaaggaaagagcgaaaagcaacactcgacgcaccgccaagtcaggccctctgcgaggctgcgcggtcgtggggcgggggaagtcgtaaactcgaggaagtcgccacggacattcgccaggcgaacgcgagaaaagcgaagacaccgcgccgagccgatgtggacgacaaaagaagctgggccagggtaaaaagagctcaaaagacgcgaccctgtagtaggaccattctgctggccgtgggagagagggaagggcgcggccgggcgccgttctccatgatgctgggggttcagacctttccttgtcggaggaaacgcggaaaaggcaaacaggaactctccccacctgcctcgatttcacagccgagttcccacgcgtcgacggcaaacgcaaacgcagaaaggcacctcaactgcggacgcaagaactcttctttctggacatccaccgctgccacccggcggaggaatcaacgaactcaacaggttgtgcaaaagtctcagattggagaagaagctagcgacggttcgtcgctgccccttctgacagagcaaaaagaaaaaggataaaagggacaccggcgccggattcgcgtttcca

SEQ ID NO: 608 - DNA, 1504 bp, Toxoplasma gondii
gtgtgcaagatacggcgaagggagacgaggaatggagatgagaagagaggaaaggaaagcgtaaaggacaggatgagtgaggagaggctagacgcgaaaaacagaaccgacggaacacaactatagagaaaagcggagaaaggacagccatgaagtccggaaacaactgactacgcaggcctaccaggctttgagagcgcttcctcgcctctcttttccccgctgcctcttgacttacactctttttcttttgaccgaatgagtgagactggccatggtgtcgatgcttgtttttcttttcctttgccgtggaggagacagctttcgcttcttcctcggcaactgctgggcgccccgaggctgagagggccggcgagagaagaagcctccaggcagcgaagatgcatgcaaggccgaccagcaccgacagcaacatcttggtccggacagggaggggacaagaaagggacaagaaagggacagggaggggacaagaaagggacaagaaagggacaggcgagtgaaggagaaaaagaaatgtggaggaagcaacagagacagagagaagaaagcagacaggggaagactgaaggcacctgagaaacgaggacgaagcagaccgggaagctcgtgacttcttactgttcgcgaacgcctctgttgtctccgtccttgagtctttctctttttctgagtctttgcgttcttcactcctttgtgtgcagaaggaagatcgagaacggcagaaggaaaggcgcgcgtcacggcagagaatgcatggaccaggggcaatggacagaaggacggagaactcggcacacagagggaagtcaaagcgcgagaaatcgggatgttttctcagtgacgaagaccacaaaactttcctcgatttccagaaacatgagagcaaattccctcgtttcgttcgaagctccaacaagtcagcttgtgcatgtttttatagccagcagaccccggacgcatgcaagcgcgcgaaccgtgtgcagagaagcgaaggcgccgcttttctctccttttaaacgagaaggaaatccctattccttctccagatttttcctccaaacgcaaacggatttcaggcctccatcacgagcacacgaataccgattttcaagtttccttcgattccactctgtgcctcacctgcaggtgttcgcatgtctttcctcaaggggcgcgtctgctaatcgtttctccttcatgccttgctttttctccgtctttccgcctctccttcgcaatttgtcttcttctctctcgttttcctccaggccagacgagggccatgcgcctcctgacctgccctccaaagaacagacaacagagtggagaaagcgaaaagcgagaagcgagctgcagagaggaagaaagagaggaagaaagagaggaagaaagagaggaagaagacagagtaagcagctaggaggagaggaagacgaaggagaaggaacagaataggatccagagaaaagaaaggaagcaa

SEQ ID NO: 609 - DNA, 3331 bp, Toxoplasma gondii
agactcctttcttgttcacgggctcttttcctcgccatctgtctccacctggctcgcttacagcttcagggtgctgactttctctgcgtagtcgcttgcctctctcttttgctcctctccactcagctctcgcccaagagtctccgagagacaggagacactgtggggtgcaggcaagtcgtgaggccgcgccgcgttggcgaggaaggagtggaggtacacccgaagagcggcggagtggcggacgtaactccagaaaactgcgaagcggaaattcagcagggcgcacatggacgcgatcgacgcatctgcgaaggcgaagaaaaacacagagaacagaggcgttgtcagttctctctgagctctcacgagccgagggagagacacacgaagggccaggagcgtggagagaaaaaagacggagagaggaaggatagcgagagaaaaggaagagaggaggagagagaaaggagacgaaaaaacggaggtagaaggcagcagccgagcgcgaaagaaaggagagagaaagagaaagagactggcgctgctgagaaacagaaatttctcctcgtgtttggaacatcgtctcgaagcgagacggaagaaagagagaagggaaaggcccaagtcgaggaaaagagaaagcagagagcgcaagacagcggaagtgaactgcaagtcgactgcttctccttctccggcgaaaacgcaagacttccccttaccgaggaaacgcgtcacctgttgtctacttgcttctgagatgtctcctttcgcgtcttctccactgagaaggtggacggaggacgcagagaaagaagaagggcagtcgtccccggggagaaaggcagcgagaggaagacgcgggagcgaagcggagagatctgccgcagaaagagaagccgcagaaagtgaaggcgagaggaaggagactcttgagggaagcgttgccgcttcagcggagggtcttcctctctccctcatctcgtccagagagctggttgaaggagagagaagagatccttgcaaagaaggagaaacgcaagtcttcgacgcgctcaaaaattttgcctagagggctgggagaaggagagacaaggagaggaagacaaacagaagagaagaaatgacgccgaagagaagaaactgggaagaggaggcggctgggagacgcaggaggcaggtgaaagtgacaaggagagatccgaaaaagaaagaaacgaggaactgtgcagcggtgcctcgatgcacacgttcctgccgaacgcgggcgcggctttgcgccgaggcagcgcccctttttgaacggaactttggtcggagaaaaacgcgcagaaaagcaggaaagtggaagaagaaaaattgaggcgaatcggaaggaaacgcttattacgacacagtgctggttccgaagaatctccgaaagtcacggggcaaagacgacgcatctttttcttctcagcgcagacgtcagcgcgaggcaaaaacaaggccgaagagttgagttctcctgaaaaacaatgtcctttctgaggaagattgacgtggagttgactctcaaaaagacgtcgcgttcatgtctcttccgtgaaccgtgagaaacatctcaaaccaggaacggagccgagcatctgtccgctgaaaaaaagcctttcctccgaggggggtcaccgcgagtctctgtcacccgcgggaagtctggtggccgtgtgagaagtttttttaagctgacgaagaaatctgctgcatggcactcgacaagcatctcgcgattcacatcaagcaaaaaaccgcgattctcttcgactgtcaacgccttctttctatactttatatatatacatataatatatatatatatatatttctgtatacacgagtacagataaaaatacgaatacacaggactacatctacatagatacacatctacgtatgtgcgtatatgtaaatatatgtatatgcatatatatacatacatttatataaacatatatatatatatatttgtatgtgtgttgttatgtctatttttcctgttttgactgcgtggacagggaagggaagacagttggcgggcggcgtctctcggcgagaaatcgaatctttagtttgcactcacactctgtcgtatttgggggctcctcaaacagcgaagggcatcggaatttcggaggaacagagtgacccaggcgtgagaccgtgacatctcttgaagaagaagaagaagaggtacggtcgtcgtcaacttggtgaatgaggcggaagtccggaaggcgcattttcttccgctgaggcgtacgctcctcacagaagcttcgacactgcttgcagcagctttgtgactttctgctaaaaaggaaaaggctttcgtttatcgccaggtcgccaaacgctttcatgacaaagacttcggaatgtcttcctcccagggcgccggcggtgttgtgtgagctcctgccccccccctccccccaatgctgtgtcgcttgcagaacgctcgggtgtgcgcgatggcagagaagaagggcgttttccggcgaagaggatccttttttttctccgccgccgtgaagaggacgcacactgagttcgtcttcttccactctttctttgtttgcgttttccgcgagttttttcctcttccaggcacttccttcctacacgctgtcgcatcgtttgccaccccccctccttcgcgcgcgcgcgtaaatgtgcgtgccgtcttttttctccgtttttcctgttgaggcgctctagattttttccttgcgcgcatcttttctttttatctcgagtgcacgacgccaacacaggcgcaagcggactcggtccttttccaggtggcgagttcggagcccggtgtcagacaccagagccgcaattgttcttgtcggcaacgaagggcggtcggcttccggagtgctccaggtgcggttgactgtctcgctttccagcttttctgcggcagactgccctcgccttcttctggaaggaaggcaaggcaaagccgcctgtcctctccgagacgaagtccggcatcgcaggcgactcgcgagttccgccgacaacacccccgagcgtcgcgcgctcccctctgtcgagttcagctgctttttctctggcgcggctcctcgacttctcgcagcagcacccacagtccagatcctctttctcccgcagcgcctgggcatcgcgtccgtctctgcgaacagagcggggcggtccttcgcactggcgctcgcgcctcccagttcccctgtccgtccggtggaggcaagcgacgaggcgagacctgctggcgactgcactcgccgctctgctgcagtca

SEQ ID NO: 610 - DNA, 4004 bp, Toxoplasma gondii
ctcaataaactgaatctgaagagaaaagcgctaagcaggaaagggctacgtggacgacactgtggtgtgcttgaatcatcgcgcagcgacaggaactcgattgaaaagagtatgcgagaacctctcctcgcttcggttgcttctgagagagacggaaaactcaaggattcagaagacacacctggaccaaaaatgcacggaaacgggggcaactacatcccgaccgaagtggggaacggatgtccggcgcttgtttctcgcggaacgagacacgcatacctgtgagagtgtttcgaaaaggactctcttcgtgtttatccacgtttttttgacttcagcgactgaaaaaaactttgaagacgggtgactgggaagggagacggagcaaggaacgcagaggagacatgggccacagcgcgaagaaatccgagctgtgacgcctcgaactgaagccgttccaccgaaggcaaaggcgtctgcgccctctctccatgagcgtctcgtctcggtggcactgtgagcagcgagttgagggaagcagtcaggagagcggaggccacacacgcaggcgagaaagctttgatcttacccgtgaagaagagaccgatcggccgcatgcaacggaccgccgcagagctggtctctctgccgaacttggaaacccacggcctttccgggaacgcgtgtggtcgaagaggcagacggggagagacgacgaaaaagggcggggagaattcaaaatttgacagcgagtcacgtgaagactaaaaaagtgtggcctgaggggaaaccgtggcagaggcaacgcggtaaaagtgcactgcgtgcggacatgccttgccttggaatcagaaaaactgcacgcaactggagttgctaaggcgccactgggaaaaaggacaaggttgcaacgggccctgcacgagaaaaaacaccgcaggcaggaatgaatgccaccaccggaaagcgactgaaagacgtgcatgtacggcagagcttgacaacgaggtacgcgctattggatgaccgtttcggggagagaacgaaaagggaaatgcacgaaaaaaagtcccagatagaaagaaccacgcagaggcgccgacggaagttggcaagttcccagcaccgggtgacggtgtttttccagcaaggaaagaaatagaaactagagagtgtggtggagccggcaaaacagaacaggtagagtttgtccgctacttgggacggaaagtggaagaaatggacgtaaaagagaaaaacaggagcacgagcaactcccacgaaaaagaaacggagagacaccgtgtgccagagaatccgacggagggggctacttcagagttgcgcgtggacttgtgctggagaagacggagtgaatgaacagagaaaagggttgagaacgcgagcaaagctcttgctgtggctaaacccacggtttctccatcagagttcttcccatcctgcattcgttccgattctcacatacaagcacttaaaagaagtggaggcgacggcttatagacagagggaaggacgccaggccacccgcctcgacggcttacttccacgagcggctcttttctggaccactacgcaccgatgaacagaagcacttactttgattgcctttctgtgcctgtggcaaacaatgcgctttgaacattttacatcacaccactgggacgtcttggcaggaagagctctagactttgacaaggcaatcctcctctctctcgcggtggttccgttccgttcttaccccccactccgtctcgtatagcacgccagcagggtgcccttgggagtgtcagcgggagaagctgcagaaataccgcgaccttttctgctcggagacatacatctaaattacctgtccagatctgaatcgtgtatgctttgcggtttgcgaaggcatcttaaccgagaaaatatgcttaacgtgtggcagaaaccgtccagtctcttgcagggttcagttggccacgcgtaatcagtcactttcaggcaggagagtcactcaggtgtttaggcgtgcgcatagaacaatttgtttttctgttttctctttcaatcactagtttcactcttccggaagcaattgtccacacgccgtgagtatttttagctgggcgctcagacgtcacctcggaagcgtcgtcagtgtcggaggaatcttcgttcacagcttcggtggtgcacgggatttgtggatgccttcagttgtgaatagaagttcagaaaaagacagttaccgcgctagttataatgaagaagaggaaacttttcatctttccccgaatgcccagtccaggtggctgtagcaagccagggaccggctgcgtacgtcacgcttgcagtcctgtgtgccgacgctaagtcagtccagggtctgactggaacatcagcgatggtgctggatgcacattaaagcttgctgaaaggaatattgcgggagccaaggtagctagtgtggtctagcacaggcaggttcgggctggtgaagaccttgagtctttcggtcgtatccggccccgaacaaaaaagcgaaagtggacagctgcagaaatgccaaaatacgtgggtttgtcacgtgccccttgtggacttagaacaagaacgaaacaagcttttcccttttacggccgcgatgatacttagggtgtagtccgcgctctagaaaccgccggttccggtacattcttgtatctttctttcgaacaaataccttgcgtgcgtggccgacatgcatcagcgaagaaatgcgaagcgcggactgcaaagaaggaaactcctccttttcggattgtgtgccccgcttcatctctttagaatggggagaccaacaaccacagcatttgtatacttgaacgtacgaaatccgattcacttccccaacgcaaccttaccccatgctccatgagcatgcttgtgattattgcagtgattcccgtcgatgggcatcttttgaacatggtgaacacctgttagggacagccatttttcgcatcactttttccgtcccgtcaatatggttcgaattctattactctgtgctgaacctccggagaacaagcctcccggtagacgttcttgtctggtgcaagcaagtctttctagcatagtctttctcccgaccaccgagttttgtcagtgtcgttcccatgttcatttcgtccagaatctgccctttgagacagggttgtgataaaggcatgtggtgctagaaggagggtgagagctgcagctgtcagactttctttggttatctgaaggcatcccctttcacgagagcggcttcacttgttttgttgattaagtgacgcaacccttctctgaccggggacccacggtgcaagagatcgtgggtgtcgcccgggaagcgattttttgcttcttgatttttttacaagacttatccaagacagaaatgttagcccgttagggacgtcagaactataacatcgggaatgatgtattagtcgctgtacttccatatgtgcaggtcattatgccataacgtaaatgtgtggtacttggatttctgtctgtgtatacccatacaggcaggtcttctttgttggttgtaatttttccccggtcccgaccactgggagcaaatgcgaggaacagtacaccctcgtaagccatcgctcatgatcgtgatgaatttgcacacacgtttttctttctaaatcgacaccccttgttaagagcttcacaattcgaggaaaccccctcactcattccgtcctgttttggcacttgtctgtcgcccttttaattccccccttcaaaaaccagagaaaacgaagttgctaaacgagggggcgtcctctagaaaaaggcatctcatttgtccacgcagagcagttacgtgcatgctgctatccttctgtgtgtctgtcttggcaattacttgttcttttaaggaaaaaaaattctcggttttcttggcgaaagggaacgttccttcacaccggtggtaattccgtttacgcgcatca

SEQ ID NO: 611 - DNA, 2922 bp, Toxoplasma gondii
attttgttgttcccattgaaaagacgaaactacccttcacgacgactgcacttctgacaggacatttttttctgtaggtctcatccagggtttgcttgggaataagagaagcaggagcaactcgtcgtcgtaattcagatcagtggaattggaaatatcctggcttcggggtgatttcagaatgatcttgcgagcatcaggatgcggtgcttttctctgctggacagagaaacactggacggggtgctgcagttttttccagctagaaatactcgagttcgacgacgcgaagcactctgtcttttccgtcggaaacaagagcacgacgtgcagaggacaggtcgttgtctaggaaggggttctctagggactcgcgtttgcggacctgaaaagaagcgatgactccctcgcgcgacagttcttcagaaaacaaggcgcactggtgtcagcgctctttgtcgaagagggagggaaccccgagacctgaggcaacctaggcctctgccgtctcatttggattcgtcaacggagaaagatacaaacgaaccgtgtgggctgttacgcagtggcgtttatgtcccaaatagatcccctttctctggatcgacaacacccaccctgcaccgttgaacaaaatcagtattggtccctgggcacaccaaccttttcttacgttgttggtaacagtaatacaaagcagaacagtcttaaggcagaggggaaccggtaagttcagtgttttccagcatgagtggaaagcgaccgggagtttctcctgccttttgtgcctgaaaacagagcggcacagacagcagggtagctgaaaagtgacaaccttctcacgaccacagaaaccgaaggagcaagaaatctgatgaaaaacgaaagccacgtttgttgatttgcgtatttttacaatccctctcacatcatcacgcggggtgtataaaaagtctgacgatggtttctcgtgttcagaaaatgacagccactgaaactcctgcgctcgttcttgcccgtcttcgtcagaaacgagaagtgtgtttcgcttaatatcgattccacgactaagagtgtggaagcaagttttctcaaaacaacatcgacggggacagaaaaatgagaacgaaactgtcgaggtgcgaactaacgcaacagacggtacacgtgccgggcgccggacagataacgttgaaagggatctgtttaagagagccatttccacattcgcagaaaaatcgctgctccgaaaaccacaaccgagtcatttcggacatgacgcgacctgcaaaaagccagtcactgccgaaagctgtgtctgccccgcttgacgaggtcactcactggctaggggtctcagcctgcctccaaggtcgcctgaaaaagctaatgcgatttgttttggagggaccaagaaaataatggagtttgcttttactgatgatctcctcgactgctttcgatgaagttaggttcttgtcgtttccggcccccgatgccgccagacacatgtactaaccaccagttggcttcgccgcccttctctgtagcctcttctcttctttttccctccattcgctcctcacaatacagcagatcttcttcttagttcattctttaatgacgcctggcttttccaggccgttctgatgaatggagatgcccccttccctcccaccgttattctgcgttgcttttctgggccgactgaaaaatcgaccctctgtgttaaggttaaggttcacatctaccttcatcctttcaactttccgcgagagagaccgtggcgcgttaaatataccaacgacactaaaacgcgaaattcaccggcacttccccctctgtgattctagattcaggtggaatcagagcgcagccgtcatctcaggttcctggttaaacggtacgacgtgtctttcgagcagttcttggtcatggatacattcgaaatacctcagagacatctgtacctgtctgctctgtacaagtacacacattttccagcgtcttgtgcggtgttaaaggcaatttcagcaaaaggcggcggtcacttagtattagtgtcatccgcatgccaacgagatgtcgataacggtgcaacttgtttgattcacttgcagcacaaaagattaggttacagcgccttgaaactcaacagacattttgtttacgttgtttcccagggctgcagtttcgaccgcatgcacacgacagcaagagagaaataacagagagcatgcagccatcaaggcttggtttcgagcggaaatgccatcgaacaagttccactttgacggagcagacgaaaaaggcgaagggggttctttaagattcttcggttcttgttcctttccctatttcttgattctgcgtgaaggaaaatgcgccaagggcccgtgacagacctgaatttttgtgcggaggcatgttggtaaaatagatgacgctcttcagatcgccaagaaaaagacgagaaacctttgacatggcctgtttcctcgtgttttccttttagcatggtccttggcctcctgcccagacaacactggagtcggaggaccagccgaccccgaattttgtgtcctgttgagaaacgcttttgttctctccagattccgtcttggattccgtcttactctgacaaagcttcagttcttttcctctgcctttccctccgtgacttggtcgttttctggatcggtgctccgcccgtaggtctttttcgctggtgactatgctgtcgccagctgtctcggcagacccactgagcgccctttctcgcttcttgttctcctcatccagaggtcagagaatgtaagaaatcgcttggccccgaactgaggacgctgctggaacctcggagtctcccgactccacctttcctgtcagcttttctctgcttctgacctttccgacacacca

SEQ ID NO: 612 - DNA, 1106 bp, Toxoplasma gondii
ttatgtatggagtgtcacctacaggtatgtggatatatgtgcgttgctctgtcgaccatctctgtctctttctaagtgtatgtttgtgacgttggagaaccggattctgctcgctgtgcaagagactcactagtcccgtggtctgcctgccgccattgtgcagttgctggggtactttcagaatcgatctttcggcagaaggcgagcagacgaggactggaagccgaggagaaccaggccagagttgccttcgtctgcggagagggaagaccgcgaaaggcggaaggactcgacggggaggagccaaagtggcgaagggggcaagaagacgcgatgcgagagaagaaagtcagaggccagctgtgtacagagggatccgagcgcagagctgcaccctgtccagcggccagtttccgcgcgtcggcctcaggcttgcgcgcgcaagccaccaaaggcgcatgcacctcttgcactctctccgagaagcgacgcgcgcccaaccgcgaaagtcgactggagacgaagctgttgatccggagtgtctagacagaagccgagagcgcgatgcggcgaggggatgaggtcccaacgcgcaggttgaggcgcttcgaattacacagctgcgcgttcaagattcgatgcacacctgcctgcgttctctgcctccgtaaacggttcacagaagatgggagaggagacgaagacgcctactgttcgaggtgacgccgtggaaacgagcactcacgcttcgcgacggttgcagagagccagttgggcggccgcggggagcgggggaagaagggcattcagacaggcgttttttacaattgcacaagacgaggcgagcgcgcgcggaaaggcgcggccgtggagacggcgagcgcgcgagaaggagagcaccagaggaaacggaactcagatacacggaccaactccggcgttttcgagagcgaagagaactgtggcgtttttgcaggtcgcgacgaacaaaggctgaaccagtagagagaacagatgtccgacggagaaggaccggctgagactcacggaagctcgacagcgagaagactggcgtcttcatgtccagcgcagcctcgaatggggta

SEQ ID NO: 613 - DNA, 988 bp, Toxoplasma gondii
cttttctcgctttgccgcgagtacctgtgaggttgcttttgctcaagctcacaggctgtccacctggaaaagagtctctcgaccaaccgcacatttttcgcactcgctcgcgtacgcgctgcgcctgctctggaggcagaagccccgaggcgtcgccttccaaaatccccggcaactccgccggcgacacagcgagactgtggactggagaagaagaggaagaagaaggagaagacgaagaggaagaagaagaggaagaagaaggagaagaggaagaaggagaagaggaaggagaagaagaggaagaggagcgtagtttctcgccgtgtgcagttcgtcggccatcctccggcggcggtgggatggcctctgaatggagagcgttcatcgttgaaagacaagagaagaaggagagaagagagagaaggagagagagacgaggaaggagagagatgaagaagcaagaagacggagagggagacgaggaaggagagagatgaagaagcgagaagacggagagggagacgaggaaggagagagatgaagaagcgagaagacggagagagagaagaggaaggagagagaggagattgagagagtccagcgacgaagggaagagaagcctacattggtggcttgcatgttcctatttcgttcttcatctgcggttttctgtctcacagttgcgtctaatagagaggtgaagtcctcccagacaggacggagatctttcttggagaggaaacccaagaggctctgtgaactttgaggaacgcggagagctttgtcggtgaaggcctcccccggagacgccaagaaagcgaaggaataaaacgtatttgttcgaaagtggaaggagcccgagagaaaagaaagagaggagagagaagagagaagagcgacagactcgagcagtttctttcgagttttttgtgttgcatgcatgcatgcgcactcgaaaaacgcttctcttcgtcttttactggca

SEQ ID NO: 614 - DNA, 3942 bp, Toxoplasma gondii
cccactcgtcgcatgcctgtgtctggcctcatgcaagccactttaccggacgtgacggcgctgatgaaagcgacaaatggcggcgcgagaaaaaaagaagaaaaggggagggtcccaccgcggccccagccgcgcgaggtcgcgaacagggtgcagaccgaggcagagacagaagcgcatttcagagacaaatacggggtcgtcaaagatatggcgaaagtctaccacgacaaagtcaagaacaacgaaatgggaggcacagttgtcaaccccgcagtaacggagctacagcgaaggtaagcgctgcacttaacaaagcgacatggagagactctacggacttcttacacaccctcgaactacagaacgaaatgaagcccagaaaatccccagactaccctgagcatccatgttgtgttaatagatgcttttcgcgaggcgatacgtgcacagacacccctacgcttgcaggtcgtcgagcgttttatgtggttacatggcacagagaagggggcatgcatatatttatatgaggagaggttttcactacactaagggactctagaggcgcggagacagacacaagccctttagatattgctgcatccgtgtttgttgcggggttgtttttttggtgtcttctgcagcgaaactctccatcggctcatcctgaagaaggaagcagcacgcgagcagcggcgacgatcccatcagccaaagaagagaaagcctgggcagtcgaaactggatgagatcctcagacggccccccgtaaccagcacgacgaaggcctgaaaggaacaggcgcccgcataattaagccgtatcgatatgggccgccttccataaaacgcacaaccctccacctaaaggttgccatccgtttacgaactcatctgtctttgcaccctgcaaactccacctacgcatctatgcgcccacggggatccgggaaacacaaacctttaagatctacacgatggctgaactcgtagtgtatggacgttgcattcaggcgcctatcgttaattgcaattatcttacatggtcaatcgagcatgtgtcgatgtctccatgctcgacaacatagtgacaccgcgggtcgagtgccgaagggtctgagggggcagcgcatgcaagatgagcatttctccaaaatcttctgaggaccaatggctggtagttaccaactctttcgaatggacgacccgttccggttctctctgttcagagtgttgctggactatctgaccgcatgctgcgaatcatcaggatccgttcatcatttagtccagacaccgcagccctacgacctcttcggttcttgtcgaagagcacaccatggaaacagcaaatagtgcgactacgatgctactcgatgttaggagtggcaatcgggtgccagaccctgggcgtgagtacccgtgcttcagaattacactgtggcagcctgaaagccgttcatcaagctcataaccctctgactcctcttttgttctgcatttgctaaaacatcgaactcaaaggctattggctgcaagtcttcccttttgggttgcgtacttcgagttgcttctctcgcactactcgttcgatagaagcgcattcgttgaaaataattggcttttggtgtaaagcctccccgtctggactgtcatttgatcacagctgtgattttcatgatcttctaagaagaggtttctcgtccatatacaaacgaaggggagattattccagtgtaacagtttaggacgaacatcatgtctgggtaggttcctagggtcagcgaggcgaatagcaagatgcatgggaaaacggtaacgcctttagcaatgcaagtaactattctgagatgaagacggtaagggctttagaaattcgcgtaagtattctgagagccaggccgatatatcaagacgggggaaaaaagctgtacttggtccttggtgtctaaggcaatccgcgaaagcagggtgcccaggcaatttaatatacatcagcactcaacaccgcgtcggcgacacaatatgagaaaaccagtttcacaaccagaacctgccagacgacagcatcgttgaacaataaacatgatgccgataagaacatgaaaaaacatgactgtcacagtggaaagttaatgtggtctcaataataacatttggaggcatgattgttacggcagcggccgtgaccttgtccgcgcgtacgagagccgtcgtgaccggtctcacgttctctgtggtatccccgttatgtcctatcagacgcttctaccacgggaaagatgtttccgtagcaaatgttcaccggaaaatgcttctgttcgcacagccaagaaggggttccaagactagatgttgttacagtttactggctcccggtcctgatgtctgcagtttctgtctggagcgttgttctacgctcgttctcagagaccgccaacaaactcgatcaagtaacccgattgaacgcaacaggaaaccctatggagtggaactatgccatggtacctccggaggggatagaacatttcaggacacccgatgaaaaaaaaacattccactttgaaatcgatgctggtgctgtggctcccagttgctaggaacgaaggaaccgcgtcacagaactcattattttgcggtttgtttgcagacagaccgacacgttcgaactgaaattgaaagaggcacatgtctctctctctctctctctatatatatatatatatatatacatcctgacaacaattgagatcgtggcactcgcttctgttagtaactatcgatgcagaagagagtgctctgcggtccattacacagtctgcttaccctgaaaaacagatgcctcaaattgtctcgcggtggcgtctcatgtcacctgcgacgcctaagccaaggcacttaacaaagagtagctcttttttccaagctcgagatgaatgacatgtcttactgtcgttatagcaggctgccagttcgtcttctgccttagtcttttttgaatcaatgaaaccgttctgaaacgactttctgaatgccgaaatacggaaatgccatcaactacaggttcgtgttggttgctatatgtgttctgacaaggttaaagtgtttctgcagtgttggggtttcttgtcaagacgtcgaagaagatgcatggtagtggtcggatccatgagttcagttctaactttttcgcaaatacacagggcctattttaccaacgaatttgcggggcgccagtgggggctacgcaagtctgtttcgcgtacgctttggtctgccacgcaactgctcgctcttcacacgcggcctatctcttcagccatccaactgtccgtggaaggagcagttcttgtttacacaatatctgaagtcacagcaacgccaccgtagctggaaaacgaatccatttttgtccacccgtcgcgctggcccgcgtgcaagaacgtttgacttagtaccttgcgaaaaatcgagcaggaaaccgtgcatggtttctcgagtgttcggcagctccttccgtagcactgttcctcgttaaattctacgcttctcaatgacacaagaaagacattaccaggtggcctacaatgcagaagaccgccgaaatcatagcacggcgcctgcggactactctagcatcccgctcaggaagaaaaacccgccaagctttctcttctcaagatcattttctgactttctatgctcatattgacgcaggatcactcgatggttccagcaagtgcccaggagtagatatgaaaatgcgcttaaaactctcttctaccctcgcagattaattgcggatgctaaatgtctacgtcctattcagttgtcgactcccctgaaaagcggtttttggcttgaacagtcacgcccagataagccagtacccgttatgtggacttaacattctgtcgcttcctgtggttcgtctcacaca

SEQ ID NO: 615 - DNA, 4324 bp, Toxoplasma gondii
cgcatgaaaatcacccaggaagatctgcggaaggcgaaggagaaggcgctgtatcagaagaaagggaacattccagagagtctgtatttgtgaagaggcgggagaaaacaatggtgtctccccagagcgtcgagacagctcgaagaacgaagctgcctcttcagcaccctccagatctgagccaggagcccaactcgatttgtggcctcccaagaaggactgacatctcgaggcgaagaagagactggaaaatgtcatggcaggcttcagaggcaccttctgctgagaagaaaggctgtgcgagcgctttcgacccgtcagttttgaggcgccgccggtagcggacaccctgtggcttcggtttctctgtgatagaactgtcgaaacgctgcgaagatagaaatgacgaggtcgcactgcaagaagacaagagagattctaaagaaaaggttatttgcccgaaaacttagcgtctgcgtgtctgattttttcgagttgagttgccagtgtggacacgcatgatcgcggagtgggggcactcaaagcgaaaccgtttatcgccaacagagtgaaccgttcagaccttttttcttggcgcatgcaaggaaaaagacgtgaactgcgtagtcgcactcggcgattcccgcgggtgagggagtgggagtagcgaattcagtcgaaagcgaagaggctttccagagcgcagacgcgacagatttgccgaaggaaaaaagtcacgaacgtgtctgtttgagagaagaacccgggccggcacaggttctccgtgtattttttaggaaggatcgtgttgacagcgacaagaaaaccacacaaatgcttgggtccacgggagcgctgtcccccagacacacgcagaaatacgagtgaaacttacactgcttcctgcgacaactttcgcaattacgagtggaacgcttctcagaaatcttgcccaaaccagagagctgctctggtatggttctttgcttgctcaagcatctgactgtctctcgctgttcatacgcgtctttgtttaccggttaaaagtcggctgtgcagagcttccttgtctgcatctcacagctaaattacattcagtatcctagaactaaatggggtgactcgacgccgcaacggggcagccaggatcgcgaagaatgtgtgacatatggaacgagaaacacagcacctgagaggaactgcttaagttcagctgctgaggatttcaaacggcggaccgcaccctctgcaccgcaaggcgtcatcttcttgcctagtcctctagagcgtgtcctgcgttgctttctggcacaacgtgaaaacgtgagaaatcctgggggagaacgtgtgtgaaggcttgtacgcaggaaacaattcctaagagcatgtcgtgtcgactgttcggcgcatgagctgtcgaagaaggctcccgaatacctgacctcagcactctgaaaattctccacagcacgccattttaggaagcacaagtgctccagtgcgaggcccgtctcggaaaagtgactggcctttctgtacacgtggctcggagctgggcgtgagggggttgggttttactgtgtagagaaagcgagacttgtcatagtgctgggtgtcggccactggagaaaggtggcagggcgtctcctggcgtttcttgcgtggctgtgttttcgagaggtttgatcatcttcgaccgcgtgaacagcgcaaaagcttcaggtgcgctcgagagtgttttctgtcattctcagtctgtcgtttttcgacgcacacagtcgctcggcggaacaacaagcgtagcagggcggtaacaaactcttcggtcccccacgaaaacggtgcgagagcaccgtggcgcaccaatccccggggccgtctacaaacagtttttcctgcttcgggacgttccattgcagtagagggcgacgtttcttcgacgcgtcaaggcgaagttgcctgcagtcttttgaagagcgtgaagcatttcctcgggcgttttcccctactttatatatacacgaaaccatttgacttgagtttcgttcacgcgtgtctctggtactggctgggaaggaacgcaagaagacctgaggctacgagacatccgagaatggggatggacacgctggccagagcgctcccccagtcttcggcgtaaccgttcaagaggagttggctgacgatgatgccgacggcggtttgaacattgagagtgacggccttggcggaaataaagtggaaaactgtgtaaacggccccaatcacagcgcccgcagggcgtccgaagaggtcgccgaaggtcaagatgtaggcggccatgaggagcatgctgaaaaggaagagcatcaacaaatcgtagctcttggtccccgacgagagaaggttgaacagatccaaaggccccatggtgtaccgcgccaagacagctccgagaacgcctgctccacactgaaaaaagcaatacagcagcatgtccggtactcgactgtgacccgcgaccagcgtgcccagggtgatggcggggttgagggcaccgccagacttccacccgatcgcataaattagagccgcggccatgcatccaatgctgagagccgtgttggcgccgtcgatgtcccccgtcatggcacagcacgcgcagtacgtgaacgcgagactggagaaaaattcagccatcagcaggttgtcgtacgccagcttgtaggcgccccagccagccaccgcggccaagaacgggatcacaacgaacgaggcaaactgggagtaactgatggacgttccctgaagggcatttccgatgtttgtgccaagcgccactgcggggttcaggtagccggagaggccaaaggtggcggtgtacgcagcgtacgtgaccagacctacggcgacgcctgagagctggcctgtgtctgcagacgtctcgatgtgcgcgaaagccaaggtactgcagaaaacgagttgcgcgaggagaatctttgaagagactgcgccttccacccccgcgggcagaatgcccgactcgccgcaaatcagcgctgacagcaaggcacccagggccgctccagcaaactggagaacgattgtcaccatggcactcttaactttgactcggcctgacagaacatcgatcaccgtcaaaataggattcagctgcacatcccggtactggtggagggcggtggtcacgacggcgtaggtgagtgagagcgcgagaccgtacgaaaaaatgtcggatttgaacaggctcaggagctcggcagcgaacaggagcgcaaaactcccgaggaactccgctgtcaagctcttcttgtcaaagtctgccatctcggaaacaggtttcaaacccttatggacagaagcatcaacttggaaggttccgtctctgctggacggggtgccgcgatcttacgacaaacaaggccggtcttcaaggacttttaaagaactgcagacgctttcagattgcggtttcgaacgttcagaaaagtggaggtctctgtagccactccagaacttcgaagacacgatagctcgtcgagcatgcccgaaagtcgtggctatcggcgagcatggcgagtgcggccgcggtcttacacaaccgtccagccggaaaagagaaatctctcattggagagagctcgtttccaccgagctagccttcgcctttcaaatgactgcgcgctcgtgtcctcgcaagacgtcgagctcgtctgatctgcacacccagccgggagagcctccaaccgccgagagtcaccagccgcttttggagagtctgtgagtcccgcgcaccgcaccagcagcgaaaattctgccgggtcgccagcgcagatctttgcagctcagacggggaagtaacaagacaccgaaagaccacggagtgcaacggatgcagaatctatctcggccgctaccccaggtcgcgactcaactcgtgtctcctctcgccgcctgaggcaagaccgcgaccgtgccagcctcaaactggctgagctgcatgcccggagcaccctgaagtgcagttgactgggtgcttccccgaatataagccgaattcttgtaattttcagtccgggcagagaggggcacggttgcgtggagtgcgccagtgaccgccctggcggcatcactggagcgagtgcatgcgtttttttctcggtgagcatcgcttttgcgcggaaaaaattcgtagaaaggccgcgcgccgtctctctgggccgtaggaccatttgggggacatcggtcatcctttttaaggaattctgatttttttgttggtgttgtccctctgcggttcttttttccttccgcgcgacaaaga

SEQ ID NO: 616 - DNA, 1345 bp, Toxoplasma gondii
tctttttatttgcatacttgttttcgcaacgcgatgccgctcagcagcaggcagagcctctctcctggaggcgcagtgttttcttttttcgtacactggatcgaccagccgttgcggccgcgagtctctttcggagcagttccgcttctttgcccgtacggggtctctgtgggggcagactcttaggcgaaagcagcgagtgcggcgactctgtgtagtcgggagacgcgtggaaaaagcgcggcgcgaaatggatttctggatgcggagaaagagttgaggttgtcgatctttcgcaactggagtgattctggcctgcctgttctcacaaaaaacaaatgagcatctatgccggcttttgcgacttggagaagtgtactgacatctgttcgaggtgttggagcgtaaactgttccttctgatctttcggtggagtctttcaagctctcagttttctcgctctttgtcgacctttgcggaagcgtttgcgagttcagcgtcaactttaagatattgacagagagatggggtcgtgttctgcaggtttgcggatactaaaattaacgtcgcaggtgatactcgatccaatgaatctcgcgactacgtcctgcattcactggagagtctgctgcaccgtctgcacaagcaagtagaaacgctgtcacacgttgtttttcgctctcgagagagaaacagcggaaaacgcaggtccaaagctgttttcttggttttccctgtgctggccttgccgcccggggaatgccctccattctcctctgagtgccgaacaagagagaaggagaacgcgggagaaaacgaggagcggctacagaaaggaaagaggagaacaagtgaaaaaaggagagagacaaaaaacaccacagagaaagagacgtgtcttcgcaagtctgttttttttaaccgattcatagtcgaattgcgagcacggtgtgcatgcatgcacatgcagagacctcggttttcctgctcgagatctctggcgaagttctttgttcctcttcctcgtgtctgcaacgccaagcctttccaaatttctccttcttcgcccgtcgccttcgacgcactttcaactaaaacttgcaaaggctgcacactgcacagccttctctctcctgacaagaagagcgttctctgtttcaagcgagagaaaagacgccgcgagagagaaagaaagagcacgatagagaggagaaaaggagagaaaggagccatccttccttcagaaacgtttttcgcgcgtttccctctctgctttcgtccgcattttcctcttcctgttcgactccctcctccgttacttctcttcctttcttcttcctggtaa

SEQ ID NO: 617 - DNA, 1946 bp, Toxoplasma gondii
ttcgaaatgtttgataaaacggatgatttagacgatctgggtggagatgaccaaaacgtctccagaaaaatgccgagagatctcctcaagaaacgtcagatgttgacgcggtttattactgtttggaccactaacacggaaatcacgacccacagattttgaccatcgcttttccctcaggatgcaaggacaaacaaccatgttacatctcttctcgatagttcaccgaatagccctgccggtgaaagctgcacatggaaagcacagagtaacaagcttccccaaagagtatctcaccggcgaacctccatatcctgctggtaaagcctggggtcgttccgtcggtcctgaagatcgtcgggcacagagctctgccgagtaaaaagcgatttcgcggtgcagccacgcttctggttcaagtaatctataataccttctacgtaaaatcgtcaggggagaatccacgtcctcggtaccgactaccattcgtcttctgtacagactaacattagagaaggctaccaaagtgaatatgactttgtacatcacagcccaggagaggttggtgcaaaacatcacccttttcctccggacaatgccgacataatgtggtgaaatttaacaacacagaaggaaaaactcggcctttgtgccagggaatgagaggagtggcagacaatcagggcgacgcagacagtcttaggcaccgggagtcgcagaggcggaggttgaggaactacactatagacgctttcgttcctgcaactccggcaaaccaatagcgtcgacagggagatgtgtgtcaggcgtcaggcttgtgaatgtgcatacaagaggtgggaacgcatatattcatggaatacccgaaggggacctttgttttcctgtgtgttttgctaggaccttccagtgacagaagacttgccaagattggggaaaagaaggaagttcggcaagtgaaaaaggcaaatactctctataggaaaagcagaagaggggaaaagctgaccaaaaggtggagagcaggaacagccgcgggacgatagaggcgaatgccacgacgagacacacaaagccaaactctcgtctcacggcgagacggcgctgaatgaaggcaagtgtgtgtcgggattggcgtcagttgtcactttttctcacattccggactctaaacttcaagtgtcttcccgactaaaatttgtggcgagacggtaaagtgaatcgttgagccggacagctaccggatagcagccgtctgcaagccacgatcacgcgcagaagaggcgattccctttggaaaggaagacgaatgaactgtcattcttttctttcgtcgcatcctttcccttcgaacaggattcacgcaaaagtgtaggatgcctgtagtttacgtacttcgcgttcctctggtgatgggtttctgtaccgtgtgtgtctcccgtctcctgcatgcacatctccgagacactgtcgattctcatcgacagtgacctttctcctctccgaggcacagaacgctcccattgccttttccctttcgcagacgggtttttccaaggataaaagggtggcagaaaatacggtttcctgcctcaagcgtcggtgcgttccttattacagatgcagaccgaaggtctgttagaagctccttgttagtctctcttttcgtctctcttctttggcagaagtctctttcccgcggacgcttcctcatcactcacacacatctcgacgcagactcctttctccttcttctcagttgcttctgccagctttttccctcggtcgttacgtcctctgcaggacttcttttttcctaccccccgtttttcgtcgcttctttcttccagatgctcgcatccgtgcatcttctccggactttttcccccgtcctcaccggctgcccacagtcttgtgaaaaggttttctcttgcgcgtggtctcca

SEQ ID NO: 618 - DNA, 2252 bp, Toxoplasma gondii
gtagagaaacgggatatcacgatgacagaaattgaatcacggttatccactgtacactgcaactggaagaagcagagtagatgttgcactagggaacgcattttttaagtgaagaagatatctggtagacatggtcagccttttgccctcagatacaatgggtcagttttagggctgttgactctcagaagaatcagggacatgaggctgacgtgctaccctacgctcgttcggcaacacacctctatcactacgtgtaaatgtgagtgagaagggcatttgataattctgcagggaagttctgttgggaactgcgcgggcacggctacctcgttcacttcgccaagaactactccgtcctgcagggctctctcattcaccctttccactgagggaaagccagatgaatcaaacaagaactgcgtcggagacttgttgaaacgtttcctgtattagtgcttgtctatgtcagagaagagcacgtctttctccttgtcatccaaaccagctcatcatttctaaccattcgaaaggtattcacccctcgaaggcgtaccatctgcagctattcttcgtcgatctttcgagctcatggttcgcatttcatggggctgaaatgcactctgttggatcatgacatacgcaaacaagcctctcaggttcacatgggccggctgttccgcagaagttggagaacagcaagtacaactcacgaacgctctgtgggggccgtcacctgacacgacgatcgggtcccattagggaccgatccaccgtaccggaaagtgttttcctcggtcaatcgctcattcctgcatttggagtcagcagcatcattcctccaatacttccgctggaagttggtggtgaccaccgccaagatccgaagtacccgttctcacaagcaccatgtgaaattcttcggacatcaacgtccgttcggtggttggatgctcagtagatgtgtgtctagtatgcaatattctacaatcttacctcaaaacgttgacattcctgacgacagacagtgggggttatcacgcagtcggtgcactcggtctttctggttcaactgaaaacgcttcggtatttggacatcctggacgttcttctgattgcaatttccattccacctttcgaccttactgttgtaaatcatgtgcagggctgttggcaaacgcatagaatgcgagcatgtgcttgacaggtcgacgacgcgtatgtcaacgatagcagcagataacaaggcttttcacgggtgaaagtgtatcgaacgtatgcattacactggcgttgcgtcatatgcttacgtaggagtttctcgctgtcagtgaagcaccacttgttcccggctgctacactgtttattacaagcacacgtgactgtcttgcgtggattgttcttgaatcaccgggacgcttctttgtgccggccttacaaccaacagcggaggaaaaagtgcatgcagcagcttgggcgctggccgattcgaaccaaagccgcggcaccatgtgtgagtcccggtgtctccgtcgtgtgacaccggctttgcttggtcattcagttttttcagaacaacagcgttggaccagggaagaaacacttccggaagaaaacatctcgtttcttgacggtaccttccaaggatcacaacacgtttgtgcagcgtgttttcttgacagcttcgctgcaggaagtcgtgggtgctcggggtgtccacgcgaactccccgagctctccgcgcacactacccgagctcttcgtccttcttgacgacaggttgtggtgccgaccgcataattaccgaacgaacgtaaagctgtctatctggtgaatcttttccgctgtctgtgatttttacgcgagcgtctgccccagattcacgcaggaaagtttcccctggtggcagcttggcgccggtggtcgggacaaggcatgtgcgtaatctgtgctgttgcctgacgcgaaccccggaatttcgtcacatcgtcccatttccagatacagttgcctcacgcggcccagtcgtcccgaggtgctgcatgccgtggagtgacacacgaagctgcgtttgtgaacattggcgtcgtctccgccgtcgttgtaactgaaagggccccttgtttaccagttaccatcaacgacagatcggatttcccgtttctgtgtgcgacagagcatcttgcagtcttgaggcagcaaaggagaccttttgttgggcagatcacattcgtagtacagcggctaaaga

SEQ ID NO: 619 - DNA, 2551 bp, Toxoplasma gondii
cactgtttctgtggtgggtcgcgacgggtcaagagaaccggaacgagaagggaagccggagatatcagctgcttcctctcgtaaagactcggcggcgccggggcgcccacgtcgagcaatcagcggagacaacgcagggaagttggagtaccgcggagaaaacgaaagacaacgagaaagaggagagaccggccatcgtgaagaggaacggggggaggtcgcgacaagcgaatgaggtccctctagagccgacggggaagcttcttcaggggcgacagacacagggagacattggcgagaagtcttctctcctgcttctttcagcgggagaaaagacgaaggcaaggcagaccgcgaaacaggcgatgcaacagccggtgaaggcagcgttaaaacggcatccgtcctctcctttccggggattgaagggatggaaaaacaagaggacagagcctgaggcgaagactcgtgactgcgtgtctcttttcttctctttggacgactgccgtcactctcactgtgtccgcttcgccttctcttgggagactgcgcattcgaggcctcctcttccaaaggccccccggcagcgccgaagccagaagacgcagtagggggtcccgcaaaactcctgttcttcagaaaagataaactcacaacttgattctccgtcaagcctcccacgccctcgctgccgagagacgaaaaagacgaccgaggagacgaacgccacccggcagcagacctgcgcctgccttcacaagcgactggtgcagagcgcttcagggtctggtgggaggaggtaacttgagaagaagcaacagaagaggaagagaatgaagaggctcgaccggcggcacagatcggcaggagagagtctggcggatacggaaaacttgcttggtctgaaaaacttgacggcaggggtagaggctcgtcatcggtgtgacgccttctaagaggaaactgcattttcgcggtggaaggaagaagcgcatgcagcataggcacagctggcacgttggtagccaaataattcaaacctctcaggtccttgacatggacggcagtccactacgcgaaacccaggtgtgcatacacccaagcacacacacggggcaggactcgcagcatctcaaggtcgccgtatacggcgtggcagacggacttttaaacgggaaagaggcctgcacggaccaaatcgattcgtttccaaggtcattgacgagaaaggcatcaagtaagcatgcgcagtgtcgcagtttttacctttttcacggaatgcccaggatcccgcggaacccccaggacaagacgtatcgtgacaggagggcggtgacacgccaccgttctgcccacagcggactgcgatcctttttctgcttcacgatgcgagcccttcaagcacttaattctgaagaagtgaccgggaacaggtcatttacacgggaacacattcctttggccgcccgcactctctcagcgggttcatcatccccttctgaacacctcgggtgtctgtacaccggagctgcgacggcgacagccccgagagcaggcagccgagaagagggaagcaatactgcgaaagtcgactttctggagtcgttttcccaagggaaactcccgggttcgacgcacacgtttcgcaagacacgcgagaaacatctcgagcttttctccgcacttcttttcgagtaaaagctggcagtgcgtcgcctctttttcgcacatgcacaggcgatcccgtcttctttggctcgcgcggtcatagtgccccccgtccgcgcatggcggcgcctgttcggattttcttgagcgtttttgacgttttttgccttcacacaaacgtgtctgtcttcactttctgccgagtgtccagggaaccacgccttcgcgcgtctaggctgttgccgccgtcgtctcgtgcacctggaagagagccacctctgtggcgctcgcgaccttctcttgtcttgggagctctttccacttttcaccgtggcaccgctctcggaaggggcaagagaagtcggtcgtttctgaactcccaggttttcagcgcgtttctcagtctcagttcctctgtgtcggcgcctcttctcgacccgtcttttgagggacaaggtgttttccatcaaggaaagctcgagaggcgtgcagcgtttttttgcagcattctcgtttgctttttgtctttctgaggtcttcttgtctcgcgagcgtccgctgtgtgcgatcgccagtctcgtcgactccacttgaattatctggctttccagtctcctctctctgtgtgaccgtcaacgcccacgccgtcacaccccccgtctctcccatcgcaggtcagaaagcgcgtcctcctcttcctctgtttcccccctttctctgtctctcttactttctgcctgaagccaacacctttcgcctctgtcgccctctactcttctcgtccttctcgcctctccctcgctgcacccgtcgccctctctgccgctcctcgcatctgtccgcacactctctttacggccgatacccttccgcgcgcccaaga

SEQ ID NO: 620 - DNA, 1513 bp, Toxoplasma gondii
gtggagggatacacgacggagagagaacttgagtgagataaagaaccagaagaaggcgacgcagcgtctgttcccgttgctggcttctctggaactttgcgccgacaagaggcgtcagaagaccgagaggaatcagagaaaaagtgatcttcaacatcttcggtgccgctgctgcagccgctcgagctgctggacaagtccgaggcattcgttacgtctgcctccgagaaactgcttccagagtcggactctgtgtcctccagttcatctgaaaaggagacagaagatccgtcgaagcgactgtcttcctgccctccttcgccttctctcccttgatctccctcttgttcttctcgcttcaggtgacccaggacgctgggaggccgaaggcgccggcgcgcctctcctgctgcgcggtgcggcatcctcgacgcggtaggctgtgtcttttttcaagacgggggaagtaaggagaagcaggcaagggcgaggagagggagacatgaagaatagtggacaaatatagagccggaacgaaatgcagaggagaaatgctttcacggaaggaaggagaccccgagaaggagagcgagagagattagcaacgatgccgatgagaaaaagaaagaaactcaggagcggaaacagaacgggaagcgacaaaaaggtcagagagagcgcgcagacgagtggaggagagacagaggagaaggagacacgacgagacagagcaccttcagagagaaggaaaacgtaaagagtctctacgcactaagcaagacaagaagcaaggaggaacggcaatggcatcaagaacggaggggatttcgaggagtatgagagggtcagaaagacgagaaaagttgtaaggacggcgaggcgaggaataaatttcttccagaaaaagggattctggctagcatcgttccttcatgaaaacgaattgacgaagccgttttccctagcaattcactcggagccatgttcgcaacttttcgcagatttacacacccttcaaggtcactgacagagaggtgtatgtacacctcgttgcccttcgctagctgcattcgcttcgcaacagcgaggcccggcaaacaagcaagttcgattttccgcggatcgcttggcacacagatcgactgctttttcaaacgacaaaggagacaacccccctttgtttcgctgttcgtcttttcgcgtttcaaacgcatgcaggctcgtcgaaagcgactcctgcctctttgcatgcgcagactacgaggcttcggagtcacagtttcggcacactcgacgcgtatatggaggaaatcgttttccctggtaagcggacaagcttccaatctgcctcttcgtgtttggtttttgctgctttcgcctctcgtctgttcgttttggatcctgggggttctgccgtcgtcttccttgtctcccttcgcgtggaggacaagcggagacagaacaagacactccccatcaaatacagtttgttccgctctctctgtgcagtgga

SEQ ID NO: 621 - DNA, 2423 bp, Toxoplasma gondii
gagacacatccaccgcttctccttcacactcaaagatgcctcttctcggtcgcggtctccccgaaagcctcgcccacggctccgacggacctgcgaccacggcggtaaatcgcgcgcgtcttgtcgccgccgatggaacccactgtctcctcgcggacgtccgtatggaccggagttccgaaagccgcgcctcctgtccgtcccgccctgtcgaaacatgtgcgcccagggtcctcgctcttcgccttgactctccgcaagtatttctccttcttgtcgttcttcttcgcgtcctgcgtttgacgcctcttccacgcgactcgcctcgtcagcctcgagggggaggtcgtcttggagggcggccgcgtcgcctcgctcgaccgtctcctcggcggggagacagtttgtggggtcggcctcgtcgtcgaccggaggagcgccggcgaactccatttcgccaacagcagctgggagacggaagacggatggcgcagaaagagagggtggacggagaagccgtcgctgcaaacgctgagaaaaaagcgctgcagaacgcgttcgggagaaacgcgtcgcgaaccgagacctggcgcccagaagtcgcagcagcagctgaggtcgcaccagcgagcactgggagcttcacgctgagagagaccccacggatacgaagagggaggaacaagaaggaggaacaggagggaggacagagagaagaggggagaaaacgaggcggagaaaacaagcagaaaaaaacgaagagaaagggagactctccgggcgacgacacacgcaagtgagaggaagcggtgcgaaaaagaggcgaggcagacgcgtggagtgcgtcgcgcagaaggcgtcaggaagaagcgacaaaactttgagttggattcacagacaagaaggccaaaagagaaaagctctcgtttcctggcgaatcgaaactgcatgcggcgacgcagcaaggaagtgccgatgagggtgagacgagtggcgaatgcgaggggcgcagaggagaacaaattggagagaacagaaggaaaagaagagagagacgaactcttgaaagggtcgcatcgaactgtggagaaacttcactggttcgcggtgtctgtcctcgagaaacagagagagtctgctgcacacggggaatccgccaactcgaacgccttcgtttctcgtccgtcttcgtcgatgcttttctctgagagatcagtcgggagtctcccgggtgctctcctcctgggggaaagaaaaagactgagctcgcaaccttctggtgtccaaagttgtcagggtcggctgccgacgctctccctctctcggcctcgttctgcatgcagggatacatccgtttctccgcttctgcaggtctctctttaagccggactgcagcacacggcgttcttcttcgattctccttcggcgcgccaactaaggaaacaggagggcaagaaaaagaagaagactctacggaaatttcttgtcgcctcttgagcacggttctcgctcgatttctcgtcggcctcggcaagacagccagggccagggtgccgcagctggttgcgcgtcgaggcagccagagagacgctttgaacggatttggaaatctggaaaaaccttctacacactcaaactttctttcgtcatctctccacctccccttctcttctataaacacactcgcctctctcccgtcttctgagcgaatctcctcttctccgtcgtctctccctccctctgtcttacttctgtcttctttctcttgcttcgtttcttctcttgcgtcgatttcttctctgccttcgatttcttctcctttttttagtagctgtctttcctcccttccttcggctagttcctttcttcctcctctctgtctccctccccagatttctctgtggtttgcatttccatccattctcttctttgttttcctctcaagctgtttcttcttcggagctgtcgtggtgtctgctgcgtctctggaggccttggagcttcccccttctcccgggggttcgcgccgaaattccaccgtctctcttgttttcttctctcgtccttttttccatcgcgccttcttcctcttgtgtctgtgcggagcttttttcgtcgagtcgcttgactgtcttcgcctttcccttgctcctctctgttgtctcgagatcttttctgcccttctgctccttcctttcgcgcgctggaattcgaaatctgcagtttgagtttgccctcttcgtctctctcagcaattctgtgagaggccttttccgcctgtctctcctcggccctcgtttccggtcctttcttcgaccttgtctctccccccctcgttcggcgtctctgctgaggcgccctctccttccctggcctcgcgtctcgtctgccgttcttctcttcttcctcgccttctgccacca

SEQ ID NO: 622 - DNA, 3015 bp, Toxoplasma gondii
ttgaccggaacgcgtttttccatggcaacatgcccggaaaacgaagcagaacacaggcggagatacagatgtgactgagaatactagtgcaaaaaagaaattaggcgaaacaggagtgggagagtttagccgtcgctcacgctggtggcaatcgagagtcaactgcagaaaatgtttttcatgtctgtgtaccacgtggaacgatcgcggccctgtccagttttacagtgtcgaaacagtgtgtggaatcgctcggttattttttgggatcacataacgctaaagtcaaacagaaaggatctggccgtgaagtgtgttagagcaacggtacaggctcgtttttttgtacgtgggcgaaagtgaagagagtaacaaatgcaaaaggaaaggtgcgagcagcgaagaaggaaggcattttatgtcgataagcgcgttccacgaggagtgcgtgttttgattccaagttcacaatggcaatgcaggggttgaacagtgcgtgcgcccaaggcggacgtttccgtcgtcggtgatcgttttttagacattgtggtgctcgtcacgttcgatatcctctacgagccaatctcatcagagtgtagcttcagtttttgtctgatgagctttttccattctggtaatttgtgcaaagcggttcgtcgctgttcgacaaaaactctttggtcaccgtaacaagtgattgaaaacgtagcagaaaccgtccgtcgtgccgcgtaacagaatcgtttcttcgtgcatataatcgtgcctgcccgcattattccgtttcgcgcctttcacagataacacattgcatttgtgtggagaaaggcacgcacattggtgcgcgggaccgttacaatttgattgttccacacgatgactgccgactcaacggtcgtagacagtcccgggaagttgaagatcgagtacactaaggccacatcgcagtccttctttgaaaccaatggtgttcatagacagacggtgttcgggtcaggttgactgtgtaatcgcttcggcttctctctcctttggcggtccgtgcgtacatggtggcaggattttcagatgtacgtgaacaggtatttggggagacatctcggccattgccacagaaagggcgttcagtattgaaaagtacacggtcagaagtacttgaccagtatctgtttttgataaaatcttgaatcgttatttttagataaactttgctttcatccccagcttgtacgaaaaggactgacaccttgcaatcgtcaagtgtgcgtaggccttctcaaatacgcaaccactcaatttggcactgtcccctcctctaggggactatgtgctgttcagtcacgctctgggccctgatccagagaacaataaacggcacgcgtccgcagcggaaaccaggagaagtcattttttcacatctctttaaaaaggccttctgagatcttccctctacagtagcgacagacatcgggatctgcaagtacacaaatgtttgtgtgtgtagacctcgaagacttgtgactgtcgaccgttctggttccacactgttacttgtcaccaaggtgtttctctggtgtatttttgtgggagacggctgctctgcaattgcaccctttgcgctactgctaaacttgtccgttcttctgttggaacggatgggcagaagaatcacgcgagctcgacagcaacctggtacgccgtttgattcaagatttcagaaacggaagaaaggtacggtgactaaaacgagcaaccttcggcatttgtgccgatagcgttgccgttctggcttcgcagatgccgggcaacgagacaccagcgatcgaagtctgacgggagacaggagtgtttcgtcgtcggaccaaagacagttgtttttcccagacagcgtgtttgttgcatatgtgtgattccacactcgtgtccacgaggcaaaacggtacgatacgttttgtgctctcaaaattcctttcccatataccgtccgtccacgttcgttgtaaactcgtatccaccttcccccctccacccggtgcaagaagcggcaggaggaatttgcggcgtttcgcagacaaggcggttgaattcgctgagctcgaggaccgttcttcctgctgcatagttttccctcgctttcctttgttatcactcctctagtggaacaagtgttgctttcggtccagggtgtcgcggtctttgcgtttttcgcgtgtcaggtctgccgacagttgcctaggtctgtgtgctccgaccgggtacaccagaacacgatcgtttcctgccgaccgcgtcggtctcgcggttgccttcgcacccttagcacttcaaatttccgcttttcagcgtttctcccagtcttcgctcctggtatccttcccaggtttgcgtgccgcagaagctcgagtgtccagggttgtgcacacttgtggagcgtccaagacggttttctagcttttctcccggtgaactgcgcccattttcttctgggcaggaggcctcgcagacagtcttttcaggttggaattccagcatcaaaatcaccggtgccgcgctgtgtttcttctctccgtgtaaacacgcagactcccaaccgggggaagctccacatttctgcaacgcgtcccgggtgtacatacacgtcgcgcagcgactggcatctttctgccggactcatttcgtgaatctgcaaagagctcgctgcttcattcgtttgcgtcccgagttacgcggcgttttccgtttcgaacggaaggattctctgcagcttctccgccaacggcgctgccgtaatccccccgccgccggcggtcaccttgggtttcgtcggaacctgaaagtgtgaatttctctgtcaggatcgcctctctcgcggcgattctgagatttctatcagaccgatcgaggctgcgcgcgggatctggagtcccgcccgcctgacgagctgcgttgccgcccctcaggctttccgcccggcttttctccgtacggtcctgtttccgatatttcctggcaaga

SEQ ID NO: 623 - DNA, 2602 bp, Toxoplasma gondii
agtcaaatgtttctcagcaaacaggtacaaagtctcgatcacagcgtctgtgctgtccagtgcgaggagacgcgtggaggcagccgcgctccgcagagacacctggggagagcacgaggagtggagaccggaacctcggagctgcagtgcttcagcaaatgcgtctcctcctcgctctcgccctcggaaggcctgcgctcctgctttgtcctcttcacatgactcccagcctccccgcgttccgcaagtatctcctcggtctcctgcggactctgccccgcctctggagtcggaggggaggcggagagcggagcacttcaaggctgcatgaagacgaagaagaaacgtcttctgatggtcgccagagtctgcgcgcagcgcgtccaacagacagaaaatcacctcttcgatatccaggccgttgatgtggccgccgaccgcgctccggtgtacagacacccggcgagagacagacgcgacgccccctgcctgcgacagccactgctgcatcaaagaggcagaagaggcccgcgcctccaagaagtccggaaggcccacagccccacaagaagcgtaattcggtggagaaaaagaggtcgggggacatcccgagaagcgacaagcctggcgcgaagttgacgatgtgaaagacgaagaggaagaaggagaacaggaggaagaagaagatccggtctcctcgcgccgggtttgcgcttcacttggatcccccgccattgtagggaaagcggcagaccgtggaggagagatcgtagagtctggcgctcagaaagaaaaaggagacaaagagagtggtcgagagtctccggatgaggaagcaggcagcgcgttcgcgagggacatgaacctctctgagattcgcctctgggtcacgcgggtgcctgtacgcctcggccctctctgtttcacgaattcatggcgatcgactggaggccagatgctctgagtttgaggcgcgccgccttcgaggaagtgcgaagacttcctaaagtcgaggtctggtctctccagcttctatggcaaatgtatgtgccccgcatccctcaccttcctccactcctccatttctcttgtcttctttttctccccgctgtctctccagaggcgccctcctgtcgtccacgccgctccttccttctgagccttcgtgcctctgcccgcggctccggcgtttgtacgccgcgtcgtctgggacgtcctcagccaacggaggtcggcttgcttatctgccagcagagccgcggccggaaaagacgcgcgtttctcaccacacataaaggcgtgtggagagatttcgttggaagggccgttcggcaaaaaggagagcctgtagaaggatcccttgcagatcgagttgcgcatgcagggttactctgcgcgcgagcgctctgcgtcattcaccgcgtttgtgcatcgaccggctggaggtcggcctgtcttcaagactggaaatggagtccttttctcagtccccgcgaaagagcctcagagccacactccaaggcgtgtgcgtctaatgtctcacatttctaaagggtgcctttttcgaagtggcaacggggagctactcagctggggctgaatccccggagaattgtcgctgtttcactggcgagtaaccgagcaagacagaagaagagtccggaggcggagagagagcggaaggcaaggaagcttcgtgaagtcccttagtcggattgtgccaacatgtttcgatcaaaaaaaggcctggtagtcagcttcagagtttttgagtgaaatccgaacagcgagacacatcgtcgtaaaacggcatgaggacgcgctggagagtcggtttttggcgctgggtggacgacgcatgcgcgctgcggctcacgcaaagtggacgcacacgcgggacttacagcgggagggcccctggaggcacctggggtcgcggagtttcgtctttccgctttcttcctgaatcgtctttagtcgcgagggctgccctgcgtctttgggcccagcagatgctctgcgcgcggcaaaaagcctgaacgtgctgcgcggacggcaatcgaccccctgcatgcagtggagaccgccgattcccgcgccgccgaaagcttggccaaaatcttgacaccgcgagctagtctttgctccggaagcaactcgagcgaccgtccatttcgaactgctctggtatcagcggtttcgcagaatatgcggacgctgggcgcccggtagtgccgctccggagaagcgacgtggacacacacctatctggtcggcagattctttcccgccggcgggggccggagaggccgcgaaagtgttgacagaaagtctgcactctcgtcccttttcgctgttcgttctgtctgcgacgagaaagtggcaatcgtcacattcgtggtccgctgccaacacacccgtcgacccgcgccgcctcagtctctgaggtgtacgtacacctgccctttgggtgtatgtacaagcctcgaatgtcactgacacgccagggtggatctgcgtgaccgtctgacttgagttagtttcctacgactcgtgaaacgaccctcgtctcccctcgaagctttctttctttcatctgcaa

SEQ ID NO: 624 - DNA, 1250 bp, Toxoplasma gondii
ttattcacgaccgggaggagcagaagtgtttttccttagtatgggtaattgcagcgtcttgaatcttgctgaccacattggaactcacgcgtacgatcgttgctgtttcagaaacgtcgcattctgacgcattttagtagagcagcagtggttgaacaggggaacgtaggtgcccgggagcgtgtttggtgcgtgctttagtatctttaccggcttaccgcccataccgtggcgctgttggagggatatcaggtcagagtatacaaactgcactatataatgacccactgaagagatagtgcaaaagtccaacaagtcacaagtcccagagtcgccatagcacctccgtctagaagatagtcaccagcctcagacgctgaactgtttcctgggtccgcgttgcacactttcgccaacagaagcaccaggtgaattgtcagctgagtgaaggcgtgacacccacggtttagttgctctattcgaaaaagtgacagtatacagaaaaaacgtctttcccacaagaaggcaggctaacatctccgtatctgctcgtgtcaccgttgtcggccccgatccggtctggcgcctgttgaggcatggctgaggaacaagatcgggcaagcgactttggaagcaatgcccacgcacggagttggcatttcacctgctcaatcaactctagcctcgtacggcgaggggcagcctagcctgtagactgctaacttctgttccggcaatcgtgaaaactcgacagccgtcgagatttatgcgcattgtgtgcagtgtcgataagcatggacagtcactgaagtagcagccttttcagcggaaccggcaagcagatcgtgtgtttggcgtcacaggggaatctcgtttccctctctgcctaacgcaaaccaggaaactgcccagtcgcgacaagtggatgagacacgagacgccggtcccagccactggcacagtacgaagtctaagttccagatgaagtcacgcgttgcgtccggatctgtagctcattccagtatccacaacgacgcttccggttcccattaaggaaaatgcgggcatagaggctgactgctggcgccttgttcagaagatggtaaaacggtgtctatacaccggacatctaagggagtgacaggttccaccatcgttgtgggcgtttgtgaattgcggtccttgatgtcacctccagtgaaactaacccggtttcgaatctttttctcccacccatttcgcttgcgata

SEQ ID NO: 625 - DNA, 3042 bp, Toxoplasma gondii
ctgtgcttcgtgcttggaaggcctttgttaaaggagagactcttttctgtggcagttggcaaagcttagagtggcgaaaaagacgtcatgggaggacgtttctcggaactgtccacgttctgtgcccgtgtcacttcctgcgtgtgtgcgaaacgttttcaggcaataggcaacgcgttccggcgtatggggcagtggttccgcaagaagtggagaggtcgttggttcgcgaacaagcagaatgcagaaattgaaaaggaaatgcagagacacacgaaaaagatgaaggaagagcaaaagaagatgatcgaccgcaaagctcccaacctcattgaccaggcggtgcccgctactgcccccgagctcgatttggttcctgatgggcctgaacccgtgcttggagcttcgacctctggatcgggaggaggcttctttgagattgcctccgcttacagacggaggccgcgcttcgacagactggcaagcatcaggagacacgatgcgctgcttgctcgtttcgataaactgtagcacatttcttccgagtggacgagacacgaaggaggcaaacagcctctcagcgtttcctgccttgccgcagaaagtggtgtttgtgctaggtggaacgacttgtacggcgtagagaaggtctaaaacggctccgtcaagagagcttccggtttgctctccagtggggacgactctgcttcgcgcatagtggtggcgttagcagcactgggggagttttaggggaaatggcgagaatctcttttcgatggcattcgcggacttgcgatgcagctgcgtgcgaccacacagttcacagatgcactgaaaaacccttgaaccccgcccgtctcatccgtgaatccttttgaattgaacggcacagatcaagcgcaaaactctaaagaaatccgtgttactgcaaaaagtaaaaccaacttcactacgattgctctacacacccaccccggtggatgctgaagtcaactaaaacaggtggtcttcactctcccacgacatttctaactttcaggtcaagctattttcgaggcgtaacatgtcgattacggactcgttccgtgcctgatagttccacagactctacttatcgagtccgcagttcggcaactggacacggtagaggcgccgacaagtctgcttgtttgaagaactggtgctttcactcgagtatcatgacttcctcaggtcccaaagacaaaggaatactttccactcgctgcagtttggaaaagcccttttaaaacgctccgatgaaaccatcgcatctgacttaaggcggttatgacgatcgggggacaacgctcaggtccgttcgtctttgcctagtcagtgtgaatactgtattaaaggtttccgtagacgtccacatagagtttccatctcagtaaataaaaacatggagtctccttcgtactgcatatctagagagcgaaaaaggctggccacgagctgtgggccgcctgtactagactcacttgctaccgaaaaactcgtgtgtattcactgaatgtaacacgccagaagtctctgttttttcgttagcaacatcaagcgaactggatgtagctgaaaaaacaatcgctcgctgttttcaccgattcacatgcatccctttacctgggaagacacaaccgtcaaaagaatgcagaagtctgagggcgaaggacccaacgaggagatacggtggaaaaacgcattttcccaatttgagtcttccgtagactcctgtttcattgttttgccgactgcgcatagacacggaaaaagtgaaaaaacatccttttctttcgtggcttgtggggagacacagtgtgtacacgtggagcgagtgagacctggcgggtcgaccctaactcgcagttgcttcggttcgccaagccgaagcatgctcgtgcacactagaaagtacagagattcgatttctctatcaagttaatctctcccttttgttggagagcgtgtcaggaggagtccagtgcaacctcgcgcagaacggcctacccctctttttagtgtcgaaatacgcaagaaaacaactgatacagaacgtacacgctggccactgtcatcgcgtccatggactcttctttccccagtcgtttcatttccggggtggaaggtacaaaaaatctttcctcttccgctgtagatgactgttcatcctaacttcttcaagcatagacagtcaccagcatggtcagcgagagcgcagaaggcagtgtgtcttgcgcgaggaatcttgcaaagaaagttggagatcaccacgctcaacaccaacgtttacccttccttgtctaattcgagagaatcaagaattttttgcggtggaaaagcgaatctctcaggagctttcgactcatgattttctaaaactcctgaggttggtgtctgctcctgccccggttgagcacagccggcatccagttagctgcgtccttaaatggacgtctccctctaatgaaactgctttctttagtatctgtaaagttttattcattcaaaactgtttctcaaacactcaggactctacttttcgttaacgatgtactagatcgctcttccggtccacggctgcctttttagctagtttctgcccacccccccctctccggtagtggcttgtttattctattttcttttcagtggtttgctgcacagcttttcacttctttccttttctatccgaggcactgggcctcagataaactgaagacgaacgatttgagctactgagaaggaacccgtgctcgccgggacggcgttcggtctgagtgagctcgtctgcactcgtaaacttccgcctttccaaagtaaatgctacttggaagtactttgctgccaactgagggctttcgaaaggacgaaccttcagacaaacaagttcctctcttcagcttcttccggtcggaaccttcaaccgcgtctgccgacgacagcaccccgacttcgggggcttcggtgggattgcatcgaacgcctttgcgtagcgatcttgccgaccagggaaactgacca

SEQ ID NO: 626 - DNA, 2020 bp, Toxoplasma gondii
caacatgcggaagcaggacggtgcagacgaagaaagcaaagaggaacatgctggcgacgaagaagcggaagaagagggatgtgagaagacaggctcggcgtctcctctggaccgtccttcggcctctggaacttcttcgactcgaatctgaggcgcgtagttgtgcttggcattgagtttcacagagcgaagcagcatgtaacccactgcgctggacgaagcagaagcaaagtgtctccgacatccgccacctcccctgttcggagcagaagaactcctgccgtggttcctcacgatttctgcttgccccgaagacaggctctcgaggacaaacgcacctctctccctccgcctctccttgggcaccgaggcgggtggggagaggcgcaggggacctccttttggcggcgagatatcgccgccttctcggccgcagtcacctgccgcgcgcgcgcgccccggagggcagcagatgaggcgagtgtcgctcgcggtcggcgccggggacatacgtcgcactccaagcctcatgcagaggcctttgcgccagaaaggagcgcatagctcacagacatgtccctccccagagagccgccctgcagcacggactgtctgtcgtaccagaggcctgaccccaccgacagatgggcgagaggtcgaccagacgggagaagagagagaagagagagaggagagagaagagagagaacaagagacgcgagaagagagagaagaggaccagacgggagaagcagtggacgagaaaggcgcgagcgacgccgaaggaaaggggaccggaggagaacgcagagagaacctcattttgagtctcgtctggcaagtggaaaagcccaaagcagagaagggcagaggtgccctaaaccccacacagcgacaagaagagggaataggaaggagatggatgtcgagagagaaggtgggcagcataaggagacgggagagcagggagagaggtgcagacgagacgcgcggggccgggagagcaaacaagtaggcgcgcatgtgagagaagagacctgcgaagacgccagaccacctgcaaccgttgcaggcggagacgaaacggaagggaaagagaccgtttcttgttttcttctcagggacagcgaacggctgcttttggacggcgccgcgacgatgagcgaggacgacggagacgaggagagcgagagggaacgcggttgaggctgagggcacacggaaaggaagtagcaaacagaagaaggcggtctctctccctcgttgggcgacaccatacagaagcgttgcgcaggacaacgaaaacagagagaagcaacagagcggaaagagaacgcaggagaagaacggaacacaaggatggaagtgccggttcacgtgaacatgcgaatttcatgtgttgcatgctctcagctttccgtgctgtcccatttccgttgtccatcgtgtttctttcatgagttgtctaactttaatggcgttccttgactttttccagacagagtaccacagtcaatcactctttggatctcctcccaagaccactacctgcgcataggacctcttccgttgggtctcttcgctgcgctgtcttcccattgttcctctctgctcctcacccgtttctatccccgcgcgacttcttcctttgtctcttgcgcgctttccgggtttcccgtctctttttcttacttcgcttcttcgtcgcttactccgttcttctcttctgtctcccgttccctgcgcgtcctcttctgcagccgcctgtgcttccttgtagttcgctgtttttctcttcagaggcgtggatccgtcttttttctgcgtctgtcttccgctgccgtttaccttgtggttcgccttcttgtcgctcccctttcctcacggccatgtgaggcccttgacaagcttttttgacggagacggggtcgattcagatctctctcgccggcgcttcttttgcgttgtggccggccgttcactcacaagcttatttttcctcgccgctgtttcctggcga

SEQ ID NO: 627 - DNA, 1441 bp, Toxoplasma gondii
ttgttctctccctcgttctgtccctcggtctcgctcttgttgtcgttcttgtctgccttcttgtatccttgtgcgttctgtgtttccctccctgttttgggttccttgttcacctgcctgtcttgtctgtcgcatgttttttccttctgtgtctgaaaaggcattcgagaagggagaaacgggagaacactgagcacccgtgggtgaagaaaccgcagacgacagaggacagggagacgaagacgaaaacgtcagagaaggaggaagagaagaccgagactctggtcgaggattggagtctcggagatccgttccttgacacggacattcctcagacgactccgtagagagaaacaccctgcccatggtcgcgtgtctgaactgctcgtcgaagatcagaatgttcctctcggtgaaaggtgacgatgcgggggaacccccgcgaaggaagacagaggtggaagacgcgggcaaagtggcgttccttaaaaatcgacatcgactcggggacttttccttgcaaggaagaatggacagactgccgtttttagctgcattgaaaacaggatctcagacccctgctgcagggtcacactcgtggaaaacagagaggcccggaaggccggatcgcgtcacattccgaggacagaggggaacgaagaaaaatgaccaggaggcgacaagcataagccgtcagagacaaagaaacaaaccacactgacaaaagaggaaatctttttcgcggcgttccatttcctcgaacacagcgaacactcaacggctcgagtggcctcgtccgcgccgccttgagtgtacatacacctcagccagggaaaggtcgctgggtgcttcccagggatatgtggagctcgaggccatgtgacgacggccacaattgaagcgcaaatctgtgttcgtcatcagtcagagatttcggaggctgagcagagagaaaggcttgttttgtctttctctcgcgacttgccgtttgtaacagcattagcagctgcatgcgcaggcgcgccgagtgcatgcaacggccacagatagtcaattggcggtaaaagtggacgaacgaggcgcgaaaagggtcttacttccttcgttatttttcaagaaggttgaagctgaccaagaaaagttctctttagctggaagcttcgaagatagatgcgatagagactttcgacttcctcggtgtcccgtcggcgctcgacgccctctcagctctcgccccacaagagagcggcaatgggctctctttcgtcgacgagaaaaaaaattgcccgctgttctctctttttttatgtgcagtgttgtgttctgtagctgcgttcgttatctgcactgtttacgtcggaaaaggttgcttccgatgcctgtttcttgtacctgcagcgtgacttcgctcgtataacgcatggattttcgtctagatgta

SEQ ID NO: 628 - DNA, 4271 bp, Toxoplasma gondii
accacacggattaaacggctgtatgtgcaactctgagcggagagaaagggaactgcacaaaaaaaagaagacgcgcgaaacgcaagagatcctttacacacatatatataatatatataatatataatatattatttatgtgtcttgtggtgaggattcaacgaagcagcaatgaaagggatatgcagtgtaccgggagagaatgctgaatgctgcgagctgaaggcggaagagtgaaatgtatgatgggctggcgagtgccctctcgtaggcagacagaagacacgagaggaaatcaaggatgtatggaggccaaggagaggcggtttgcgtcgagagaaaggcctgccgcagcggcgtaacgctgtgaggggtggaaagaaacaagaaaacacagagcaagtcgcaagcagtatagggacgtcgttttctgcacatctcatttctggagtccttttcagaatcacgtaggaatctgatgtgcctgtttgttcggtgtgaggtacacagttctccacgcggttccgaaccccgttaagcactctctctgttccagagacagtcaagagaatacgtttttccgccagcggttgggcggcgctttttgcgagtctgctcttccgatttcgcaagatatcgtgacaaggggagacacgagagttagagggacgacaggacggagcactagcgggtgcttgcgacgctcggcactggaactccgtaggctttcgtgttctgtagtccccgccagaatcacgcgggtggagagagacgccctctgcacaccagaccggaggacggattggttttccaaagtcgtgtggcgtagaaaacgagaaagtctgttcacaagcgactgctcccactcggcacgcgtctctttctcaagggttagcggcagacgcaacgagggcttcgaaaacgtacgatagtcgcgtccgaacgtcggtgtgagacctctcgattcacagtgtttcgcgatacaattcaaacacgacgccagaaggattctaagtggaagacctctcgatctgcacatttcccatcctgcttgcgaaatcaaaaaaacttcaagcccgctgctgttccagaactctacgactttcacaaaacatccacagctttggcagcagtgctgctatcagctctacgactggtcggctgatcgggtgcttgctccagctttgaatgatcgcgcttatggacatgtcggcttctgcaactggcagaacaaaggaatcacctcttcacctgtgtgtctgcgccaccctcagggtccttctgtgttgagctgtattgcacgaagttctttgtcaatcgagaggtcctggaagaacgacctttgctgtgggcgggctggctacatcgcaagagaaagagttgcattagttgtggcggaggctgcacggactgcgtcgcggtctgcgttctgaaagaaatctataatgcaagcttttcgtgccgtcgcatgtcgattcgaacccgcgtttcacttggcaggatgcaccagcgtttttcgcggcaaactcttgacttgagtcgtgccgcagcaagcgtttgtgtaactgagtacggtgtagatcgtctggactgcatggacgacaggacaacacccgccgcaaaacgcggtgtggtctaccaccgtttctcttgaaacagctgtttgccaggctgatttagacgtgttagtcgcgtgcttaggttcttaaaagtgcgacgcgaattatgtttcgctcaaatttgagtgtacagtgtctacagcaaagtaagcagcgatctgttcctctaccataccatcctccagtgtgttcgagagaaaggggaaggggaagcaggtcttcgagcgtcccggtggcgcggcgaggaattatttgctctgcgtgggagttggcattgcacactaacaacaggaaattaaatagagaacgaaacgtcaaaacatgtccgaaggctccgtgctgcggggcccctcgccacccttcggcgtaggcgctgctgtgtctcgtccagccctgttgcgcaagtccccaccttccattgttcgactttcagaaagccgaaaaacagttgcgattctgaacaatgggtaacgcacgttcacatacgtcgaccggaactcgttctaggctgtcaaagcaactcaaaacatccttacacaccaccagaggccatggtgtccgcggcaccgaggctggcggtcgcattgggggatcgacagttcttgatagccttgttttgtgcagtgtcgtatcttcgcaggggtatcccccgggaacagtgaaagaatctagcctctgcatcttcctctgggaaaccatggcgtgatacgagcgtcccattgcggagatgtatgatacacagttgaacccccccttgtagatcggataagtcttcttcgattttctgatgagtcctccttttccaatgaactgtgctgcgcatcccatacactcgactcaacattctgttgatccagataaagctatcttaagaagcgcgcctgattctctttcgcggcctccaaaactcgaggtcgggtatgtagccgcatgttctcacatttttcttgcttctgccggagagatgcgtcttctttatgcggctgtgtcccgcgtatgagagttctgtttctctacttgccccttggacgcagtccggtcatgcctgaataacatccattctttgtattttgcggagaggcagtgcggcaaaccttcgagctctcgcgccgtttctttgcctcaccgcccttcgaagaactggtgaccgcttcgtgtggcgggggaactcgtgctcaaagagtttccagtgtaaaggctcggccaggaagtcgcggcaagcaaatatgagtctgttaaatacggaaacgtcagtgattgaacatagcctcagttgcgtccatgacttatcctggtgacgtctacagcccgatccccctcgatggcctgtcgaaaaactaaggcttttccggctcccggcctccgctgttgcgtttccaagaactggccgatgtctctctctgtaccgtctctcttttttctggagtatgtcggcagcgctgcttgaattccacctttgctccctcttccgcgatgtcgtgctgtcaccacggctgttcgggaccggtgtttgttcataccagcagccacggacactgcggtcatcactgcgggcacgactgtggtcatcactgtggtcacggattctgcggctgttgctgctgctgctgcgattgcaatgaatgctgcggctgctgccactgctgttcgtgttgtcattgttgctcgtgcgcctgctgtttggccgctatcattatcgcgcttctcctttccctttctggtgggctgctcggctttattttgcggtttctctaaaggaaaacgcgactgcgccagtcccttgaaactcgctggactgggaggcggctcacgattccctggttggatcgaaaatcgaatgcatggctgcctgaaatacccccgcaaaggggctgtgaccgattacacaagacagcggccctaaagatgctgctgtggcagcgacgcaggcgaaacacaacttaggacgacgaaaacccgctgctggtgctttgcatagaaacgagctctggtgtatcttccttgccatctaatagggatactatgattatgttcgcatacgctgttgattcccctgaagtcgccctcaacaagcgttctctctgaaatctgaatcagttgggacatcgaggacattgttcatatagatcggtcaccgcaacgacttctgccctcgtctctacgccttgtcaccagtatcttatatacctacgcatgaacccaacattatgtaaatgtatatatatatatatatatatatttacatgggttcatacatgcatacgtatgtatatatatggcttggatgttcagctgtgtttattttcgttgcttgatgcgtttttttcctctttgctggaggacacagtcgatctgcggcgtgcatgtgccgagtgacgaagtgccagagacgggccctgttccgtttcccgggcaggaaatgagctctcactttagtcgaaactcgtttgcgcagcaaaagtctcatattacgtgaagcaataatggcggcgcacggcaagccgagtcccgtcgagaggcacagacctgcaagtgctacgagacacgcgcaatcccaaacactgccagactggagacagtcggtgaaaaatgctagccggggaaataggttcagtgtcttcagtcgtgacgcgctcgtcgccaaatcagaaa

SEQ ID NO: 629 - DNA, 1776 bp, Toxoplasma gondii
ggggtgtcagtgctaccctcgcagagcccgaaaaacactctatcgctttatgttttttgttactcctgcggtgcacccaggtgccttcgtcttcgtccgagacggtgcaaagtcagagagatcgacagatggtgacaatgagatactattagggacagaaaccttgcccctctctgtcgtctaccttgtccgttcccactcacctcccagcagaagggagagtccttctgcgcaggaattcttagacgacgaaatgtgtccaatttcatcttcgggaaaagttaaagacctcgagtcctcggcatgcacaaaggcatgtataaaggcatctaagcatgcaactaaagaagacctaaatagatctggtatcgtcggcgcgtacctgctcagtcaatcggatcaagaaggacagaaataagcacatctgtgtgaagacatatgcgaaacacgtctcaaaaagaatacaaaaacaatgcctgcagaggtccgacgccgttttgtggacgtacccatgtatacgccaaagaggaaaaccggtatctctcgttaactacccctcatcaagcaggtatgcatgtatacagagagaaagattttgctttatggcagcttcattttgagacaatttgtgtcccgatctgcgggagccaccggcccgtttttctgccgcgtttcccgcagcggcctagacgaggagaagagcgtttcttcaagcctccaaagagccgaaacagcgagtgtagagaagaaatggtcgacaccgacagctgagaaacgagaaggctcctttcaaactacggtgagtcggcacattggcgaagccgcgaagccgcgaagccgcaggacggagttctcaagagaagaacggggagaagtggcgagatgtcgcggagagccagaaaaggcattcaggagtttattttcttggacttattgccatgctgtatggtacttctgtttctcgagccaggctgttgcggaagaggaaacaaatgaggggcgaagctcgtgaccgcatgtccagaacgcgaggggcaagagcgaaaggggagggagaagtgcaaaacaaagaaacagacgcaagacgggaaaaagcaaagaaaaatatgtgtagacgagaaaggcgtaatagtctcaacgtggtctgttatgagcatcacagtctctcgacagcggcgttttaaaccaaacgtaacgaacactgttccgcaaagtttcacgcgtagtctctcctttcgattcaataattgtggcgcttacgcgagactggtttgtgttcgctgcgtgtcctttttctctgtccgataaagttttagtctctgcagtgacgctcacgtggctatcttgtttttggatcgttctttcccctgcctctcgctttcgcgccgtatgcacttcttgcttcttacctcgttcgtcgccgccctcctctctgctgtctcccctgccctttctcttctgttcttcgtctcctcttcttttctcacctatctctacttaagtgtggtaaccctttaaacttttcttctgtcagggtcgtctgttctttctccgtctgtgtagggcgcatacggggaaggagcgggcacctcgagagagcaacccgcaaagacacacgagaccaaggctggcgatggaggagaatgaagggaagaacatgctaggacagagacggggcggcaacgagcaaaacgtagacaacaaatcagggagacgtcgtagaatatctccttttttctccgtcttttccgtactgtcggaagcttctcgacataa

SEQ ID NO: 630 - DNA, 3463 bp, Toxoplasma gondii
gcgtgtatgtacgctgcatgtaaactccatgcacacttcagagcaggtctttctcttacaggttggctgctcgtggagggaaacgcgataaatgcaggctacatgcaacttccgagagcaggaccgccgaagttctgatgctttttgtgcggcatctaattgaaaaaccttttcaactccacttgtaactcgctttctgaaatcccagtaccgcatacgggaaagaacggctctgaaagtatctgtagttgtgtgcgtgtcgccacagatttccgcgtcgatctagagtcagactgtgacgtggatcactaccagcactgctgcgacaaagttgagacaaaaagctgtaagtggttccgagaggagtttacacaacgcaccttgcaattacttagagtaacacaatttgctcagtgtgtagcgagagagctacacaaaccctgattcaagaaccccaagatagcacggtcagtagcatgactgaaacgtaacttagtaaggagaaaccgaccattatcaactccattgtcgttaacctagacagatcgtcgcaagtattccggtcaggctaaggaaggagcttagtaaagtgaaggtcatacgacagatgtgaaaggcgtgtagttcacactttcgtaccattcgaagggagggctgaaaatggaattatccgcatcaaaagaatgcgtgttcccacaaacactcaaacggcggtgcaacaagccaggaaagactgagggacacgaaatttcgcggcactgtcgtcaagctaatttgcgtgtctgcgcccgcatatgcaaagtgttcacacctattctgcaccatttacaactaaaagaacgatggagtagggaagcgcgtgctccgctagcaagcaaatttatcgttttcaatctgcttctgcacctgaagaaaaaaagccaagactcgttgcagactcacggttgtgccccagtggagataccttgccttccggattctgtgactaagttcccaccggggaattccaccaaggcatcgggatgcgaaaagcggtcgactcaaatcaatagcggcgaagaagtgggacggaaaccgatagagatggcaaagcaaacgcaacggactcaggcgaggccccttacatttagtgccttcctgtagaagcaggcattggctgcgcgaaaggcaagaatgaacgtagacttctgccgaaaccaaattaatcactgcagcaaatgtgaattaatgaaaaggaaccggtttctgtctgtgtccctgccggtacgggctgcgcagctgagacacctcaacatgctagacggagcgtttttaccgtccccccagaatctgaagggaaagccaacagcgatggtcgcgtttttgattgattcacgtcgaaaacaagaatccgcttcgcgtgtgaacggtgtcttttcagactgtgggacgaagaatagtactcagacgcaagccaacatcacgaacatcacccgcacagccttaatttgagatacttaggacggaacaacggacgatctcacactgctagtggatgtttcgttccaacaagcgattagaagcgggaaatctacacggaaaagtatatgcacgggttccgttatgcgtgaagaatgccagaacctgaagcacgcagaaacggctgcgagcacgcaacccactactacggagaatctcaaattttgctagtggtttccgcgtactttcgactgtttaaacgtctcggcatgttgggggattctgaccgtattgttggtatttccattttgcattgtttcttgaagcacccttaccaactcctcgtggattctcttctacagaactgtttggagcttctctaaatcgattccatgtgactacaggttccccacttccaggattttgtttgttgacttcttggctagcatcgtgttaaccgtcggactgtgaaagtctggccacagcttctgcgtggttctaggtttctcccgcactactcgccgccagtggttcattgctttttgtgcctttttgtgggcggagctctgcgttcagaacggagatgatcccccactcgttacgacggcaaagctcagatattagtatgatcagtaacatcgtagtagcgctgggcgtccctcgagacaagattgtttacatgctccgatgtgtttcgggaagaaacgtgtaagagttgctccataaaatacttatttggattttcgctgcggaatctctccctcttccgtccttgcagagttggaaggaaaatcagtttatcggtaaagcgaagcttcacaacacacgcagaacagggcaagccttttatcagtgtcgcgtaggtgaccaccgacaccagcatgtagacggcaaacccctctttcaggaacgcactggggcaggtgcggcacgttgtctacaaatcaccgttcctttctgtatcagacttcctcaaaccctgacaacaggagacgcggaacttattacgggatgacaaaaacacggcgggtttcgagtttcataccactcgaatcaggtggtgcgcatcggtgtttctcgagacacgcgcattgcatgcggtctgatccaaacacagagagaggctttggtttttttgctccggcgccaagacaaaaaaccacaggggtctggtccgccccttgagccgggagactgtcgcctgccgtggtccctcatattctttcccaaagcttctgtggacgtgcttgaaggtgcacatgtttgttttgagataccttggatttctgcgtttttggagacaccggcaagatatattgggaggggcacgtgggctgtgcctcgaagcgcggcgggaaggggcccgggggcgcttttgcctcgccgttttctcgtattgtctcggacttctgccgcaccctttgtgcccgtgcgatccagtttcaaatttcacttctgaaactcgtctccgcaaagttccactagtgttctaccgcggctccgcaaccggcgacgctagaggcggcagaggcagctgtccctgcaccggacgccactcatcaagacatgcgaccctcgcagaccgcgggagctcgaggttctccgcgtgttttgggcagcgttgctgctctgaacaaagactcttcgttgtgtaaatttcttttttggtacggaaacgcaaactggagaattggcttaccgctggtttcaccacagagtcgccgtcctttgcggtgctcgccggcggcgcggaaactcatgtgcaaaaaacgcagctcgacgaggggacctggaggcggagcgacggagaacgccggtcgaccttagtcctccagttttttgcgtttcgccactgatttcgccggagagatctctgtaaaaggtcggctgtgggatcggccgacgcgcagttgccttggaaaatgcacgcgtcccctactgtacatacgcctcagtcaagaccatgcgtcacgtgtcgccgatctgtctcgcctaactttcacca

SEQ ID NO: 631 - DNA, 4316 bp, Toxoplasma gondii
ttgcacagttgaacttcgttccatttgcttcttcacttccgttcgcgccgcggaactctgaaaaaaacgcgtctgcgtctcccctcgaaggtccgccggcctgttcgcggagcctttcccccgccgcggcttgcacactcggatctcgctctacagaggaactgtctgcggctggcgttccttccgcggctttcttcaaatgctttaggagagagacagccggcgctgcgtctctggtttggtccggagacagaacagcgttaactgtctctgcgtcaagcagcctggggtgctctgccgcgagagacgcgtccagtgcaccacaacagttctcctcgcctgcggtgtcttgccgcctcctctttgtctccaaagacgggttcggacgcgggcgtatcgtctcgcaaacgccgcaggagtcgccgcacagtgggccgactggagagaagggagagggagaaggaagcggggaacaagtttctgaaggagagtctggagacgcgcgacaggagtcgggtgaggaggcgcgttcctcttcgctgtcctgcgtgtcgaccgccatgtttgcagaagaaaagaaacagaggtgacgaggagattcaccagcaaggcaggaagacgcagcgacgttgcccaggcctcacagaaagcggagagacgcttccgtgaactcagcgattacaacagaggaaagcaagggattccagagaacgcctcagtgatcgagatgcaaatgacggcgactctgtccacatcggaagaaagccgcgttcatccaagagcagcttccgtgtcaccggatggagaggcagagacgcagagagggccaacagcaaagagtcctgctgcgtaggagaagcagcgatttgatgttgaccctctctgcgtctggcagtcagaagaacggagtgtgccccaggattcgcgcgcagaattcacgctgggttttcagtccaacagacaaacacaccaagatggaaaagtcacaccacgagacacgtcacgagacaaagacggacttggagagaagtcgcggtgattcgaggaatccgtctcagctgaaaaagacaacttcatttgtcgtgtgtgttgcccaacctctgttgcggctttcgctgtcaacagaccgtgtctgagcactctctgcttctataacacactgtagagccagcgtttcggcatgcggtcttctaacctgagaaattggagaccacagagtggtgtgttcgagaaaaggcaggcagtggaaaaggcagtcgagaaacgaaacaagaaaagagttgcaccggaacttgacccgcctgaattcaacagagcatgcatctttttacgcgtgtaacagcgcgccaaaggcatgcactctgaatcaacgcagtcagctattgcagacgatctggaaaatccaagaacctcgttgtttgtggcttcaaagagggggaaaattctccaacacaaaggacgagagtcttcagaaagggaaggatacatgttcagtatctccggaattacctgagcaagcgctgccgcgagacgctgagactcaccgcttctcaagaagttcagatctagcgcgttgccactctcgaccgaatgagtattctctttgcctgtcctcagttctctgtcgcactcgaaaggagaagtgctcgttgcgcctcgaagtgcaaagagatagtctggcagatctccagctttatagcgttgaaaagaaggggggaacagccgaggtacagaggccgtccgcggcgatagagtctcagaccagactgagagcatccggcctcacagacgaagaggtcagtttctgtcggtaacggtttcttttccccgctgttggcttggcattttactgccgcttcgacctctggcgattctcgacgcgtgtgacagttttgcgcagctcgctggctttggtccacctacaggttcagttcgtgtcgaggtttagtgtttgtcggaggagctctgccgccactcgtcaccagtgtgggcacacttgggctggccaacctggtctgcagcaatggcaaaagatcaatcatatcctttacagaagatccagtggacgcagcagcgaatctgtgtgactctgcgcatggcggagacgaaagaattcgggcggaattcaatgcggggagaaacgcccactgttgtttgccatcgctggattctcttcatgagttcgccacactacagctttccccgcagcgacacgacaagctgaaacgccacacattactggcaataacgaggagcggcagcttgcgcaggtgttttctctatatatccgcctacgcagtgacttaagagaatagacacacggacgtcttcttgaaaacactgtttccggacttacacaggccatcttcgagtggcattgcagcagccctcgatttccttccgctgccggccttcctgttgtgacacgtagacgaccaacgacgcaccgccggtctttcgcacatcctctagagggagaggggacatttcctcaggaaacatgaggaaactcccgtgatccgtgaagacgtacagctgcaagatgtgttcagtctgatgcatttcaaggcagttactgtctcttgtgcatttctcattgaaaagaatgaggcactgcgtagcgactgtttcgtcaataggcgttgctctctccaacagcagcgtaaaacgcgagtatcgtggatatttttcctctgagggaagccactcgaacacagtgacgcagtgtgtgtggctcgagtgcatgtcaattcatcgtacacctctgccgacgaatgcaatctgacgagctagtcgcatcttccgtcaaccccttttccgtgttcagctctgccagtggcggcaggatcgtgaataggactccagataaaagctgcagacaatcaagttctttgtgaccgttgtaaaccaacgggcaagaccactcaggcaacaactgaagctagactccctgttacacactaacgaaggggattcctaggtcgccaccaccccattgggccgcgacatcggctagaagggctgggtttcagaatcctacggcagaggtgacgatgcaacatacgctcgtgcttctcgaattcgcaactataaaaaaggctagctattctgtaaatacgctttgcacgaatcgtgctgcatagagaatcatcgaaagatacacagcccccgtttcctacaggcaatatagttaagttggacacggttataccctgagcaccgtcaaatccctcaaaccacaacgagggtggaaacttccttgagcgactcgacaggcactatggatagcgtgaaagcttcgacactggagaatgaggaaaagccagcccgcgtattgattcctggttacaaacggcaaacgggttcttgaaattcgagaagacagctggaaagtgttggtgcagcatacctgatgtacggtgcgtcttctttattcgcttggtacgcctgcaagcacattgtctgtcgtagtcttgtgtattttgagtcacatggctcgaggattgcataactactgtcaactgcttaactaaaaatgcggtaaagcctgtgatttctctcccgctgcatctgcatgacacccgatccgctgcaccggcgaaacccagcaggtggccgagtaatgcgtccctgcgtctgtttcagcaacagacacgtacagcaagtagaggatgccaccattttaaccgacgttcttgcccggcgaaagccccagcaacaaatagagcgttcaggtgactgctggtttctgggaccacgcagaacagagaaaaaagtctgtgataactggggaacgtgtttcatgtgtgtgcagttgattctgcgatccagaggcggcagcgtgagaatcggttcttctcagcgcccgacgcgtgtgtcacccccgtctcgtggacgaggtctgtgtctccggagaaaaagctgttttgtgtccgtcagcagtcccctccttcgtgaacaactgaatcaccttttttcgctcttgattttctctttttaagctcgttttcggcgttcttccatgctaccgtgggctgaaattaacacccacgctgcagtggtggctgctgtctccgtctccgcaacgcggttttatgactataacggagctttctgctgtctccgtctctgagttcctgtagaacgacgttctagagtgtttctttgttcaaagtcgagtcttctccagagagaagtcccgaaagacgccttccctgtgcatccaggaccttcgaacctcctgaagacatgagcgcggcgccagctacctgcacaacgccagtttcctccttcagagagcgtccgtctttctctca

SEQ ID NO: 632 - DNA, 4018 bp, Toxoplasma gondii
agagaggccggtgccaggcttgtagaaaaccgtgtatgaaaaagagaagaaaacgaggtggaagagaagaagtgaagaagagagagaagaacgtgaggaaacgaaggaggacgagatgcgtctcgacaggagaagagtcagagaaatcccttctttccggcgagccgtgatcattttgaagaagcgttgcgttgctttatcacgctgagcacggatgccgttgtctcaggaagtcctgaaaagaaatcatcttctgtgcattccagagggaagaacgcggacgccgagaaggacgagtcccccgcacaaaggacgatatgttcagtcgaaactggtccggagggaacggcacattttgcgttgttgcctgcattcggagtaaggcattgacctgcaagtacgcagcagcgagctgaagaatttgtatgctttcgacgccagtcagaagatctccgagcggccttccgacgtccgacctgtgcagactgctcgagctgctgagaaacacaaggggagacagctggagaaaaaagagacccagactcaaagaaaaggaaaaaaactcaaccactcaacgtctgagaatcaaaagcaggaaaagagagggtcttgggaggtacgcgttgaaacgcttctcccgctggactcttgcgcatccatctgcgggtgtgtatacagactccttgcagaactagagggaggagagacaagctctgtttcctctcgctttgggcgtcctccctgaccagcgctcttcctctcgaggtgagaaatgtcgcatgcaaagacgaagaaagaaaaggatctcggctgtgcttttccttttccacagcatctcgagtgcaagtctcttgtcttgcgcagcagcgcgccacaggcgagcgttggaagaagcgagatacctttgagttgcgccttcagcattgacacaacagctcgtgcctcctcttcacttgaaaagccgcggctttttccctgcgtggacgcgaacagaacgcgaggctttccatagagaaaaagcgccaggttggactgcatgcgcgcatgcactcgacggcacacttcggctgcgctgcgccaagacagaaaaagacggagcagcggcgaggccgaagaaagccgggcagagttttcggagagaaaggtggaatttcactcaggaccctgcactgccgagggaacgagaagaatgcgcgtctgacagaagtgactctcggctcttcaggaaccattcgctttgaaacatactgctgtcgagcggtgaggttttttccagtagcgacacaagttttagaaccagcgtcggcatggcttctttcgatctagaccagaggtattttcgaaatcaaccggtccgcagggattcaggactcagagcagtgatccttgtagaaatctgcttcgctccagtttcggcattctcgtgaaagtcgtttgaagagtgaggcgatctggcgagacttttctgctcagaagaggccttcccagcacctgggtactctgaagagggacgatgcattcgtatccccagaccaaactcgctgtcgcgcttcagaaacgcgccagttctcctctgcctctccttcagcgagaaaaacgaagtcgagagacgtctttcagcatcgatttgccgcgcagaacaacggtgccttgacgcaggttgcgggtttccttggctgcatccagagcagaaaaggagaaaatacacaggaaaaagggcggaaatgctacacttaaggcgagcctgcaaggcacagggagaacacacaggactcatggagaaggaaaggagaaaaccggaaaagcacaagaacagtacgagtcactagaagagatacgaaatccgaagttgccgcgacacagaagaaacgcctgtcctcaaaggatggctttcttcccttgcatcgtctccttgtttgctttcgtatgctgctgagtcttctcaagaaacgaattgatctttctcggacctcaaagaaaaacctccatctcgtctcacgtagttctggtacaacccccaccacgcacagtccttaccgaaaagaaatactcatccatatacatatatatatatatatatatacatatatacatatatgtatacaaatgtgtatgtgtaaatatacgtctatagaattaaaatgtacatacctacagagagatatataggaagttaacatgtttatatagacgtcggcgactgcatgaggatccatgcggttgaagattgccctgattgctgtctacgtgcgtctccttatcgatgtctttttgttccgatttgtgttaagcatctctctctctctctgtgtcctgttccatacgtatctctctggacctatttatgcatatcgttgtatctctgagccgtcatgttttccgtatgtctcttcgtttgtactcggacccccgtccatttgtagccattttcacatttctggctgggagaaaagtcgagttgcttgtccggtgtggcgaccctgacagatctttactttcactttgtttctttctgaacggcgagtctctgcgtccagattgtggcgctttgcaggcgagtgaagaaaaaaatgttcgagagagcccgcagagtggaaatagaggtttcccggttctctgctgaacgcagttcgcggctttatacagagcttccgaaagcatctttcgtttctccaacgtggagttttcctgtctcttcgtctcgatacatgcggctgagtgcgacagttgtccgttcacaccttcaatcgtcgaccgagaagaacggcggagaaggatgcagagtctctgcggcgaaggaccctcaaggttctctggagagagggatttgctctctgaagattaagcggtccccaggacatttcggtttttgaacttccctccaagttcaggtcgttttctcaggacgagaaatgctctctgaaatgctagatcggctcgcgcagggttcttgtcagagtgtgcacagagacagagacggttcctgaaaggcaggaaacgccctctgaagacgcgtctgagtttcagtgaaaattcttctcttgaagctcgagagcttctctggagagtgtgtcgacgcagtgggaagtatggaagttcatcagcgctagcgggcgttgcaagagaggaggataaaaggaggataaaaggaggataaaaggagaaccttcttttcctcgatttgcgcgtgctctcatcagttcccctccacacacacacaccctgtcgcgtcgctcgcagctccttttacggcgatttttcgcgtttcttccttctaacttcaagcccagttctcacgtggctttcttcttttgaaacccagacacacacctttatttttcaaagaaaatttgaaccgtccccggcggatagacatcgctggtacccacccgccgcaagacacactctgcagcagcgggcaaaatccctatagtgactttttttgggggagagggaacggctcggccgtgtgtgttgcaggttagtttcattttctttggcattctttaatttctcttcttccttcgactcgcctttttccgtttctctctccccagactcctgcctgtcccgttccttccgaagccgcagcagggaggtcacacggtgcgtggatgcgctaggactcgcgtttcttcctgctgtggctgtttgtcttgttcttcggccgagttcgtctttctcctcttctccctctctcccttctttcttttcggactcggaaaaagcctttgttcgattgctttacgggcgagcgaaatccccagaagagaaccgttccgtctccgttccgaggggccggtccggggggtccaccctcggtggaagaaaagaagcctttctttttctcgcctcgttttcccctcttcctcacggtttgttctttcttttcgccttgtcctcttccgcgcttcgtctttctctcttctctttgcttccccccccccgaagtgacccgttgtcttgcactctctcgtttcttgcctcttgccttccctctttggcttctctccagcca

SEQ ID NO: 633 - DNA, 819 bp, Toxoplasma gondii
gagatatcgatagtgcattgcatgcatcaactggccaacagagaaagagagatacaactatgtgctcgcacaacgcatcaatacacggacaaataactacatatatatatatatatatatatatatatatatccggataacgcatctgtacatgcaggatacatgcatgtatggcacaaaatatttacacaaacatgtatgtaaatctccgcagaacgaatcgaaaaatttgggacaagcccatggatgtgtaggacgcgcgtctagatgtgagttcaacgcacttatgtacgatgcatatatatatatatatatatatattatataaatccaacataaatgtggatacacatccgagagatacgatgtatatatatatatatatatatatacaccagacagaaacgttgactgcccctccctatggggatccaaggagaatgtagaccccccagaaacctgaatagaggaagtcgaagcctgcgagacttcaggaaagagttgaatcaaagacgatgaagaaaactctcccatgtttcttttttttcgtgcgcagactgggtcaccggtgtacagagagcgactgaccgtcaaggacccaggtatggcccgcgggtatttcgatgctgtcgacgttttccagatcggccttcatacgcagctgaatcaccaccatcgtgggagagtggaagcgaaaacaagagaaatatgggggagccagaagaagtcgtcgcgcgaaaaaatacgtagaaagcgaaagacgaaggccgccgaaagaggacagggaattgcccgagaaacgacgtcgcgaaggcggga

SEQ ID NO: 634 - DNA, 2287 bp, Toxoplasma gondii
agagactgtccacgccgaaggagagcatgtagccgtgctcctcgaccgcggcgacagtcgcggggacgaccatcccgggggcgagggagttcgccgagaggccggcattgaagagggaaggccgcagcgagagaaggagaactctcgagttctgcgagtgtcggcgccagtcgccttcctcttctctgccttcctttcctcctcccagaacgaccgtctggacgacttgaccgacatagtggcttcgcgacagcggcaggaaggtctgcgcatgcggtttgccgtctcgcgccccaggcacctccgacgcgtctccgaggccttccccacacacccttgcagacgcgaaactgggcgtcgactcttcctgagtctgcgatcgggggacgcaccccatcattccgaaaggcaggtgaacgatcaactcgctggtgtgaacctccgcgacgatccccagaagcagcgaaccgggtgacaccgtctccgcctcgacaggccgcgccagccgctcgaggtgctctccgctctggggagcgcagacctccgagtccggctccggccgcgcagccccccgcgcgcgctgggcgagtttctcgcgtctgcggacttcgcctgcgaccgccgcaggggagaaggctgcaggggaagaggggaaggaagacgcgaacggcgcatactgcgctggagctgggcgagaggcagcctgagacgcgccgccgctctttgcagacgaacgccgcggcgctgctcgcgggaagtctgccgcgtccgagaacgcggcgttcacagacaggaagccaggtcggccccgctgagtctgcgccatgggggcgaaggcggagaactgttcaaggagagagcgaagcggagaaaaaggagaggaggacagcaggaagtcgagaacaggcgtgagcagaagagactcgcagaggaggcgcggagagagaagtcgacctccctgcaaactgagacgcgttcgactcggacacagagcctgtgaagaagacgcaggctccgcagtgcgcgagagagaaacaagagagcgaactgcgtcgaggggaaaaacgaaaaaggagtcaaaaaaagacagacgacgccctgcgggtcgttcagcagctgccgagcgcgtctaggacgagagcccctcgcgggagaaacggagtcgttgcgcgtagcagagcgcgttttgcgaggtgagaaagacacacgcaactcaagaagaagaggcagcagacgacgagaaacccagagaaaaaaaaacgcaactcttcgcggcaatgactctcccacttggcgccgcgtgtggggcagaaaacactcgacggcagaaagggaagggaccggcaaagacgactcgcggagctggacctttcgagtctttcccctgagctctacttctagagacaacggccgaagcaaacgtggagactcagaggaaaaaaacagacaatcatctggcccttgacacagttcccagtttgactcagacccgccgccgtgtcgcgttcgagcgcatgcatgcaagttcggcgcatgcgagtcgcccagacagcgaagccgcgctcgcctcgacgaagcttcgctgtttttccgcgcatcttcttccgaagagacaccgcaaactcttggctgctggcctagggcgtttgttgcgcgtttgtctccaggaaatccgcgtttctgtcgggtgatgccgcgccgtttcgcttgacggatgcaccgactcgcgccggctgtgtacctgctgctacagttgcacactggcgcgccgggcacaaaggtgccggtgtcgacgccggtgaatttccttcgtttttctcgccattttcactgactccatgcgtccgcttcatttcgcgaccttgcgtcttcctgtacagcccagcttgaacttttctgggagacagttggggaattcgttgctcgtgactgggcgccatgtcggcaacgcagccgcaaaacgcaaaggctggccgcacgtgcaaagcgtccttccctttcctgtgaaatgagcgaaacgaggaacttttgctttgcgctgccacagcagaaggaattccttaacagcaaaggaacgtccttcaaaaggcgcgcaaagatgttgacgtagcctccgcaccgcggtgccactgcagtagagaacaccgtcgacgtcgtcgagtcctggaatccggcgtttttcatttcttctttcgacgcacgcgaagttccacaagaacgttcagtgaggtctcttcacgctatgcaaacttccttttttttcgaggcacacggaaaccaagtccaa

SEQ ID NO: 635 - DNA, 906 bp, Toxoplasma gondii
gtgctgatacagtccgatgattagaaccctcatctaagtttatactcggttaaacatgttagatgctagcttcccggctaaacatcccttttatttgaaacacacttcccttcttgccgtttctatgatctcaaagtaccagaagacgtgtggttccgagaatactcagtatatctataagtctattccgggcacaccctgtcttttatcggtgtgctctaaatctaaattcatcttacaattttggttgcttagttgcaatggcctttgtactaacgtttggatacttcagaagcgtcttatgcgtgagctcatacggtctgctcctaagtacgcagtaaattacgctcccccacaacgtgccctagaatttaatcgaactgcccaaacatctgcagatagtatctacacgacatgatatgcagtggcttttccgaagccatgtttccgtctaaatgtcctaaacggtgtgctgtctctatgtttttagacgcggcggcttccttaaacccatcacaatgggccacctactagcagggaggggttctatgggacccgatggggtctacagagatgcggtgtcgatctgcgcaaaactgtcgtttttcctgacggagcccggaatcgtagcagtactctttctcatcggatctaccgcaaccatttgtagcctgccttatcttttgggtctcggattctgggatttgctgacacacacgctgcctgccttatttgccgggcatctgcctgaatctgtgctaatttcatgtccccatgcttcgcaaattgcagctgggatattcattcttatttccatttacctatggcaacaaactgcaagggtcattgcaaaaggatacacactgccacggcgtttcaccgatccgtcccgtcctccaacatgga

SEQ ID NO: 636 - DNA, 4264 bp, Toxoplasma gondii
gggatttgcggcagagtgtgggacatgctccgccagtctagacagttcacggagagactgcgagcgcagagcttcgagcttctcaactcgccaggcgctgcgctgagccctcaaaagctcttcgcgccactcctgctccgattggggtctgttcgaaaaaattggtgtttttcgcttgaagtcggagcgccgggcctcgtagtcgactgtccgcgagtcggccgcgtgcgaggaagagaaggccatctcgttgatcggtgtgaagagttgaggaagagcaaggcggcacagcagcgacgactctaaagcaagacgaccggcgcaatccaggacgcctgaaggagtgcctctcccgtcaagacgagagtgacaagagtcatttacacatcttatgcatggaacataggggatgcggacttccgttaatgccgtcgcataatgaaattccgcattccagttgtcttcagcactcccgttgggtggtgaacagacatcagagtggaagggggagccgcacgggatctagaaaagcggagttgaagcgagacgccactctagagcgacgagcaaatcaggactctggaggggtgcggatccacctctgtttttcaaatgtggcgcagtgtgtgttgcaacaaagacacaccacgggctggctgccacggaacatcgaactgaagaaaaaggaacggatttgaatgagacagggcaacactgcgggctcctttacgagaaggcagagcactggtctggtcacagaactgcgctggcacgcagctgagaacaggattctcacgttctggagcgtcgcgaaaaacactttcgtcggcatgcaagacactgttgcacccgcacgacggcttcttcggtcaagaaaaaagaaagtattcggcgaaattcacacgaggcatcgctggagaagaggtcgaggcttcagaggcagcgagatttacgcagaaggagccactctggctcagaaaagtatctgcagcgcaacccaattaaacgacgcgagctcagcgcggaaagagaccaaaagagaaccgaaaaactgtttttcgagtgtggaaagtcctttattggaggaaaaagagaatttgcactcaacgcaaatgactgaacgacctgaaaaaactcgaagcgcacgcgatacgcgaaaaaacacagcatgcacgcggcctacatgcaaccctatggaaacgcgcaaaaacgacgtaccttggcgtcagtcgggaatttgtcacagttttcttgttgatctcgagtggacgccatcatacatgagaaaagcattagttgggttccagatggttaacagggaaatacaatcctgcgtgtgcagtccagaaacgggagtttcgcttttagacccgcagctgccccgtgcacacagttttaacagaatatgcaagcttctctgcacagttttgcgatcgggacgacgcgtccgactacacactcagatctcggatctgatggctatcttctgcagtttcacgtcttctttgtttgctaggtagcacactggcgaccgacgttcccaatttctgtttctccacataatttccctgggttcgtttgcttgtcagtgaagctggaacgcagaagagaaacgcgctaccacaagctggcatttacagttagactgcggacggtccctgtttaatttatctggggaaaacgctcgctccacgacttgattaccaccgtcgaacggtgcgtagagggccggcagtaaccgtcagttgcacacgccactccatataggtattttcaccagtccagaagtcacagagaaagcagataggggcgcttcctactgatacgctggtgagtgctttggcaagcaggaaagagaaggaattttggggactggttgccctagacctgtccctcaaaaacgtaagggaaacttcagcggatacctctgcactgactcccccacgttcgtggacgtggagccagaggaatggagaaaaagggagttcaagtaagcgtaggaatcccgtttcatgatgtggaccaaggagtgtagctgcagttatctgatcggttcggcgtgccgggtacagaggatctagggcagtgagcaggcgtctgcttgttactttgcgtgataagtaactaggtcagacttaagcgtgaaaactgagggaaatggattgcagtttagtggctaattgtcaaacacgtcaatctcaggttttccatggaatcgatgtggaagagcaggcttcagaggactaccgggggtacttatgactcgcctgtttctgtttagttacagaaagacatgaaactggtatacggaaagatacagcataacatcggtcggtacccacaaccgagctcttcaggcggcggcgtacaagatgggcacacatgagggggaaacagcatcagtctaatcaggcagctttgtagacatccgtttcggtacgcaaagagaagggggcggcacgtagactcagacgcagaaaccgtatttgtggtcgaatgtgagatagacaactatgtcttcgaagagtgtgcattagctggtgaatgccaattgagcgcgggaacactgggtttcgtgaacagtctttatcggcagatccaagtgtcgtttccgcggctttttttgctggcgtttagtatgcccgcctgcacaacgggcctcgccaatgtcaagatcgattgtctcctcgctgtgtgccgtagcccttcgaatgaagtcgtatcatgcgcaaagaaaaaactggcaccgacgcagcactagcagaaacaagagatgttacgacgagcgaatacatctgtgcagcattctttctttggtgcttagaccaaaactgagctggtttcgacggaaggctctccggagaaagggcttttaggaaactcccccaattcttctacttcgcggaaaacgaaaaaacatccgcgaacttcagtctaagacgactgcccactacgccatcgttacatgaaacgggagaaaaaaggagacgcctcaaatcaggcggacagcgcctgcctgtccagcgcttcctgttctccattgcaaagtgggcatctttttgctccaggaagactttcagagtagagatgcagtcgactcggactgactaggctctctgcagatcatttacggggggttccaactgagcagcggtttaacggcataaacgggagagtttagtgatacgctatggtgaaatgaacaaggtccacgcgacgagaccagacgaaataccgcaaaataggaaaggaaatatctcctcgactatatccgttgctaggctttcttgcacatagacaatcgagaagccacaacagctagttggaacacgatgggggctgaggcggccgggaggccgagaggcatgcgaagacatcggaattccgtgtccttttttcgactttttgactcaagaaatctggtcagaaggatgcgggaatttccagaaggaagtcagacgaaaaaacgaagtcattgaagaattccttcccgcgaaaaaagcgaaaattgggcttaagacaggtgttagagagcttcaacttttccacgagccgtacatacaccgcgcatgagcgcgcatgcagagtcgcgcagacgacagccggcatttttggcagcagatttttttctcttcttctgtgacaacgactgttctgctttccacatcgcattcaccccttctctgcagttctcatcctgcctttgtgtctcgtccgtctataaagcgaggagaaggacgactaagaccagcgtggtcgcatgccgaagagcgggacaagaaccagctggagaaacctaactttggcagcgtgggcagcgacgcttgtgaaggcagatcttcgcctctcacctgttgaatagagaagacttttcaactgcttccgttcgaaagctacggaggagatgcgcttgtgtctgtccacccccttgttcccgcattctttcctgtcctgtgttttcctgaatcaggcctttccaaaccgaaacgcagatggctgtagaagaaacggtcgtttagacgagtcgttttttgtggaagccaagaatcgatattttcctcgaagacgagagacccgctgtagcatgcctgcatcgcatggcctccgtggccccagctttttacagatgttgtttccatgtagtattgccctcccttcgcctttttctcctcttaccttttttcatctacccttcccctctcaaattggttctccatttccatccattcgttgtgtctgagcccatttcccatctcatccagta

SEQ ID NO: 637 - DNA, 2343 bp, Toxoplasma gondii
gctgtttgtgtctctttcctttcctgtgcgcacaaactgatctcagtttccggccactctcgcccaaattcgtctgaaatggctcgaggcgagaaacgtctcttcaggtccaattgttggcttgacctctgcgaatctagagagagcacctacaatgggctgtacgtacactggtcgtatgtacacgtagagggcttcaaggtttttgtgacgttgaaaggacttttctgcgacgtttacgatttgtccaagactggcgagaaccagtcctttcagagacgcgaagactccaaaagtttcctgtctcgtgtacatacacctcgtttttcctaaggaggtagccggggtgtcggctgttcgtgccgaatcgccagtttctcgcacacactcgacctctcccgttcctcgtttccctcactgtttctctttttccacctctcaggcgcgtctgtgggcgaaaatgagagatggactctccgtctctgtcgcaacctagcggagacagctgggagcatgtctacgacgaaacgaagggaacaccgctgcgagctatgtagctttctgtcagcctcttctttcacgctcacacacatttttctgtagagatagatgtgtacttgaactagactcgacttccggagtttctctctcgcttcctggagtcttttagagacctagcgtgcgattctaactgttgaaaaacggagtcactctcgagggcggtagcgaaaagtcactggttcgctgtattgacggacgcttgaccacaggtcggtcccgttgcctcaagcgagctttccacttcaacgtgagacgcctctttttttcgattcttactggcgggagcgaagctccccgggcagcttgaccctgcattcgcctcgggcgctgaaccgaacatgtcagctcaacactgtttcgcaacgatccaacaactcagcacaaaaaggcgcattttcaccgaacaaagctgatgcccatccggggacaggagtcctgcgtcctttctcaactggcgaaggacttgcaacggctcggtgtgtgcgtgcacagtcgcgagcgccagatcgcgtttggatcgcgttcttctttgggagacttgtggcaaaaaacatccgccacatggttttcctttcggttcgagcgcttgccggtggcacttcgacgaacagggtcgcttccgtcgacacttggaaaaggaacggaaactccccgctcaaagaaggggctccctttctgcatcgtctcctgttcccagcgttccgagtcgtcttgcccaaccggtggtaggtctgagtacaccgctgggcgacaggtcacgcgttgcggagacgggactgctgcccttttcgctttcgctttcgaaaacgcaaaaaatcctctctgctctggcgcttacagttccttttcagagcgtctgaaaacgactccaccatctgtcgagcgcttgggtggcggaggcagcagttgctcgacagcgaaaagaagcactttttcttctgcagcctctcagggagaaaggagggttgtttttctcttgggatagaaaggctggttgcgaagcgttctttccccatcttccaggtttcgggtgtatgtacaccgcagaatctggctgttgaccagaggtgtatgtacaccgcaacagaactggacacatgcgtcgtcagcgcgtggtcacctcactggtgttcgagcagtttttcgctcttttctcgtcgtttcttccccgtctttctctcttgtcttctttcgtcccccaattttccatctcaacacatggtttgagacactcttcatccccaaagtgatcctctcgtatcttcctctcctccgtttcgagctggtccctcttgcatcttgtgcctgtctgccgcctctctctcacctcagctcgaacgaaggcgccgctctgtttccttcgtcctcttcgctctcctttcgtcctcgttcgttgatcacagacgcaagaagtgtctttcaattttaactggataaagtcttcttgcaagcggcgtggagttcctcctcacccgtcgacaggctcaagcgaggagaacagctgcacctccctgaaaagcatggcttccgtcgcgtctcctgtgagcgcccccgtcgtctcctctcttgcctctccctcaacttcctgccgcacacagccacagcgcgcccccttcctgtcctagaggcatcccgttcgtcctcttcaaactttctccactgtcttcaagtctgtctctcagtctttcttctcttctccccctcttcacagcgtgtgcctgcagggcgttctctggcgccttcgaggcggtgctcaccatttcttccaaaaggtcacagaca

SEQ ID NO: 638 - DNA, 1921 bp, Toxoplasma gondii
atggaggtgttccttcagctccgtttgccgtctcaagagaagcagcgaagaggagactgcagaggagagagacgcggcagatggagaagagacggaagaagcagcagacgaagaagatggcggagtcgacgagactggggaggagtcgcgggaggaaggccggccggacgcggagaggtagccagcgtctcctcgccaggacgtctcgtctttccgcgagaggcgggagccttgcagggcagtttcggatgcagaggagacgtcagaaagctgcttcgtctcgcctcggtgacgcagctcctgttcctccccttcgcgcggacgcccgtcgttcgctgccgcctccagacggctgtcgccggtggcagaggagacggacagggagttgatctccgctttaagacgacgaatcgaggacgagaagcgccgcagctgctgcagcaaatcctgcaccattcgacagtcttccaggtacgccgcgtcggctgcggcggcaggcgccgcatgcagagggaggagcgccaccgcctggggagaggcagaaggcagcgacgcctggaatgcaaaagacatcgcgaaaaaaaacgccagaggtacgagcaacaagaggggagaggacgaagcgcgtagagcggggagaggagggtgcagaaagaaaagcaagggaagcaaagaagagagaaagaagacagagaacaacgaacggaggctggagagtcgtcaggacaggagtcgcgtgagcgtctgaaaaagacttggacgtttcgaacagataaatggacctctcacagagagagggccgaggatcgaggccggagctacagccgagcgacgggaagagaaggaagaacagagaccttagaaggagagaaaatgtctcgaccctgagaggacgcgaggcgagacaggacagatgattagagtcgagagcggtccggcggagtggacggagaaaaaaccggaaaggaacctggcgctggacggcgcgagcggacctgaaatgaaggctggaagggcagcaagacgaagacgatcgcagcaggtgcagagtcgctgaaaaaagctgaggaagactcgagaaacgaagcaacgaaccgacagggaggcaaactcgaggagaggaggcgacttgaaggaggaacagggaacgagacagaagaggaaaggagacgcagaggaaagagaaagaataacgcagcaagagagagaagagaaatcgagaagaagcgacggctgcgatggcgcttttgaccgaggacgaaaggaaaggagacagagaagcccagcctgcctcagcgacaaacagatgagaaggacgcgggtgaacctgccactgcacaggacgcgagaaggatagccggagctgctatgagtctccctttctcacgggaggcttctactccgaaaacgaagttccttttttcctctttttgcgtccagttcaacgaccgcgctgtgaagaagtcaggagcgcatggagagcgtcggcaaaactgcacacctgcgacctttcgcagacgtcgagagaaggcccactggagtgcagcgtctccttggaaagttgagggtaaactggaagtctgtctctgttgtgaagagaaaaatgaactgctttctttctgaaggaaggcagaaggcaggcgaaagcgtttttcctcctcccttcaggtcgaccgacaacgaccttctcccccgtcgtccgataggggaacatcgctttcgcctctcgtattttcttcatgattttctggtgcatcttgtttccggtgcgtcttctccttgttttctttgcctttcatctctttcccatccttctccctctctgtctcctgccttctctttggtctctctccgctcttcgctcgcgttttctcccgacccgtcctctccccctgtcgaagtctacactgttaaagaacga

SEQ ID NO: 639 - DNA, 3131 bp, Toxoplasma gondii
tggattgcaaatgtgccagccggtagctgtatccggcctccgtcagttggactgccatttccgacttggctcgaaaaggacgaacggttgctaagatcccttggaccaatgatcaggcatctgaaagagtcccgtacaatccattgcactgatcagcagctggtgagcgtttttgctatcctacattactgcaaataagaatactaggcaatctggaatttcgagtttctaaacatcgggggagataaattggggagatccagtgaatcagcatgatactgtaaggaagggaagctcgtgttccttcggtcctcagataacagtacattcacgctgattatcacgtagacggggtgactccaattttgacacacaaagctcccttgttagggacacaggcacgacgcctgtggtgactgaactgtagactgcgccgcaactacagtgactgatcgtttgaaacatgaagaccatttctgaacgactcttcggtcgcttgtggcgaagcactctctgttacagccaccttgtgtagggtcgtgatgcggtactacgaactatcgactacattatagacaatctgagtgcccagtggctcatttggagtggaaccacatggtgatggtcgtaggaaaccgaatcgagttctgcccgcgtcagaggagagatcgtcctggcagtaacattgcgcgacgcaaaagcaactccccattgagttgcagtcagtaccgcggaaaagagtttaggtccccttttaacttcttttatgagtcacgctactggtgaaggcggtatgtagcatacaatgagcctgcaaaatcacgcttctacgcgccacgactgtaacgccgatcttccttcgaagacggcataacagagtgatcaaaaactcagattcaggagtatctcttccgtacagaaaacatacgataatcagcctcaaccggagcactacttttgcacctgcggttccagtgacgggaaacgtcgaaaacgcacgggagttgcgcgcctggtgctaccgaattttgacagtctggtgttcgtttagacggtaaagaggtaaaaaaccgccttcatgcttctcagcaggagagatgtaaggtcactcatctcgtacgaaagtcttgcaagaccactgatgatgtgctgagcgtcgtgcagtgagaagtatgcatggagacacggtttcgcgcaaggcatacgctgagccgtcatgcctggtctatcgcgaacaggcagcataggtgtttgcacttcttttgggcgcagactaatataggggggcaaggcagcgttattttaatgcgtaagtactgcaacaatcccattgacaacgagcagggagggaaactgggagattgtaagggccaagctcagctttgcacaatagaagtccccacgacccgctgtgttttttgggaaccacatacaccagtattatggacaggcaaaaccttggtcgttaaagtaccgttggtgtttcggactagagtgtagcctatggtttgccttttctgacagagtgaggcagacttcattaggtggcatgttgcaatggtgtccctgatatgcaattgttgatctgctgttcttcctccgccgctgcagggtaccaaacgaccaactatgttgtgtgatgagccgtgactccattgcgaggtagctatacacgatttacacgccagcggtacccccctcagaaactgtgcgttgagtagtgaaatgccatgtctattggaaggcagtagctctctaaatgaactattccgaaagggacagagaatgtgaaggatgctgttgtctagatacttgaccgaatgctgatgttttcccttccaggcctttctctggttaatgataacatacgcgccagtgccactttttcaaacgtacaaagcggcacacggcaatcggggaattcggtcacgtatcgaacgcggggactggttacctgatgtaagagtattctgtgacaaggtattttgggggctccgaaaaaagggactgtttgatgcttccctcccgatgacgagatggcaccctcaactccggagcacgtcccttactggattgtcttacatccaacaaagcacacccgacgtcgtgagatcggccactgggctgtggtcagtgcgttcatcgttctggttgccacattgacttttccaagcttgtgtgacaaagtcatcagatatgacagcagtacttcggcggacggggggcacatacatcgctccacatctagtcaagaaaaacgttatcgggaggaatatacttctcatacgtcatcccggtaaggttcatccactggcaatgcacacacacatgatcaacagagagctgcatgggaaaaaaacactccagagaaggcacttgcgcacggccaatccgttttttccttttatgccttataaaggtacgatatgggactacgttgttcccagaaggctcatggcgtgtagctggagttatgctttgattaggcttgcactggcacccgagagaacgcgatggttcttctggcaacacgggtttcatgctgagtgcgaggtacaacgttttactacttcatctgcgcaatccccgaggataccatatgtgctctgtgccggcttgcttgcaacgcctgcatgcatgttgatcaacagttttaggtcataaatgtatcctcggctcgtgtacggtgcagccttaagatggggtgtattgcagaaatacaaacaaggtactactaagttatgattttgtcattctgtcctgtgggcagaggtgggtggtgcgagcatctgccacagactctgctagtcagtgtgacctgcggactgaagtggccgacaaggttcgtgcttcatcatcaggggatatgtctcgaggtcgttcaccacagcgaagagagaacaattacagctcggtttttcagttaacagggttttgccgcataacattgaccgctgaattatcgacagtgcatcaatcactcgcctgggaaacgtccattccagacgattgaagagccacagagtgtcccttggggtaaaaaagcctctttctccctccccccgtctctcctcttcaacaactgcttcacgtgttcgctggtgagtgatgcacaccagggaacctagata

SEQ ID NO: 640 - DNA, 3022 bp, Toxoplasma gondii
tatgtgaatgatgtctgcgttcctgatttcggtgggtgctgttcgcagcaagttggtggttgtgcagcgcggcgtctgcaacggctacaacagcactctctcagtatttttgccgaaaagtcgaaatgcaagatatccaattggaaaggccacccgccggtcaccgtcgcttttcgtcggagggtgacagcatcacctctatagggaccgacagcagcgacagcagtggtggcttctatacgtccggtacagaacctgcactggaaagagagacactagacgacgcacgcgtcacgagagaattgcatgtggcctctttcgttggcgatggaaatgcccgggaaaatccaaatccaaagccaattcttgtcggccgatctgtttcggtgcctcctgtccgagaacgctctccggaaacaggaatgatgggtcctgcaactcaagacggaatcgaacttagactgttgtgacatcagtgcttccgttttcacagttgtgagcaaccggctcaaaacaagtgatggacgcaaagtttagggccgcttttcctttttgaatgcttgagatcatctgctaccgtcccgaaaaccttctacttgccatcctgctgcctacggaaacggctggggcggcctacgtcacttttctaaaagcatctcacaggatgtcacatatctaagtggctaagtagatgtgttttgtttggattcaacatgcgctcccgctctcaaacaatgctgcattctagagatacggggtacggccagtttcctgctaaccctgaatcacggtatagttcgcaccagttggagcagcacttaaaacccttactcgagaagaggagtagtggcgccgatatttatcactggtttaaagcgattcgggacgatctacctttgacgcagcattcggggctaatggtctgtgctctgtgtacctggacatctatgtggtttatgttgacatgactgttcaactaaggtggaactctgagatatttaggctgtgtcagtctctgaagttccggatgtttgcacaaagtcgtttcagaaatctagcgcagcgatcagattttgcgacgggtgtgtcaagacagcttaaccgagtgatctggcgtgcctaccctcgatcccacggtggtgtttcgtttcttgaaaacccgccagacaaagtcttccagacgctgtgtgcctaacggccattcgtaggcgagtacaaaagagtaaaagaggacgtactactacggtgcttggcgaattgggtatcgcgggcgttttaatgggacctgcctttgtcttcgacggggagctagctattgagcaccatgaagtagcagagccctgtgcgagctcggacgaggaaaacgtgattctaacgctcttaagggtgagaattacacatgctgctctaccacattggagttgtgacaggctgaagcactcgtgttttgtcgccacgtacacctcggcgagtgcatgcgtgcaaaaaaagcgggctttctataacacacagggggtcgaaaaggtcacgtatatctgccattcccaaactacaaatggaagactatatcatagctccagatgaatacggctgataacgcgcacgagaaggtttttcgagacctgcttctcttaagacagtgtaagtgcctgactctagcgacggcgcattcttttgcgccgcctgtgctggttcgaggttcgccacttttccggtggtgggtcgccgccaggatgccgccactcacggttttcttttatgctcgggagcaggcacttggaagcttcaccgcaagctcgtcagaactgtttggttggagaaaagcggcagcaatcgtacagcgtctcgtccttatgttcacagaaaaaccataggcaggcaggaagcttagttttgttcagtatggttggttgccttgcctggcggaacgaactcggttgtttgtggtggtgtatttttctttctgggcaatgttcgacattgccgaaacgcggatatttcatgttttctcgtcatctgagcactgcgtcgtttaaataacccaatatctatcccgtctttttctcgcagaaagggagcatcttgtccctccgacaccgctgaacggaaagcgtcctcgcgaaacgggtgcagggaccacgccatcggatacttttcgttcctctgccgtaaacgtctgctttttgtttcattatcatacttttttgcgtgaggtttctaaatagcgtacactggatcgtgtctggggcaggaaatcagtcaaaaagtgttccttccatcgggagctggtgcgcgtcgcgtttgtctgttgagtgttaacgcgttttgcttgaaaaagctgccccttccggcctgcgggctaggttcgaaaaaacagccgatgcttatgaactctttctaaattcagagattccgtgttgagggcgcggtaacggaacagttctccgctgcaattcggcgtgagtccgtcggccaccgatggaatatgtgaaagtagaagcgaacgcctttcctcgttgtaagagtccactggtcggacaaggattttttatggtctctcagatgcagacacaacgtcgtttttcttattctctcagtccggtggcaggtgctgccatgatggaccccacttgcgctgacctccagctaaacgcgagggtaacacggatctttcacaccatattgtcctgccgggaatttttgtaccgtctgtctttctgaagaggccccgtttttttttctgtgttgaccgagggtccgagtctgcggtgcactgagttgcgcctcgccgttcgccgcagccttccagctctcgcctcttttcttcttcgtccgccgcgtttgttgtctcgtttctgcggaatttgtgcgtgagacagtaactttctagattcgtattttggtttccaagccgaagccaaatggcactgcgttgtctggcggctttcggatattccctcatcgccaaaaccgtttttcttccacctcctctaatcctttcgatttaactcttctgtagaga

SEQ ID NO: 641 - DNA, 2668 bp, Toxoplasma gondii
ctcaagaagagagacagcagctaacgggagagagagcctggagagaaacgcgagtcgactgaaagtgagtcacctggaaggggagttccacgatgacagaagaagagggacgcagaggaagaaccggcgaagagcgggcgacatgcgcaccgcgaggagagacgaacctgctcgggagaaagccaaggaagatcttcgcggttgaggaattcccgcggctgaaacgcatgcacaaatggcctggcgagcagcgggaggccgtcgtcttcctgctcctcctgccaaaagcgcatgcgcgactcctgctccacaagcgagacctgggggtcgccttcgttgtctgcgtctgcgtcgccagtgtcctcagcctgctcggagactgccgcagctcggcgacgcccgcgagccgatcggcgtcctaaagacagaagaacaccgcaggcgcatgcagcggcgaggctagggagaggaaggcgagcgccgagggggggggagaggaaagaggagagaacgcagacgggagaaaagaaggtgaagccgtgaggagcaaagggagaggaggaggcaaagcgagcgcggcgacgacgtcgacacaaagaggcaagaccagcaggtgcaggcagcggaaagcagagtcagaagaagttgatttggggggggggggactgcagacgtacgtacagttgagcagtttcgaaggcacgcgtctagcaaagcaacagtggaagataaacgagggcaaggaggcgcacccagagaggagagaacggcgctgtccaggtacaatgtgaacaagagaagacggcggcaacttcgtcgcgtccaggaggcttcgcaagttgctcgaaagaaatccctcacctgctcccgtcgagaaaaggcgaactgcatgcgctccagagaaaacgcggctctcaggcgctctcgtgccatgcggtggaactcgaagagacagcgccggagagacgacctgcagtgcgagacgggaagaggagacaacgcgagaggaggagacagcgcgagcggaggagacagcgcgagcggaggagacagcgcgagaggaggagagagcgcgagaagaggagatagcgcgagaagaggagatagcgcgagacggagacacaggataggaggctacagagtcgctgcgaggcaggaaggaagccgaggagatagaccgagacagaggcagtcggaaacaggagtatcgctcgagaggaaaagcgttgatgtcgcaggccgacgccggcggcctgagcaggaaccgaggaccgccagagacaggcagacgaaaagagaagaaagaagacagagaagagaggaaaggcgggagactgtgaaacaaattcgccctggtctccgtcggccagagactgcggctacccccgcgacgcagaggaccgcacattttgcgtctaacgaggaatccttttctctctcttctcggcgttcatcttccttctttcgatctgcagaggcggaggacgactgcagggatctgcgagccaaactttcacgaaggagacgcgctgcgacgattccgatctgcgcgcgttcgattatccgctcgccgagtgccgcatgccacagtgttcgcgaccaggcagaccgccgccggcgcccgttgtcgaggctgagtccgccgcatgcgcccgcgcgcggattcacctttttttcggaccgagagacgcaaacagggaaagaaaggatggcaaaaaggcgtcgagatggagagaagaagggagagaaacgaacagacgaagagacctcgtcattcgaagcgagattccgcggcggcttcttgagcggcgggagagggccgccgcccgcgtctccgcggtggcgggtccaagcgcggatcagctgcatgcgcattcggcttctttctgtcattggaaaagaaataaacagttgttttagaaatgttgcaagagttcgaggagagagaagaactcttcttaactcaggtggatactctggtcttcctccgtctgcccgcgtcatgaccaggcggaagacggtgtgctactgtatatcctgcagcgacaccgcccctgtcgacagaggaacgctggatttttctcgctcgactgtcttcactttctcccaacgcgttgctggaggcgccggccctgtcctgttttttttgcctcgcctcttctcctcgccgtcgcggaccagacgcctcggcgtggagagggccttcgagttctgtccgacaaccatctcttggcgagacggcaggagaaactctttgtcgagagaaaaacgtgctgctctggacgactggaagcaccgttctcttcctcgaggcggtcttccagctgccggatttcttcgccggtcgccgcaggaactcgcagctgctgaagaccttgctcccggggacagcaggcagagccgacaagagttagtgagcaacggaggtgtagccttgggctaaaagcagggggagagccgctcgaacgccgcaggcaatctgtagagctgagaagtgaggcagagcctcttggagcttcgccgaaaaagccgcagactggtcaatactgtgacgcaggaacgcgtgactgccgcgcatgcactggcgcacagtggacggagggcaagacaggggaaactctgaaaaggagacggaacgcgaaggcgaacagcgcaacatggaaagcca

SEQ ID NO: 642 - DNA, 1508 bp, Toxoplasma gondii
agagctattcagggtttcagcgatcaatctcggacggaatattccccaacaaaagaaccggtcattctgcacagagtacctctccctgtacgatgctcacagtcatctctcacggtactagtctgcgctgtatgcacatgcctacataaatatatatatatatatatatatatatatatgtggttgcttgtatgaagagtgggattctgcctcagagaatacctccgttagtacgctgatgattttcttcgcacctgcgtagttcttttgtgagaatcacggaaacagccgaagcaaagcgtctgcgacgcgcaaatgctcgaaagtgaatccatatctacaacgaagaagtggaagtctatctgatgcagcgtgagaagagcgagttttggaagttttctgctctgaacaaatacacaacaaagtaatgcaagagactgcaaaaaaagcacaggcttcttatttgacgcgcttttaaatgaagacagatgtccagactgcacgcaattgggacctcatgaggaaagctgacgtcggcgcggcgtagacagaagtcaacctgtctctgtgcacctcggagtggaaatcttttctttttcttcattgcgttcctaagtctacaaccggcatctagtcaagcatatatatatatatatatatatatatagagagagagagagagagagagaggtagatatcgatacctatactcacagatatatatatgcatatgtggtacttgtgcgtatatgtgcggatgcgttaaagcgtcctgcaaagttcgccgcgggcgttaagcagatatgcccagtgtatctgcaatgtgtaaaatctgaatctctctcgatctaccaggttgatgaatcgatgtatgtctacgtgtatgtgactacgtataagtagatacgtatttgtatgcagtaaatggcaaagaagaatgctgtgtatctgcttttgagtccgtctctattaagatcgaagaatccagtcttccactctctgcttccctggacgagtgtgtggagccgagacgccagaaaagcgttcctcccgtttatttgtatgttgggtgcggtcgccctgctgcaggcgttggttcttggtttgttctgacgcccagaaactcttaaaaacgcgtttcgatttgtctcatcgcagcgccgcacatgcaagtgaatttctcttgttaccttttcagaatataggccgggcgggggtctttcgaaaaaatgcgttcttccccgctggctggagtagggaatttcccggtgaatgcaagtgtttctgtttgttgaaaaagatttgcctttccaacatttccggtcttttctgcggtgtgctttcactcctctctcgtcgacctcggggcacacaccgcgcctttgcttcgcggcaacgagaagcgagtttcttcggtgaattgtcaaagcaagaactttggttgtctttttctttgtctttcttcttaccggagagaacacaactgcctgactctcgaacgactggca

SEQ ID NO: 643 - DNA, 1742 bp, Toxoplasma gondii
gaaggaatcgcttgaaagagacagtttggagacaaagcctcggagaccgttgaagagagggaagagagcactcgacctctcgcggaggcttccactgtttttgtaaaagtggagtcaacttgcaagggtcgttttctgtgtgtcacaatttcaaacttggttttctgaaatgagggacttcctaccgcggtcgatctcttgacctcggcagttgtcggcttctctgaagtctgcgtttcctccattttcgtcgcctgcaagtttctttgtcctcacccgctgtcttcgtctcctcttcctcggttttcacgaggcatctttgcgttccgtccgaccgcaaaaacgctttcgttcactcgtccttctcctgctttttcgccaccgccgttccttcggtgtctccaccttccgtctctcttctccttttcaactctgcctttctcctctttctcgagtcacatcctctcctcttgcttccgggggactcatcctctccgctgccggtctcaactcctctcttccggagtctgccttccttgcttttcttctccgaggacggccgaagcggagacggccagtcgtttgactgctccgcagagagagaggtggatcaggaaggtctcttatggatcctttttcttgacgcgtttctctgcgtctcaagcgagacctgaaagagttggaggatcgacgaaaacgcttcaaatcgaggaagctgagtcaatgctgctgtcgcacactgaggacgatgtgcaagtccatcgagcttcgtcagcagcagaagaacgaagctctgcaggcgcgtggaaagacacccgccacagagacaggcctccaagacagaagagaacaaacgaaaagaaaagaaaacgaaggactggcgcgcgctcccggcgaaggccgcatttgtgtccgccgaaagacagagactgtctccggggaaatcgacgcgaggagacgacagaccttttttggaacagctgagaatctcgtacacacagccgacgagacgccggacggattttctggagaagcaagccgaagttgacttggaaccggacgaagtgtatgcactggaaagcaagcgaaaattcgtcttttcgccaaaccagggatatctccagagcaaacacgatggagactggaactccagaaataccaagctgctgctggaccggcggtcggactggcgtttttcttcagctctgtccactgcgcgcatgcagggagaaaatcgacaggacttcgagactctttcgaacgaggccgtttgttggattacttgcctctttctccacgtcttcctttgtctcctccggagcaaaactctctgttgaagtttcgtcgccttcctgctgtgagtttttcatctttcctcctgttctcgactcctttctccggacctgtccacctctcttgcatgccaagcggagaggagagacgccctgatgaagccctccacgtgacgaagcaagaaactgagttctctcctatctctccagcttctttcttccttttcttccttttcttccttccagtttctcaacagttccactctccagtgcttctctcgcttgccttttcctagtcacgttctttctctcgtctcgtctctccgccccgcagtgctttcccctctctcctctctcttccgcttctctcccttccgcttctctcgcttcctctcctctctcttcattcgactttcatctgtctcgtcttccctcttctttctcgcaaga

SEQ ID NO: 644 - DNA, 1330 bp, Toxoplasma gondii
gcaagaccatggacagacgcgtttcctcgtgtagattcatgtctagacgccgaggccgaaatgctccagaaagagaagcgtcgcctgcctcccggaaaagcgtgtgaaagcgtctgtgtttttgcaggtccaaccgcagctctgagaaagagaggcggctccgagaactccgccctcatgcgaggaaatgtcaagacgcttccagagattggtctcgtcatcgcaggagatgaaagaagaaagcgaaagaaagggagacgacggcagggccaggagacttgggaggactccgaaagggagagaacctgggcagcgtcttcgattctcgatctcctcagtttcctcacctttcgctgtttctctttctctctctctcccaatcacaagagctgcatgcagaagaaataacacagagtcgtggggagacagacaaaagaggaagtcagtcgtcggcggatgtgtacgttgtaggcgtgtgtggctgctcgggtgtacgtacacctgggtatcatctcctcgggggccaagcaaggcacagagggacggggaaggcgaaggggggaagcatcagagaaaccgagaaaaagatcatttcgaatttgtttttttgcctgctactgtttcctcatttctctgaagaagcgtggcttcggttttctgcacacgagcgtgagaacgcctgcgcatgcagtcacaagttgggggcgccggggagaagtaggaaaattcagtgccaaaggccctgagaggaggagacagaaaacgaaattcgcgaaaaaatcttgaaaaattagaaagaaaatgtgtgggagaaatgggcacccggagtttcctgactctggtggagagaaacaggtcccgtgcatgcacatatctgcatgcagtgaatgattttggagaattcgtctggaaataaactgcttcgtttcttttgcaagtatccagactcctgcactaaaacccatgattttcggtaccttttttcttttatttgttgctcccgcttcttctcgagtctctcctgaatgttcacaccagcgtcgtctttttcgctgccgcagagttcgtcgggggggaggggggaggctcgccgtatcaaggagtctcgtgtgtgttgtgaccgttccttgagtttctcgttttcctcccagcaggtccgccgtcttgtcgcccgctcttctggccaagaccgaagagcgacacaaggtttctcctggctgttcagctccctcgacggagaactcggctaccgaagagaactgctgcgctggttctccttctcgcatgcagtggtgaaaggaagaaccgacttccgctggctccgtcgtca

SEQ ID NO: 645 - DNA, 4122 bp, Toxoplasma gondii
tggactgcatcgcggtctgtcaaagattgctcctacatgattaaagaattcgtgggggcaaaagacgcgcttgtccttgcttcgaacaaccggggttgtacatcaacgggctgcacggctagtctgcatcctatgacgtcccctacacgtttcttttggtacagatcgtgacgcaacatgcactccggagtagagttagacgacgtctcgcttttagcgccacaccgccgctgtcatacgttccagagatggcacctgcatatctcaaataatgatctcggctggtgatccgaggtgacgaaacgccctcagtgaccggatacatctactgaaccgtattggaaactctgccgcgcctttcaggagacactccagtgccctgtatgcacgctcatgcttgcttggaagaatgtattcctatctctggtattttgccacctggtaccgcttcgggaagccccgcttaaacagtgcaacgcatcgctgagtactgcatagtgtcgaagcctgctactgcttgtacgctgctgcatccagcgacagaagcgagcccacaagggcatcgcaaatacggggacataccgtaatgacatggacacaatatgcatttacagtttcggacagaagtttgccctccgctcgtaaacgggacgcggtttgcgatgcacgccttctgcgctgttcataaaatatataccacgacgaccacgattaagatgatgaaaagccttgcagatgcctcccgagatgcactgtcagttctctcggagtggcaaaaaaaccaccacactttgataagtgtcgggcgcaatacgaggaaaactccccactggcatcacctgtttttttaaggtcccgtgttgaagcgtacaaggcatatcaaagaagaattaccacacagctcggaaaacgattgagctactcgcctttgccgcagcaggtgatcaccgaccgaagcgagtatgccatggagaagaatgccagaaccgcgcatgccagtgatgtgcatgactcgacaacaagccatctgccgcctcccatgatggtgaagatcttgtaatcttccatattatcctctgtgggtttcgtaaaatactgcggcacgccgaccatcccaacttctttaacgatgttgtggtaagtagatgtgactacgctacagctcacaagagctacaactaacacgcagccaaatgccgctgctactaaaatgttgcatatcttaggagagagacagcaatgggtgatattcaggattattgccaccgcgaatgcaagaataaaccaaatcgcgcctaaggaaacagtgtatccttgaccacctccaccaataatgaggattgctcctgaaatgatgaccaacgtgacgcaagggacgtacctgaaaaatatgcaaggacaataattaacagggggccatcaattactcatgatacatgagcactgctctccggacatcgatattggcgaactgttgaagaccgtgcagcttggacgtccacagcaacaatacaagtctttcccgcacacgaaaaacaccacaaacgagtgaagcagtttacgaaccccccaaatcaccacgctacgtagacaaggtgaagataaccgcacattacagtgtttgtcctgctgactgaccgtcaacctacgaattctatgtgggtacttcggagatcccgacgcgttcacgtagtgatgagtgcagaaggcatgtgacaatgtacactcggtactaagaacaccacttacatctgcgcctccggaattggtgtgtcgttgcccatgccatgagcgcggctgaacgaagccagtgtcgcaagagataagactgcgactgctagaatgtacccgctgttggccctagcgaagtaggtgtcggcttgcgaccacgagttctctccttcaaatgaaagctcctcatgtttcacataggaaatgtaaggctgcagatacgctccggcagtcgcagcactgacgacgcagtagaggctctcgacgatattgataatgcacaggggacacatgaaacacggagaaacaaacagacccaaagcaacaactgcagcgataagaacagcaagagccatatgaatgagacccatatactcgaagacactgtatgcgttcgttgtcagagaagacgcctccaagatatcgtggatgtccttctggtggcctatcaggagcatgatgataccggtgacgagctgcaagctcaacgccgtgcaccacgtgccaaccgcagggctctcatagccaaaacgctttccgcaaagccccatcttgtactaaaaaatcccttctacactctacaaaaattttcgccctacgatatgtccaacgaaacgtaacgacggctgtttcaccagacctctagttgactctcaggtgatgtgacctcggagtggacgaagggggtctcgcgttgcacccgtggacttcaaacggggacgggacctaacgacaaagctgtttaagcgaacacaacagtaagttcccaatagatccaacacgacgttctttcacgttgagacacactggaaaaacaccgtgcaacgaaatacacggcagcatatatggtcgccgtccgctggcgttctctaaagacctcagcccgcgcgatctgcccgtcattcgacggacacggacgggactgctgtgcagctttgtgcgcagctcgaagacgtttttacagaaccgctcatgacaccacctcccctgtgcccgccgcccgccgcgtgatagctagtgcgtgcatcctcgtttataaggcgacccaaataaaggtttgggtggttagtttgcaacaagcccgaagacgttgacacccgcgccccagttcgagatgacgaaatcaggatgacgcctgaccgtcttttgagcgagagggccttggcggttgtccgccgcatcgtagctccagtgtagcgtgcgacaaaatagagaactcgacgtgagatctcagcagggttaatcaaggcactgacctcacttacgcaatcgacccgcgtgatcctaagtcagcggatgaaacactccaatggtgtaactccatctgcatatcttcgtgctctgtgcaatgtttactcaattaggaacacatagggtgctcctgttgattttttcatcgtaggacgacgagaacagtcgtgctagaccgagggaaggaagaggcgagtatgctctttcgcctacggaagctgtctgtacactgagtgaacgccacaacttcgcgcgttcgtccggcgggtgaaaaaaacgaaaagtagcaaaagacgcagttgcatgtgttaattcatcttttccttttgtgtctcattttcattgccaccgctttacttctgtccttgcctgttttctttcacagagttgtactggccgaccggcggccggttgctttttctcttttttgtccgtttgagatgctgtgtgaactaatccagtctccgcaacaggccagtctctgttgaactatttataacagaacggacgtctgtgaactggaactgttagaaagcgctccttttcccagtttcctgagtagcagagccgctagctcctagaggccatcgcaaaaccccgtcccgttcggagtgaccgggtggaacgaaggcaaaatttttgcccgcttgccggttttggcatcttctaccatttctgttcttccacgagactagctttattcgttgcttcgttctcggaggccacttcgtgcttgtttctagtgtagggaacagggacttccgcgtcagcgctgagcaccaggcccctgctcagtgacgtggagaaattcttcgggaagggataaagtgacagtcacttcaattcatgaaaaattgggtttgggagaagtttcccgcattttatttcgatgagatcgttcgaattgaggctaaagcgtcccttctttttcgctagccacatcttccgtagaccacctcgagcatatcaaagacatactggttttcgtcgcgttacctaagggaacacttgaagaggtctcgagcacgagtggaaagaaattgacgcaaagcatagtcttcgcggtgaaggaacagtggcgttaccaggtgctgctgttcagagcacacactcaaatcagccggttcttacccggcgcga

SEQ ID NO: 646 - DNA, 2512 bp, Toxoplasma gondii
aacgaacgttgagtctgcctgcgcagctctgtgttctttttctacatctgtgtatgcatgtgaagagaaagaaatcgatttctgtcgagactgaaaaccgcatgcgtctcgaaaaagttacctttgcttttttctgcgcctgagggagttgtcaaacggaagggaggccgccggaggcacgcaggcagcggcagttcctcctccatgtcgtcttctgcaggatgtttttccacatgagaccgcgcgttcgcctctcgggactctgagggctcccgacgcttcttcgcgcgcctgcccgcgagttcctcggctagcggcgccgcacagagaacgaggagcgcctcaggcggagacgcgaggccgaaggacggcacaaagagacccggcgaagtcgcctgaagcgacgcagacgcagagaggctcggagagagcgaagcagcagcgactgcgtcggaagaagagagagaagagggagacgaaggcgagagcgcggaagacgaagcagtcgaaggagtctgcagaacctggcgagaaaaaggcgcggcggcaggcgatttacacagcgtgagggaagtcgcacccgaagcgtagagttccgcgccgtcgagagaagcgcagggagaagaagcagcctcgcgggagagatactgacacaccagacgaaccggcgcgtcatagtactttgtccggagtaccactccttgggggagcgcggaacgctgctccctcacggcgcagctgcaggcggtcgaagttcctcgtccttcgatgggtgtgccgagcctgtggaggaggtcgcggaggaaaagatgcgccggcgaaccggaggaaattccattcgggtgctccgcagccttccctgtgcatgcagacgcctcggttctctcttcttcgggccgctgagccgcagcgctctcctgtcctcggctgtctgcttggctgtctcccttcagcaactcctcagagagcacaagcagaagcagcaccggcgcgccgtggaggccggcagaagcctctccaagcagatctgcttcgtctgccttctcgtcacagcccctggaagacgaagaagaagacgccgaggttgatgaagcggaacagggagaacatgaggcacacacagaggaggacaggggaagagagagagaggagagaggcgcagagcgctggagcgcgttttcgccagaaggcgaggagcggagaggagacatgtcatgtgcgacctctgctgaggaagagcgatccatgtttgcagaggggagaaagctggaaaagttgcagtcgaagagttcacctgagagagacacgcgtcctttcgagaagcctctccgctgttaaccgcccttgtgttcgacggccctctgtctgctctctacatacgccaccgtgggatgagaaggacagttgcaggaggacaagaaagacgaggaggacgagacggaggaagacagaacagagcaagaagacaaagcacaagaaagatacggagaacaagaaaggaaaccgggagacgggggcggtgaggagcacagcgaagatcgcgcccggcggtgactgcactcgggtgtctccgcaaagaaagttcagctggtgagttcttttctcaaaaactcgaggaagaccgtctggtcgaacgattgcaggcggaatttcgctgaagaaaaagaagtcgagagacaagatacaggagaaacgtctcagctgtcgatcgcgagcgaagcgggtgactgctatgtcctggcacacacctttctcattcagcacagacgacctcctttctttcgaacctcgtctgcaggcagatgagagaaaataaaagaaaagttgaggaacaagtcttgaattgtggcttttctggtccgcgggagatggtcctcacctcaggacacccttgtcttcgtttttccaggtcgggaaacgcgctctttgcgtttgtcaaggtcatacgtcgtctttgttttttctggtggatgctgcatctttttctctgtgggtcctttcttcaaatatcgtcgcttcggaatcttcggagctcctccggttcttcttttctccaccgcaggactccccaaagcaggcgcttgtcgtgattggtgtggcgggcttccgggagttgtcttgcaagaccgcctttcttctcctcttctttgtttcttatctcgtttcttcgctaattttactcggtgtttttccctctcctcgatcgcttttcctctgtcttgctctccaccttctatatctttttttatttcctctgtctcgttttctcgcgtctcctttgtctgcccttgctctctcgcctgtctcctctcctcctccgcctcttctctctcttcttcttttttactttctccagcgcttcttcccccctgctcttttcaccgtttgttccacagtttcctcccttctgcactgccttctctctccgcgccttcttgctctcccctcgttttttcctctcttctccgtcctctctctgtgtgtctcctttcttgtcttgtttctttcaaga

SEQ ID NO: 647 - DNA, 1419 bp, Toxoplasma gondii
gccagacacttggatgaagagaaagtacgagaagagcgagagaagaggaaagcgacagtgttctacgcgtcagacggcggctttaagaagaaagaaagaacagcagatgccaagtcaaaggcttggaagaagaacgaggctgtgacaaaaaccaacgcaaacaacaggtgctacgccttcacagacacctatatacatctctaatatgtacacacatgcatatatatatatatatttatgtatgtatacatgtaaatatatgtatatataggcatatatatatatatatatgtatatgcagatacatgtgcgggtactgaaatccagagaggacgatggacggaggacaaagggaggactggtatttttcgtcgagactgctggggaacgaagagaggaagaatgaagaagtcgttttttaacaaaaggcaaggagagacgctccgctcgctgttcaagacatggaaagcggcaaaggtctctccttgagagaagagttcaagagagagagacgggagttacacgaggagaagaaaggatcttttgcgtcctgctcgttccatctttccttggctgccttcaggatgccggaaagtcgtctccccgagagggaagacaagtggaagagagagggagaaacagagaaaaaccggaatagacacacttctcgctctttcctcctctttcacagtttttcgctctgtttccatcgatttcagtcacctaattcctccgaactcccaagtcttctttctctttccctccgccgcctccccttcagccccgcggtttttcctctcggtgaaggtctctctgcgacctttaacagcagaagggagcgccgcttttctcgcttctctcgcttgtccgtggtgcagaagctgctcttggtcttgtttgcgtaagagagagtgagcagagaggcgaagcagaaagttcaaaacgggaagcaagaaaacgtctgcgaagatcgctggacagcgcaagcgtagcttacggagcaccagaagaagccttcagcaacgacacagagacgaattcgtaaaaacttcacatgtgcatgcgtcatgagaagtgagaaggaagacacacgccttcgattcgaaagaaaaaaagagaagacaatgttaaaaaggagaaagagacagtttcagggaggcgtcctctcgccgcgagaaaaggcgagctcgcagttgcgttccaccatcacgcacccccttctcgaccttgtctcgaccttgtcttgtctttttgaggtttcggagggcagcgaaaatcctgatttcaagggagcgtgaccgggacgaagttggcgtttaaggaaagtctttctttcctccatctcgcagaaagtctgtctctttcggcgacgagagccgtcgtctcgcgtccaaaagcgcgtttttcacacacgctgga

SEQ ID NO: 648 - DNA, 4206 bp, Toxoplasma gondii
cagtgaagtggacgcactgttcgctaaaaacgtccgggaaatgttcagaccatggctgcctgcgcctcgcaaacaggcagaaacacaggaaaaccaaattggagtgcacgtatccaaagacagaacctctgtatcttccgcgactgcgcagacgccacttgcacgcagggaagacgtaacctgtgctccctgaaacagctggctggtcgggaaaaagattgtgttggaccctggctcataatcgatttggcaggataatgggagaaaagcttataatggattcggtctcagcgacaaccactcccagtgcgatgaaaaatgccgggggtcgatttcctcaccaccgcgatcggtttctatgggaggctgttgagcaaagaagcaccaaaattatcagtgttcaagtcaatgggcatcacaagacctactaatgttgcgaaacggataatttctgtaacggaaattggtcacagagaaatccgcctggcgcagcgcctgttgcgtgccggtcaaaatgacgtgacaaagtcaggaatggcaatacgaagggacacacaaaaaagccgaggagtggagacttgcacgcaccgtttgacacatcaacgcgtggtagggttgccacttaccttcaccaaaatgcccaacaccgggtttgatttgagggggggcactgcgtgaacgatcttgaccggcggggagaagcactccatcagcgatgcgagagccggcgagaccagatgagacggcagaagagaggaaaaacaagagaacaaaggaaggcttgaagagagcgaggaggggcagggcgagagagcgtgcgccggacgtggtggctcggccccccattttcttcctctttctatcgacaagtgcgcaagagcctcacacccaggttctggctcgatgccatcgccgaaaaagaagacgggataaacttgataggacggacaaacctctagagacagtagcggaaccgatgcggtctgcaagtggcgacccaaagtcgacacaaaatagaggaggaaaagcgacgatcctgataaccgaagaagtgaagttggggacaggacctaacaaaggcaagggagagggcacccgccgctccttgagtctctcggcgtgggaaggtcgagaaacaagacaaaaacgatcggaggaaagcgtgcggcacctgtggtaagacgcagaagggactctgacacggcagaccaaacaagtttggaagcactgggccttccgtatgcaaagacgcgcttcctctgctatgcataagaaagtactcacacaacagtaccacgggcgtacgcctagctttctagacgctcgacttggctggcagaaccgcctggcacgtgcttttcgcgtggctaatcagctttcgttcggagagaaagagatcattctaaataaacagtttttcataaaaaaggaaaagacgaatgcgcgtttgtttcctctggcaggaagaaagaacacgccgttcggccgccacaggctgtcacagctcgccgtgtcttgcgaccgcgagggccacagcaaaggccgcgagttaacggaaaaacgttttggttttccccgatcttttccagcgctttaaggggatgcgaaggtctagttagaacacgtcttttcctaactctcccgcgagactcataaaccgtcaaacgctacgccaacctagtcaggaggcaagtgtttgctcagggaaagctgaggaaagacatagcgacggactgaagactgcgggagaaacgtgcgttcttcatcccaccagagaaaaagtttctgagccaagagtagccgcacagtgtcagccggaagacaaaacaccatccctttctgttgagcgttctcttttcaagatcttagagccggcctccgctcgtttcgaccacagtcttggttgagtagcgaagcgccgcaaacagcggcaaccggcctggcgagctgtcgagaaacgtgggcggggcaagcagcagaccaaaaaaagaagcgcttcgagcgaaagagagtggaaaaaggaagatcgattgtgagaagaaagcggttgtttttcagaaccctaaaaagatacggaatcagcgccgtcgtcgagtcgaaaacgaagaagccgcgtggcaactcccctagcagctatacgccgcgtcttaccgcatcccgaaagctagttgtacgtttccttacgctccagcattcaagacttggcgacgccagcatcgccgaaacttttcagtaatccaaaccagtttttcgctgaaattctcaggggagtttgcgtattggatactgatcgcgagccacaagagtcacggggtcacattgctcgaaagacaccgcgaaccagatcatcttgcgtgattgcagctcgccgtcgtgtcctcacaggaagaccgcaatcaccttccaactgtttttcccgtcaatagacatgataatatgaacatttgaaacgaaggatttctcaagcgatctaccaaggaagaacagacaccgtagggcgccttcattgaataacgtttctggtcagccccgtcgctccgcgggcccgcgacagaaaaggcatttttgccaacttgcttagatgccatatatcctgttttttcccgggaagacaaggagatgtgtccacagagctctatttcttggcctacggctggttcttgaattgtcgaattttctctagatatgtaggtggaccagagttcctgattcgcgaggttgcctcctgttgttttaagttgctgcttagcgaccgaagtggacggagggattttacgccagtcggtccgtcagtggccgcaaacctgccagaaatactgcttccgggtctcttctgatctcggaccaagcactggactgtcagccttccttctcacttatgactgactaaataccagcaccgaatctacggggctggcccttgccttgccagctcaaaaccctgaacagtgtcagagggattcgacgactaagcgtggaaagcttccaagtatattcccggcaccttaggtgtctgttgaaaaacattcgcactggcaacttgtgggcaacgagttctccgtttccacgatgatttccatgacaacgtgactttgcatggttcccaaagtccgaagagacggctgatccagcgtgggaatttagaaaacgacagattttctgatccagaactaagcagagtttttttcttgaacagttttgccgaattctctaccaacagcaaagtggcttctacggggcaggaccaaaccccactttttcgggggcagtcgacactccctctgactcttgaacaagagttaagccttggttgtgtttttctccgccaaatgtccccccagaaaagacggcaggtcgttttgttatcagaatacgaagaacactgagctcatggatttcaatcaacctttacaaatggttccccgtgcagcttgtgttcagtcagtccacagtacccgtacttgcttctgcaaaggatagcaccgggcatttattgcagcgtttcggggcgtcgcagcgaaagaaccgggtgcgctgcaagcttcgtcttcatttcttccgtcaacttggaaaaagaaaagaagtctgtacaaccggtcctcaaaacaacagaagtggtaccgccgcctaaggtctcgttccagcgtgcctgtcataaagcggtgcactttccaatgtagcgcgacagacaactgactacagtccactatcgatgttacattacatgaaattcaccacgtaatagggtgcatctcttctcagaaacaggaaaaggctcctctcctagccaacgggacttaaccgctcccgacctacgcttgtgaggctgtgtagtgtgttccaccgagggctagcgaattttccagttccgagtgtcacatacggggaagagaataccttgtgtgtgcaaggacaagcgacaccgaaaacaaaacttgagaaggtcttcgcttgcacaaacaagtgcatccctcggcatgctgtccgtcgtttttcgggctgtagcaacatactcgttgtgatccgaaatggtagtgacggaaacgcttattcgtccatctgttccaggaggggtatcagagattggatttgtaggactgaaggctttatctttcggacgaagtgcgcatttctgcgcagttatggaatggcgttcaacagttcactgacgcgaacctcactgcgtgcttggctttggtttccgca

SEQ ID NO: 649 - DNA, 2545 bp, Toxoplasma gondii
tttagcgacatcacacaaatacagagaattcagacatgtactcaacatgcgcagatacacatatatatgcatatatatatatatatatatatagatatagatatagatatatagacatacatatatatatatacttgtatgctgttgcgtgcgcaggcagtgacacaattgcatagagattcaaaaagaacgtcgacgcagagttttgaggaatggtgtacgaggcgcattggcttggggaagagcgaactcttccataaaagaaagaagttcctcgcctttatcacccagcaacgtatatggagttacactgtacctctctattcagaaacatttacgtgtatgtatgcatctggatgaacgaaaatcccacacatgaaaaattttcaaagataggtagaaggacatgtacgagaagctcggtggatcggctacctcgtggaagagtcaaataaccgcggggagcttctgggagttccctgaaatgcaaagacgttttctttcggcctctgtgtgtgtgtgtctgtaacggtgtcaagatctctctgtccctctgtggagagatccctttctgcgtcatttgctatcgattcagctccttttctcgaaacgtttctcgctctctcatccgaacttttcttcgagtgcatctccttcttccctaccatctctctcgctcaccctcgtccccgccgcttgtctctcccctcttcttctgtccgtgtacaaacaggaatcaaaaagactttggattgagtgtagcgaaaaagtgaacagtgcgacaagtttcctgtgtctcgtcgtctccagccggcactgttgagagcattcgcttcgcccccgcggagctcctgtcacaagttcctcgcttctcgcgccgttcaggttcctttctgcaaaaaatcatgtctccagttcctcactgagttttctcgaccaagaacgaacgcgttcgttgccttctgcctgccatgactttttccggaaggcgctcgtatcggaacttttttcaagacccatcagctcacgccgggaactgacggcgcattcctgcgcgttcgttttttcagttccttgaactgccttcttggctcgcgatctccgacggtgtttgtatgtcgcgttccacgtcgaacaagcaaatctctctcgccccagtcaagtttgcgtttttcggctcccgatcgtttcgctacgtttctgtagacgacgtctttctggggagtccattatcctgtgtgtgcaaagcctcgtttcggccttgaccaggcgtttgcttttttcgcacaccggcgctctgcctttgcgttttcgagtcggcgacactcggtgccgctgagaatagacatccgtccctcagatatcccgtcagggaagagttcgaaactcgaaaaacaattgtgagaagaagtcgttgtgtctcccgccccccgccttttcctgtctggagcggcgcgatccgcaacggcgcgttgttcttctcctcctcccccgcgcgcgtttgtcgcctgcgagttggaggggacgcgcatgcactgtggcggggcgtttgcggcttttcggccgtcggcttttcaactctgttcgcatggccagggtgcaggaagtttctgtttctgcgcggttctccccaccctgtcgctggagagaaatctgtgtcgctgcacgctgcctggtggcggttgactcttcggcgcctctgcgcctctctttgtcttcgctctctctgcgcaaccaagacagacacgagaagaacgcagtttttctgcgagactgcatgcagcagaaagctttcctcgttctcgccgggcaaggcgaccggggccgcaagtgcgtcgactcttgtgctctcttgtgctcctcctccgccgtctgtttttctcggaacagtcgggagagagtctctcggagaggcaaccgcgcaaagaaaccgacctgcccgacgagtcggtggaaacggggagactgccgcctcgtcggcaccagggcgaggacgcgagagcacgcatgcgggaggcacaccgagagggaaaacgaagcggaaaaaccggaagacggagaggaaatgcaaatgctggaggctgctcagggccgacaagagaggaggcaactcggagaagagtgtggcgtctctctcttctgcctgcgccgtctccacacaaatgacttcggatttcgtctggttgctgagggaggccaaactctctgaggaagtctcgccattccccgagattccctgcaccttcaagcgcccagcaacctctctcttcctttcaaacgaagtcgccgtgcgaacctggcgttgccggcttgtctcctgaagaccctccgtccctgtcgtcgaacgcttcctcgaccttctcggtcttcccttgtttatctcgtttatctcgtttctctcttctcctcagcctctctttttcttcctcgtctcgaggttctcctccacactcccgctctctgtctcgcttttcctcggctctgcctctctcttcgtttcctctctcctctcgcgcggtctgtctccgtgctactcctctctcaa

SEQ ID NO: 650 - DNA, 2248 bp, Toxoplasma gondii
tagaatattctcacaagcagtaagcgtctttcagtcgcatttccatcacccacaattacaccggtagtttttgatcatgtacatcgcgtagtgttggccggccccacggcgcccattaagaggacattatataaacatgctgaatttctgccatacggaagtgcattgttcctgcgctaggcgtttatgatcaaagagttcgtttgataaaaaagagagtgatacttagtctaaagttcctcacaggcgacatcgtgctttcattttgcttgatcttcagaggatctttcggtcgaaattcagagaagacgttcgaattccgatttttccttgaaaaaaaaagagtgcctcagtgtcgttgttgaattgcgctagcgagaatccggtcttcagttaaagaggtctcgcgctaccccttccacattccgcgggtgaaaacttttaatttcagctggagagaaaaccaggtctttgctccactgaagtatctggcctcagtcttgcagaggatgctgtcgaagttactgttgcttattcatggagttgtatatgtgtcaagaatcttttgaagtagagtgatccacgagccagatgctcactcggatttaaaaaaatgtttaagctgaagtcgtacgaaacaccagccgccaaggagacccgtcaagaggcagatgaaagcgtcggaacctcctttggcaaacacaagtgcatcaagcatttgtgaagggattttttgaggtattcgattcttcttaacattcaagcgccttgaaccgaaattctccccgagacaaaagctgtgcgagatccttctctgattgaagagcagagaaatcggttctccagaaactcgaggaaggtctctacctcaaagagagtcctttctcctttgcaatcaaaacaccttggactttcagtccagaaacggagagctggccaaggaaaacatttccagtctgcacgtcattcttttcgccgcttctctacatctccactttgtaaacagatttagcatttcgattttacctctgcgaagagacagcttcagagactcacttgtgcggactcgcggaagaaactcgagatgagtctcccagtcacgggagtgacgcaggggatattctctttcagagagctgagaaatgcagcagccgaattctagacagcgctgtctctctcctcttcttttctttgtttctttcatgttggaccgttcttctgtgctctttctgtttcctgccttcctcacaaacgcagcggggcaggttcgagagccgacttccccgcagctggggaatttctgcggaagcagccgggcgacttcataataacacagcttcccctccgtctgctgtgtttcctctgtgtttcagaaaaacgagaaagtggatctctctccgtttctctccttttcggcggtgtctcttcgcggctccgaggtgagaaaagtcacgcagattttcaaagggcgagatgcatgcagatgatgagagacaaggcctcaacggaaaaaacggcggtttcaatctcttcagagaagctcttccaatttcttttctctcactttggggtctctctgacgttcttgagagacatgaaagagctcgtgtgtcaagaaggaactcgtccattgcctctctccactcttcacccagagcttgcgaggtgacgcctggccgcttgttcatgcaagaaaattcgaaatctttctcccgtcatcgactttcgcgaaaaacgtaggagctcgcattcttcagagcgaacgtactggaggcctcagaggggatctttcctctttttttccgtggaagggcggatcggaagagcagcatctgcgaaaacgctattctctttgtcagcgagtctcccgtccggtctctgtctcttgctgctctgcctcagagaggcggagcagcttttccgagggcctgttgacttgtgaaagatttgacattttcgcaggagcagttgccctacaatctgcctttgtcttgctcgccgaaatacccctttgtctcttcacctcttccttccgccctttggcgctcgacgcgaagctgtttcctcctctgacagaagttcttcgtctctcgttttcttctggcggtttatgcttctctcattctctccttcttccctcgctttcgtcgctctcctgcttctctctcgttctttctccccttcttttctcgttttcctctccgcttccgtctccctctcttcaacttgtttgtgcgggtggacgcca

SEQ ID NO: 651 - DNA, 1720 bp, Toxoplasma gondii
gtcgaagccttgctcgtatgatcccggaacatcgcttcgctgttcctcgcaggcctgctgggccggcgtcacggctggaaaggcctcgtcttctcgcggttgcgccgagaccgagggcgcgtagatctttttgagttggtagactgcgaagaagtcgaggacgaggaaggccagacccgctgcagctaacaggaacggcgcggaggagagaaaggagacgagcacagaccaaggaacagccatcgtgagagacgctcccgccccccacaaacttccgttcagggggaggtcctccagtctcgcatcgaggagaggacgggaaccacagaaatctctgaaagaagaactcagccaccagccagccgacaactcacgacttcacacacatgtacatctccagatgtttaccgaggtctacagatgccatattagctgttgttgaaagctcgaagacgttttgagacatagacacgcacagaactcgatgcagagacactcatacagactggtcgagagatcgcaagacagagacggagacgaacggatacccttccggttgcatctgcaggctgtacgagtggaggagcagctgagagttctggaagaactggcgagaagtgacggcgtcgcggcgcctcggcaaagcagaggcgtcaacgagacgaaacgcccgacgttcggccccgtcaacaggtaagcaaagacgaggcgaaagccgcgggacgcgaagcctccagaacgtccgagaaacgcgagagaagagagacaacaccgcgagtctctgaggcggcgctcttcctcgacagtcggcagggagcagaagtcgagagccttgcgtcttcagccgtgaaagcttcaacgcccatctcaaacgcgaccgaggaaagtcttgcggctttctctgttgcacggagatggcgcaagagttgccggtcaaaacggcctcgggaacggagagaggcagtgcccagagaggagatgccgacgaagacgcaactgtttctcctgccttttcttggagcatgcagcaaggctgtgttgtggtgtgttctcttttctgccccttaacaaattgagggaaggaacagaagcgaaaggggagggagagaactgaaagaagagacggggaagtaggagagagaggcgaggcggcggtgagttcggcgcagagtgtgcgacgagaaagccggaacaagtattttttcagggactcggcttctctagtttttgtgcgaagagacgacttcgcagtctttgctttcgcgcctgtttacagactgcggaaaagaaagaaaagcggacagcatgcagagcgtgagcggaagttccggtctcgctttttcctcgcgcatgcagtcgcacaccaaggacacaacgggggagacgaaatgactgcgagtaagagacacgaagcacggcagaaggaaagagaaaacgcagacaacaaaggcaggcagcctctcgctttctcggtgtttgaagcagcaaagagcgtaggcgtctttggtgaaggacgcgactgcttgctcgtacgcaagaggagagaagtctggacagcggacgctagctactgtcgatctcagggactctgcgtttgaactcgaagcagcagaaactacaggagctccagttgtagagaagatacaaagaaaagcgcgctgtttcggtggagctcgggaatcctcgacgctggttgcatgtcgagtggcggcgagctgta

SEQ ID NO: 652 - DNA, 3875 bp, Toxoplasma gondii
cattcggtggtttgttttctgcgttccgtcgcacgactgagtggaaacggaagcgtcgggcgtaactgccgacccacgttccagcttcttcatgggcgtctgggtccccgtctcgtggttgttctttggagagaactttcctttgctcggccggcgctgcgttgccactggggctctcctcagcgctgcccgccgggtacggggagtctgttgcgccaaagtaaaatccgtaacctgtcacatttcttgccagcctgatgacactgtgtctcgggtcaagacgttcccaaggcaggagcgactttgaggcagaagtgtcaccattgtcttgtcgatgccactcctcggcggtgaggtccaagccatactcgcgaacaacctccaacgcacagtctattcgatccaggtcagccttatcttcggtgcaggcgcttttcggcgtgcaaaacgccccagatctgtcctcggcattgtcaccgtttgccgacatgttaagcggactcgcagatcgagatccagacgaatgccttgagctactagccccggggtgagcgccatcaactggctgtgcgtacagcgtatgattcggttccgagtttcccgcaaggcttccctcgtcggactctgaagaatttgccacccactccgccttcatccgtgtttttaacgagctgctctgtgacgagatagcaatcccgacactctcgtcggtcgactgaagacattccggcctgacaatcacggcatgccggccagatttgagctgcagagactcgcggtcaggcgcgctcccagcaggggactgtcggaagttcttcagattcgcctgggtcactggtgtgctctgcgcagggtctgaccgaaggtgtccgttctggggggtctggagggagtggcgtaacaggggcaggggggggcatggtgaccgcagcgagcctttgcgtgaatcaccgaatacatttgaagaaagtgtgtcctcaaacgcatcgaaatggtttgctaggtttgcggtcgactccgtcccgttctctggatccgtttgaacaatcatcccccgcaacgcctcaggaaccgccgacaggtcggaacctgttgacgggagggaggccatttccacctcttcgcgattatggaaaagctgagtggaaaacaaaaagtcgcgctggcttccctgcagatctatacacggaaagacgcgaaaacgctgtcgcttatgcgcagccgttcacgcagctactggacaaagagaccactgcgtccgacggccgatgtcccgaatttccatgctttgtatgccaagaattaccagctgggaccccttactagaagaaggcgaaaagcgtggcgatgatactatgaaacctcggaatgcaaagagcgtgcgaggaggtccagagcgttaccgccactgtgcagggtgcgttattcacagttggctgaccgagtcatcggaggcgaaccgacggcagaaagaagatgctgcctggcaacaaggcggagccgcaccgaacctgcaaagctggtcactctgttgtagaaacatgcacgttcttgatacattctgagcgctctaccgtggtcattcgcctcgcgacagcgcagccgcgctggcgcactgcagctgcactaagcagacacacgcctgtgaccacccaagacttgaatctcagtgagtcatatcagcaagtcctacacatcttccaaagtgacgtgggtcgagggagcctcggcaaacggcccgcgaggcagcgtgggtggtcgacgacggagatgcaggggaaagtcgtgctcctgtggcgcagctctgcgcaaaaaaaacccgaagagaatgccgtttctggaaaactgtcgcttgacgcatcgaactgcagcgaagcagacacgaaaaagcatccaccggatgctagagaggaaccccggtcgcggatcgattcagagatggcgttcagtaagacagccagacgacacgggacgagagggtgaaggcccgtactagcagttgaggagctggacgccgtggccaaccactctccagataaagaggaaaaaataccgtccacaaagtcccgtactcatcggcttcatcgtcgccgatggacccgccacggattcactgggccccctgcatgtgtcgcttgagctgcctctagctaattgcaacggccatatcgggacgcggaaaagtggatgacatacagaaggtcactgtgtttccttttgaaaatatcctggagtgacactggagtctctcttcacgagaatggaaaaatattgcgaaacctgaactgagtgcggccactccctctttgtttttgctgtgtgacgcttggccaggtaccgctcttacggtcacacagagctctgtgaacccgagctgtactcttcgctggcagctgctctgccgctggtgtcgtcgaggagcataaaccgggggagcgttttccatgaatcaggaaagattaatgagatttcactcccagaatgcttgccgcctggagaaatctagaatcgagtacaactagatctatgggcttggagagccgaagagtctgacccaatcaggacggcataggggtcgactgtgacgaggtctaacatgtcactgcatttttcgtgttggggctttctttgccagcctgctgcttatgtttttgaggtatgccctgcttaatcgctgcattgctgagctcactcgaatcgtgtaaagatgtgatttcctgtaccaccacgatggtaagggtcgtcgaaacgcgtgtttgcttgtcatgtgaagaccccgttttgctgaaacctagaatgtctagaagaatctgaagatcaacaggtcgcctcacgcggatcgcttgacgtcttcgacagcatcattcgaagaccagcaactgtggggtttccccgcaatttctctagctgcggcggtctcagctctggattcggttgtgcctacaaagatgccgtgtcgtgcagtggtgccagaaagcagatagccactccgtcagacgtggctccttccgtttcctttgctgcgcctaacttgggagattgtcattttgaacgtagcatccggtacttcactactccagcgccacgctagagactattgaatgccgagctcgaacaaagatcccgtggcgtggcgccgcttctctgcgatacgtgaatacgtgatacagtggtacccgtgaacttgtttaagtcgagcagttttacttgcaggcacgtaacgccgttgatcgttgaccgggtgatgctcagaggagtcgcggcatgcagacatacacagcgaggtgcacttgtgcacttgtagcaggaaactgcagctaactcactggactgtgcttctgaaaagaccacagagtgcctgaggttcaggcttagtctccagcaaggggtatcacacgaactccctatcatcccgctttgcacacagcctcatccacgggaaaagaaaccggcacccctgtgccaacaaaagaatcccttttccacgtgtagtttcagttttctaatctgcagcggacgaggctcccgctcggacggtgtctgcagagcggatactgtaccccgtgaacaaacgtgtgaattgtgtagaccgatgcatcttttctgtacataacccgagcaccgctgtcaccccagtccccatggtcccgcccccgtttgctttcaaagaaaaccgccggtcgcagcgcagtcgccaacgcgcggaaggcgcaccgccggactctggtccacccgcccaagctgagaattgcatgttcttctctggggaagagaggctgctgcctgaacattcccttttgtcttccaaacaaaagtgaagaaacgtttcgccatcctttaggtcgtgtatatagtgcctctgtttttgcgtacaa

SEQ ID NO: 653 - DNA, 651 bp, Toxoplasma gondii
gcaaagagtccggaatcgggtggcggaaaacaccaagaagaatctgcctttgttgtcacactcaccacagcccccactggatggctcgagacagctaaacctgcgagaaatggatgttctgccagtgttcagtgacgctcggaagctgtcctccttctcctcctcagcgttttgatttcctgcatgctccgccccatccggtaacggcaaaagctcctgctcgacacaacgaagcagagcggtcgcgcacagcctcacacaaccaaaaaacgaagaagaggggaggaggaagagggaggagagactgaagccacagaaggcgctgaaggcgagcactggtgagacgagccttgaatcgagagaagaaaagtctcaccatttcaagtgagcagggcagaggctccgacgcatgcgcaggctgagagggggcactctgctggctgcccagagacgcagacgatgactgcatgctccccatcctcggcgggagttgggctgcagatggagcgagagaagagaagcgactgggaaggcggaagcaagagcgacgaaacaggaacgagcgagagagagaacagacctgcgaggcaaaacagagggaaaagagcggtgccagacaaagaaagggagcgagacaatccacgcgaaaaa

SEQ ID NO: 654 - DNA, 2077 bp, Toxoplasma gondii
agttttccctgacatttgtcgaagggaaactccgagtgaacactccaccaatgctggcccagatatccgacataacaaaccacagcggtgcccagccgctgccctcagcagcttgtacttgtcttcctcccgacacttctccgtatataagccgaggcgacgtggcgagtcgcagttcgggcgagtccataggggagttcttaccattcctttctgcggggagtggtcatgaaggcgaaagttgcagacgacagcgccagccaagagaaggtcgcggcgagtctagggcctgcagtcaccgaaggaaaaatgagcacccaatctggaagtaaatgcgtctctcgtttgttgcggatgacatgtgcactcagcacacagacggacacagagtctttcgcaacgtttccaacacatccccttcttcctccaccctggaactctgttccgcacaagttggactacactttcgccgttctctctgtcgcgtccgcggctctaggtccctacgcccactcccctttggcattcgtatacaagtacacatttaaatgagcacaggcgcagacgcagtacgcaccatacctacatttacagacgtagacacatatacatttatgtcgagggctaaggggctgtcgcgttcactacggccgaagcgttacttctgtgggagatgcaacgcagagggaaccggcaaccagagtgaagcgaaagcgaagaggagacaaggacagaggccagctctgcgctctaatccgtagacgaacaaacgaagaagcgcggaaagaggagcgaaatcgaaatcgaaagtgaaggcgtaccgatgcctctcgacgaagaccgccaggactgtgcgtccgtcgaggcgtccttgggcgtggtggacggcgccatggctgcagagactttctcgaagagaaaacgcgaaaaaagaaaagagaaagagatgaagagattcagacgagacggagacttaaggagaaaaaggcgcgcagtagacagacgagcttcggcgggtctcgaacggttttgagacggagctttctgtcgcggggaaaaggacggaaccgaagaagtcgggcgacttactcagaccctcgcgatccgctgtgaagaaggaccggctcgtcttcttctgctggtaagagacaacacggtggatgcacgttgtcggtgtacttcagagagctctctggtggaagacctccctgtgttcgtgtattcgggcaatcagagatctcacgcgctctcgattccagcgtctctcgtctctctccgtggttttctgaaaaggaaaaggcggcccctatcaggagatgacatcttgaagcgacccaaggcaaacgcggcaagaagaaactgcatgctcactggtgtattgtcgcaagcgcaaatatccggtcaacaaacgaagacggaccagccggccacgtcccgggttcttcgcaaaaaaaagattcaacttaaggtgtattctcaggtcgcatatttcgctttcttgcttccggagaaacacgatttccctcgaaatcccgacggaaaaagcttcgatcgatctcttccacacggcgtctacctcgcgatgcgcctccgagtgtgacaggccgcacgcgatgacctgactgaaaggggcctctcctgttctgcagacgaacgctgaggacgagtctcgcgctctcgcagagactagcggtgggttaaggatttgttctgcctttgtttttccttccacgcgtctttttctgcactttgctcgaaacgatcgctgctttccacccgtctcttgcgccggccgccgagaagtcttgaactctgcgggagtcgacgccaagaacgaggcgggactcgacgacgggttccgtgtgtttttttcctggattttttctcgcgtttcttcctggagcgaaacggagcgctttgctccttcgcttgtatttttccgagcaaacttcccgcgaaagaggagaggcagacaccatcgtttctgtggtcagaaacctgttttcagacaggagcgcgcatgcactggaaactttggagaacccgtagcttcctcgcgacctcgcctttctaaaaa

SEQ ID NO: 655 - DNA, 1735 bp, Toxoplasma gondii
ttttttacggagacgaccagagggctcctgaaagaagttgttgaacggtgacaaagctctctcgagtgttgtctctttcgcgtcttcttctctctaaagttttttccaggcagttccaggtctgcccagtggaacgctgcgcgtctctacgggggcatctgtacagctctccgtgcatgcgcaggcctctatctggggaacagaaacatctgcggatcgataaaccgcgccgcaggatcttcgccttactttggaagtactcgattttctggttgatgtgtttgcgcccagtcgcatgctgccgccgtccagcaggggacgagtgagtgaggtagatgtcgcagtattcgcagtagtacttcggcatcttgtcatccagtctcttcgcctgtttcagtgcggtctgctgtctcagcgcaagaaaggtcaccacaccttctgcgaaaacttctgctctctgctcctcgcgcgacgctctccggcgagaagggagagcgccttccgacggctgcgccgagattcgcgaaggcgccttcgctctggaaacttgtggagccgccttcggcgacgcttgccttccggccccccagtgcgagatgcagacgcagacgagagaagaggcaggcgcgacaaaacgcacagagacgccagagacggcgaacttgctcgagaagagagagagcgagatttgaaagagcgccccactgggggagtcgaactctgccgaaaaaacgcgcaaaccgagaaaggaagacgacgtccccacggacaacgaaggtgacggtcttgtcttgagaggagaggagacgcagcctgcaggaggagggaagctggaagacagctgaaaaagagcagcgactgcagatttcctgagagacgcagtcgaggagaccgcgaagaaagaagagcagacgaaagcaagcggaccgagagactctgcagcgccgagagcgaagccacaaagagagagagagaagcgcgagagaggagacggagaggagacagagaggagacagagaggagagcgatggcgctttcggcttgaccgcgtgagtggcaaggcgagagacgcctcggaggaaggaaactgcgagaagagaacagatgtttggagaagctgttgacggtgcgcggcagtcggagcagctgggaccctcggacagagaaagaaaaagagagtgtgttagagtgggttgctctttagttgaaaaaacggcccagaacgcgcgacgcgccacgcagcgaaggccaggaaaaaaagttctttcgccttcgtgagcgagcctgtagatgcagagaaaagacaacggggagcacctggggagtcgcagcaacgcacgcaaaaaacaaaatgaaactgaagcgatttgccgctccctcttcctctcttctcgattcgggtgttggccgtccacccccgagcgtcgccgcgtttcgttttaagaggccgatgaaacaggaaaggtcctttttctctcaggcgaaaagtcgactctcgctgaaactcaggggcttcgcgagcggcgccgcgcgtcaaaaagtccgcgggggtttggtcgggcacaacgaatcccccagaagaatctgcgaaattgcatgtccttccggacgctccagctgtgtccgtcctaaaataggggaggagagagccgcggagaggaaggcccgcttttcttcgcgaacgcgcgcgcagggcgattcccagaaaagaaaggacgctgcgctgtctcacaga

SEQ ID NO: 656 - DNA, 2777 bp, Toxoplasma gondii
cttcccgttttctctaggtgcgttcctctggttcgtgcatcgcttccctgttccacctcgcagacagcgccatgttcagaaaccgactgctgcgatgctgacacgcgtcgggctggatgcctgtgccgaagtggagggtaggcgttttctctctggggacggcagttgcttcgcggaacagagcaggacaaatacccccatgcatcaagttcttccgagtttaagcgtgtaagcgtctctccattcaactcgtatgcatatgcaatttcctggctgtaacgtggatgcgccacaggcgaggttgcgatgtctcctgacctggagtcagcgagaagtgattgcggccgcgaaatcacaggctcaccgcagaaaaccggcaaactggttgcatcttcagcccgccggaacttcttcttgatcgctacagccgcggcgctgacagctagaaccgtcgtgatcatcgtatagtctagggatagagcgctacgtttgtgtctcagatccactgcagtggtccggttgtacgggaaatgggaaccagcgaaagtgaccgaggaagagccagcatagaacagcggcaccgtcgtcgttcgttttgatagtagggaaggaactgtccgtgtttcagataactcattcccccatcctcaatgaagaagagacagccgcaacccttcgctagtctcaagatgccaacaggaaaaaccccttggtttcctcctacgttcgctcgccgcgacgcaaaagctggaatggaaagcatcaacggggtccccacgcatgcccgcgagaaggctccacccatagatgcgtaatagcagatgagttgcgacaaagaagtgcgacacactaaagaaaaccgagataattattcatctcgtagaactatcacaaactgagtgacacgacggatcggctaacggacggaacgggaaacagatgcggcacaagggaacacgcgtctttttatgcgaatgacggaaaatttgcgtctctcttaacacagagacatcattttgaacgcaagctgataaaagcatacaacggctagtaagcacatcttggctgcgccgcgaacggggggaacttggcggttggtaaatacaggacaagagcgtctaaaaccaaccctgaaggccatgggaatgtattttcaagatgttcaacagaacgcgaacaaacagacgtatcacaaaaaagttgtttttgccaattttcatcgatctgagaatcctgcgtgctcacccttcgcccagtttctcatctgggttttgagggaacaccgcgagtggcaaccacaaccagctgggctagcgtgcgcgatgaaatccgcctacgaataacttcaaaagtcgcatctatctttagcaaatttctgcctacaagggacaggtcatcatgggagaagcaaccgagaaaatcctgctaacacacatgagccctcctcaagcaagtctcgtagtcggtttgcttggttgccgggatctaacgacagacgacgtgtgcctgccttaagttacacggctctgctactaagtgtgttcctttaacatatgaagtgcgacggaacaaacgagcaaagtcgacgaaacaagagaaagagacccagtgcgtttgaagccgagggaaattcctcgcagtttgtcgcgtctcagagaaaaagcggcggggggccgtttgcggaaatgtgtttcctgtctcgtccacactacacagcgcgacttgcgaggcgctcgtcttgcacgaaaattaccatcgttcgagggcgatggagatacagagaagtccttctttcgcagttgttaagtagctggacccttccgtctcgggctgcgtttctcactgtttcacacgctgtttgctttgtctggatttctcccctttcaagggccgatcgcacctagaaaaataccggtcaaccggctcgcagctccgcttgacatcgtccctgaatttactaccctagaaggcgctgaaagtgactacacccaaaaccggcggcgtgttagaacatttatgtcatccatggttaatctagaatgactatctgagagctgagctgacgggaaagtagcgaaaagagcaaaagtgcgcgcgtagggcagcccgcaatgcggaaattggcagcacatttagagaaagtcacctcgcttaaaatcactcgagggacatgaacaaagttttatgtgagctcaggaaatgcattcacttttgcttctccccagctgccaccaaagagtttaccagcgtttcttggtgcgtgtcgacactctttggtgagtcgtgaggctcaacttttccgcacgcatcatccacttgttgcccgtactctagacccttacacagtttcccttttttgattttctttcgagaactccactcaatttcgttcaatagatatccactccgacattcctttgggttttcaacaagtgctgtggactcgctccgctacctttcgattcgcgctcgtccggtgtgtcctcaatctttgtgctcccgttttttcttctttgcgacttgcgcattcgagccaacttccgccgtctgttggactttgcaggatttggttccgacgatcttgctttctgtcttcccctcttatcagagagatcgacgttcgtgtgctgcggaggtaaacgtcttgtgcgcgccactgccccgatactttctgccatctttcctttctctctgttttccgttgtaagaacccctcagaaggcagacatgcccctcttccctgcgtctttcgcaatcccaggcttttcttgtcacca

SEQ ID NO: 657 - DNA, 2495 bp, Toxoplasma gondii
tgtgaatgtgagagggctggtgtgcttggtgtggagagaccgattcagatctgagagtctctggggactggcaccgagttgtcgagttgatctgtaggggatgtttgagagaggaactttaggaactgtttgcgttgttcttcctgctcgtgttcacgctgggagaccgattgtctgcggagagagcggagctcaaactgtcggtcgatcacaatggttccggttccgacagtcgtcagcatgacgagggagaacggaatggctgtaaggaagcagcaacaattgcacacgagctccacagaagtgatttttttttggatctcccgaaaacgcgaggaaaccgcgtcgaacgatactctcggcgtccgcatcccctttcgcttgcatgcacagtcgagtccagctgtggacgtcgatgcaggctcctctccccgaggggctccctgtcgtcgtttactcggcttgatgcgcacccacggaaacgcagcagatcgacggatacaatgacacacggtcctgcatggaacagtgtacgttttcggtacatgcacatgcgcaaaaacagtcacgtagcacgcgcatgccaataacgaatcacctctttctacgagcgtaaacgcatgctttccacgctcattccttgtcgtccagacacacctcaaacccctgcatccacgcatacatccatgcatttacttaggtcttcacaacagcgcaaatatatatatatatatatatatatatatatatatatatatatataggtatatatataggtatatatagatatatataggcatgcacaaatacgcatatatatacatatatatagatatatatgtgtatataattatgaaggtgttttgcatgagccgtatggatcgtggaactgtcggtcatgtgagttgcggtgtggagatagatttgtagcgaggtcgaaagtgaagtgattttcgcgaactctttgctccttaccaaccgtgatgatgcctgttcttctgtcaaagttgtaaacgctttgtttgactttgtcgaacgcccggtcgagctgcacgagtcctcgctgcatggacgcaggcagccgtcgccagagttccaccaacaccatgattcgtcgaaaggcctggagaaaaaaaaggtcgatttttgccgagtttctctcccgtctcagtccgcatgccgtcagtcttcccgatcttccagagccacagcgcttaggaaatttcccccggaggagggacggagaatcttccaaagcgccggacgacagagactcggacctggaagagtcacaggcacacgcgtgcgttccagacaggctgcacagtggaagaagcgccctctttcacaagagaagcgagcgttttcttctccgcgaggtcgtcaaaacgcattgcctcgtttctagttaacgaaaccacgagtgcaggctctcgaagtcggtgagcagacgcttttctgctctctcgcggaggcgaatccccgcgagcgcactgtggactctgaaaacgccgcttttcgacttcgcctcggagagttttcccagtttttctggacatcgatgccgaaaacttcgcgaattccccagacgttgcgtccccgaaaacgctgcggcgcccttgcatcgagagccggcttttcttgctcgtttccagcttctttgcctggacgctgtgtgccgagtctctttttaaacagggactgtcgttgcacgcgcctcaacaagacaagcgagtgcctctttactgcccccttttttgctgagttccgcggtctctgccggcttcctgcagatttattgagctgttttgcttcgatagaactgagtgtctctaagaaaatgcaggcgaaagagaggaagccgaccttttttctgcagcttttctcctgacgcgagtccaactcgctgagacacagcgtgtgaggcgggtcgggtttttgaggaaaatgtgtggactttgtctcatttgttttatcgcaaacaatcggcagcgtgcgtctccatttcaagtcgacacgctgtagagcttcctgtgctttagatcccttttcgccgagtctagacaatattgcccctcacgagctgcccgtacagccgggcgccgtcgttttttgcaatgagggaggacggaggcgagaaatccatttttttgccttttcgctttcacactttcgagcctttccgtttgcggcctcacagcatcgtgacgccgtctgtgatttgtgtcgtttccccggctagatgcggttgtacacacgcagaagacataggccgacacccgatcgagtcttgtctttctctctccggaattaaccgttcgctgcaggacgccctgccttccgcatccaatttgaagctcgggatcgtcttttattagaaatagatttcctggacaaccgaaaccgctgtgtgtgagtgtgtgaagatcctgcgcagctacgggtttgacgttagcgcgagactcgacgattccgagagggccttggtttttgaa

SEQ ID NO: 658 - DNA, 3860 bp, Toxoplasma gondii
tctcgtcggacaacggaggtacagctcggcgattgataagcgactcgccgcatttgaggcagtactccggatagacggtgggtctcaatcgccccgccacttcgtcgggctgtgctcgagtgtgcgtcctggcctcctccaggacctctccctgtccccggccttcgtctgcaggagacaggaaactccgcgcatgaggggaaaaggcagagggaggatggggagacgaatgagaagactgcgggggaagaggagcggaggaagaatacggcgaatgaggagaatgcaggggatagtgagaggagtgggaaaggggcgacgaaagagagtgaggggagaaatcgagttcgtcacggagaaaagaagggggacgctcccccgagatcactgcatcctgcgaagtgccaagcggcacagctgagacagatacgaggagcaagacaagaagatggaaacgcctacagaacgtaggaggaaagagaacccacgcttcgcgacgaggtcgggcgaccccatcgctgtcaaaccttctcgccatactcaatccctggagaagacgttttttctgtgcatgtgtttgcgtgcgcctttgaagacctttcaaagcgatacaaaggaggcactctttcaggggcgttgcagacgagcgagcactgaggtgaacatgtcgtcacatagctatcgatcttcacatttccttgtctccctcttgcctccacaaaacgctccatctaagcttgccaggtctcccgttcaatcttcctctgccgacgacgctcagtggacgaacagccagagaggaaaagaccggcggcctgtgtccaggaagaaaagaatggtgtggtgaatggcgaggaacaacaacgcagaggaggacgttctgtgaagatgtgaagtcgagaacaaaggacgcccgctcgacgcggaagtggaaaccgcgaaatcctaccgcagtgaaccagcagctggacttgcagtctttgttgcgctatgattgccccggttgccccctgctttccacccatcctctctctccagttacatccgctggttctgcaccaacacacatcttggcagacacaccgtctctgtcccttgggaatttcgcagcgaatgtagcaagccggagcaggcagccatctttataaaggccactccgggagagctgtacatgcaccggaaaacgacaccagggaagaaagcgtttttttttgctgctctactttaaggcagagaaggtttcccggaaaaagaaggcctctgcggaaagcggaagcgaacactttcgttggataccccgaggaaaaaaaagaggtaaccgatgtgatggaggagacacagcaaaaggcactcacgtctcaattcaggggaacgcacgcagcgcgtgaccggcgagcgagcttgcttctcgagcaggtctctttaacacattctttgaagaaatatctctgttttcttgtctcatatccatcttcctgccttccctcacttctcctcacatggcgttcctcttgatcctgttcgtctcttgtttagcggattcgctccttcccttttgtgtcacctgccttttctcgctgtctcctggggtctcccatcctcccgcctcggtttcttcgccttcccaattgttttctcttccgtctcttgtgtgtttcgcttttccccatgcctggtcctctcttccctctctgtttggtcactaccttcgtcttttccgtgccatcgtcgtgttcttttctctttttctggggcttcgagttccttctaccgtctgctctgacctccacgcttccgttttcgctgttgctcctcagtttcgcgtttacttcgtctctgctgcctctatgctttctcgatgtaaacccgcacggcggttgccactgacaagaatcagagctcaccatcgctgcagagcagaacgggacaacggcatgtgtcagcgaaatggctcatgaatgaggaaggcatatatagaggatgtgcgtggcgtacatactttggaaacgagaacgatgtgtgaggagaatcgggacgtttttcggggggggtaagagggggaagcaggcggcaaggcggagaagtcaaatacaggattaggtggggaactttgaagaaaatgttttacgcttacccttaacttgacagcttgccgttatcccttcaggtgaagaaaaggcatggaggcatgtctttttcgtactaactgggggatgcttcgtccactgcctgagacactgcagagttcagacgtcgcaggataccataaccataaggggcctgaaccgcaaagtgacgcgggaggtcgctgggtcacttgctacgcacgggcacacgcccctgatccacggggcatgacggtccgcgtgcgtttgacacaactgcagcatccaccgttgtccaaattgtctgaagttagacacagaatgccagctccctcccgattcgactggggtgtacagacaccgcagcgcatcgctcgcggccgcagttgctttccgtaagcagcggcgttctgaataagttcccccacgtgtcacagaacgccgctctttggtctggtcggaatctgcccatcagatgctttctttttatttctgtcgagtgagtggacacacgaaccccgcagaaaccgagcagcacgctcgaggtttcaggaatccgtctccgaatcaaaacagcactttaggcatggtcatcatgcacggacccacggcgactttccaaggaactgtggtgcagagttcggacgaccctaaaaatcagcggggcttctcggtgaaattgggatgtgaggtagcggagtgaaggacgcgggagttccagaagaacagttctcgtaagcgacagcatggtctctacagtgactgttaccgcctgtcacgtggggacactttgagtctgtgcaagtgaatctctggagtgacaagggttgtgaaaagcgttcagggtcctccatcacagcagactggccatggatgcagggtgtcagttacacagcacactactcgctcacgaattctgtttagctgtaagtggtcaaccggctacaacggattgttccgaggtacgggtgcttgcgaggccctcagccgtgtgggcgttaggagactttcgttttcagaactcgtctgcggttctagtctttctacgggacaggctgggaaaagggaatacagcagtaaacgagcgaattcgccttgtttgctcctcatgaaatacggagaaagcagccagtcgccagagggacccggtgttcgaaggaaacgctgcacgggagccacgcaaatcagaaactttcaagttcccgtcaccgaagctcgactttctggccccagagttgcagggaaaatccttatgcgcgtggactgttcgcttgtctccttctcttcgcatggaacggactgttctcttgttctgccaccctcagtcgtgtctgagcacttgtctcgcttgagccgtgagcggacgcgatcgttggcaggggatcgccgcgcacacaacactttaggacgataaggatgtggaaaataaagtacgtagcaaggtggagagaggcgtggagaagcaaatagaagaaaacagaggcggaagacagaacgacgaacggttcgtatggaccaacactctacttcattagatcacgcatacggtggtttgagacaacaacacggaaaaaagtgtgatgctggcgcggcagacgggtgtcgctcaggggaagtgtcttgctggtttttgtcagccactttgtagtcgtgatctggttttttattcggagattcgccgtttgttcttttcctagactccacacatttcacgccatgtcgattccgcagcaccatttggtacaggctgcttca

SEQ ID NO: 659 - DNA, 2790 bp, Toxoplasma gondii
tcgccgctagaagacaacgagaggcaaggaaaagccttcctccttctcgcgcagtggagacaagaatagacacttcgtccttcgaaaagggaaactcgagagccttcgtagagagaagaggaagtcaattccgaactgcagaggatgttgcaaagaatggaagagaagaggaaggacggtgcctccttagacaaaccgagaagaagagcagaaacgggagagaaagaaacgcgacgtggaaggccgacaaagagagacgaaaacaccgaggcgccgcacagcaccacgagaagaagaacgagatctgtcgaagacgcggcaagggggaggggaagcgcgaaaaagtctccagagaggtccttggcaagccaggaaacaagaaaaatagacctaaattcgacgaaaaaaaagagctcccctcactgtgatcacgatgttctcgcttccggtggcctggcatgagccagctgtctccgttgcctcttgcggcagaaacgcaatgctcctcaacgtcactcgaatcgaacggacagccaaggagcttgacgacgagagcgcgggaaacagagaacaacaccagaggcgctcgtcgagaacggggaacggagaaacagacgacaaagcaagaaaaggcaagagaggatacttcgaggaaagacgacaaagaaggcaggagaggaaaagaagcagagaacgggaagagaacaaggacggaacaaagtggggacaagcgacgagtgcagcgggcgaacaaggatagacgacgaaggcacacgaagggagagtgcagaaaggaggaaaacggcgaaaagacaacgagacctagaagtacgagccactccgacgaaaagcgacaagcagaaagcgacaagcagaagagaagaggagtctcaggaaacaccgaaatgaggagcagagaaggagcaagagacaaggatcggctcgcgagtgaaaacggtgtgtatctaaactgaagagagacaaccgagaaaggaagaaaaagagaaggaacagcgagaagaaaacgagagaagtgaccgagaagggcaaatgcagaaaaaggaaccggtgagcgtggaagaaacgcgggcggtgtcctcgaaggctaacgagaaatcacggaacagggcaaaaaaggtgaaaaaaggtgaaaaaaagttcaaaaggcgacgaaaccgaagagagatccgagagaaggcttcacaatgaaaaaagaaagaaaggttaattaaaaaggcagaacaccgtgacacattggttcgctggattcgcgcaaggtcttcgaactccctcgacaggcgtggagaaaagtcgagaaagaaaaagcggaaattgtcggaaagtcgcaaaaaagaaagagccaaccatgtcagcttcttcagtttttaaacaaaacttcaacgactcgtcacccgctctcgtcactttcctgtctcttcgatgcgtgacctcgtcgaagtcaacgacgaggaaaatctcgcggctgctaggggtactgtttcagtgcccgtttcatagagacttttacgccttgttgctccacaaagacttttcactaagaagacttaaatacagacatatatgtgatgaattattagtgcccatgaaataaacttgcacacattattgacgttcaacactgagtggataggagtgcaaggatacctatattttaaaacgggtgagagtaagacgccatccatgtatctatactcaagtttgagcatcggttgacatatatatatataaatatatataaatatatatttgtatgtttgcgtgcaccagttattgcgaggtgcttttcccttggaaactgcagctttgctattctttcgtaggagacgctcttagagttcgtggatgcgtcactcgagatcacttccacgctttctccctgtcgttttctccccacctgccactcaccttctctccaccttgtctgtctcttgtccttccgcatatacagatgcatactctactttcatacaacagcatctaacggtgtactctctctctctagatatatagatatacactggagtctgtatgtatcctgtatgttcataccggtctctgtcgcttcccctcatgcctcatgtctggctttctaaattgaccgtgctatctacgtatatatataaataaatatatactcgtacatccgtacatgtgttgatttagataggtgcagactcttgtatggtgtgggtttaggtccatatatatatatatatatatatatatatatatacatatatatatatatatatgtatatatttgcctctttgtgcagtgatctgtctagggttgttttcatggttagacgcgtttggggcaatgtatgtcgtggcaagagattaagcgatcggtttttcgattccgaactgtttccgcggtcgcaggactcgccaccgtcggttgtttctgcagtctcttttttctgcggttttctgtcgatttaatttaattgctgcttattcgatgtcatcgttttttgagtccggaacctcgatccgtctcctgccacgctgcatacaccttttcttcttctgaagaattcagactttttcgttggaaagatactaaaaaagttcacagagaaacaaacacagcgcgccagcacacacagcgcgccggcacacagcgagctcgacccccttgtctgtctttctcgagcgagaagaaggcgttctttgcctctcttgttcttttttcttcctttttccttttccgttttttcggcatttgtccaagagccaggaggttgcgtgaactcttgaaaggga

SEQ ID NO: 660 - DNA, 2224 bp, Toxoplasma gondii
ctgacggaaccttttctggcgacgaatgatactgcagttcgaccgtcggctgtgaccacaagcggatgccaaccgaaatgtatttgcggcgaggcaacttgaaggatccagtccagaaattgaaacaagattcgatcttggtacgcgaaactacgcaaaggcaaacggttgtccaggcagcgttttcccattccaagcttataaaaactgtcaaggccgataggcaattaatgaataccaatcgatggtgcctaatagggtatgtaggattccctcagttatagaatatcaatgcgattcatgacacacaatagacgttttctttttcgactgaatagccgaatggcggaaggtcatgcagaagagttctgaggtagtctgtgagcctcaccagggacattcgtgtagctttcgattggtgaacgaggcagctagcgacgttcaacctgtcgcttagtccgttgtgacatacttacagcacgtatgcaactcagctgacagtcatatgagtgtgtattagtttgactgtgtgaaaaatcctccacgtaaaacgagcatgtaacgtgtgaggcttgaagcagcaggagcacgcttatggtgcgtatgcgtcaattgcgatgattcacctgaaccgcaccgtttgcagctcacgatagcagtcttttttttgcaaggataaaacccgtggcatgccttggattcgcttctaccagacagttaaatctaaagaaaatccgcttgctagatatactaattcctcttgacgctgtcaactttctacgaagatcttgaaggatggctgaaggaggaggaaaaagagaagctgtataaataaattatcgccagaggtcaagcggctttggctgaatgttgtcagtgttgctgaagaggcgtggtatgccgataatggctctaccgtggcttatcagtccagacaagtgttctttcaagctgaactccttgtcatgcaatattggtcgtgggtgtcacgcagcgctgctgtcgtgccggatgtagcggttgccctatttcaggtaacgagcagaagacccattcccctccagcattttggcgagctttggattttcattcccatttgtctctacactagatttaaacgggatacagcagcacggcatacaagttgttatctagcagcgccgtttctgtgaaaccggaggagcggttcttatttgtggagttatttgtggagagggacaacttcagcagaagcggcgctttgctgccggagaaaaggtgtggacgcaggaaatactcgatctctactgaagtttgggactcggtctacgcggtgttcacgtctttttcgtgcgaaaaagtatttttaatgaagatgtgatttcgccgaattgatgggctcgttgtcgcatgcccgaccagccccagagatccatgtgtttacatcgcgtaaactccccgattatatcggtgacgctcatggacgcttctcatgggtgagcaaattctcgatggtcgcaagctgtttatctgctgaaaattgcctttcttcttccgaaggctccacatgggcaacggctcccgtgattgatacggtcgaaggcacacgcagttacgagcggatgcacttctgtcaggacaacctggcagtgctggagcttccctatgatttgcagtcaggccgtagcaaactacgactcaacaaagtgtgaacccaatcaaacattctgatggccatctaaataaaatgttgttcgattgcaatcgtccgaatctttcgcgtgtttatggtgacgcttgagagaacaggcgtatgtacggttcatcaattaagaatgttgtacatgcgtagcgatggcgtcaaacgctgcttcttctagcagatcgtcacactgttgcgaaactctgtatcgtcagcagatgctgttggaggtttcgtctccgcatagatctgaaaactagtatgcaacattaggaagcatatggtcatcacatacaggataggaaacaacgcaaaagtcgccattctacctgcattgccgaacgtggcataacgttcgtgagtttgcggtgtaaactaccgtccgagtgttttgtgtcatgcctaagaaggaaaactcagagcatgtgagcatattctcgcttgcttgcactctacttactggatccgaacgtttttgaaacgctgttttttctatagaacctgcttcaaagaggaaagggggtgtccaccagtcagtggcaa

SEQ ID NO: 661 - DNA, 2104 bp, Toxoplasma gondii
atttctttccacagtttcttgagacataggcgccgtgttgagagacaaaaggcgccagagagtctgagatcttttcggcccttctttcggcacacagtctgcatgcctgatacttatgtgtagttggtaagagatgtacatctaccaccaacatacagaactagtgcacattgattcggttatatatacgatatgcatgcgctgacaggtggatggaggggtccctgagtcgccagaagcgcaggtacgtttcacgcgtccatgagaacgtatacgcagtaggtgtctcttatgtatgcatagagaggcatattttctaggtgcatgcatctctcgttttgcgccaactgaggtgaattaaaacaaagctgtctctctctgtgtgtggcagtgctcctgtgaacgtaggatgcatatgcgagacatcttggcggggacatcatgaatctttccgaaactcgagagccacgttttaaacaaatggattcccgcgagaacgagccgcctttcttgtggaaacaggagatgagagttcggaaggtgtatattgcacccctccaagtttcctccttccccactgtttcagggcctttgtgctgaacagatttctcagtttttgagaaatgtggaagggcgtgttggcgaaattccatgcgagaaagcgcgtccgcaattatgtgccaagaagtccactttttctcgggtgatattctacgctggacctcatacgcttatgttgacagaagctgaatgtcttgctggatttgatgcatctcctttacaccgggtgcctttgctggaactgtcagacccggataactgagtacaactcaactgcttcgaaatcacgtttttccgccatggactgcctatctgagataccgtgcagaaagttcgactgagccggctgtctgtacagcaggttaactcccagacaggaagcaaaggcagaaggtctgctgaaccttcaactgtcggagaagcagcagctcagggaaagaaggggaagcgaggcaacgcagggcagcggacaagccgaggaagagcggacgggagggacctagcgagagaaggagagaaaagaggcgatagagaaacaagcggcgagaactccatgcagcaacgaacagagggactgagtagagaaagcggaagaggaagagaaacagggagagagaacaacaaagacaatcacttacatttttcatgcgctgccgcccccccgtttccggatggtgagaaacgaccgcatcccctgtgtccccccattttctccctcgcttgaccctccaccaccccccctcgttttctcgacctcctgtggtcttcgaagagcgtttctgcggaaaaagaaaaggaggttcctctcgtgttctgcgttttctctgtgggaagcaagctgcggagttcctcttttttttctcgtggaaagacctcgtcttcggcgaggaaaacgcacttcgccgctcgcgtgtctctcgtgtctctctctcgggtggatgtacacacgccgcggtccacgagtgcgtttaatcgacttccgtcaaaacgcgttgtgtgtcggccagaaagtaaatgaattgcttccggtgaaaagaggaggcgcggaagaaagacttgaaaactcaccagacactcacatcctttttctccaggcctcgttgatgcctgattccttccttggcagctctgtgctcctgtctccttcgtcgcgtcgctcttcgcctcgcttcgccgttcctcgctttttctgaaacgctgtccatccatctgtctgctgccctcctcgctcccggcctctctcttttcctgcctgggtgctctttcgtctctctccaaaaaaaacagactgccctgtctcctctctgtccggccccttcctctctcctcgtttcctctggccgacactggtcggtctcccgtttttgcctccttccctcctctccgtcggccctctttctctttgtctcttcttctgctgcctttccttgccccctccgctccgccgtttcctctcctttcgccgcgctatccccgctctctcttcgccgccttttccgcgccttctctccttttccgcgccttctctccttttccgccacga

SEQ ID NO: 662 - DNA, 2218 bp, Toxoplasma gondii
tctcatagatgctttagaaatacccgtcttctttgtccgcaacgttctaccgatgccatgcgtcatataggggctgggttgcactgcagtcttgattgatgaaaactaggccccagacgagcggcatctgttccactgataggatttgaaaatgttgcgatatgcacctgttcttgcagctgtcttacatttctacgaggcatcgacactcaaagcgctgcgatgaataaaaactgacgatactgacgtgcacggtgtacgggtaggcacatgcttcagtgcttggttacattcaggtgaccgcacttttcttctttgaatgccatgcttttgtagagccacacggttgctgtgaaagtgccacactctctgcgactcggcgagaaaaaacctcagaagctgtgtgcacggccccgcgacttttttctgtcattcactgtattgctaagagcagggcagcgaaagctcaactagtattggttccatgagaactcagcaatgcccgttctaaatagacacttctgacgtatgttagcccctctcccgtggactcctgtgctccacatgtacaccttagtagtttcttgattccagacaccacgaaatcgaatcctcctctttcttctggattaaattctcgtttcgagtgtcgagagcttcgctactctactacccgcagtggaccctgctgctgccatagccgttgcatcggcgctctcgggatgctggtgtcagcataacggaaacagtgagcgcttcctgacagttcgctctgagcgcacttccccacagtttgtgctagacaagtcaccgtcggactgcggtcttgaacactggctaagatctgctctcgaatcacacttatctactgagttaggcagcgatcctgttctccaactgccgacactgtggcttcactgttacctcttgaagttacccctccctttcaaaactatgggaatatgagggggcgaacaatgttatgccaaggactgaaaaactcccccagcgtgttgggagtagtacccgatacaactttctttgacggcattcccaccatgtagtagttcacgtttttgccgcgatcaggtgtagtcttgcttgcacaggaaggtttcactcgcctccgaagaggtgtctgttacccgtgaagaagagcatagggggggacaccagaaagtcagctgaaccaagcacctcaggcagatcctttatttttgtgaaatgagccaatgatttagaggagcgcggctttttggggaacggtcaaggacggaggtgaggccgactggtccccggccttgtggcgggcatgggtcttttacgcagaagacatgaacccaacgaagaacagcccattatatcgtcacacgtagtaattcagatgactggcttgtcaatcgcagacgatcttacctaacagcctatcgcaagctctctcgccgtgagccgtaacggacgcttcctgcatgcatttgcatgtctttaccggttgcaggtcaccacagcagccagataaaaggaatagcgcgccacgctgtactagtttttacgaaagcgaaagccactgaggaacacgcgttatatttcgtgtaccccactgactctttttatcagtggcttcaatagctgcacacctttctgagaaaactgctccgtcatgtgtcttcttgcagaagtcttaggttcttgatccgaaactcccctccagatcgtccagtttgcagtgtgtagccgagccacttctcccccatgttgctccacgtccaggttttccctcatccgtgaggccgatcgaagaatggactttctgcgttcaactcttatcgccttaaggggaggcaattcgagttctggcacaaaccgccggggtgccgcccctcggtagcggtgtgttcgtgagcacaatgccgcaaggaagccacggcttgataccgcgtgagacacaactcccacgtgaaaaaggcagttttaaatttccatctctgtcttttgcgatggctcgccagccagttacgcaacgagttcgtgtttgaagtcgctgccacaagcggtcatctccaccgaagcgcttcgagaactcgtagcgaaaacccaaacctagagcgttgtttttggcagccgcctttttgtccctttaagaaagccccccgcaacagtaccagagcctcgagtgcttcttctctgccctactctccgtctttgttttctgtcgcca

SEQ ID NO: 663 - DNA, 1096 bp, Toxoplasma gondii
aaaggagagtgcgagaagaaaacagcacacggtaacaaagaggaaagagatgaagaacacggggcatctggaggagagcagaaaggaggagagcagaaaggaggagagcaggaaggatgagagcagaaaggaggagagcaggaaggtggagagcagaaaggaggagagcaggaaggtggagagcaggaagtagacgagagagtcggagagaacggagagggtgaccgaggggcagggaaaggagagtacggaggcaaggaagacgaaactcgagaggaacagactcggcgtttggaccatctgtcgcagacagacagagaagaggaaagcctaggcgccatcgtgtgtgccggaaaatctgcggaaaagatgctcccttcccaaagtggagtctgtcactcccctgctctcgtcgcatcactgcgtgaaaccgatggaggacgtgcggtcttcacctcgggcgaaatccacctctctctttcttctttcttcctaatttttctcgttctctttctcttcttcatttcgttctctttctctccttcttctcgttttcttctctctccttcttctcgttttcttctctcttcttcttctcgttttcttctctcttcttcttctcgttttcttctctcttcttcttctcgttttcttctctcttcttctcgcctctcctctcttctcttcttctcgcttcttctctcttcttctcgcttcttctctcttcttcttgcttcgtcactttccttctccgccgaacgctgtttgcatgtgctggagcgcgttcacgagtagcactggtgcccaaacacagactgcatgcgactgtacttcatgaacttggcatgacagccgagaacaacgacacaagagaacgtggaggcggggaacagagacctcgaaggcgtaaacccagagtccgccgcggcatgctacgcacaacggcgcgcagcgaaaaagtacattttgtgacgggcgggagaggagaggcgcgcgcgagaaaaggtcggtttttttaaaagcaaggaactcgacactgtgtttttcctaggtacttttgctggactcctcattcccaaatctacctctgcatgca

SEQ ID NO: 664 - DNA, 1426 bp, Toxoplasma gondii
actccgaatgcagagacaacacccgaagctgtgaagttcgctcaactgtctctgtcagccggcatgcgatgcgttcgttttctctcctggccccacccgggtcgttcaatccgggagaaaagacaactccccaggaggagacaggctgcagggcagactctggtggttccctcattgaaaagaggagcaaacgaatgacagagaggcgacgaccaagtcgaagcaagggatctcaaattgcagaaacgaggagaaggagcaaccagtacgaaggacatgaatcaacggaggagacagcggaaacagtggacagagagaatagggcgcttttctccgtggtgacaggaactacagagttgaagcgatagacataagacacctgaaagatgtttccaagctcgtgaagactgtcgacactggctggacgaagcagacctggagatttgtggcttcttcagcggaaaaccggaaagaccttccgcgggagagggcgtcgaaaactcctcttctttttgtgcatccccccacctggtccgctcctctctctttctctccacccgacgctcctttgcgcatacgttcttttacctgtcatttctgtaaacatttcactttactacggttcacgggatagggagagcaattcctgttccaaagacaccttcgtctgcgtgtgcaaagggacctccccactctccagattgtcgcggacgagtggaaacgccggtcgaatcaaacgaacgaagaagtagaagctcctcgatccgccttctccagcagttcggctgtaaaatgaacaatcgaagcgctgagctcggcccgcctgtgtgtgaccttctgcggcttctgtgtgcgttgacgatctgggagaaaatgtgccgtttggagccgtttcgtcacgcgcaacggactgctagaagaagtgactcaaagaagttgcttctgtttcaatgccgatccccgtacttggtaacagtccgtccagcttttcgcctttcccttcgtggcgggtgtagtcgggaaaagcaggcaaggccgaccagcgggaactcccgaagaagcggtttttccctccaagaaggacgaccaatcttgagacacccggaaagcagaagcttcttctgcggattgagcactgacgaggtaaactccagcgtgaagcgttcgcagaaaaagcagaaagcggattctggcgagtgctgcatgtgctgtgcgtcgtcgcggcgtcgacagacagctgcctcttgactcgcaaaaccgcttgacagagaggggcctttctattgtgtccgtttcaaattttttgtctagagagggaaaatcaaagactcttgggtgctctagaagacagcgcatcgataaggcaggtgctccagaaaagaattcgcgggagttttttgtcaaggtgaaacgaggtaagtcatcg

SEQ ID NO: 665 - DNA, 2140 bp, Toxoplasma gondii
aaaaaatgcacggtctacgagaaaggcgtgggtttagttgccattcggcgacaaaaggccattgaaagcgtgccacttgcattcactgacacatatcacctacatgctggctcccgcgaaacaatgccaacccattttcaaaaccacacagccatacgctgtttgtagaacaatgctgcaatgtcttgcctagactcgcaacgtcagctgtccatagttctccgttcttggagttcaccagacacactagctgccaaactgcgattcgacggggttcaaatgctcccgactgcggttctttccaggttggctggttggacagtggcaagcgatgtggacctgtccgcaagagatcgacgtttttgatgagcatgcaacatctaacttttttagaagaaaagccctaattatgtcgagcaattctagctgagagtgcgcatttaatgcatggattgacaccgtttatattgtggtacatgcctgtgtttgcgcccaggcaagaaaggtaggtttacatccattcacattcagcaggacctactgtggatgccgccggatgtgcggtaatcccagaaagtatttgttccaagttgccaaaggcgctgtgtcggctgcacggctttgaagttgctctgggtagtaggactctggccgatgagtgtcccgtacgtgttcatgtctgagacccatccacgaaatgtgtgtaactttaaactaaacttgctggcacacgagaggaatttcacagtagatatgaaaaaccaacacgtacacaagctgtacaaatgtcgtgagacgcatttcgttaggcttcccctggaagcggcaggctctctggtcacaacagcgatagaggtgagcaatcgctcctcgtagttgacttcacgaatgggtgacatgagatcctgaaatcgacagtaatttctcttgtgtgcaagacgtttttctgtcgcaaaacactgcaccgacggactctaacctccggactctggtttcttttgccgcgaccgaattcggcttaaattgccccctgttgcatgttctcagcatttttctgtttctcccccggatttacccgtcatgagagtgttttagatgtgtgttgccaacggaaaacccgtccagaagattgtacaggttgcatctcacgttagactcgtgtctgtgcgactgggtcgaaacgcacgtggacgcaggaagccacattcctcccacacacgcatcccacctgttgtttttccggaagcacttatctcaaaacagcagtctcctctgtaaagaggcgagatcacctgtattgataacacgcacgacagattccctcattcttcggtggcaagctatgcaggtgtctatcacgatgacctgccgccagagggactcccgtggcggtggctttcatagaaacagtggacgtttcacccacgacttgagttgtttaccttctctcttcctaagtccaaacactcttaaagtggatgaccccagaaccttggaagcgctgctggtgcccgttaaaagcggggaaccccgtcagtgtcacttgtttcgtcgctgcaaagccctttctctgcatgtgcagcatgtggtaatattcgcgagctatctcttcttctggctagctagcgcagtggagctaccagcgacgcagagaaaaccaatgtgacagcatctggggttttaaccgtcgcgggggaagggcggtcttctctttttctcgggagctcttgggtttccgaaccacaggagcagctgagtgctttttgatttcccccttttgttccgtttttcgggctggtcgagaacgagatccagccccgggaaagacggcggggccggcggagcggcaaatttgaaacgccggccaaccaaacaccattgggctttcttccgaacggcctgtattgatggatccgtctatcttcggattttaatctcggccgcctctccaccgctggccgtcgctgcctcttcgcggcttgagactcatttgtaccgacagaacgagggagcctgcccacggagacgggttcttcccgcctcgagtccgagaacggagtcgaggcgtcagtctctttaaatgcctctttcttaattctgtagatcgtctgttttccccgttttctgagtcttggtgcga

SEQ ID NO: 666 - DNA, 2566 bp, Toxoplasma gondii
tccgcaatcaaagaagtgactggtacgagtctgcggcgctcggaaaagcgcgccggccaccgagtgaagacaaactggccactgacatcgagctccaggtagaccgcaaactggctgcactggagaggccggttcccgtggcacggctctcgtgaaaacagcgcactggtgtcgtgaccgatggagagcgaatccagggaggtgaaactgtctctcgagttgggcagaacgccggcattgtcttggctctcggcaaccgcgagaaggtccagtgcccagacgcgcaccccatagtcggggtccgttgtaactccgccgaaggcccagaacggactgagcagccgctctgcatcgcgcagcgactctcgcgtttcctggagcagttgagaaagctggtcgcgaaatggcgaatgtagagaggaaacggccgccgttgccctcagcagagcacccagcgaagactgtagcgagctacagagggtcctctgcgtctccgcgggaagagaggaccagataacggtggagaatcgcttcagagaaaaagcttgttccccagacgcacccactggacgggtcggatttgacgcacgcgaagacgcctgagacgaagcagtgtcctcgaaaaaggcagacgccagcggcctcggagaggaaccggaaggagcggcgggccggtctgagaggagacgaagatcgctgcttctggaaggccactcagcagatgaccccgtccacagattcagtttcgtgtctctgcgcgagcgggtaccatggggaaggggagcagtaatagaagctaggaatgtgtttcgaacgcagagaagctgccgaattttctcacggagagaaacatcattgacgcagtgagacaggaaacgggacggtacacgagttccgaaaaacgcgcctctcttgccgcctgccacatcgcactgttcaaaataacgtcccgaagcgttagggggaatcaaagtgcagcaatgcggattccggtgaagaagaagaatagagcctccagggtaggtggcggcaacccggccatcaggagcgacgacacatgcgacaaaacacgatgtcgacccgagagaggaggtcgatgttttgaaattgctgtcttgagaaaagagggaagcagggagattggaggcagggggcagtcgagagtttgtagccatgctgaggaaagacgttgaacctgcacctcaggtgaagagcttggtcgttgggcttaccacctttgcccgctgttccacatttctcacttcgaagtaccgctatctacggcggcaactccggatgggtgtggcagccggctttgtaggcgttcgaaagaatgacggagtcgctcgagatgcacttgatttccgcctacgtggttgtaccacggtcgctgggaaagctgccgaagagccaaggaagacagctccgtggcaggcgacttccagcgaggcctgcactgacaaggcgtggacacaagatgtacggagttaaaggacgcgtcatcgttccactgaaggtcgatcggtagtttcgtggcaagaaccgcgagttaaccccgggttctgccctttttcacagggaaaacaaggtttgataaggatattcggaagcgtcaatgtcctggcggtccgcagagagaaccgcttgccgcttacgctcgggaactgccctggctggtacgtccatcggagctggacatctgcgcgacggtgtgcagacgtttggaaaagccgagagtcacatatttccattagcgcgtgcagtgttcggcacttccttcgaagacaatcctccaattgtacccctacgaaagttagaggagctacttgttttggagtcaaactatcagaggtccgttctcctgatcgtagagtcttgaagagcgaaaacgctgacgcggcaagacagaaaattgtggggtaacgccagagaagacaggacgtgcatgcgagcagaggtgctgcgccgcacacccagagagatgcggctaattttcgggcagggacgggcgaggcaaacacacaactgtagaccgcagtggtgcctgatctgtacagggtggtgtgttcttccgctttgtaggtagaaacccacagaatgggcgttcgtgagcaacccctccccccggcttacataagcgcgcggcgtcgtcaccgcactagagaccgggtactggagacattttgcccgaaaatcgtccacaccaccgtaggaagttccccatgttggtcccgtcgttcctccgcaaggggttgagggcggcgtcattaccgtgtttccctactcttgcttcctcgcgtttctaaaggcgtccactgcgacggttcgtctgtcgctgcgtcactgcgtcttcttcctgttttttcgccttcgatcaaaaactccggaagtgtctatacgcaagtcgttcgaagagagaagggccgccttcctgtgtgttgtcgcctgtctcttcgtccctgtgtacagcaaggcaggcgttctgtccgtgttaaagcagcgatctttccgtaggaaagcgggttcccctttgctgtgcattttcattttcgcgaaccaggaacaa

SEQ ID NO: 667 - DNA, 4109 bp, Toxoplasma gondii
cccacacttcctcgagcggaaactgacctgtttgagaggagatgttcgggtgccaaattttcgtgacgaacttcatcttggggggattgtaggggtagtcaggaggaatgacgatgtcgagagtgaagtgcccaccttcgtagggcgtccccagagggcctgcaatgaatccccgccaacggtggatgtctccgccgacgatttgagcagagacgccatgtgaagtcgagtgagtagccgcaggttctgagtcgtgcgctctctggagttgctggatatctgccagctccttcagaagacgagcctgctcccgaggcgtcccgcgaggctgcgccgtcgccatggcaagaaaaggaagtgacgcgggtccggagaaggaagcgctttagcaagcaagtgcacgcagctgcagagcctcaggggaaaaccggaaagaagaagctccagagatgcacaagagaagagagaggagtcgggaaggcgcgggaagacgcagagccacttgcagagtggggaccctcaacgccggggtgtacgtacagtcagtgacggcttggggaggtgaggttggagcgtcggaagaagcgtccgcgggcgagaggggagattacatgatttttcacgaagactcagaaggggacggatggagagaaaatcggtgactggcgcagagaagcaatgacgagttgatgaggccgagacgaagtttcgacacgcgccttgagagacggacttgaaaaagaccttggagaagactatcgggagagtctccccactgcggcgaagcgagtggagtgacagactgccgagcagaaatggagaagaaatctgcggcacaccgcggcgaacaggcagcctcttggaattgagaagacgcgggaagagagacgggattcgcgacccagaagaaaacagcttgttacctgaagacccgaagagacaagagaggaaagaaaagcacttcgacctgccgcgcgagacaacgcgaaaaagaaactcaccagacagccgtgacgcagaccctcgtgaggaagagaaaaaacttatgcgcctgcgggactcaagacgaacgaagaaaccagagagagaattcagcccagagaagaccgcgagaaagaacgaagaagacacacaggcaagagacaaaaaaaagcaagacgcgggagaagagagaaaacctccgacgaactcgggtgtcagtgttggccgaaatgcagcgagaaaagggtcctccagggaggacgcgcttggcagaagagctgagaaaacggagaaaccgagaagaaagagaacgagacgaaagaaaacgagaagaaagaaatcgaaaaagagggcaagagattggccacgccgccagagtcacgtggagcgcagcgcatataagtgtgagaagtgagaaggaagagaaaccgaatggacgcgggagacgcacccgaggatgtgcgacaaagaaaaaagaaagagaaaaaagaaaaggacgaacagagggggaggaaacgacgcagaacacgcgcgtcgaattcagccctcgacaagagacaccggtcaggaagaggtcggaacagcaaattaccgggtggaattcgggagcagaattacgtccttgaggctccgaacgccgtcaatgagaagaaccaagtgtggaaaaccgcagacagcaatcaactgcagatacgcgcgtgatcgcagctttcctctcccgaaaatccacgcaaattaacagaaatcgacactgacgagcacctgcgtggccgcggcctggttctcagctactacgaaatcaacagcgttcgagttttcgcgcaagtggaaaaaggagcaaatcctttccaagcatccagaggcagcctcgagtcaagcgaaaagtcgctggcagtttctcgctcgctgtttctgcagaatctgcgaatttctctgcagcgcaggctgagaagtcctgtgcttgccggcggaactccgaaagcgcctttggcgagtctcccttgcacagccggcccccaaggactcggtcgcgaaccagaggtttcctcgtgcagacagtgagaacaacccaggtttcttgtccaccaaaagggtcaaagctccggcaccgggcgaaacaggtcgaagcccgcgaagcgcctttctcggatatatgtacacctgacccgccgtccagtttcgcgcttcttcccgcgtggggagactccaccttttccagtcttctcctcgaccgcctgacgcgccagcgtgaagaagtacagttttctctgtcgtgaccgtgatgcagcctgcagtgccagccgctgcttccagacactttgacctcaccgaaattcctctgctgctcaacaccgtggaagtccatgaagtctacatccctctctgcaccttctttgtcctttcttccgacaaaacgacttcctcagcacactggacagttcgctacggcaaacccacgaccaatcactggtggcagcctgctgctttcacacatgcccgaaagtggagcgagtcgtcgactcctcaagagcggtggattctgcgtatccgggcactttcctgcagcggaaggccggaaaacttcgaagaaacagaggacagcgatgcgttcgttacaccgcaaatgctccttcgcacccaccttagagaaacgctcttataagaagtgttcactgcaagttactgccaaagctgcacgttgtaggtggaagaaagacacccgagagaaacggtgaccaacgccagccgcatcgcatcaatgcagacagctcgtacgcgactagggacactcaacagcggctgtggcctagacaccttctacatcggttcctacgtaggtctcgtatcagcaacgggtgcagggggaccctcaggcgccgtgatcacgagaccgtcgtgctaggccggtaacatctttccaaagtgatctgcacttctgacgggcgtagaacgacgggccgcctagcatacctgaccgttttaacactcgatgtgctctgcctgcgacagctccgtgtccgcagtgtcgcttctgtcagaaatcgcatttcctctgaacctaaatgagcgcctaaaatgtgttcttcgactcgagtcacccagttaggaaccgcggggcgctgggcgagaaacccgccggcgtccgttgacgagccacaattgacgccactaaaagtgctaagcgctgcgttctggacagtgtgtctctgtgtgcggcgtgtttctgttggtggaaatgctgtcgcattcgggactccggcagctctgcgcatctctcaacagcagaggcgaagagaggttgcggcagcagcgtctacgaacactcaccacgtttcaagacgacggcgactgcgcctcacgaccccagatgcaacgtggaaagtggaccttgcgaatgccgtcgaaaccagacggccaacgtcgaaaaagcggcggcatgggtgtcgctgtgaccgtccagtgcacagaatcgcttcgggggacttggctgtatcgatgaaaagctgtggtgtcgcgtggagagtgcgcgcgccagcgagtcgggtcggttgcgatcgatctttgcgtggcgagcacgctgtcgtgttgggtgcgagtgcgactgaaaaacgggcttgattgctccgaaaatccacgatttgtttcctcggtgagcgtccacagtcccgtgcacctgtcgagaagaaactcaggcgtatccggaccgtttttgcgagaaaacggcgaaaatcctcgagctctctcggcgccgacagaatccccagagcgcgcgaaccagaaagtcgcgagagcgcgcgcgcgcgggctgtatgtacacccgagggctgtttgggcagctctgtcgcagagccagttttctcgaattttcgtccttcttgtttttggagtttccccaaatttttccttacttgttcccacactcacgtcgtcttttcatcggagatctcttccgcgtctccttcgacctgattcctccgtccacgccgtcgaaggcgcgcgcggtgctgcagtttcagggcggctggccagctcttctcggccgcttcgacgaccctctccggggaaaaaagaagttttctctccttcgttgtacctctttcctcgtgttatctctctctgaagcaaaa

SEQ ID NO: 668 - DNA, 3024 bp, Toxoplasma gondii
agattgctgttctttgtatacagtcgagggaatggtgtattagcgggtgaacttaggtatggtttcgtctgctgcgggttgcccaacttcagtcttccctgcagcgccgaagccctgttactgcaatgtacacgtctcgttagtaagggtttgattttcagatcggaagccgtggttttgccgaaggtgcgcctttttcaaacggtatcgcactgttttgagacgaatcgtgggattatcgctaccctcgcgtctctacattgggtgaaacagaatgtttctttttgctgccgttaacgcaccaggatgtttcctgcattgtgcaacacgcctttaaagacacccgaaacctggactgcgatctggactcaataccccgacgtaaagcgacacgtggaatggtaatcctgcgacacgaatccccgacgcttttgccactgtgaactgccctactttcgatacaggagtcagtgcagatatcttctacagaatgcacggaaatcatatccgtagatgtggcaggtgtagttaggggttgcaaagccaagcgactccttgctggctgctacatcagcctccaccgcaaaggtgtgccggcaacactgacttgacgcccgttgtcgcatttgctttcctggctgtccatcagtttcattcgcactcatccggctttccacaagtaaaaacgcagcagcgcaacatctattgttcgaagctgatgtcacgagtagacagcatccttgcatgcctaccagtaggtctagtggtacagggagagaggaaattgcgttagttcttggcaaacgagttctgcaacccatataggttggttcaaaagccgtacttgtctttcgtacacaggcggcactgggaacgaacataaatatcatagccagtcagtatcatagcgagacccacaggtgacggttcaactgtagaaagctaatatctattcatagccggagtataaagcgtctattcagggggcaccaactggaaagttggcgccattgaccgggacggcttccccccattcctttggggatcgtccacaccataaaaaatctagacatacaatcagctcctaaacttctactgaatgtttgtgtcatgacgacgtgaatgcatcctaacattttcacgcttgacaacttggttctctccgcaagaacgtgcccgttattggtggcctcttgcacacacaaacttcacacaaaacattaacctacttgcgtcacgaatcatcgcacctgacaaccgggcgcctgctgtcgctatcgagcgggtgctgtgccgccagagagcctgtgggctccgacaagtattttccaaagttctccggcagaagacaacctgatctgaggcgagtcacatatattataccgctttctccaatcagctgatggcattcaatataaggtttcccgggtggtacgaaacaccacggggggtccccgagcacaacgtcctgtcatttctccagttgcaaaaccgaacaacaagcctttcggtggtctgtacatccttactaatcggaaatgaagcttaaagttgatagttatatcttaggatgaatccatcgtgtcgtatgtcagggtttccgtccgacggacagccggtaaccctggcaactccctactttaatacgttgttcattcttgtcgagcagaatggactcaaactgcagctggtgtcccacttcgttctccccaaaacacaccgacacataaacagatttgagcaatgtccaaagaacgtcctgctcagcatcagaagtgtcaggtgtgtctcttgataatcgaagtaaatattgagcactcgccctctagcatcgatacagccactggcagcagctggctacgccctccgcgctgtcgaaaacgcagcgagctgcgcgagcctcccatcgtcgatattcctcttggcccgtcggaatcctgaagccgggcgcgcgagcagtggaacccccaaccggagcgtttggctgtggactgtctcaagagaatggctggcatgctttctcggaagaaaatagatcatgcagaagttcgtaggttcttccaaggatgtcgcgtttttttcgtcgacgtccgagtgcctgttttgtttcctgcgtcatgggcacgtcctcccgtctcgcgcagctctgtccaaccatccggattcttacccgctaactaacgggggcggaaaccgcaacatgcggcttacgtgtggttaagattccggatgggcggaaccgattttccccggagtttcctcgtgtttctcgctcattttgtagttgtgttgtcagtaacagggtgcggcgcttcgctgtagttacaccgcagaggcacggaagcaaagccgtgtgagccacgtgcctcgtggacaatcgaggcagttctcacgaaaccgacacagggaatttagtcttctccgattcttctgtactttcctccgtttttttattgggagaaggtggagaggctttgactttcctgcacttgttcccaaagttcatccccccaaattttcttccctgcagctcgcgcgtctccacgccggcacgccacttgtgaagaccactttgctgccacgtgtgtcacttcgatatagtcatattcgcgttgcatgtccttccgcaccattggttgaccgtccttaactgctcggcttttcaagggcgcgccgttacttcccttccgtctgagccagagacggttatggcatcgtgaatagcctggggttgccgcgcctcagctgtctgtggcttgtagtttatcaattcgtttctgagacgtctcctcctgtgggaaccagtttctagtcttgaatctgcggcgacagtggtacaccagttaaggtacgtataccgattttcgcgaaaaaaacaccctcggcggcactgtcatccgctctcatagggggtactgcctacttgctcagtcacggaggcagtgtgacgcggacacgcgaccccagaaagcttcccctttgagtttcgtcttgtgtcgtgagtttcgctcttcgtcgagaaaa

SEQ ID NO: 669 - DNA, 2936 bp, Toxoplasma gondii
aggtgcgcttgattttgaaaagctacattaacggttcgcaaagtggactctttctctagcaggaaatgattgatgtgttccacggtgcatcccagtcttttttctaggatctacatcaacggttagcacttttgaaacttgaggatttcttccaatttgtctgcggcctgaacatgaccaacgacgcagtggtggaggactgtcgacagatcctgttttggtgtgagtgaaggtctgtttttccacttgaactgcttttcgccgttccatccaccttcgtttcatatggtgatcgaaacacacaagagtgaagggaacgtcgagggcttaagtttctgctttgcaggaactgtaagtcgagtgttgccgggagaaaaatcgggggcgtcaatctcgaaaggcggcagttttgtgcagaacttgacatgttggttccgacactttcggtttcctttgaacttggcgtttctcagggaataataaaaaaaccagtcttcagtacgtgcgtcgccttcagcacgcagccaggcgccatacagacgagatcgacgagcttagagaagaattaaacagacttcgggcgcgaacgattccgatgtttgaatctgcggtgtgaaaaatggaatctcctattgcttctctctcatgcaagtctcaaaaatgtgactgccggcaactcaaaaagtggttccatgaaatgagaagttggcgacgagagacaaaaatgggaaacgatgtggaattcattctacttcgatttccgatcccgtgcagtggaaaagcgctgccacttggcgtccataggacgataagacgaaatgccaacgggggtcaggaattgtaaaaccttgtcagttgcctcctaagcacatatacatacagatactaatcttcatcagtgtcctttacgcggtcgctaaccttggggtcgcgcgcaaatccgtagacttttatcgacatttgattggtgaatttgactttttcaatggcttacctgtacctgcactgaatttcacctgccgccctcactggtggagtcttgcgccacagctatgagggtagagctgtacatggtcacatttccgaaaaaaaataccggcgcaaaacattactgtcgaccgccacacggcacccgagatgcagcctctttcctacattgaaagaaccatggaggggcatgcgtcactttcttgtaaagatacatctggtctggaagcagtcacatcctcgcttccttagtgaaaagctcggacgaagttccgttgcggtttgctgaagaacgactgacccgctaatcaaagatttgaccgagagctaaccgagcaccccaactcgtatttttattccccagaaaaaaacggcaactaaatgtcaacccatcctgcgaattcgagacggtggactgcttgttaacgtgtgacagtacggttgtagtaagcgctgcatccacgatccaacgggctgaattcgtcatgtctgctaacaagtgtttgtgcgtgaaataaagctacgcacagtcggcagaaacagagtcgatcccataaacgtagatcttccaggttggggcgcctggtttgcacggtgaccacagatgtcagcctgtgtgcagttgataattaggactcgaacttcgtacaacgtggttcgattttgatttatacaaatgaacatgaaaaaagggaagaaacagatgcatgtgaatatggaaacacccttctcgtctcattcgatttgtccgagagaaacgtgcgaagccgcttcccgctcagccatttcccaggactccgactatccgcctcttgtggtttgttcgctttccacacgtcaggggtttcgcggaactcaaaaactttccttttgactgtttcagagagtccttcttcagaagtaaatggacagagcgacatccctcgtttttggcttctttcgctcagaattgtcaactctggcgaccccgggaaaatacgaccgagtccttttctacagtccacgatcaacagctgtttgtcagctctgctagtgcagagatattggaagagtcacgcgaattccttcgatcgtccttcagaaaatgtcaagcagctgcagaagcgatagggcggctgaaattgtcacatcccggcatgcacacgacactttcacaggaaggcgccgcagtcggggtgactctttgatgcctcactatccagacggtccccgtagcggctttttcttgtgcagatgtacgcggtaagctagtgaatttctttgatgcgctgtgtgcaatcgctttctacggtgcttttcttgcatgtggtgatgcggctagcgcgcaaatctttgcgagcgcattgccgagaaatttctcccgttgtgtattgctggactttaagtccgggatagacgaggactaagagactgtcttccaacgctatggcgatatgcaagttggtaagcgtaaaacgaaacccgtacgctttcacaaaaagcattcttatccgttgcaagccatggctgcgctccagaagactacccaccccgacggcatgtctgacgccagacgacaagaccccaccctccatccaccatctccccttctgtgtgtacatgcagacggtaaaaaatgatcagtgtacgctggtgaaatttgccatgactcttgtctttctttgaggcttcctcggccttctaaccctttagcatcgacatttcctcctgtttcgctgctcctgttcattcacccaagccaggtttccctcgtaaatgtacacctggcgactgcagttgctgggaacacccggctgcttttcccggcacagcagcgattccggagcactgcgattcccaggtggtagttccttttttctcgcttctctctgcgtatcccttttacgcttcgtcaaagagttctccgcagttttgcgcaccgctttccccgctcttttcggtagtcgcaa

SEQ ID NO: 670 - DNA, 2097 bp, Toxoplasma gondii
cagaaatgccacatgcttaggcatgtgtgaaacagttgaaggcaatagtgcctttggcggccgctcggtgttaatgcgtatttccttgtttcttcctatttaaccagattacccgaacatcattcctagacctacacgaagtatggcgtaaagtcgcatgcccatattgcgaatgtgcacgatactgatggcttccgatgcacctcgagcatcgctcccgtcatgtagcacgacagagtctagtgcaaggagcaagtccggcctggagaatgggcagtatctatttgggcatgagggtgcatgcgcaagtatatcatagatagtcgccatcccaatgtttacactatccactgttgctttgtgaacagcggatggctcaagtagcatagctgcacaccgacaatagagcccacaaacagtctcggaccactaaagctggtatgcgaaatccgcttagcttccgttggaagataaaacaacgagggggctgcgggatatgggaacccaagctactgattattagggtgttccccgggtacccttatctgtgggcactgttcgtttaccagtagcaacgagagcctcacttgtgaaggccgcacgatcttcgcgacactgtataccctcattatattgttcacactcggaaaaccgttttaatgtaataaatgcgccatccctctttttttgccgcgtaacaggggtatcaggagtgacgacttcatactagtcattctgatgcagcgatgaaaagccacccattataatatatacacacccttgatgcagccaggtttactacgagtgtttcgtgttccgaaacaaacggggctcctttcaaactttggatgccagcatgtggtctcagtttccataggggcaacgtaatgacacgcctccactagtctacgatgctcagctcacacttgactcctgcgctgagcatatttatctgcacacttatccgttgattcggttgaaatttacttaccatacaagcaatgagtatacgagaggttcgcttccatgtggcaccgccgctactgatgagtgcagctcatttgttgatttgaggaacggcccgtctctacgcaattaggttttgcttcttcgtgcatgcagttccctgaggatgaaacaccacatgccttatcgctataatacaacccctatactagagagtgtacctgttttttagagttatttcatagaaaagctctcaacagcacgtgaaacggccaggagttcttcctgtgggagacaaattttgtggcggttttatgagtgacgttcgcttgtcattgcatgcgcaacaccgatttcgagtggcaccgaagacacgtggacttctctgcaccactacggtcacatgtagaatcttgttttcttcgagcctggactcattgttccttttcaaatgacgtgcttcccttttcgaagtgcgacagtgctgctttctctctcggaatgcccgccgtgtctccctgtagatcgcgttcgaaacaacgccatattctctagctatcttcgtggacgacacttctcaagatccggtaactttgtccgtgcgcttttggtggtggttattgttgtcgtcttgcttgaggcgtatgatgcttggaggtctctgtgcttcagaggtgtgcaggtcgtttcagcgcgtctcgtaaactcacgaatgcgtttcttctttccaccaagctggctgcaaatttctttattgagtgacatgcgccccaccccgactagaactaatgttcctacctctaacacgtgctgagaccttcacttgtgcacaatttgactcaccagctcgcgacaaagtccacgcaaccactgccccccatccgtcggctacaaacgacatctcgccggagatcataagggtggctactgtaattcagaagaatcccgtgtatgtacacgcgtacatgtgttagattggatagtggttcacagttgactggaaggccgaggcgtgggttgtctttcgtaccccgttgcacgaacgaggtagtgtccgtgtcgcctccgaaagcttgaccgtgtgtttcgacagacgtcaacaagatccaaattcgtggaaaaaagggacaa

SEQ ID NO: 671 - DNA, 2413 bp, Toxoplasma gondii
cctttgaaaacatcgcgaattctcccaactggctccagaccgacacccaggcctggaccgcctctcctcgcttcgtgagtcgacggcctggaaacgcagaaccgccagctgcagagagagaagaagaaggcgacaaagcaagagaagaagagcggaggggaggagcagaaggagggagaggagaagggagcggaggagaagaaagagaagacgaagggagcggagctgcagaagaagaaagagaagaggaagggagcggaggagaagaagaaagagaaggcgacgctgtggggggagggtgagaggctgccgccgcgtctccactgagagtgttttgcgctgtctctgcagattcgctgaggcacttgaacgtaatttcacctgaaaggggagacggcgaactcggttggaaagaattttgcgagtcttccgccgaggtatttcggaggggagaagccgagagagccggtgaggccacagaggcagccgaaccggaaagaagggcaccttgagaaggagaagaagcaagaggaggagaagatagagacgaagaagacaggggagaacttgctagattggcagacgctgcatcgtcagaacagaccggctgcatgggagcagaagaaggaggagcagaggagacagaatggacagaagaagaaatgtttgcgtccgagagaccttgcgacgactcggcaaggtcgtcgcgctctgccccctggggggtaccttccccagacggcaacaccggagacgccatttgaaaacaaagagcgaagaagccgaggaaaagaggaaaagaggaaggagacagaggtgaaaaggccagacaggccagagaaggacgaggcaagacagaggaagaggggtgaagaggaggcttctgaagaggcaggaaacgagacaaagacttcgacttgtgttttggtggaagcaagcgcaagggagaagggggatgaagaaaccttctttttcttctatctcttctctttctgccaatggctcggacggccaagtctgtcctttcgcaatgaaaaggtctctccgctgtacagacgcctgaggtcctcccgcctttttgaacgcgcgtgccctccacagcgtcttcactctttccagcaaacgtgtgaggagcgaggcgaacgccgttgaaacgaaggaagtggagtgccttttaagcgcaggtctgtttctctttcggaagaaactaaaaaggcatctctctgcaggggtgaccccctgcgccttcttctgccttggaagagaaaaaactcctggtttttctgcaggcctcaggcgtccttcccagcaaacgccacacagtcagcctttacacacaaaagcgaacagattcagacctgcacagaaggtatgttttcgcgctcgagaagaatgcagcggctcgcgcccaccggccagctgtctcatgtcgccatgtgtgtaccgactcgctcgagagcatgcagagaaaaacagccagatgccgccacagacagatatacaagtacaccgaacgtacgcgtttaacgatgtgacgagaaggcatgctctttgctagcgcctcgccttcagtaaaaatgaggtacagacgcggtggatatgcgcagaacagagaggagatgaacgatagtgaactcggacggaagcgagagagaagagaccaggcacaggagttgcgaaggtcgattcaacatgcgccgagaaaagaggcccctctgagcgcgttgcgtcgactctgcaaacaccccactgagaaatcgttgcgttttctagtttggtgttctctgaagaaaagagagaaacgattttcgtcttacgagagggcggcgaagatttctttcgcgcctgtcaccgttccgttgcaaggcggacttcagctctcttttgcgacagtctcacatcgtctcgactgttcttgcagcttcattctcgccgggtcttactcattttaagcccatttttctgcatttcttgtcgggtatagtcctaaaattcacacaacagagacgtttttgagtcgtttaaggctcgtcgtttcctctcttctccctcttcatctcgttttcttcatctcgttctcttcatctcgttctcttcatctcgttctcttcatctcgttctcttcatctcgttctgttcttctctttctgtctcttcttctctgtcttctctctcttcttctctgccttttctttctctctcttgttctctgccctttctttctctcttttcttctgtatccctttttttattcattttcctcgtcctctcctctgtctgctcgattctcttctgcgtcgtttctctcctttccttttctcctctctcccgcacatttgcctccttctcggatttccttgctgcccgctcgtcggcttctttgccaagcagcagcgaagtccgaactccgaga

SEQ ID NO: 672 - DNA, 2426 bp, Toxoplasma gondii
gacggatcaaacggtttcggtccacgggatccttcttattgttttccttggccagtggtgccgtcctctctagtgcagagcgggaggggtcacctgtgttgggcgccacccctggctctgtctttccttcctctttaccattcgtgcccctttcgatgtctgtttcactgaagccataacgcttcgatgaggcggtcttcatctttctttcagtagcatcggtctctgcaagctccaccgcgatacgtctcagctgttgtttaacagaagacgcacgatccatcagtaactcgcgtacgctctggtttcgctgctgaatcgcgcgtgccctcttccttttacgatggcgcatatatagtcgaaacacatcccggagtccgaagactactaccagattaatgagcaaaacgaggcagtgctgcgctataggaagtctgtcgcgtagcgcattcaaggtgctgtcagtctcggccgcaccgggagtggcggcagcggtgctccattccccagaatggacaaacggtagagcgacagtcgtcccatcgtccgctactacataaaggttcacaacgcggtattctggagacactgcattcccctcctgcgccacactgcggtctcttacaggcggaggcgcctgaaaacttcttgaccgaagaatgtcgtgccgcatggcacgcctcaggaccgctccaacgcgggtactcactccagcatccagcgctatcgaacaaaccaggaaaaggaggaacaaaaacatgagcggtccacaatgtgacagcgtttttctatatcgtgatacatacgctgtcccacccgagcatggggtaggcagcctctgtggtgacagctgcatgagaccgcacgtcccatagctgcagccatcacctacaagcgacgacggcttcgtctgcatcatgtttttaacatttataccattcaggcaactcgcgtaaagctacgcagaagctctcgaagtcattggtacggcagtgccgaaacacggttgaaaatgatcgcatcacgccgaacaagagaagcaccaaaaccgagaatgcacgtgtcactctcggccatgatgcttccctcatcgtctgcggattgtgctggtggtgccgctgtcgttgtatcgcagtcgtcgatgcagcggcagagacggggacactggcggtgttagaaccggttactgaaaaagcctttcatgaatatgccaggataagcaaggaatccaggaatcttgtcggcgggtgtacgatcaatagagaacgtaaggtccgcggtggaggagactagcgtgttacgcccactaccactaatgattaccttggagcaaagcaacgacacgttgaaacgctcacggaacgaataaaacattgtttccagatcaattcagtgagatacagcgttaacaattgcacggatgccttcggagccgcatttgaacgaaaaaatcacaacggaatagtcgttcagttgcagtgaatggctgcgcaacgcttcctgcagctcatgcatcccgcatgtattgaacacagtagcaacgctgggtttagaaagagtgctcaagagccaagcgactctactgtccaatacaacggcaagaaatgttacaactgcttgcaagtatgaaaagaactctttcggttcaacgagaggtgacacgatcctcgatagcggtcagcgcgtatcctcctgggaggtggagcttcattccgtaccgatacataccttcgaggaggtggggggcgttgagtgttccatggcgggttgcctagtagatggcgcatttgtaacgcgagcatactctgaagttgcggctgagatggtatttcctagaaaggtagttccatcccgtactgtattttacaacaagtgaacatgtttggtgagagagacatgataacgtcgttagtgatgcgactccgcctctgtaactccaccgaaacgtttcgccgcggcacactttccaaggggccgcaaagccacaccaaggcgtttgccataaatctgggcgacattttgtgtgaggacttcgaccaaccagacatccttcttttttcgtgtttgccccacacactttttagtggacatcagaagcacaaggatcttagcctgagatgagagggattcgagtttcacggggcacgtagagcatgcaacgattatagtgagtggcgtgccagacagaatctgcatccaaccaggccgaattcacatcatgctatcgtctttctactacaatggctccctttccttcattcacccgacacagggctgttaaaacgattgaaagatgaattttgaaagcattttggtcacatgcttttgaatggagatattattgcggtgtcgagcaacacaagacagtccagcaccgactcccggtgcgggaacacagactgttccaagagagtctcgcaaaagaa

SEQ ID NO: 673 - DNA, 3795 bp, Toxoplasma gondii
ctctgagagacaggcaagacgacagaaacctcggagaaagtcagacgccgttcaaaaaacaggcacacagagatccgcatttgggggattcgtcacaggtcttcccacaccagcgcaagctcctcgcagcggcgcaaacgacctgtcacggtgtacatgctcgcgtacgtcgacaggtgtatcagcatgcaacggagacagacacgagcagttggctgtttccttaatagctcgagaaaggaatgaccgagccaaaagcctctctgtcatttacggggaaaaagacttcctttttcggctgtggaaggggggtccacagaaagagcagaccccgtacactacgaatcagaggcctatcctgaaagtgcgttggatgcgaaagcgaaagggggccgtcggtgtgtaagcgagaaacgcgcgttcaacagagttcactaagaaacactgaacagacgtggtgacggccaacatcagcctcaaaatgcggtggagtacgaccaatgcagacgcagtcgagcgaagaggcttccaccgcagaaaatcgggtgcaacgtagaattgtttcgctgcgactgtgcactctggtaattcgccattggacacacacacacagacacgtggactctctgtgctgaacagaagactgttcgtcgaggagccgcacaccgtaatttcgctgtggcctggctgcgggcatttttgccattcctgatatttcactgacgcgccggtgacagagacacaaacgaaccaccggtttcggtctcaggaactgtttttaccaccgcaaaaaatgctggaaaatacctcgtagtgacctcctcgcaagcggtgcgcggcaatacaaaacttgcttacttgttgccacgtcagcagccgccattttcgcaggaaaaacgaaagagtagtccagaaacaagcgcgggtggcttttctaagaaaacgacaaagtgcaggaggtgaaaattccgctccgaaccgtgtgatctcgcactggaggacgggaaaagaaaccggacggggggggagcctgccctgtctgtcaggttccgtacacaccgaggggacgaacaagtgcaaactcgcactggagaaagaaatatggcacaccgcacgcgagtcgggaagaaacttggaaaatacacgtcgatgtgaccggaagtccgctgttcattgccagcggcagtggtagcagaacgggaggcgtttgctcgcgaagagcgtcggctgcatgcatgcatgcaaacggtcaccacgccagcgacagatgcgacggaggaaaccaacacacaaggcagagaggccaaatgcatgcctggagaaaccttcactgcgcttagcacaaccggcgggtgcatctggaagcacagagactcaagcaaccgtggatggaaaagctgccccaacgtcagacagtgcagtggtactcccgtgtgcagagctccaggtttctgacgcgcgactccccggggtgcactgggtgagctgctggaaaaagcctttccacagacacgctcggatgcacgaagcgcctggagcgtgcagttttggggaccagcgtgtgtggtgcggcagaagaagacgacaccattgtttgaatagaagcagacgactcgacggtttctgtcctcgtgtcttgaatacgcggggcgaagtgggtcgctggattgcctttggggatccaaccatccctcggagtgaactgtcgatgacccgattcgatacggaggtgcataaaagctttcaggaaacagcgaaatgcacagggaggtgcctgggacggtaatgggggttcctctcgcttctcttgtgtgtagatactagacacggaatggggtctggagtcggcctgctctgcctggcttcataccgtgtagacggggtacggaaaagggaatccatcccctgttgtggacgcaactatcatatgccttaggtttgaaggatcatcgtaggcacttcggactgtggggagaacacagcctttaatccggtaactaatgagtaatgggtatgagctgaggcaagcctggcaacgatctctcgtccttcgttgttgcttgggggccgcttcagttcttttgcaacacagacaatacgcctctagtgtgcaaggcactttttgacgtcgccgctgacgcgctactgagcggcaagcagcgtggcgtaggcattggtcgagagtgctttccgacgcaatttcaagatcgttgatgacaactatatcgtttcttattccctctcgtgttagtgcttgaaggttgtatatgttgctgcctagattcacgtccacatcgtggaagtgggctcctcccagcttctgtgagcgatgcaccagagccatctcctcttctgctgcaaaaatcacaccattcttcctgttactcgaacacctgaggggtgaccgcgtttttgggtacgaatttcttaggttcatcgagttgtgtatggtacacttccatccacagtggctctaagagaaacacgccgatgggaatcactgagcccattttgcctccccttgaatctcgtccaggctaagtcaggcgtcccggttgaaaccacaaagagaagagaattcgcctccgttgtcgccggctttgtcgagcgctcacttggcacaccatcagcagacaaaagagatcacactaacaagtggtaagattcttttcgcttgctgctattgagttgtttccgtttggatgcgtccttggcgaggcgcacgactgccggggcctgccgcgtgttcctggctagagcaaaagtgctagaaaaagttgctttatcgtgtatgttttgtttttgctcatccgatgccagacgctcatacatctcacacatgtgggcaagaaacggaatgtatcgtctaagttgaattcagacccaacatcggaactaaccgtcacgggactaagcgcataatacggcttcgtacaggacatggtagaaggatgaggtgcatactcttttaaaggaaagaaaaagtactgtcatgcacttttgcatggggtttggcattgacaccccaattaaacttcaactggccttcgctcagagggtctggaggagcgacggaggaaagaggttgcttcgtcggcccagtggagtcccaacagatctcccgagctggctagtcggggtggaaaaagagaggcagtttgtggcgggatcgaggaaaattctcatggtgcggcagactgggacatcattccagtttaaccgtcccccttaatatttcggataactgaagcattagtggcgacggtgtctgccaacttgatgggggatgcatgcactctggagggcaggcgggtacaggacagactcgttcgctttttcgcgagtcgagtttcggtacttgtgaccgggaaaagcacttgagtctctaaagcaccaggatccaatgtttgaccttctgcaaaaaaggtttcctcctctgaagaaagcgtagaaagtgtgccggtaagcttggcacggaaagtccctcggacacagcagcgcgctaagctcgaagcctgctctgcgtggctgaaagcgtgctaactctgcgctgccccacttgtggtcccatgccacagaggaaaccaagaattccctttttgaatatgacggaaggtcgtgtgttcccatgatgctactattcgtgacggaattagtgtaaggaagtccgagcggactcagttcccagctccgtcttccgtatggatcgcccgcgaaaaccgataccagtttaagccagaaacctttatgtggagcagaaagtcaaagggccgaggtaggacgggctggcgcaaa

SEQ ID NO: 674 - DNA, 1960 bp, Toxoplasma gondii
ctgagagcggagaaaagcctgcttgcggaagtgacccacttcacaagccgggttcgtagcaccatgtaggacgcctggagcgcaggaagtggctttgatatgttttttccgccgttaatacgccggatagcaggaattcatatgtggcaactaaaatatacctcatgagaaatggcacattggcgtcttacgatattggaagccatcatgttgaggccaatcaacagtgcctgtttgatgcgttgcattttgtcgccacggctaggttgttctttcgatgagctgtcatgcgatgtccttgtttacttcatccaaattctgttgtgccagcttgttttgagaacactgagaacatctataagtccattctgggcactccttgttttctaccggtgtgctctaaatctaaatccaccgtattattattgttcctctcaaacaatcttcaggacttgtgaattaaacaacacagtaaccctaagaaaagccagaatggactatctcaaaccttcatcctgctgctacctctctaactgcatgttgaacgcttgcagatgcataaggtgcttctcaaatagatctgaatgctagattgatcttatggaatgcacacatcaatgaaactaaccagtgaaaactgtaggatgaattaaggcgctggcgccagttcagagtcccagacagacgtccatttgaaggcagatcgagaaacggttgtcgtaaggggttgttctgaaagcactttgagaatgaacgaatcctgaaacaagtgaaggacgttcgggaaggagcgaaggtatgccctcggctggttccgagttgtcttgtcgatgctcacagacaaagcgttcctgtaactcctcattctcagacattcgtcagccgtagatccaaacccgcgcaagctggcaatgattctacgaggcagctcctgacaccgaagtcgagagcaggggcgaggtctctttgccaagctgttttgctttctgttgattatgggttctgccctccggaactcaactgaaacgacttacgacgtgcgggttgaaggagcagctcgacttccacaccgtagctcctacacagagaaccgaatatccggttgccttatttacacccgaacacaaatcgttctttcaaattccgacagcgcgatgaaattccccgttctccctgagtgtttcaaatgctctttttcttgagaggcgcggtatgcgcggatgccccggcactttctgctgtgcctgcgtgcatgcactcattgggggccgccctccaaaaatcgggctttctcgaaccatactgcaaggtgtcgccagagcattagaccgcattcactttcgaagggtttctcgagacgaattctgggcctgggcatgcaggagtacgtgtgtagttctcatagaccttttttcgtggaaatctggtgaccttcgtagtcgtcgcgagcaagcccgtgagcactgactcccctgctgttccatagtcggcgttcgatctcgaagattccagcgcaggtcttctgtaaaacagcagtcgtcacttcttcttgttgccgtcggcaagctgatgcatcgtacactttcacggagaaattctgaaccctttctgttccagagtaaatacgggattcgtgctaggtcccttgagccaccgaggcaaacgtggccgcgggacctttccccttaacacgggaaatcagcgggagcgcgtttcaggaaatcccttgtgtctgttcccttttctcccgacacgccccccgcatgcacacgccgaatgaattgttggtcaaaacgtggagtctgtccgttgtcgaggcaacggttctgcctgccagagacgccgtacagtgctgtttctccatcggtccctgtgtaaatgcttggtttctttgtcttcagaaaggtcttttagacttcgcatttctggagctcttcgacttcttgtccaggaccgaaaa

SEQ ID NO: 675 - DNA, 1896 bp, Toxoplasma gondii
aaaagctaacggaggaaaacgggaaataacgtagcaaaaatggtcgtgcggcctcggcgatatttgtgcgttcccgacctctcttctctgatgttgtcccactttctgtcgagtgtgtttaggtggcattttctggagctcttgtacagtttggccttgtttcgtgaaatccttgacagaagccacagggatagcgtaccgttgctccgagaggagaagttggtttttatattcagtggttgcttcgctgttttacattccctccaggactggtggcagcctgagggtgcgcactttggttcaactgcttgcttgaatgagagcgcgaaaaacgcattctggaagcaatttcaagctgtaaacaagacccttccgctatttggaggaaagtctttgcgaacgcgattgcagaaaaatacacacatcgacaattcacgcttcatagggtacagtcaaacctggttggtgccaggatcgtggcaacacaggcgttggaagctgactgcattgattaaaaaatagaacaaaacagagctttcaggcgatggtcttattcgaggcttggcatacgcagttccagctctgtccacgaaaatgctcaatctggcgggctggtcattcaacaggcgaaagaaaacgtcgcaaagtggtgggagttgtcctccagctgagtgacacgtgacgctgcatccatgacagaagggaagtcgagcgtccggagtccaagcgccgtctgcttcaacaaaactctggggagtgcgttgtgtgtgacccgtgaactgtttcgctttagaaaagaaacctcagcttcacaagccgtgctgtctcgtagctacccagagaaatgggggattcagaaccgtcaggcgttccgaatgtctgtgctttaagaaagtgagaagcaagaggccgccgtgaaaatcggacggtcttggaggttcaagaagtccttccaatgcggcggatgtggctggtgggagcaaacccaagcaggcatccagaacagagactgttcgatatatattctagaaggggatatgacagagatcacccttacccgtttccgctctgtttctacggctagtaaggaacacggtgtgctgtttgtttcgtctataaaagaagagttcgacgacccccagagagtgcgctctacggcaccttgtccaacctacaccaccaccgaagccagaacaggaaaactctttatagtaagcacacaatggtgggggcttaaggaaaataaatatcgcaaacgctgattgggcatcatgcgctgcagatgtagtccctagttcgactccaggctggaccgagttcttctgtttccaaataagtaaccctggtcaacgctggttgttcagggtgaactgaacattccgtcaagaaccttcccgcctgatggtctgtccgttcctttctcgccctcacaccgaggagcaaagctcgtatcccaactgttagtcaaggactgttttctgaccccgcaaagaatgtgcatttcgcgtgttcgctgtattcgtctgcaccactgccgctttcctgcataaggagatgccaggaaaaacggggcgtgtgccaagaaaaaggagcttctgcatgcaaagaaatttacgacgggctggcggctgcaagcgactgagttgcaccgcggcttgcttgttgggcatgtgcggctatgtgcaaaaagagtttgcggcaaatacgggacttttcgaaattgatttcgactgagtttctttgcgtcttcaaaagcaaagggtcgggcggcgactccttggactcccgtctccagactttccaggcccatcgagaaaggcgtgttttcgagcaataaccgacccagacctccttttgcttcttggcgttaccccagtttcgtttcacctgaatgta

SEQ ID NO: 676 - DNA, 3346 bp, Toxoplasma gondii
attcaaagagagagaggcgaaagtgatcgatagacgtttccgttcccaccccaaaaagacctcgccatcaagcgcgcgcgtacgtacaccccaacgtcttgcagacatacggaggaccagcggcacagcagcagcgaaacagccttcccgtttctctctctctttgtctcaaaatagagggagagaaggccagcatgcgtgtatagatgctcacatccatgcacacatttgtggctgaagatttctgcccatcctggttttgctctgttcttcgcgttctgttttccactgtgtttgtgtcttgctcgtttcgttccttcctgcgtctctcccgccttaaaactctgccctttctcctgcaggttttcgcttgcctaccttcccagcggtctcgtagatcgacccaccggagcgtcgagcgccgccgggccgcgcggaggccggagcagcctttgtcagctgtggcgacattttttccagccgaacgtcggacagcggcgctgggagaaacgccggagagggcacaaacgcgagctgcttgaggcttgagaagagagagaacgcgacggagcacacacgaaggcaggcagttctcagaacctacgctgaggagcggaaaagaccggcgaagcgagcagagaagccgacgagaaagagaagaggagctcaacaggagggaagaaggcgcgagtcagggggaccggacggcgcctttgtgcgaagatccgtcgcagacgagtcgacgaagatacacagtcgctcgacacccttcttcgacaaaggcgagggacagtgaagaatggcctccagtttttcgttaaaaaagaacgagagggcaaaacggaagaacgggggggggggggggggaaccggaagggcggccaaagcagtcttcgacagaggtcggtgcgttaccagagttcgagtgtgcagtccaccctgcttccctccatttctccttcgccgttacttgtgattcctcgttggtgtctctctttctctcgctaggaagagagacatccgctcgcgttctcagcgcctctgctcgcgtcgctctttaaccagttgtaacgctacagagagagagacgcacacacacatacacacagagacagagagacagaagcgctctcggagcgcaatctgcgaacagaaacttgtccgagagcgacagtgcggaggcagcagtggcgagaagaggcgaagaaaggcgaacgagaagaaaggcgaacgagaagaaaggagagagagagagaagggagaccagagctcgaagggggatccaagttgcatgcgcgagattcctttggcctccttccgagagggggtcggcgcggtgtgcagagcctccgtcgaggagagaaacaccagagaggaaaggagagaaaaaacgagaaggaatgagaacagagaacatgtaaggaaaaactcaaagggggacaagcacaccgcaagactcaagcaggaaacgtcacagaaagatggtgacgagactggacaacggctggcgaattcgacgcgcgcgacccccccccccgacggaaaagacaaccgcgagacaagcggcatgtctcttcaagaaatggctgcctctttttcgcgaatgcttcgttttttcaaagagcgttcacaccttccatcaccttctctcgaggtccacttggaaagagaaaaagagagacagagagaacacagcagaacaagaaagagaggagaaaagagaaaacgggagagaaagggggaaacgcctgtattttttcctcaggattcaaccggaaattctggaaggaattcgagctttttcttgcgtcgacgcaagcgaacatcgcgctgcaaaagccgtcacttctcccgctctccctcactgcatcttttccttctcttccttttttccatctctctctcttgctctgtgtatcttcctcccttgctgtgtttcttttctcggcttctgcttccccagtctccatgctggtctccctcagggtcgaccggccggaagacacagcaaaaacagaaagtatcaaaaagatgtacagacatatttaagggattagacgcgtacacttcacttttcgacgcatgaatacagcctcgttctcaaccttagtcgacatgtatttatatatctgcatctttatatagagatttaaacatgtcagcatctgtgcggccagtggttcggcatgcagactacccaggtcacaaaatatgtagatataaacatgtcagcatctgtgcggccagtagttcggcatgcaggctccccaggtcacaaaatatgtggatttaaacatgtcagcatctgtccggccagtagttcggcatgcaggctccccaggtcaggaaaaatgtagatttaaacatgtcagcatctgtgcggccagtagttcggcatgcagactccccaggtcaggaaaaatgtagatataaacatgtcagcatctgtgcggccagtagttcggcatgcagactccccaggtcacaaaatatgtggatttaaacatgtcagcatctgtccggccagtagttcggcatgcaggctccccaggtcaggaaaaatgtagatttaaacatgtcagcatctgtgcggccagtagttcggcatgcagactccccaggtcaggaaaaatgtagatataaacatgtcagcatctgtgcggccagtagttcggcatgcagactccccaggtcacaaaatatgtagatataaacatgtcagcttctgtgcggccagtggttcggcatgcagactccccaggtcacaaaatacgtagatataaacatgtcagcatctgtgcggccagtggttcggcatgcagactacccaggtcacaaaatatgtagatataaacatgtcagcatctgtgcggccagtggttcggcatgcagactccccaggtcacaaaatatgtagatataaacatgtcagcatctgtgcggccagtagttcggcatgcagactccccaggtcacaaaatttgtggatttaaacatgtcagcttctgtgcggccagtggttcggcatgcagactccccaggtcacaaaatatgtagatataaacatgtcagcttctgtgcggccagtggttcggcatgcagactccccaggtcacaaaatatgtagatataaacatgtcagcttctgtgcggccagtggttcggcatgcagactccccaggtcacaaaatacgtagatataaacatgtcagcatctgtgcggccagtagttcggcatgcagactccccaggtcacaaaatttgtggatttaaacatgtcagcatctgtgcggccagtagttcggcatgcagactccccaggtcacaaaatttgtggatttaaaca

SEQ ID NO: 677 - DNA, 2498 bp, Toxoplasma gondii
ggggcaaaaccgtgttgtgtacacgcacgattttgtatgttgttgcgttctggagggggaggggtgaggaacatgagcgtggaacgctgcctcccccatccactttttcacggcagcatactctccaaacactcttgccgtttaccaagtgtctgacagacgtttccgaaaaaatcttcaggttgtgtgcgtcactggtctctggtcatgtcggcactggagagcgagagcaaaggcaaaagaccgcaggactcagtgtttccttattgtccactgtttctcgttgtacacagtgtgtcacaacgtgtaccgcatggcgtttctgcgtgcaaacactttttctcaagcaagagcactttatcgtgtcgtttccgtcaaagcccgttggtcctcaaggtggtgtctgctgcagcctgtctgcgatgtctttctcctttttaatcaatgccccgatccacgcctggcgagaccggcaccggaaagttacgggagaatcagagcagcaaaaggctcgcgttcacctgcaacgggattgccaagcttacagaactcgctgcgctttcggggggaagaacgctgtcgaacgacacacgctcaaccgaccggttttgccgatgagaccatggaagtattcttagagcgatgcgaccacatggtttagctatgatcttcatgtcaccacattatacgtagataggtcgtgtctttgcacaaatgatccgagaccccaaactgacctgactgaagaatcccagcgcagcgccaacagatgaaacagaggggcagagtgtaggaagatgaaacttcacgatacttgcaaatgctgtcggtgtgtcgtttgtcaagaaacgattcaccaaaaaaagatgcttgcttttgggtgcgaatgctgttctaatgtcggatatacaggaaaacaaaaggctgcacacacgtctacgtgcactgtagggggaaatatacttcgcagagcggcagaaaaaaaagaatggcaattgcaaagatgcattatattgtgtcattgccacacgacagggaaaagggacgttcatgaagattgtgtaacagtaaagaagccatctaaaagtgaaaatccggtttttcacgccccctattattacatcaccacccgaagattgatcgtgcgtcaggcgagaagttcttcagagaaaacgtctccgtcgtcggccggcctctgagtgctgagaccagacgagatatcagctttcatatcttcgtcgagtggatggacctacatattgagtttcagacaaaacaccgatttcgctccctttttctccttcttttttccacttttctgacgggacaggcaggaaggtatgagcgggtctgacattatcttctgctctttggtcgatgagaggcgtgtctgccttgagtgcattgcatgatctacacgcgtttcattgcggaggaagcccccacgtatatatttcgcccttccgattaccgcggtagggaggtcagagcggttctcttttctcatttcaagaaatatcgcttaagtcaatggaggcatgactacgtgggcaaccacatctcgttcccttcagacgaacagtacttgcttggacacctgcctttcgattcccgatatatagcaccaaatgaaaattactgcaaagaactcgttgatatactgttagaagttcttttactcagcttgtgattgccttttgtaagacagtcaatagccttggtataaagcggagagtggagaaaccgcaaagtttctggactcgtcgaattagtttcatgttcagccaacgcatttcctgactcgctccgagttgcttaccccgaaaggttttagaaatgaagcgttaatgtcgtcttctaggtttttgttaagcggcaggataggaatttctgacaacgtttttgtgccagagacgtcttgtgtaatgggagttccctgtggctcctcggaaacaaggtccttttctgtttcgcgagtgccaaaactggccttttggaagagttcttctacgaagcttttagctactacagtcagtagatccactgcttccgtagacgagttttcttcggccttactcgagggcatttcttgatggttttgaagcgtgtctttttcgcaacttgactcctctgactgcggagggtaatcagagttttcctgtctcgttccttttcctggagttccattctctacatcctgtgaagattgttttgccacgtcggtaaaacactcgtctccctccccggtggacgggtcaccaaacccacggtttgattccgatgcaggttcggtcttttcttcggatgttttcctgttagaacgttttgcgtcccctgcttctgcaggtttgtcgggggttttcgatggctgtacgcaaacgtgcagggtctctggaggatcagccgaccccgctcgctgtggttgtttccgatgaagaaaaggcatgcaacaaactaggcaactgagacgttttttacctccatacgcgggctcgaga

SEQ ID NO: 678 - DNA, 2457 bp, Toxoplasma gondii
cgtttgctcttcactccagacactcggagctcctgttgtccgtcgcctctcagtctcgaggcctgcgcccccatcgctcgcgcgtttttcgcaggctgcgtggacgcagccagcggcagaagcttcacattttcaggtcgcttctcgaacctgccagctggcaagtcgttgcatgcagccgcgccgagctgggatcgacacgcagccgcctgcttgccgcgcagcagagggggagaagaagacctgaggagttccgcttcgtcagtctccaagagctcaaaggcagaagcactctgcgcggaacccatagcgccagcaacgaaggagaccgagtttcgagagaaaacgcagaacggccaagcaacgaggagcgaagacgcaggaagaaggaacagtggagcacaggtcaagacgacgacacaaagtggaggggacgacagaggagactgtgaagaagaggcacgaagaagaaacagtggggaagcgaagacgaagaaacaatggagacagagaggcaagtgactgcgcaaagaagttgcacgacgctacagaagggagcagcagcttggagggaaatcgattgcaggcgcagcagacgccgacgaggctactgtcaagggggcggaggacaaggaaggaggtcagcgcgtcgaggacgccaatgcgagtctcgcgatatttttgcttccaggaaaaaggaccaagaagaaaaaagaaaaagaaaagaaaagggagacgggagaaaaacctgcccccgaagaggctgtcggagtcatccccaaggaaaagaaacgaaagagaaaaagagaagacagcgataaaaacgtccttcctgtcgtctggacaccgcctcccctccccccggtgtccctctcctcccctttaccctcctcctctttctcaatgctgttccacttttggtacagaaggattttctggatcttgcgccatccgaggcttcttccccatctactggccaacaaggagaaaagcggaggccgccccgctagggactggagctcgccgacaccagaaggaccttcggagaatcctcgctgggagtgaagaagagaggtgaaaacaagacgcgggagtccaaaatgtaggagaaacgtgtacagattggacagaggttagtcacgactcgagaggttcgcttggcagaagcagagagacgaagaactcggcggaagacgagtatctgggagaagctcactcccgcgtctctgacacactgctaccatatctgtctccgtgatgaagaacagaagagccaacgaagcaaacggttctttgttcatgaatgcgcaagctgcactggacgcaaagcagcatttcgagcgcgagtgggaaagccagcagcttcagccttgtcgcagcggaacttgtaacgagtccatcctgcacaggcaccttttgtctcgcgagagaggaaaaattcaagcgaagccttcggagctgggaaagacgtgagaggaaaaaaaagggctatcgtggcaaaaaagagaaaacgcgagaggcgtcagaaagccggaacgcgcatatctttgagtggcgctcccctcccttccgcattgaaatttcaacatcgaggaagcgcattcaacagcaccacacacagacgaaaagcgtcgaaacgaaaagcgagagaaaaccttcttttctcccgcgctagacctgaggaatgcgtacaaaaaaagcgcgcgggtgtttttttggctgacgacgatttctgatcggtcggatactcgaagagacaacgtcactggactctgtgccacagcgcgatgagttttctttctcgaatatgtggacgcgttccccctcgatctgcccggcacctcctccaagccgactgccagagaagtgtgtttcctcaaagcaagtggattttagagaaaaagagacgaaaaacgcacagaaaaacccgagccggcacttagatggcgctgcggtttgcgcaagactagcttcttcggcatttgccagtctccatgcagcggcaaaccgggtcgacgcgtgcaagaaacgggaacaagacttgctttcagatttgcaatgacgaaacgctgaattctcgttggcttacgcggaacacgcagccgcaacgtcaacaaagaaatccacgtttcgtcagactctgcagcttgcggtgagcagtcccgtgcatcgacaaaacgaggatcgacgcgaaaaaacggcggtggcagaaagcacagaagcgtgatcagctcccactgaatgacgaggagtcttttgccgccaacaagcaaggtgcaaaccggagaaaaagcaaagttttcggtgttcaaaagaaacggagtgacaaagctccctgcgagccacgggcgcagtgtacagacacccgaggcgattattgttgaacccgcgcgaaaagtgtggagcgcagtttgggaagacttcggacggtagcaaacgatcgtttgtctcgtggaa

SEQ ID NO: 679 - DNA, 3590 bp, Toxoplasma gondii
ggagcctgagcaggtccgcaagagtagtaaccataggacagatcttgagcaccgttgacagaagaggagctggtcgcgtcgcctccaaagagggcactctgctcttctgcatccccaactgtgtaggtgtatgtgtggctcccggggacgccgtggcctgtcaccccttggggcttctctacatccactgggagcctcggtgccgagacagagccactccacgggccttgtgaagcgcacatcgagtcagtcctatcctgttgcggacctgaagacgctgcaccagtcaacgtccccccaggcgcttgcggcgcggtagcggcgccggccactgtgctgcgttcggtcacatcttcacccgtctgctccgttccttgtgtttgggtgggtcgctgctcttgaggcgagacgcagtcgacgaagatctgctggcggatagcttgtctgtgagccaaaacgtctttcgacgacgaggtccgatccaccatgctgtttgtctgcgatatcacatctgcatgcgttccgtacgcactcacatgagagcccgaccgaaagatcggccctccctgagagagaactggtggggaagtctcgttgctcggcaagccgtaataactgcgtgacgagggatactgctccttttgagaggcgccggtagctgcgccgaggttgggcaccgaagccacaggcggcaaagacagcgcctgctggagctgcggatctctctgagcatagctgagtgacgtagtcgccagctcgggaagtggaattccagagccggaggcggctctggatctggtgccagatagcgtggaggacgcagccgttcccgctacgctatagagacgagctccaggaactccttcttcaggcatcggagtcgacgcctgtgaacctgtgagcgccgtgtgctttgtcgagtgctcagcttggtacatgtgcacagtcttgaaattacctgggcatgtaacgcacatatttcagatgaaatcgattattctccgcgacaccctgatcgggtgaccagagagagtgctgttgcttcaacatgcgttcgcagtgtcctaccgagatgcggttctgttcaagacgctttctctacttgcctgtgctcgaagacgacacgctggccgcgtccttgctttgggtgcccggcattacgtagcgatactcgtcatgcaggctgaggccagagaagaaagattcttggccactggcatctgcagctgtgcttgacgacgttgtcggtgcatggtggtagtacgactgctgggctgatgctgaggcggcgacgcgcttgttcggtgtcacctcgtacatggaagaggccgccattccacgatggtggctcgtcatgttgccgggggaaaagatacacgcagctgatgtgcgtgcagcacgacactcgggtcgatggaggcgagaaaccagaggaattcttggacaagacactggaaaatccaacacagacacctgttagatcgcagccaaaacgaggcaagagacggagagagggcagggtctgatgctcgtagaaacgactccggcaccagtgcgaagaaaagcggttgaagaacaactgtactgccgtcctcttcagccaaactaacgaattcagtgaacacagatgagaaaacaacctacgcctttgtcactgaataccctcagagcaggcgcgaggcagactggcgggtttgccgtcgcctgttgacggccggacacagccacacagtgacagatactggcaaaacgcgggttttcgtcgaaactcctgaactgcacacagtccagttcaatcacctcccttcctcggcgaaacacgcgctgagtagttgctcaattgtccttcggggagcctttcctggaagatgcagaaccgggatttgcgtggagcggtgtgcgtcttgcaactttggactttccacgttggcgcgacagcagaacaaccctggggtgtcaactatgtcaggaaagggaagcagacacgaaaaggcttcgtgggcaattattttgcgtccgaatatccggcgaaatcgacaggcaaaaattcagagctggaaaggcgtagaatttggcgaagtgtgcaagacacacgacccgccaaaagaagcgactgaaacgcgctcaaagctcgcgaactcgctagccacgtttcaacgtggatgatgcgcgttttcgcacatctcgtcccactctttgtcagacactgaacgcgtgcctcaggcggggccaaccgtccattcccgtgttccacgtgtgtgtggcgtttgaacgaaaaggcgtctttcacgcgcaagtcacaaggtgcttctgctggggctttgagacgggaaaaggaaaggctgtattcccgttacgcttggaagaacggggtgctacaaagggagcgttcgtctcgacaggttctgcgtctctgcgctcccctaacggcaaaacgtctcggcttatattcggagctaacggaccatcgcattcaagacacactttctcggctttgtcccgctcataactgcttgtgtcactacattttcacgatattccgtcggctggataacagagaaagaactaacctaccagttatttagggtttttcctgctttatccaaagttttcgaagcgagtcgtctgcagaagagcccccttgtcttgtagttcgccagacctgtgttgtgcccacgacctcttcagagccgtgagtagcctgcgactgccaggcagctactctgttcctcgcgctccgaatcggggcaaaacggacaggagaacccccataaagttttttttgcgctcaaaacgccttactgttttttctgcggagtctccaactcgcgagttgcattcagggcagtcctcgtgacactccccttacagatcgtcatgttctttggatctttgcgaatgtcttgtcgatgcattttctggtcttgaagcgaccagctggcatttccggtctaaaatctgcaagtctttctctgcctttttctgctgctccgatatcagattcttgtgtttggggtcaggcatgcgcttgcagacacaatccatccttttaacaacggagacgtggccgaaagaagccgtcttggcgctaagtgacggcttccgagttttaaagcttccataaatttccttgttcttcgtgccgatccgatgcacaggcccatatgtgacatcccggtgcccttgcccccactgtcttacatcgtgcgccgtggttcggggtttgaagatcttctctttctactgcacataccgatgcgttctggcaggtagctacgcgtgttggtccggctagatgggcatgtccgtatgctgccctagttgtgtttgtttcccagcttccgaagattgtggattcaactgaggtaacgcgcgggctgtatgagacattattcagcgccctcaagctttcttctgtctgaccgctttggatcttttttcccggcgcctcgcacggtgcgtttcccagcactctcccagccgaaaagatatatgcgcgacgttccttcttctgtgtctctgtttgtccgtgtcttcaacttctctccgatcctccaaagcctgtgtatctctccacgggtccgtcgaca

SEQ ID NO: 680 - DNA, 1921 bp, Toxoplasma gondii
gcgcaaaagctgcgaagtaaaattggacgggaacggttgcatgactacggcagtagacgcacaaacactggaaacgtcatgtattcttcctgtcttcatctatatctcctgcgctcgtataactgccacggtgagaagctctccatctccaatccaccgcgtgacgttccagctagatcagcaagtaggttatccttttcattatttgttcagagaaacatctgaaaccgggtagatgttcgaaacagtgctgcgtaaccaatcactggccccgtgaacgcaacaaaaacccatgtccccacaaaggtgataccggtgcacgggcaatactcatctcggtagcagcgtaacgcactacctcctcaccgcactttagctgcttttgcacgtgtttgttgcgtaactccactgtggactaccatagttcgtagtctgttggcgtacggcattccccatacggagtatctctacaactatgatagtcctgtcactttcgagttgtgttaacagtcgatccctaattgtcaagaggtcccataaaagcgtgcttcccgcaccaccaacactcgaagcattggtcactactgcatcgacatactagagctgcgtactaatataaattgactcttcctccactctgcatcgttccaccaccaatggtcaggtatcaataaaaacgtacgtgttggatggcggatcgaagctgatcaggtcgttgtacatggtgtcagactgtctgcctccccaaatgtagatcgtatcttcaagttggacaacaacatgttcggtcctggctgtaaaaactttgccatcgtggacaatgctgctgaaaaagaaatcaggaggtgaaagtatgcctgatgcggagtctccatagactagttttgacgattcactcctcgctgattctttcttcgagctggcctgatctgccttggtgtctgcaggctgttttgtgtcggcctttttctcaaccgccttagttgcttcagccttcttctcaaccgccttcgttgcttcagccttctttggttcctctttggttgattcagccttcttcggttcctcgttagttgcttcagccttctttgactcctctttcggagcggctttgtcagatgtctctatgttcttatcggctgaatctgacttgccggcgtccggctcatcagcggttttactcgccttcccaaggccaaaaagtgaccgcttcgcactctttttcttttgtttcgctccctcatcttcagtccaagatccatccgaatcgcccttgctgaaagcagattcagaaaaatccgagatatccgacatggtctccaatcaaaatccgcaatagccttccggcaaaaacccgatcgcgacagggtaaagccaccacacacatggcagctgccccgacagactggctaactcagctgcccgcaagaagaacaaagcatcaacgagagaaaaaggataattagcgtgctctcccgagatcgtttgtatgtggttgcggacccacagcggaaggatgggcacggttggttgtatcggggctgggaggcaaaaaccgacactcccgatagcgacgatacctacatttgccactacaaacaagcgtcgttgacctcgcgagacggaaaagcccgagacgaacgaaagaacaattaccctccagtttcccactgaatttcgggattgaggcgaagaaaaaaacagaacttccctgacacttcggcctcaccggcacgcaacatgcccgtgaagttggaaagctccaaaaagacagagtgtggcctcacgtcaaagacaaagagaaattagacacattaaaagcctcaaggtgatcgcaaaaagtgtggagtcctgtcgcctagaaagtgtcgatacgagacccgtctgcgtgagggccaacagctagtagcacatcgggaaa

SEQ ID NO: 681 - DNA, 3480 bp, Toxoplasma gondii
gaattcttgtttaaactctacccgttcattctcatgtcatgcatgcaatgaatctctgttgcttcttttggggcttctgggaatctctgacgttcaccaagctccgggcttggtaacgaaactcattctcggtttgcgttcggcactcgcggtgcatgcaagagaaatgaatcccttcgattggaacgtgcatgcagttcggactttttttcacctcatacaacagaaaccttttggcaaagaaaaggaggcatcctcactcgacgaaatcggttacacagttccgtggtggaggcctcgagagaaggtcttgaaagagaatgcccttcaaaaatctttcgcagtaacggcatgtgaagagtcgaaccaacttccacaaatgaccctgattatgcggcacgaatgtgtatctcttgggactgtcataatacacctttttacatgctactaaagggacagtgcacggattatatactttaactctaccgaggtatgagcagcctctagtggtgtacagcagacgctgtctctgttccactacctattcgtaacgtgatgttccagctgtgactgtcaaaaaagacacggtagaccttcggtccggtggacagagatcttcaggcttgaaccaggagtgcaacttatagtacaaaagccgcagcaaacggaagttaagcgacgcgtaagaatttctttcataaaatatgacacggggtccagcttcggttgttatctgattggtaagcatgccctgagaaggtaatgataaaggaatgctaacagcacagggtcaaaacgtctcggacgctcctgcaacattctattaacgtgtaggccactcctttcatgtggcgtccggcttgattccggatggtgatgaaaaccgatgacttcttttcctggagagaaaccctttctcagttcagcgcccagacgattccagaccaacgcagccgtatcagtggataggtgtgcgacactcttggagttgtgaaaaagcagaagggttctctagatcgatgtcacgcattttacgcagctcatcaagactacccgtgtttctgtaacagtgcatctctcgacgacagcgccgttctttctcgaagagaagaactggtgcggggacgtctaaacacgggactggaggttccccggggaaacagctgctttcttgaagaaaatccaatcctagtatcagcttcgccgctacgtatatgtttttacggtggaaaactgcagcctgaggaggtgtgcatggcaggagaaaaatccggaaagagagagaggaaatgaagagttctcctaggccacttgtatctttttcgcttcccctctcctggatacatgttccctgtatctgttcagatcactgcgtacttgttacgtaccgcccgaggctcacttgtcatcttttgatgacaccttcctaaggaaggatacatgtgcctggttggtgagtttctttgcggagagggaggaaggctagacaaaaaggagaaagacgtttccgatgctattattttcctggcttcctcgggggaaacgcgagatgcgtgaacctcagacgagaggcaaagaagagagtggaacggcagagatcgattacaagcagaccagcaaacacagggagaaagaaccaagctgatggggaacaaggtcgcgagtcagaaagaacgaatcctggagccgtttgacttcctacattactccacttctacgtgactgtcttcaaagaagtgcgcgccagacgtctggtctgtgactagaacctgttgtgtcttcagttcgtacaaaacatacccaaccaccctgatctcggtgacacagtcacaaacagtgtagaaacttgagacgggaaaaccctccagaacatttgttgtttcttttgcgcggcgtgtacaccgtgagatcgacccctggtttcgatcttgaaaatctctgtttaccggacccaagctctcttgagttggagttactgcatgattgctctcctgtgttgctcgccgtcagaacaacagaaactcttcaaaagcggtggcttgttggtatttagggaaactttgctgatctaggaggcaccgggttcacgtttcacgtgtgcagggggttgagatcccgctgattttaggtggagtttctttcaacacggataacttttctgaatcgcgtggagcttgccaaacgtgtttgtgtgcgtgaactttgttgttttccctgtgtttcccgtttagttgtaaaggaacatcagaaaagctcaggaatcggcaagaagactcgcaccgcttgcttgcctgcaggattccgacactttcgttaaaaggcagaaggaaagaggtaatatccagaagtctttacacaaaaagtgtgtttttttctcagcgttcttcttgtctttcccaggagaacgtcccgcaagttttctgacatagagtgaggattcagaaacatcaactttttcgatctgattgtggagtgtgtgcaaatttgtcttcagttctcggttttgatgccgcgagtggtcggacgagaacatcaggcgaaaacccccgaaaagacccagacagtttacgcggcagctaggagggcctctgtgcgctactctgcgttttctgatctgtctgctactttttctccctttgctttcgagcatcttttcacgagtttgtgtgctgttcacgcgcgttttcttttcctttctcttctcatgttttcggggtccccgaaggtttcctttccgccaacacttccgtctccctgccttcctgtctctgcctttctcttcctttctcgctcgcgctgtttttccttctgaggagaacctttctcttcaccgtcttgcgcgtcgccccttcgtctcttcggttttcttgctgtgtatttgcgttaagggaaaggttctcgactgtaactcgcctttcttgctgctcggttgcccttcttcccgtgcgtgtgtgtcttttggtgtcttcgcctcccttcttttctttttccgcttcgacgcctcttccgtgcttttcaccggactcgcccaaaaccggcgacccctcttcagagacattccggagtttccctgtgttttctgtctcggaacctctcccagtcttcttcttcctccccgcctcaggtgtcgctctttcccccttcactcgcgctgtccgttcctcttggctgctttcctccctcgacttctcttccctctctgggttgcgtcttctttccggtgttcacaacacacacagacgcccggagaccgagcaaagaggcctttcggacagcctggactttgaacgctgagagaaaacgaggaagacgcgcagcagacgacgcagaacttggtggctggggaactgcgcttccgctgaaagtgtcggaattcgactcgccaagcaccggccagcgtctctgcgtcatccgaattcaagactcgacgggccaagcaaaagacaacagaagggagagcacagttctctgcaagcaaaa

SEQ ID NO: 682 - DNA, 4846 bp, Toxoplasma gondii
gggaattagaggatatgtggctcgcgacaggaacttgaataggttctggagcttcctggttcccagatccagggtgggaacccccagtggacgcaaaggtcgatctggcagcatgcagacggccagttggcagcgtcgcggaactggaagccgagagccgggaacctaccccgtcggcagggctgttttccgcgagtccagtgcgttcttgcgcttccggattcggccgtatttgcaagccgttctggacaggcgctccgggtgacttctgcggacgaaacggaggagcttttcccacgatctgcggtgttccggcattcctcgctggatccgcgaggcggcaggcgggcggcgtcgcttgctggccgacctgcgcgtcagctgccccgcatgcagcgcttggagacaacagaggctcgcggagagcgcgtccattgttttccccgctctccggagcccccgaagacgaaatcagctggggaggaggaacaaagggaacgtcggagcgagactgcacgcccgcaagcgccacggagaggccagacttcgacatggagacgccgtgagacagagtgcctccgcctagcgaattagacgaggaattgcggagtggggcaccagggacaggagaagcgtcaatgccttggaagccatgtgcagagggattgccggtcggcggtcccgcgactttgggcgagactgccgagggacgcacggcgtcggagagaacctgaggtcggagagggacctgggcgcgagctgaaaggtggagcggcggatccgccatgtctcggaacctaaaatgctggagaaaacatgtacgaccgtcgagggtcgacgtcaatgcgggtccgccaggagcggccgcagacggcgggtacctacacggggatccgcagaacgcgggaaaggcgggcggaaagcataaatgcacttcgtcgcggggcaggtcggaataaggacgggagaaagggaatcatacgggagcgttgcggtggaaaggtcgcggcgcgcgtgcgttttcccgagccgctagtcgcgcggaaggcaagacgacggggaagggaaggcagcaaccgcagatatcggcaaagcaaacaaaaagtcgaacgattcaacttgagttctgtggaagttggctgcaaaaaaactcgggttccctgtcgagcacaagcgcagcgaaaagttttgcggaaatgcccgccaaggcatgcgcagccggagtccgggacacatgcacatacttcttttcgggggtgccgacttcgagtttgcgtcctcggagaggaagccaagacaaggaggcgtaaattggattcctcacacatttgcatttcacagacacaacacgcagaatggtggttgccatgtttttcttcagggaccaagtgaccagacgcagtggagcaaactccaggttcgtgcgcagacactaccgcgctagaggagggcaagtctacaacatctgtgcgtggagtctgccttgaaaaactggcgcgcgaaaactctttggaaggcgcttcctcgcgcatgaaaaagattcaggctgtgtggcctttctaccacccgcaaagtctagatgccagcccgcaaacacgcatcacaagctacacagtaaactttcactacaagccggggggttgctcgtgttcgtcggaagaaagttcccagaaaactggccgtgggcattcgatgctcaagtgcgagagttaccttgcaaaagttgtccagatctgttcaaatgtagagtacgacgaagtgacgcccacaggggaaatattgaaactgcagatgggaaataagagacactcaccatcgcttcgagttacaagcaggagcagagcttttcggattaccgataatcgcgagaaatccgtccttccgtttctctagtccgtagttgcctcttcgaaaggcgacttccacctggagcgaagaagtctctgggcatacaaatttacagaggattcttgagggctccgggaagtccatgaattcgcagtatacaaacgtacctgccattgcgagcgtcttttccccgggtgccgttgcttcgaccctggaggcgccatactgtgaatttcagaggcaagttctgttgttctggcaacttaaaaatgccaggcagatttcctgtcactgggtgacacctacgcgattggtatcctgcctttacaggaggtgctcttgttcgtatcgcccacgctgtttgcttgagcccaaaaaagtggttttccacgagttgcaagcatccgtcactgattcgttaactgaattctcaggtggcacagccgttcatttcatatagaaagggcccagagactcgcacacccacaacggggtgctattcgtcggatttcgcgtcgatcgtttttttttctcgaggaaggtcaaacagatcaccagtttcacggtatctgccgatgttttttacaagggatccgaagcatcccacgtctatcatggtagcagcttttactttcgtgcttgtgattcgtaacgaatcacccacgcagcaatcaatggtcaccggatcctcccaccgtcggcatagttactttgcgtcatatctggcggagaaaccgcggattcctttttccatctcgttgaccttgcagaactagcatgaacgaaactgctctccaggcttcagtgggctgcagagacttcgagatccttgtctagaaggaacgccaccgtgagactttagaatgatacaggtggcggctgctgcacgaactacaccgtgcttgtcacagtacagaacatggtactcatgcgtccgcagcaggaacgttgagacttccacaacagcgcagggcgtctgaatgccagcgggttcgtgtagcgtgactgccacttgctacttttttcccgtgacaaggtagaaatgcaggttttcgtttgcgcgccatttcgggtagtgcctataatggcaactctcctactaacggaacgttgcgccgtagaaagttcttggctgttccatcggctccggggcatgtgtatgtatgtagaaaagatgttacccaatgcaagttgcccgatcttttttattgaaacgagatttctcctgtgaagttgctagacgggttatggccccaacattaagtagatctgtctcgttcacaccgctgctttcaccagtaaaaagggaaagtcttcatttcaggaaagaacgaacacgaaaatacggagaaggtaacaaccactgagttcaccacgtgttcgattcgaggccttcagagcatctgcaccatagaaaatagaattatcttatatttcgggctacagaaaacaagaatcaccccaaccttcgagtgaatttggtctgtccgctggtactcctctgtgtcagagttgcctgacgccagccaagaaacgacaataacctactattttgtctgcattcgtcctttcgggttgccaagaaccttttagacagacgaggcttctttcgtgcagacacatttcttctaatgtgtcgaaaatgcgtgcagggcctatgcatacagccacacatcgaccacggaaaaaagttgtctgcaaagccccgatgcggattcacggtccttgtggcggcttgcatatttcgataaaaacagtgttcgcctcagttttgagtatatattcaggtgtacacaccgtaggtagtttgtgaaatagcctgagcaatttcgtggacccccagtgccggggttcaccgacccgcaacacgttcccgtggagtgcccggacgcttttggctgaagatgcatatcgagcatggcggccgttgctgccttcactcgaggttccgttgtgtgttttcgtgagttttgtgcgttgtgattgcccgccagcgagcatggggagtccagtgggtatcggccgttcatcccgccagtgcctcttccggcgagcaacttctgacccggaaacgccgcgagcgctgccaatcgcactgggcacgacggaacgaaatggcgtcccaaagaataggcgctgcgcagctgatggtgtccaatagtttagaggaggaggggcgctgcggatctcgaggagggaagacgcaaaccttacggcttttttccggaaagaccgcatgtatgacgccaaatctttccgcggagctgggttttccctctcaggaaaggcaacgcgtcccgggaaagctggcgatttgtaagacagacgcagcagagcgatgattacgactcctcgtgcgtctggtggcatgtgggcctgcaggaattccccgttgtccggctgttttctgagagctaccagaacaagctctcgtcagattccgtccaccgcctctgccggtttctcttggcatcctgcgccgacacacttgcgtgaaagccgaatccgctttgagttcgcagcgcacattgcttcttctggctcgtttccccggattttgtggtgtgccgatttttgacgtggaggtgaaccggtgcctggattcttcgttaggaccagcgtcccagtgaaagccccacgactgtcgggcaatcctgcaaacagttcccgtttctctaaaggcttgccccacccgcgctcctcatgcggtgatctctgtgttccgtgcttcttgaatcagattcagttcccgtgaagttcccttctagagatgcagcccacgtgcactgcctcgaacggtgaattcgcctgctaataacgcgccaaaggcaaacggagcatctgcaaagccctggctgcgtttccagagactcccgaaccggtaaaacccccccgtttctttgttcagcatctcacagacgtgaaccgtccaaacgtcttcttctgttggatctgttattacacactgtggcggtatgctattctcccgtgattgaca

SEQ ID NO: 683 - DNA, 1748 bp, Toxoplasma gondii
ggtaatgacaactacaggaaatgtcgatgtcgccaggaatctgtgaagactactcttgctaggtgcacgattgagatgcatttgcaagtgtatgaaaacctatagaatggctggccgattttcaattcgccagacgtttgcacactctgaacgtttatgtcgcaccgggtgccctagctagaaagggtattcactgttccatttatcacgtttcaaatgcttcgtctaaggtttcagtgggcggccggtcgacttttattgaattaagacggccatacatacgtcgcctttcctatgaatctctctctgggtattggcaggttgcccgtcacactgttcggaaggtttccactgcatttgaaactgccgcaatgctgtcgatgtgaggaagtaaccacattctgcatggggtgcccccttgagagaggaatagttcccctccaggatttagagagagagaaaatgtcatgtttcgtaaaaacaaatcggttgcaaggacgctgctttgccattccagtttacacactcttcttatcagcggatacacaggtcacgtgtaccttctgccaactcgtgacctgtatatctcttatgataaatttactatcccatagtttactccacggaacaacaaccatggtggaactaccttctgtgcaagtcattccagatcccttaagcaactaagcaattaaagcaaaaaaaaacacatagacgcttgacatccacgtttttcgcgagacttctaggtctaagtaaggacgtcagcggagtatagcggcgggtgcaactgcattgctaggaatgcagctgtgccttatcagaaataccataaatggaagatgaaatctctctgcagagacgggagactgtgcctgcctggcgacgcaacaccaggagggtcacgcagcgacgttcgctagcggcggggaagctacacctctgcatgactatgcatataaaaacacccggaaatctcacaagaaaaacactatggggtccttcataaacaatacgtgctaggtgttgaagatcgatccagctttcttcgtgtcagttctcagtttcttaaaaactcttgtgcaagacaccggggcaactcaaagcgccagcatgcggcatggttccgtacgtggagtgtcggctatcgcgcaaaagactttctgtgatgatgttttgtgtggcgtacgttcgttttcattaatacaaattgtcagatgaatgtatcttaacaagatgctccaccggcttctttctggatcaaattctgctcttttccttccgttttttttcgctgcttggacctcgtctggcaacatctgtactgcatgcatcgagcgtaggtcgttctgtctcttctttcaaccgttttcctgtctcctttatcctttatcgcgagttgcttttcccttaactctgcgttcttctttatttccccttcatctcactttttttagatacacctcttcgttttccctccacgtcgatgtgcgacttagcttgtaccgttcgacggagcccgccgatattttcgattttctttttttttgtgttcacctgtggagatctcgaatcaaacagacatccgatttcgtagtacaccaaatgatttcggctatgagggagcagttttcaagtgtccatcgtcgctgttgaggcacgaggtcgcttgctggactctaacggatcacaccttcccttccgcgtaaatctccttcgcatcttcagacaagtctttcttgctttca

SEQ ID NO: 684 - DNA, 4377 bp, Toxoplasma gondii
gaggaaatccaaaaacggagaattcacagaacttctccgcgcatacccgtcctgcaaaagaaaagccaaaaggaaaaaacaagtgcggactccaaacatccacgaaacaaacgccgcaaatgcgcacatgtacactttactcagcaaacacggggaaatacacaaaccccaccgcaaacgatagacgaacacgcgcagcataccttatatatatatatatatatatatgtgtatataaatatataaatatatatataaatatatataaatatatataaataaataaatatatatatatatatatataaatatagtcatacatgtttgcagcatagagacgcacatgggcatgaacacgtacatgcgtatttacatgcatacgggtgtgtatctatgtctagagttttgcgttggccagcatgtgtggtgtagttgtcacagaaggttctggataagtgccagaaacattgggagggcgcgtgtctttgagattggcgctgaagtcggtctcaccatgatgtccaggtgaagccagtcgcatcctgcgtcgaccattctcttggcgtctgacgcaagggaagaaaggtcactagcgaggaccgaggggcagatgataggttttagctgtgaagacattttcgtgaagagaattccaagagttcgcctttcaagtcgagaagctccagagtgttcggttgatacggtgatacggagagacgccgagactggctgttgcggccgccggtgtacagcagacttgcggggacgcgagcttcttcagcaactagctagggcgttcgtcttgccggagtcggtttctgccgttggtcgttttcacccggcagactgccctccgagaaagcacgcagccggacgccgtgcaggcagcagaccccgcagaaatcggcagctggaagcgccgcaaacgcgtcaaactgtgtggctggagacagaaaactgaagtttcaacgggaaacgacgccaacgttcgccacaggacaccaaaaagcgcgcagaaaaaaaagcgagtttgaccgcggcggagacaaggagtcgaaagactgcagtgcaggtggtgaggaagatgagccgttaaccgaagaaagccacgggccgcagaggaaaattcagatacgaatgaaaaaactggcgcgtgtgtagaagccaagaaagtgaacgaggctgccaggagagaggtgagtcgcaggttcagggaaacgcgttgagtcgaggcgggattcgcgcagcgcttgcggagaaagatcgcagatcgtgagtgtctgcagtgttctacgaaagggaaacaaaccgatccaagtaggggagaagtgaaaatcggccaaagtggcgaagcgactaaagaagagtgggaaagactgtaatcttcaaattcccaggttgaacagtatagcggacaaggcatacgttcaacgcgcgcatgcaaattaaaaaagcgcagacgttatgcttgtgtgttgtcgagtatacgacttctctgcggtggatacttcggatttcgaaaagacaacacgggagaaacccgtgtgcttttgatcaaaacggagtagagcggtatcgaagggcatgcttgccggcgtgactttgtaaagattccagctgtctgccagcaacactcggaatctgctgtttgcgaagaggaagtgtgatacgaattcctgtttgcggactgcagtacaatgcaacactgtgcaggaaagcgttggggtgtgctcggtgtgcttacagaaacgtgttgatgaggattgcctagcgcctggtggtgtcagaaaaaagtccatgtgtctcatataacgtcagttacttcgaattcacaaggtggcgacggtcgacacgatgattcagggccattgtgtatcatcgataaagacaacgctagcgttgcttattacccagtacaatggtactgatcacactagcattcacgtagcaatttatctctctgttaatgcgaatggaaaataaattaaacggtaagttacaactggagcataatcgatgtggagcaattttgatatcgtacgatgggttggtgtacagcaatcacaacgaagtggttctccatggctgcaaaactccacttttctagcgctgtcggcagtaacgatatagatccactgtgctggtaaaattggcgttaaacgaagtgaatcgcataacctcgcggagctcgccacgcgcatcttgaacaagtgacttgtacgtgacaaaacctgcagaattaagatggttcacagcataaccgcgccgggtgccatgtcttatgtacaacggaagcgcgcacgatcgaactgcagaacgggtcaggtcagttctctcgtagagtctacaactctaggtcttgagagtctgccgcgggactatcaaggcccttcttcctcatatatttgacggaaaacctagaattcgcatgtttggctcgcatttagccgaaatactccgacgcgtgaccaggaaaagtgttcatcatttgcgacgtcaacgtgttggttacgagggtgcatgagatttccgtagctagaacggcacaaggtgtgtagagagtcgtctgccagtcacgacctctgcgaaatggctgtccgtgagacagcaagaatgttttgacaagcaaatgcgtttggtacgaacatacacggagaaattgagtaggaaggcgataaccgataactctccgtggtctcgagtaagagtttatgagagtgtcttatgattcctgttgcggttccgggttgggcgtcatcggcatctagacgacgcttcttcaaaaaacgagtcgatttatgacgcggctttttcattgacagcatcgttgtcacgcatttgtacttctggtcctgccccggtttaccgtgtaatgtaatcttgtacaattgttacatggctttgcgatgttgaagagctgcaaactagatatcacgacgtccacaagggagcgccgcattcttcaaacaaggcaatcgttagtcaactgctgaacttttggtatgctctggcaatgtggtagttcatttgaagagcgatagaacgcagtacttccgatcttagataactgttttctcagggaaaaggcaaaacttcagtttctgtaacatctttgcggaggccgattcgcacctttttcaagcgtactacgtcccgtctacggagagggcgcccttgggtttcttgctcagagcggctccctgtaagctggaacatttacacggcattccccaccttttcggtgttttttgcctccagtaatgcacaccagccgtcggaaacaggcagtgacgacagatggaacatgctaactaatggcgatcctcgttcgcagtggtcagtgctaccaatcgcgtgacacttcctgctgaagttacctggtgcacgctgcacggacgcatattctgggggcaccaagcaaacggatggtttcagaatgcgacgacacggctgtctgacacatagaaaccgtcgcaggtcttctaccagcaccgtaacgttaccagactctgaacagatgcgtaacacccgtacaactagaaggtcccactgaaagcagcaaactgtgcgaagtctccagaaaacgtaaaattccctcttgtttacctatgagccagcgaaaagtggtggcaacacaacgtcatgaagcgtagtttcgtgggcggcaaacgtagttgaaggctcgaacagaatttgtgtcctcccgaaggtgtagagacgcgcaagatagaagagtgttcctggcgctcgacgcagttcgtggtatttgcgtcctctcctgtggcagaacctttgtatgtcggtgctgtggcagaacacgcaagatgaagtaactcctgtgatcgtcacacgctcgtgggtgttacccgcacaacctgtgtagagtgctttaaggggacgggctcaacaccatgaggaaataccctaaaaagctcgaacgtccttcagctagctttaaaaagcatcccgaataatcgaaggagtcgtttcttgttgcatctgctagtttcggttgagtcacagggtcgcggacaacggcgcatgctgagactcggctcggcaaacagatcgatcgcatatatagtgcgttttcggggctgcctaaattcttttactccggagagctgtcgtgtcactagttttattggccacaaatcgacatgtttgcttgcgtatgtccttcctgttagggaccgacggtttttcgcgcataaactgcaagaattaccctttatctgccagcacctttctggttcattagtgcgccaggcaaaaatccattctgttgaggcagaccgagcgaaacgcaccacaccacactgaaaagaacacgtttggcatagtagaaacacactgacagagaaccttacagtggta

SEQ ID NO: 685 - DNA, 4058 bp, Toxoplasma gondii
agaacagtagcgacgccgacaggagtgccgcgcataaatgaagaagctggactgcgtcgaagcgagcaatcgagaagagggtgccgcccggcgggggacgcagcagagagagagaagaggaaagagaagcgtagcggaggagcagctctcccgaaaacgacagacaagtggagagagagaaaccaggactgggagaggaagctgaactgaggtgctaccgacacagccgagagcggagaccgccagagcgaagggagaccggcaaagacgaatcaagaaaacaattgatcaggccaaaacgtataaagacaagaaagcagagacggcaacgtgtaaggcatgcgctcgagagacacccgagagttctatagaagaggggaagcggcctcgcaaacggaacgcagagaggggaagcagagggtggaacacaattggcgactgcgcgagagagactggaaagaagcggcgagggggggagacgaggaaatctcgctcgcctgagcgcatgtggaaggcgaagcaagcgaaaaggtcccggctgcttgtggcgagtgagcttcgcgaggaggctccgacgagagagtaaagagaaaggagaaggatggcgcgtttcgaaggcagaacgtcgaagaaatcgtcttcagatgcaaagagatgtttgcatacaccgcgttcgcgccagcgttgcgtcagtgggagttcaccggacatacttcgatgtctctacagaattcggagcaacttccgtcaaaacctccgacaaattctcaacaaagcgccgcagagagcccagaggattctcggctctggatcgagaaaaacgctgctttggggtgtacatacaccttaagtcgcaccggtatcccgcgcgagtcactcgtcgtccggtttgcgggtctcgaacccacggcttgtttgacaaattgctgcggtcgcaaaggaaccggaaaaaacgcaggcaaaaaaagagaggcgaatcccttggtgccgggagaaaagttcgcgttgatttgaaagtgactcttcaccagggacttgtcaaaaccagaagcaggttaggctctcgagtgaccgagcgcgagggcagcgggacgtttgcgggaaaaggggcgagaagacgggcgccttccggcgaacaaatgcacgtctagatgccaagagcacggcgaaagtcaaggaaatgaaaaggcttccacgaattcaaggaaatcatcacactccgagaacgcagactccacgttatccaactagctatcgagcgcggccgcgtattatccgccacatgcctctccgtgtcgtcttttcgcgcgaaggcagtggcagttcttctgtaaaagatggcatggctccgacagagagagccttggtgtgaagacgataaagttgagggcgcgcagagccagtttttatgccagagaaggggaaaatgtcgcacggtcgcggacccctgtcgcccctcccagtctcggcggcattcaaccgttcgtctcgttcgctaccacaagtaacgcggaatgaagtcgtcttccagaaaggcgtttccacttagcttctggatactcttcttcgcagcagttttcccgcgtctcggaagtgcgtttctctcgatgaaagcgcctctccaggctcgcggactcgctccggccgcgaaagagcgaaactgcactgtgtcaaaacctggggaactcgacgattggtccgcaggcacagcccaccccccgggtgaacatttcgtcgatcgtgggagaatagctgtgaatagtaagggagcagtactgaataccatggcaataggaaccgatttgtgaatcagaatgaatcttaggtgactaacagtgaataatgggaggctgtgaatgtgggtactagttgaaacgagagaactcagattctccagttacgcaggaaaggagctttgctacacatctgacacagacagcgcatacggacggcacagaagacgaatatgcctccgggtttctcagtaaactcagcgtccgaagaagtgccagtggaaagctggtaaacactgagcgcgtctcaacgtagcagaaaggctccgcggttgtaaatcgctcgtggaaccgggacaatagaccgaaccagacctttgaaatttgcgaagagcaaggcgcgcgttgatctgcaactctctgttttgaccacggcctctcccctggtctaaaaacgtcaaataaaagccagcggggagcgccccatgttgatggtcgagaggtttcgtctttcgtgatactcgttttcccagaaggaagtcgagaccatcgcaccctcgacgttttcgctttttcgcagttccatctgaacgtgctggtggctgtgagggaatgacgcgtgagagaaactttcgaatcgagcgcactcgagaaagactccagacgtcgtcgttttggggaatggtggactcgtagacaaaagcaggcatatgaggctaccggtgaaagggactctcgaggtcttccaagtcgagcatcagcgaatctctcgtcacttctctgcactctgtgtgtctggcaacaagggagagacgtacacaaaaaggaaatgctttcgcgttttcagagcgactctgcatgcgtatggcggaactcaagagacctttgtggctgcctggagtacgcagatccctcagtgagaaaggagaatcaactttgtcgccggtaaatccagttgaacaaagtgctcctgagaacagcgcggcgcaactggaaagaacaagtgaactgatgactactgttcagatcccgagctttttattcgacggcgtttccgatcaaccttctgtcctctgcgccgaccattagccatggagtgcctggctcttcacagtctccacatagacgctgcgaggaacggtttctctctgaacagtctctctaagaggtccgggcggaaggcattctctcaggagaaagccactgacaagagaaaacaacatccatcgtgtggagagcaaggcggcctgtgaacagatgtagacaggtcgaacgcggagtgtcgcctattttcgagtagcaagcagtggaggcgaggccaagagagaaaacaacaagagtctccactcttcgcaacagagcgcttgcttttctgccgtcaacgcagtcgacgtataagcagtcgacgtataaaacgcaggagcgattttcctcccgtaggcgcccggaccgtcactgaggcggaagcccctgcgtgggtgactgaaatccgccaattcgaggctcttcgccaggcccactggtgcggtgattgcccgagactgagaaaattcgcacggcgactcaggctgagcggccctttcattccagaaatccagcgatgcgcctagacgcctagacgcgtgcagactcaattctttgtctcgtttcctcaaacacagctccggaactgtgcagtgtctctagctcgcagctcaacatccgaagcaagccccggtaaaacaacaacagcttcctcgtctcgagaggcgctctgttcgtggtgagcacagaaaccttaaaacatatctacttttcggcgaccgtgcaccgccgagagcgtccggtttcgggagcctctttcccgccaggcttttctacggaaggcggattcgcttccattcgagaaagctcttttaccgcttctgccttctgctctcgcaaaaacgggtcgatgccgccgaccttgagaacagtccgctgtgaggactgaggacatcgggactcgagccgtctgcgtgcatgcaagcgagagcagctgtgtttgctctgtgcgcgggaactcgcgcgggaactccgttcttttcttttcttcaaaagagacgtctctgtctgaagactcgccgactttgcggggaaacgccttttccttttctgcgtattcccggtgtctgtccacgccattttttgcgcatgccttccctgttttacccctcccccgtccccgggcacctctgcaaacctctgcaaacctctgcaaaaaaaccactgacttcataccactgcatccaagtctttgcaggcaacttttcctgatcttcagggcacaccccttcctccacgcca

SEQ ID NO: 686 - DNA, 1848 bp, Toxoplasma gondii
gacgttcacagttcaatatgataaccaaaagctgtatcgcctctgaagcccgcatcgacacttggaccatgcagagggacatttcacgtttaggatgggagaacctatagctttcgcatgaggcgcgatgcgttaccaggatgcccaggaaatgtctccatcggacagactgcttgttgtacatgctgaaataagaaacatgcatatgtagcagaactttttgcatcgtaatcgacaggggcgacagtttccagatgcacaaggctaagtatgtgcccaggcaacgcccgtcgcccgtgcagtcccgcagaaaagcccctgcttgggacaagcgcagctggacagcgatattcttttagaacgggcagtaggatcgttcccacaccacctgtgggggccgctgcaatgaaagaggggaaacatctctgtacagcaacacgagataccgctaacagcacagtacacgtatacgatgtcatccttacacatggcctcggggttgaaatacctctaaattgacatgtggccagcaggactttacagcaaacgtttacacgtggcacggtgctgatgtagccatagtagcacccacgttacggagttttgcccggcaaagccttactatagtgggcactcatgtgaatgatgaagatcaagctaatactgtggcagaggcgccccctgccccggtaaacgggacgctgtctaaacaatgtgcgcgagagggaaggatgttggatatctcatgataaagagaaaataaggagcaacactaaggatggaaaggaaacttactaaccctccgctggagctccggacgcggtgacgcagggtactcgcggcgtcgcacagggctgaagatttgattatctattacggtggaaaagtacccgtcttctgcaggaaaagggcttagctgtaaggctgtcgcacctactgctttctgaaataatacactggtagcggatcaacttccgagccaggccaaccacgaccagcagcatcagttcttagacaagaaagtgagttttcttggggagccttgtacaccacataagcacagcgcagaggtttgtatgggcaacttgttaaaagctttttcgcatggcttcgagaaaaacggcatgttgccatttgcaatcgagttccttctctgcttcatccaggctttctaactgcatgcgtggagcacaccagtattcaccttcttccttcagtgttctatgaaaaacgacagcttagtggttattttaaaacattctctgctttgtgtattcgtttaagaaactagtaccagagacgcagcgctccctctagcagtcgtggcctacaagcagcgcacgccctcagcagttgctgcatctacttacgtgcatgctaacgtgccatgttaaacgccgccaacacttgttgttcccttcgtctttgtgtgggttttcttagcatcccaaggcttgatctgagatgaaaacgtaggtggagcaatcccagtacacaccggtgtaagcatttttgcccatgaacgggtagatgtcggcagtttttactggcgccctgcacggctgaagtcgccaaaactttcgccggtcaagagcctgtttgagtctttttgctgatgtcgattgaacgcaagagtttgtcattgcgaaggttatacaaatgcggagtcgtaacgcatgttttacctcacttttgaagtttctttgggtcctttccgtccagttgcatgcaagcacttgcaacttcgggctggaccgttttcctcattagggcggagatcaaggcgttcattttcgctgacgaaaagacgctatttcggaagatttgcccactatgtcttttaaacca

SEQ ID NO: 687 - DNA, 1504 bp, Toxoplasma gondii
cataccgtttgtagtttctagcattttgtgcggtgcgaaagcatgtgtcctacgcagtcggtgctttgctcgtttctatgtcaccactttccatctaagtttactctctgagactcgatggcggcaacaatcgcaccagtctgcctcccgaccagataggcgggttcggccaattaagctcctacaaaggaccgcatgcaatcaagtcgatagcatctgggccaagggaaggtgggaagcaacttttatgtgacgagagtaacgacgtgaatacgtgtgcggggtttagcgtgtacatccaccatcacgcggaaagcccccaaaaagtaccttcaaaacctcctgggaactactctcatatcagacccatcgatacaagccaggcaaatgttgtatgcacatgtgcatagagatgcgtagaggcgggtggataaagagatttatttagatttgcaggctgcgcttgtagtacacgaatacaggactctcgaggagagacgtagccttgctcttttttccactgctgcctcttccatccgcaccctgatctgcatatacactgaaagcagaaatacacatttacaaacatgcgtatggtggctttgtacggaggacattgtaccatctttgtcccaggctatactggtggttcggatgtgatacatctaaatacatgtccatatatagatgtgtattatgtatgtagatgtacatgagtgcgtatgtccacatagccatgaagggagatgcgtagagggcagagcggagcgtgggtcacatttgccgatgtcgcagcgagagaaactgggaggcggcgaaagcaaaaagaacggaaaaaagagactgcagcgttgtggtgggattgtgacctttgctcttttttcctgcgtgtctttgtcaccacgcatgcgctggagcaaagacgactagctcgagagagacgacagcgggggatgcttttcgcagaagtgcacaggacgaacgaaacgaagaaaacgaaagaatgcgcgacgcagataaaacaaatgcaggaaacacacgggggcattcacacactccccctcgttttttcctttccagaaatttgcctcagctctctgctcggtcgaccacgcgcccaaattgtgacacgctgtccagtgtacacgcgtttcccttcagcgttagaagcctctgaaaacagcactttctcatccgttcttccacctccatttctttccatcctttgtctttttagtgtgcaaactctgctgatttccccgagtgtcgccgttgtctccgtatctctgtggcgcgtctggcccggggatgacccgctgcgcttcgcagactcacatccaggcttacaccttcgaagctcagtgtgtgtcaactccatgtggattttggtaaatgtttccttcttaataactggacacacttgctcatgcgcttcattgaagagagccgtttctcgaggtccggctcctcttccatttcctcttcaccgcctctttggcaaaca

SEQ ID NO: 688 - DNA, 2458 bp, Toxoplasma gondii
cgtcttcgggtaaaccttcttatacatctttccaccgacttcaagcaatccataaataaggaaaacagacgtttaaaatatgtatacatacttctccagttttctctcttcttgtatatatatatatatatatatatataaagttatctatgtttacgtgagaaacaaaggggtcttgagaagacacggcaaaaccagtatccagcaatatcgtatcaaacacacttttgatgtgtgtatcgctctggctctaaattcgttcgttttttgccgttcatctagtatatagatatatacagacatacgtattgtcacgttccctctaattcatatatatatatatatatacttgtagaactatatatacatgcatatttatctatatacatggagagctacctgaacgtggtttgcgcctgttctgtcggttttttttctagtatattgtacagggggttgcttcaggtcgcctgtgttcagaagctggaagtcttttttgatggatttgaaggatgcgtttctgccgacgtttgcgtcagtgtctgggatggactatcctttccagagtgtagtcagcgagaaggtttttctgtttctttcctgcgacgcttgtcgcctttctttgcatcgaaaagtcagaacatttgtttgcttcgactgaatgctctttttcgttccacgcctttctcagggcacattgaagtgcgcccctgtaacttttttcaccgtgattcagagacctccgagatctccataagaaacggtttgtgtcttcttgtcaccttcgtcagctccctctctccgtggcaactcgtatgtctgcttgtcccttcgtgtgccaccgagcattctccaaatgtttaaggacttttctgtctcctgcggcgaagattgcttctttctacggaaacagttccggtccacacactgcatgcggttctcgaaatcctccgtcaaaaggcgctgaaagccttctttccgtggagaaagacaccggggaaactcacccgcttcgctcgtgcccctgcacacagagagggcagagggggcgtccttagaggtaattttcctggagaaataaagttctgcggattctaaaagacaccaactgcgcggaaagagacgagcgttctgcggagcgacaacgaatgcggcatcatttcaggaaaaagaacttcacaaagagagtacgcaattcggatgccgtcgccactgcggagtgtgcaagggcaagcaagcgtcgaccgcgcgagctgttcgtcctgggagaaaggctcctcatactttttatgaaaaaaatgctcgctttcagggtgcagttggagcagacgatctgtgaactcgcacgcatacgagttggcgactctgcggatcgagaagaggaccgcgaaatcgcggctgaagacgacaagcctcgtggagatgcgtctggggaaaaagaccctctcgacggagtgtcttgcgcacgggcgccaccgagagacttttctcccagaaagccggagacaaagcgcagcgagacattatgccttctcacgggtctcctgtccttttcttccaaaaaatgccagctctgagctccgcgatttcaaagtaacttccgtcgggaaaaccgagagatctgaacagtccaggcgtctttctttccacttcgtctcgttctctgactccgccgatttcttggctttctcctctactttttgggggtttgatctgcgtcagagtgtcacggcacatgagctgccttgggagcgaagcgcacggagaacatttcttctccatctctcacacattttagtttctttcctgttcgtttctctcttctttcgcgtctctccctgacgcaaaacagccggatgctctccggcgttcctctgttcaaagtcctccccctcggctctctgcgccgcgcgcaccgctccacaccacccgctttctcctcgtctccccgtccgcttttctcagcggcaagacccgatcgtgttgtgtgtcgttctttttcttttcctttttcggaaaatccaccctctctctttctctcttggtcctgcgcgtcacgccgatccctcgacttccttccctcgcttcccgacagccgcgagaaggcttctcgcgactgaggctcgcgagacaacgcagcacacagaggcctgaaaagactttgaagagagcgggaaggttctgcgtctctgcgtccgccgaaggattccttttttccaggttctctcacgcaaaggaaggagaacctgcggatgcagagcctcccgggtgtcgagagacagcgtcagacagaagaaatgttttagttccccttttctcgcgagactccacgcgcgaaaacgaactccttttctcccgcgagtctcccctcgtctcaccgatcgagaggagacgaagagtctcttcctcctccgctcttccctccacagccgaacggtgtctcgcttctctttgaaaa

SEQ ID NO: 689 - DNA, 1884 bp, Toxoplasma gondii
aagcagtctcgacgccgcgccattttgagtcgagaagaagaaagtcgggcaggacccaaaacgaagaaaaaaacgcagtaaaaggaggtaggagaaaagaggtgtaagggagcaagaggcggcagacagagaagcagagggagaagacgggggagagaaagaggaggaaggagagaagacggatgaagagcaacagggaggagcggaagacagcggagaaagcggagaagaaacaactcgtgagcaggcaggcgtcaagcggcgacgaagcgacgagagacaggaggaacaagagacagctttgaatctctgaacatcagctggtttgacaaacagtgctttgaaagaacaacgaccatcgagaacgggaagagccatgcgaagattcagaagatccacaagacacttggagccggtctgccaaaaagtcgaacctccactaattgaaaaatcctacagacgctcttcaaggaactgttccaccctctctccttccttctccttctcctcctcttcatcctctctcgactcgcggctctgtctttcttctccttctcctctctctgtttctctatccccttctcctcctctttctgtctctctctgtctctctctgtctctctgtctctgctgctccttttccttcttttctttttccttctcttctcctgcccttttcttctactcttcctcggctttttcctgccctgcgcgttctgcgtattcgactctcttgttttctgcgagagcctcgccgtccagcacagctccggaagagactggcggcaggctctccggcgacagagagagagaaggtcgccagagagagagagaaggtcgccagagagagagagaaggtcgccagagagagagagaaggtcgccagagagagagaaggtcgccagagagagagaaggtcgccagagagagagagagagagagagagagagagagagagaaggtcgagatagcgcgcgaaggcagaggacggacgaggagggggaaactcgagctggtaccgcgtgcctgcagccgaattgttctccctcggagcgaagacacgatggactcgcttagaaacggaaatcctatgcgaatttctttcgacctttcctcttttctgcagctgtccctgcgcttcttttcgggtgtgcgtctctcgctttcaaggccgactgcgcgcatgcgcatgcactggctgtgtaattcgaaaagcagagagcggtcactgctcgagcagcctgcggaggctgctcggccttcttcgtctccagacggggagtttcgattcttttttccggcgttttcttctctccatctgcagcgaagtgtatctctggaaacgcggcaacgtcgcaaggcgtccgtccggctgtgcacccttccctcatcttcagcgtcacctgccgggaacggcctggtttcgcgttttttgtctctccacacaactgcaggcggcgctgcctcaccacttgctcggctctctttctcgacgcagacggtccgctggtgcaactgcctttttttctccgcgaagtctcgccgttcttctccgttctctggggacgaagacctgccgcgcgggaggcaaatctggttcgccctgcgcagacgccgcgctccgtcgcgaagaaaaaagaagatcggtggccgtcgttctctccgctttcttctctctcctcgcctgcaagtcctgaagctccgactcgacagctcgcttcgactttaataaaagccgctcgcgccgtttctctcttcgcgctcaggttctctctcgcgttgtcgctgcgcctctcttcgtgtgtctcctccgtcggggcaggagcgtctgaaagccgcgctgcggacgcagcttttcctcgaactcgcgctcgtttcgcaaaa

SEQ ID NO: 690 - DNA, 5012 bp, Toxoplasma gondii
aatgtcgcagagtgaatggtcatgttcacacttggtcggataaaagatcttgttacaacccgctgttgacttgactccagagaaaagtcgcgtctacaaacctagcactcccattttaaaaggtggaacaaggagttcctcctcgacgcgttcaggtcgcctcgtggacgcttcgttgcagtggaacgagaaaggagctccactttctctagtttcgcgacacacaggaatgactgttgcagaaacgaaagcagaggctgagagaaagtcacgtgaggtctgccatgtgtatatggttagagttccacaggaaccgagccgcggaaataggacgagagctcttttttagtcggaaaaaaactgcacagcgaggtgaagagacaaacagtgacaagtgcgagtcaacatgcggcatccgccagcttctcggatgtcgatgcactactaaaacggttcttaccctgatgcgtgctcctcgccaggcgttttttctcctcttcaatgattcgcttcgacggcattttcgacgtctttctaaaaaacagatggcaaaagaagcgacagcagactccaaatagaacaccctttgattctttttcgtccgcgctgattagaaacgaaggcaaactttagagaaggaagcgagtggacacccgcagcggaggaaaaatccgcgacaacggaggactgaaatcttttctccagtcgtttccgacagaagaggtccgtccgcaaagcgcgtacaaccagacgcatacgtgcataattgctggaatgcacagactcggcgggcatatcgatgccgaaagggacatacaacggcagtgacatcggtagggagaatcggttggacgcagttgtttctgggagagcatcacagttgccgggtcatcggcgtttccgctattgaccccgctttgtggggaagagaatggaggagtcactcaatccttgttcccaaaaaaaatggtatcctccttgtcttttcctttcattccagtggccatcttctcccgcgtcccccgggagaagagtccctcttccagaaatcccacttctctttgtcaccctggggtggcacagaggcgtttccagagtcgcgcccgctcgcttacttcgagattttcctccgctgctcttgtcgccggggccgttcgtttgtgcgcctcagccgactaacaaatccttgaatgggcggcagcgaaaacgcagagcgttgctgcgagaaagtcgcagcagccccaacgtcgtccctggcagagaaaaaggcggccgacaacggggctgagagcgctataaaaaaagatccaaaatggagaggtctttttcacagagctcgcccgcggttttgcggtcgggtggctctccacttccttgcagaattgcaaattccaaagtttgtgcgtcgtgctcgtgcgcgggcccaccgttggatgcatcgcccaagtgcctgccgctctgccgggagaacatgcaccgcgcgaaaaaaagccgaagagcggagacatgggcaagcaagacacaggggaaaagcagattgtgtcctcaccgcagcatagcggtctttaaatgccaaaaagacagaaaaaagccgggccttccagacacaaggggaaaatgcgaaaacgccgaaatcgcgataccggacaccggaacggcgggcgataacgtctaatatatcgatacagcggattcacgtggatggctgcaaaaacctgctgccttcgcctcacggaattgggagttcgtctcacaacatgctctggtacggtgacagatacgctatctgtttggataggaaacaagctcaaatccaggaactggaaaagacgcgcaaagcagccttgaggttgacgcgctttggtgagggctgcttgcctgcctgccagatctgcacgcgagaacgagcatcttttgacgctctgtccttttctgcgttttgccatggccctcggcgtaggctcgatcacactaactttgacagagaaaaccgaagaagcatggacactttccgaggtgtacatacacctcatcagtgacgaccaggaaccgcttttcatcagtcccacggtggatgtttgtgtctgttcgcttgggtctgtggttgcttatttcagtagaaaacgccgtagagtgcgttgaacctcccccacggttgaagaagaaaagtggatcttcgtgtgactgtgtttactcagaagctcagatgctctacacggatgaaagccagttctggaagcggcgctttcaccgctgttgtgagtactcgggaagtcggtacatgtgacacgacggctctcgacaagaggattctctaaggcacgatgatgccatggttttgaaggactattttcctccagtggctgtgtgaatgcgctctcccgagtgcgtccgggtacgggtgatggggcaccacaaactcgccagtctgtagatgattttgctaaaacatgagcacgtttcagtttgtcacggtggctgctcgcgtggtgtttgcagaccactttcccgaactggaaaagacagataaatggagtgtattctggacatgcgtgggcttactaggagcgagtaatttagttacaattgatgtggtacagatgaaagactcttggacaacaggcactctgacatgtgagcaagctgctcgcaggtctcggtttcctcagcgtcgagaaaatggctttcccctggggaaaaaaacatatctgcatctaggctgtagcaacgtgctcccactgccgattacgcggtgttactcgtcaatgggtgataaggttccgtaccagcgttctaccgcaattcgatggacacaggtctcatggtaagtgcaattccaattgagggagaggatccgatccctgaaacccaatgtgttgtgggcctccgacccgaaaacgcaacgatggcttcataccggaaactgccttcaactaagacaccgccggccgtcgtatcacacaaagacagcggaagaatcccagtcacaaagagtacggaagtgaacctgcttcgacagcatgcaattattcgttcgaacgaatcgaagcatgttcgcaagccgcagaggcgacgattagatccatgaaagcggcggtcagacaatcccagatgttaggtgaaaaaccattgcgggacagaaaccacacgtgaatgccccccagtttcgatttgggcgacgatcgaagaacatctacagtccctgaattgctcgtatcactagatccatcatggtaagtaacactgcgtttctctgactgtctacgccttagttcttccccgtttcagagttatctgaaggttccagcttcgcgtagcattgctggacatgtcaactcagatgcccaagcatgttttccacggtgcatttcggctttcaggtgtcgtctcctccctcgtgacaggaactgcgagtcttcagacatgccagcaacaaactcccctgagctcgctgttaataagggtgataacagaactacgtatgttgcgcgtacagcataaccgatgtgaaagggactggagccaacctcagctctatcgtcttgctaaacgttccctttcccgccagtgttctgagagcacgccattcttcccgtcatcaccgtgtcgtttgcgtgtcagcggccagacaacgacgccgcagggtctgtcacctttcgaggtcaacacagtggtggacgaccactgcctttgtctagtttacctacccaagacctcgggttctgtatttgccgcaggacattgctggatctgagaacttttcgtgaaatagccttgccccgcataccggcggaaccagcagatttcccggtgtgggcaacgccttctggcgtatgagtgactacagatccatcccttattcgatgatccttgaattttatgtgtctgccttctcgtagacacgcctgctgaaacatgcatttgggtacgcatctttccatctgcataccttgactgtccctgctctgtaacggggtttaagtctggtcacgaggaccttgaagaatgtagacaagtctgttgagtcctgtcccggcacactgaggggtaggtcgttttcatgtccggcgaaaggcttgcttttgcgggagcgtttctacaaggattaatgctaatttttgccgggtctgggcccccaaaatagctggattcatcatcgtgcgaacgaaaatgtgtctgagggcagtggtgttgcgaggcaccctcccgtgtgctgccacgtccaacctttctctggaagaggaacgcttggggcttctttgccggacacacatttttgctccagctgtggcgttgtttttgtcatacatgtggaaagctgaccctctgtttctcgtcgtcgcgtacaatttcagctgaaatcctcactttgcgcatctttcttttcggcgcttcttttctccggcgagcgtccacgggtcgtccgtcgctgccgctcactcttccctcctcacgtttccctctttccgcgcttcaccgcagcatgtagtgtaagcgacaagtgcacgattttcacggcctttatcgggtcaccgttgcgatttcggccgtttgtacaactcgccatccagtccggtagagctcgattcgcgtccctcggcggttccgctcgcaggttttccatttcttttggcttctcccgcgctttctcatcgcttttcacttgacagcgcccgggccgaccggctttctagcgttcctgtccgttccatgtctctctcccgcgctgtttcgcgacttttttgcttgtatccgcccacttcccgtgtggcaggaagcctccggatgtccgccgctctccacgtacttttccccaagacaacgccgctcttttagcgctctccgtccccccttacgtcgccggtggtcccgcgaggcgtacgttcacgtttctgcctggccgccgcacagattccgccgacccgttccacccattctcatcgaacggggtgcagttaaactaccgaccgcgtcttttcttcaaggcagttccgctctcttcttcgtctcga

SEQ ID NO: 691 - DNA, 2174 bp, Toxoplasma gondii
ccaccatcgctcggtgagtgtttgtctgtgtgagcaaaatttgtttttccccggcggcaattgtggactcctattgttcacgacttccgccacgtcttttccaaagggatgaaacgccttacgtaattggtgtgtggttcctctagctgcgattataatagcataaacaggagaattcagggagtgtttttggatttggcgggggcaccagattttgggaatctcagccacattcagaatcacaacaagtagatagcctgacagggtgctagactggaacatagcctagacggtttcggtatgaccaactgaacagcaacgtctttaagcggctgaacgcggatctcctcttttgcttcctgtgagcccttccccccactctcctgatttcttgttggagcggcaccaacgtacgttgctttccacaatggttgaaggaggcggattagtgaggacgatggtatgtgcgctaactgatggcacacgaccgcacacgtaggcatgtctattgaaaaattcatgcaactggaaatgtttcgcgcgtttcgtagggttgcagaagcacgacgaattcttaggggaattgcggtgtggcaactgtttgagtttgcactggtgacgccaggagcgttgcaggagttctatcacctccaatggtaggaaacgtgaaccgcctctcgcggtaatcgcttacaacctactcgtagggagagaagaaacatatgatacggactttctgaactgaccagtaaaagaaaaagaacatctcttgatttctattttgaagttgcggacgattgttgacgcggctccatcacaggccgcaatgactcgccacccgattacctctttcgaatcaggcggtcagactcaactgccatatcaaaatataaagcagcaacgattctggagagcagaaaaggggcaggcgcatcgtcacacacgtgcggacttgcttgctttcgctggacgtccacttgccggaagaataaccaaattgcgagttttactcaatagcctgctcacatcgacaatcgtattatacacggctccacagagtgagcccgctagtgttttaaatctttagttaaaggacgtaaaaagcgacagaacgactctttctacgtggaaaaatctttcccacgccgggactcgaacccgggtcgcccgggtgaaagccgggtatcctaaccacctagactacatgggatgatgtttagcttgaccggctttccattagctttatggaggctgctactatggactggcgaggcgaaagaaccaaatcacaacgtgtactgtagaatggtgacatggaaacgtcgagaggatcagagaactcgatcctcaagagaacagatacattagaagtcatatctgcatgcacgtggtaacatttttgccaagcatgccgtggcggacgcgcctctgtcgttgccgcaaaatcacaccagcgaatgattttttttcctgataaacgagtgttgtctaatatgggatctattaaaactcagtcagacatgatagcacccataggtatattttgtagagtcccagaggtccttaatcgtttaagatgcatgctactgagacgcaagggcggcacgctgcatgcgtaaggtaatttgcttgggtaaaatcccgcttgccttcgggttgcgtcgcagtaattttatgtgggtcggttctgacatactctcaacaccaatgagctgctgccggattacgatcaacgcttatacacctgacagtgttttcgtcagcgttggcgaaaaatagtgggtttgtcttccaacctagttatcgaaagcgaaccgtttacacattttcccattttgtgggtttttgcagcaactctcgaggacggcgtggtttgggcattctttaatgggcatgttccctctgcccgttaatattgaggatcggtaccagaaagtatcgtagccggtgcactcaattttccccgtggtggtggtacgtgttatccaacgccgagcacctggggtcagctgagttgactcggcttttgcctttgacgcgagcaactctttgggaggcgacgtgaggaacaaaggaggcactgtagaagcttggcacccaggctggtgaagcactggagggagaacgagcctgggattgtggcgaaaggctctaacgatcacgggaactcaaga

SEQ ID NO: 692 - DNA, 1962 bp, Toxoplasma gondii
agaagagaacgaagacagggaggaacgccgcagaacaggagacaacgtcgaaggcgccgagggagttccaggagagggaggcgtctctgaggcgagaggagagggtcgccggacagctctggagagagaggagagatgcgctggacgcgacgacgcctcagagtaagtgtggagagaggataagcgagaaatcgaggcgtcgagaagagtgagaggagcgacagaacgcggaaaaccggcgcgtgcagtcttcagagaactgagcctcccctggagctcccgcagagaggctggcgcctctgtcgtgaagtccgcgtcgtccccgcgagcggcgcatgcaggagggataggacgcgctgccaagaggccgtccagcttcgaacaaaaacgaaggggaagtcgcggtgtatgcgcagacaccgcaggactgagcacgcgctcgggcgccagctgcagtcgcagcatcttgccgcgccagaaactcgaagataagccgaaaggtggaggaaagaagacgaagaagaacgaagacgcggagaaaggaaggagagacagagagacgaggagaagaagaggatggatcacgcagagagaagaagaacgaagaggggagaagaagagtgaggaggcgaacagaagagaagaagagaaagaggaaggggggaagacggacagaagaatggaagacgcgaagagaaatgctgcagaagaggcgactctctccagcgacgcctatatctctagctgttcgcgcgactgcaactgagaaaaagagaagcttctacaagaagcctgcgtcctcgacgattcgaagaccttctgatgagcctcgaaggccaggaagaagctgcatgcgcgtgaatgcagcgtttgagtttgtcgacaggacagagaggttgtttccctcttagttctcgtatcacttctcctctgtctcctcatttgcgttcgctttcgacagatccgtctttcgttttctcccctggcggcggacagctgagggaacctggtgcgtttccgcccgtctcctgcgcacagaggaaaagagacagaaggcgctctctcgcagagaagaagaaaagtcaggagaggagcgagacacgaacagggtgaggagaaaggagactcggaaatcgagagagcgaggaagaaagcgaggaagagagaagcgcgatttgcgcgccttgtgtgtgtgctgcatgcgcatgcgtctcaccacgagccgagtcaacttttgcgcctttcctgtgttttccgtctaactttcatgcatttcctttctaggtgtcttgcgccttcttttggttcttttgtgcttccctagtgctcctttggcaaagacgagacatgagaaaaagagaaaacgcacacactcaacagctttcgattctcgcggtggaggtttttcctctctctcccgtcttcttttcccggtggtcgtcctcttcgtcttccttccatttctgagtcggctgtcggcttctcggtcctgccaataacgtctcctcatagctctctcttcctgcttgttttctcgcggtgccgctgccagtctctcctccgctctccctccttcagtcaattctccactcctgtttctctccatctcctctttctctccatctcctctttctctccatctcctctttctctccatctgccctcttgtctatatcgccctctgttaaagttgtctctctctctctccacctcggtgtgtatccttggcgtttcttctcgttccgcctcgcgcgattccgctgccgtctgtgatgcgcatatcctttcgctttcccctttgtgcatttttgcgccgattaaccagtatgtctgccgcgtcgtcttcgtctcccttctcctcctctcgaagttcttctctctcctctgttcctcgcagcctcgggcgtctccgctgatcgtcttcgtcgcttcaccggaccgaggagcgccgcagacacaaga

SEQ ID NO: 693 - DNA, 1852 bp, Toxoplasma gondii
actttgaaagaactgttcgtgaaggtgtgagtctgcaaggctcgacgggtgaacctccaggtgcccctgtgtggaggaaagcgtacctgccggaaccgggtcctcaatggggacgttgtacacgatctgtggtccactctgagtgttccccatcttgtcttagccgctatctgagacaaaatgcgaggaactgaggaaacggaggttgcaccggaagtcgttcttcctcgaagtcgacaggtttcggaaacaacacagtacgcagttgagaaacactctctccttggcgagacagcacacacaggcgacacatgaccgacaagatccggtagaaaaaggtactccctgcatcgggaataagcagagaaacaggttttcacatgaggaactggcgacacaccgtgtgcacaagaacgcctctcgtgtcgcgcgtccagactcagcaggcaagaaaagatctacactcagagtcagcgtacaacggggatttttaacgcgaatccacttcgttcgcgccttttgcaggacgaaaacctacgcgtttgctgcggaggatctgtacaacacaacctaatgagatgtgaaaaggcaagacagcccacagttctactttcgtctggcacacacgggagatgaaggaaccgaaacgggaagagagagtggtaaaagagcgcgggacgcagtgcagggggaaccgagaaagaaacgacggaccggacgcgtaacgcaagagccacagatcatcggtacttcctcgacggtgcagtgtacggatacctgggcaaccgccagaaaaacgaacgaagccagactggcaattccgaacggacgggacgaacagctgggccgaaaccagagtttggccgttttctccacgaccacctttgcgtctttgtgtgctggttcgccggtattcgttgtcccttcccctcgtttaccgtggacacacagtcgccaggaaaacgcttaccacagaaaaaggtcccttcgagggagaacaggaggaatgctgagatgccagtccgaggcgcagcgatgcctgagaaaagtgccccgagagacaaggaccaggaagaaacgagagacggaaggagaaacggtactcgagaaccaggagacgccccggggaagacagcgccagggaacgcgatctgttttcacacgtgcgagaacgcagacgactaaaccgtatccccagactgggtgcgctaaactgggagagagctgtctccccgggaaagaacctttacgggcatctgtcggctcagaaggaacaaccaagactggacaaaagcagaagaatctgacgaaaagaaggcgaatcgggtgggccgtctccgtcgaaagcagtgctgaaccagatccacaaaagccaggttgcacgaggcacgaatccgacgtcgtcctggttgggaaaaaaagcacagccacctggaaatggcgatattgcccctcttcctgcaagaatgagcccccttttccaaacgaaaagcgtttcccgaaacttcttttggccaaggactcgcatctgtgcagcccctgctctccaccatgcggttcgctgtcactcgcgcgacatcgcagctgcatatccgcggccctgttccacctctccgcggtcacgtgtgtcacctgtcagtggcgccagcaagacacgtgcaacgtagaggggcccaaccagaacaaggagcttctccggaagtttcttcagctgacagtctctctgcagaaagaggtttggcgttccggcccggcttctcaaggagctggtccgctctgcaggcaaactaccgatgcagcgataccatactcttgcggtgaccccacatttcgccacatgtctgtctcacga

SEQ ID NO: 694 - DNA, 1981 bp, Toxoplasma gondii
cagtgcacggtctaggtaacggtagcactatcaagcatcttcttccaaatatatttcatggaacaccccaaattctcatgtttgattgccatttagtcgctaatatacaaccatccaaggtatatttatctatcgcaggttcgatctaatgtcccgttatactatgtagacctcatgccttctgatactgtgaatgcgtgactctcctaggcatcgttcaagtgagaagccgtttttaggattcatcagaaatgtacaacaacgcccgcccctttctaaagaggcactactctggacagcactctctcacgctgtttgacacgcccctgttcttgcctccgttcctgagggtctgtatgaacaaaatttggctgtaggtcacacctccgaagaggcaggaaaagcctctcccaactggctatgtatgtgtaagcgtgtgcgtatcggtttctctctgggtcacgtgtcctgcacacctgcggtctccgcatttgccagaacgtgagctttgttccgtccgtactttggagttggtgtgaagtgctcgttttttttcggcttggactcttcaggccgagagccgcgagggaagaacgcgggaaaaccagtttctgcatcttcgtggtgacgtgtgcctaaaacaggcgcctgccgctcgactcgcggctgtcaagtcctgtagtacgtacacgcgcaagcacgaaggtctggagaaatttctgctcggcacaactgcagcggactggtcgagggatccgcggccgatgaaagcgaggcacgcggagaagcgttttttccagcgaagacgtcagcgcgcagaaaaggggggcgcctgaagtgccttggaggcttgtgtgtcggcaagaggcgtttgcggcgagagaagcagcctcacgacccgtttgaaacgccccttgaaaagagaagcgactgaagagagacagtcaagcgggatactctctgggcgcaactgaattgttagagggccttcggctgtacgtacacccgagcggcaaattcttgggtgtatggacacctggacacgcgggttgagtcgcgaagccggcactgtcccgccccacgctctgcgaagtgggtcgtctcgcgctgtttcgacgggatttttttctcagcaatcgacgcggcgcggtgtttccgctcgagtgtttcctcgtttttccgttcctttcgcctttccctgtctctcttttatttcggcctcgacttcgcgtgtctccctgtctctctcctccccagctccgcgaaagtcggcgtgggagttccaccgcgttttcgagcttcttttcgtcccgtcttgttcacgctttgtttttttcccgcctctcgctcagacgtatcgctgagtctcagatgaactgagaagaggcgaacaaatctgtttcccgcagctctggcgaccctccccgtcagctgctctcgtcgaaaacagctctcaactcgtcccagttccctttttccgtcgcgcgcccgtcgagctttcttctccttctcctcccgccgttgcccccgagcagaagagcgtccataataacgaagttctttttcctcgtgtgtctcttcgcgcttctccagtctcgcttgccttcgtctcccgtcgggaacacgcgccggcctctctccttcagctgccgcccgcgctcgctcccttctccagcgtcttgtttccccgttttctctcccccatcctctccgcggggtctctgctcaaactgactggctttctcttttttccttcccgcgctctcacgttctctcctcgtcctccgcctccttcgtcactggccctcgcgtcgtctgccccccaccgcagttcttctcctctccgttctctccgttcccctccgttttcctcccggagttccctctggcctcctttcggcttctcgcttgcctgcgtctcctgcgctcctccggcaacaaaagctgcttcgctgcactcgccttttgcccttgttcaaga

SEQ ID NO: 695 - DNA, 3004 bp, Toxoplasma gondii
agtcctgagtgacggcaacagcagcaggagatgagacaccgacagaggaggcaggatccacgccgaagtggacggaagtgacgggagaggaggcatctcgagcagcgttgcggggagacctgctgaggccgttcttgcaccccagaagaacgtcggtgtctgcagcttcataaagaggagaccgtcccgaggcaggcagagacacattcggcggctctgcttcttttccctcagtttccgagggggctgagtcagctgatgcgggcaaaggagatgtggggacggccacactgcatgcgttgccgtagggttcgtcactggagagagatgggtgcggggacgaagcctggacagacccagagtacgaggaagcatcgagaagccctggagcggaagccgacagctcctccgctacagactgactgcgcctttctccgcgatcatccagcagctgtggagacgactccgcctcggcttcgcgagagccctgtaaaagagcctcgctctcctccatggtttgtgtgaaaccctgcggccatggacgtctccccgaagcattcagggacgagttaaactgcaggtttatagatgtccacggtctctaccaggtccaagttcgatagtgctggcaataaagcgccgcggggtgtggagacactccgcggttgacgcacaccgttccttgaaggacgcctcttacaacgtgacacaaaaaacagcgaacctacgcatgcttctttcaggtgaacaggcttctgagaagtcggtcagaaacgcagacacaaacaccaccagagtgcaaagcgaggaggcgcacttgggggttttcggtggagaaacttgaagcgatctgcatgcacgattgcggacgcagggaaggtagtcgtggcttccccagatctcctttaacgaattcaggagggtgagaactgtaatccctccgagaaacttgggtggaagacgagaaccgtgaagggccgcaggactacacgagtccctcagtgaaatgtgcagcagggcggctgcctcagctggcttctgactggcactgcatgcgccgaggacatccggctcctcactccttttgtggtgaagagaaaacagtcagaaaacatgaggtcaactgtgttggtcgtacgcgccggcgctgcggacagtgtgaggggacggcccagaacactgcgcgagagaatttagagcgctttcccggggattccaagaaagcagaagcaagcaatcccctcctgtgcggaagctgcggctggcacgaactgcaatcactgcctgttggttacgcggaatcgtgaggcacgaccaattgtgcggaacccgggccgttagactcggcaaaagtgagactcggacgagaaaacactccaacgcttcacgagtaactgaggcacagaaaataaactccaacagaagaaccgtgaagccccagtagtggacctcaaatgtaactcgtgcgtcgaggtgtgcgaggaactcactcgtgtaagcaaatcctagagctgcctctccaacaagaaaaggctacggcggttcgcctgggcgcttctccgggagagaccagcgtgagtacgcagaaatgtcagactggagtagatcgacaaagttctacgcggaaaaaatggatttgtgtccactcagctggctccagggccctttgaacagttaatgcgacttcgaggtgacctggttcgaaaagcagagagcgacggcggaggcaagcgacctattgggaagaaacagaggaaagaaggtgttaaaggggagaaattcgtcgaaaaagccccgggaacccagcgacaagcggtgtcaccctcattttttccagggctgacggcggctgcatgcaggcgtctgcagaggaaaaggagagctggaacaagcgaggtgttctctcgaaaggacgcaaagatcagcctcaaaacacagaccgcagcgaccgaacggtgccaaagatttgaaaaacacaggaaactcgagggtggaagatgaacttcgcagaaaaaaaaggggtagatatctcaaattccaacacgcttgtcgagctgctggcttcgacttgtacgaacaaaaagtgtgtccctcacaaagggcttgtgtgctagccgagttgcgtggattcttctatcttttttctaggaccttttatgcactcatagacgcagatacacccaaaacgaatggattgttggtgattatgtcactcctggtcaatctaagatttccttccgagattcgagctttgaagacccgaatgctcagtcgtcgacagtgcatgactcgacgcgcagtggatcagtaattgtttgcgtatataatgtgatcgttttgatggtggttggcagtgccgtttctggcctttctaatcactatcgctagtgcttctcctactcttcttgcccaatctcgaccatgttattccgtttgtcctcgctcattctcgacagtgctcttcctgctctcccgtcttctcagtattcctagtcctggtcgtcttgctttttcgagatggcccttctccacaggcaccaccgaggagacatatagacgaaagattgcctaggacaacggcacccccaatgggaaacaccactttcgctggccgtgcacacaagcgccacttggagtcacgttggagtacggactggatgcacgaacatgaagcaagacactgtcgcattcactgcacacaaaatgcccaaagtgaaaatatatatgtaccaatgaatatatatatatatatatgtgtatatatgcagcagtgaagaagaatagaaaacgaatttcgcaagggagggctaccagttgcaccatgagcgacctaaaggagtttggcctgtggcgaaaagcgtccacaggagcctcttgtcgactgtatgtagactgttttcccgctgttttcaattgtcaaagccgcatcaaatcctgaactgttttaaatctcttctcaacgggaggatctgaacaaagtgggtcgaatgaaacgctgacgaaa

SEQ ID NO: 696 - DNA, 3115 bp, Toxoplasma gondii
ctgacccatgcctaggtagtcgttcgagcaccacagctgtacttcagtctgcgagagctgtttcgcgacattggcgacggcctcggaagcgacagtttcagatgcttcttcgttgaccgattgacacatccacctgtccgcttcttcttgcgcgcctggtgcgcctgccgcctctctccgtatctctgtgcctccctctgcgttcggcgacgccgcggcggcctcgcgagcaccttgggctccagatcccgcagactctgcgtcgccctcccagccgctttgtcggtcgaagaagatcgccgcggtcgggaacgccccgcgcttccgctgcagctgcgcaaagacgcggtagcggccctctgcatgcagttcgtttatggccgccgtgaaacgctgctcgtagaagaacggagacagcgccgaagcgcccgccgcctcgccctcgagaccctccaagtccgccttcgactccagcagagaagccaccggcgcggccgcggtcagagcgtccgtggagcccaaggcgtcgccgcggctctcgaggcctgcggctgcagagggcgcaggagacggcggaaaatgctggtggttgagagtggtggcgcgcatgactgcaggcagcgtggaggagtcgaatttcgaggctaccgggcaaaaggcgcgaaacggaaagagcgaggtcagagactggttcgtgtgtcgagacaagaaagggcacaggtgcgaagacgcagccagcgacgcggccgcgcgacgagcacgagcggccgtcggagacggacgcaccaggcgagacatctcgactttcagagaatgaagggagcaggaaacgcagagagagaggaggcgcaaaggcaggaagagacgcgcaagagggagggaaagacagagaggagcgcgaacggaagggtcgcggagcgacaggaacagaggagagcgagacgccacagcagggagacgggagaccaaagaggacagacgacgagaagattagagcgacgagaactggagagactgacaagaaaactggggctccgggcgggggggggggacaaaggggaatttcttcacagtgctcagggctacgaagaaagagcagcggcgccgcgcacacagacgaggaagacgaggatttgcaatcgaagcacaaacccgtgaggatttcgatctgccaagctgggcctcccggcacgcgtggattcctcgcctcgagagagacgcaaaacgtaaattcattcaccagagaatcgtcacaggacaaatcctctctcctggaaacgtggcaggcggcggggccggcccttcacaggatcgcgcgatccgcagacctctttctctacggtgtctgtacacccaggtgaggtctttgagacgatcaactgagacgtcagccgagcgaaaagaggtctttctctacaaaaaagcggatcagtggggtctccgccacctcaacgctctgtacatgcataaaatctaaatcgatcgtgaactgcggcttccgggtttctcccaatcgctggaggggaagcgagccaagggcgacgggcctttccgtccctgtcggaacgccggcgaatcttccctttctcgggtgtacatacaccggaattccagccgcatttccccctggtggtgcggagagaaggaaccgacaacgaggggtggaaagcggctactctgcgtcctcgagagggcgacaaaaaacccaaggcgacggcgtggcaccgcggaagttcgttccgggaatttcttgcgcctggaatctgcgagttctcagtgtgtcgcgacttctcgcggttcctaccgacaacgaaagcagcgacggcccaagcgaacccgtcgcagtcactgcacaagacagcagcgatgcgagtttccgcggccagagagaaaataaaacagaaagaaacccggaagaaaacgaagaaaacgaagaaaacgttgccaaacaggcgccgtaaagagctttctgtcgcgaggccctggaactgccccgcaatgtcgccggcacatccaggtgtctctgtcgctgtcggccgacgtagacgagcaggcgttgttgaggtctgcatgtcagctttgtcccctaatttttcacaaacacgaaaaaaggcgtctcttttgcttgttttctcgggtgtatgtacaccagagggttcgactcccacgaaccgacaaggtcgagttactgtggtgcccgcgcctttgcgggtctcctcgcgtggctttccgccgtttccttctttcttcctcttccttctttttctcttctgttcttcctctccttctcgctggcctctcttctccgtgtggatctgcttccgccattgtttctttcgctttttctgtccccgaacagacggcgagacgacggcattctcgctttccgtcgctcctcaccgcttggagacgctgacctttcttccgctcggttccgcgacgtctcttccctttctccgttccttaaaactcacaaatttcctgtcttctcccctgactcctcttcgtcttttgaggaggcacacagtttcctgtcgctttccgctgccctctcttcggggccgcaaaaaaactcgagaggtttccggcgaagaagccctgccttttcggtgctgcttcagtcgatccgcaagctctttgataactgagctggtcgtggagagagagaggagaagaccagttggacatggcatcaggaaagtttgagtcgctgctcgtctctagtctctggccgtggtgttcttttctttgggagcagaactcctgacgctctttgagtcttctcccaggaccgggttcgctctgtctctttgaacgtttttcgctgtagaaatcatctgagtcagacgcttcttccacctgcagttctcgtctcttcgtgtcgaatgtgactgggcggcacagagcatgcctgttcagtcgtgaagaagaggtccaagtcgcggaggcgagttcccctttgtctctgcgaccttcttctctccgtgcgtctcttttcttggtgcaccagagctcccgcccgtgaagcacgaggcccggtttcttctctctccgctacagagcacccttgctcttctttttgggacggcgcgtctgaggctgattaccgtcagga

SEQ ID NO: 697 - DNA, 2034 bp, Toxoplasma gondii
cctacttctcggcagcgatgtttcatcgtaatttcacgacgatattcttcagtcattgcaatcatgttaaccgcgcgaactagggaaaaacactttctgcagtttgcaaacggcagccaccgaatggcgttgcgtggcaaaggcccgttgtcgcacaagtatatttcagtctccattgtttccagaggcatccttcgtgcgcacaagacttccttgatgctgacaaatgcagatacagaggctcggagtcgcagaggctaatagagtaaggtcacgttcatatgggacgtaccacccagtgccgattttggctgatgaagggtcgactccagtcgcagaagcatgcatggcgagggttgacagggaaaacaacgcctcaaaggaccggatggcttgtgcatcagagactgaactgtactgtagacgacgccaaaggtggtttcttgcaggcagcctgatcgcgagtgacactgccgaacacggaacagtgtcttttttcccagtctagtgaattatagtgaacacgtataattaccgcagagggacactctgcaatagaaaccagcctcgccttggtgtgtggggtctacgctgccaggttacctctatgaccccttcatacctgcttcaaatctacagtctcgttgttgatcgataccaaagacacgatcatgcttttcgctgcaatgcggatctactgttatgcgggaacaaaccgaattcacatgcggatttagagccagagggcgtcacaagtaggaaaaatctcagcggagcccggcacggttaaactgcatcgtagcgagctgaaaaaaaagtgcctgtgcgtctcatgggatggatggacgctgcgccttacgttctatgaataacaagatggatagataaatggacacgagtacaggacagcacgagcaattactggggcgtgctgaagcgctggtcgtcttcacagttacccaattgttttcggaagcgtaaatatgttttaaaagcttttggtaaaaacacagggtggaaagttgcaacaggcccaatggaagtagtgagaacatttcgacggcgcgttcccatcaacacatttttgcccctaggaactttcagtacacctgccgttgattcgtgtcacgagactgcggtgctttcttggaacgaagcgtcgcagttgagggtatgctacctatcgaaatgactaccctgtagtctacacaacaccgacctgcacaataggtaacgtcacgcggtcgatcggagtaggccaaaaatacgctccgactcctaccagaacagcgatttgtcgggtggtcaccagctcacactcgaggtatgcaaatataaaggagatcctcttgaggcattgggttatttaacacataattcttccactggacaaagattgccaagtgtcaaatctcattttgggcagtggtgacagttagcaacatggctgggatcgctcgatgctaccatcaatcgagaaagaatgcgttcgttgtttgttccaaacgatcgtcacattactaagcggccactcgtgtccgagcgtgctgcaatcgaatttgttttcgtaatctttgtcgcaagcggtcctcttgtgcatgggcgcagcttttgtgctcgtggacctggaccttccgtcgcaaagaatcacactcgctgcggcagacgtcgctcagagggggtcgctcggggctgtggccgtccgcggcatttccaagcgggtgagaagggatgagacttgctagtgattcgcacttgtcaaccatgtgacttcacatacacggaccatccagcactcttcttctctttggactcactgccgaactggcgcgtttcgtgtgtctgcttgtcgaggttatgcgtcgtgtccttttttccctgccgcgctcttgtgaggggtcatactcgcgccgcatgccagtgccccactggtgttcgattgctgccgctgcgtcactactagagcatcaagttctgtaaagtttcctgggttctctcatccacactgaatcattgtttagaggtctagaataa

SEQ ID NO: 698 - DNA, 4386 bp, Toxoplasma gondii
tgtccatcaaacgcgacacctccgtctggtactggtgactctcttggctcttctgcaccgcctcctgctcctcggcggtcaagggcgccgccgccttctcgctctcgtcgatcggcagcgaccgcggcgcctcctccgcagtcaaaggctctgcggcgtcagtctcagtcgccgccacccaaagcgccgagggagagactgaagcagaaaaaaagctggacgtacatgcaacggagacgcccagaagcagggccgcgaaggccagcttcttcggggtcctccggccggccggagacattgtggtgaaggcgttagcggcaacaggtcagaaccgaagggcacacagactgctagcaggcgacagagaccgacgccttcagagtcgacagagcgagcgtgaaaagacaggcgctctgcaaccggaatccaacaagacagtccagcgaagtcgacgggtgcgaacctcccagagagaggggaagcgtgtgacgccggagcgagagccgagcgcaagaactctccgactcagctgtttgacgcaagagactcgcgcgaagcctgcgaacaacaggaaaacagatgcaggtgacagagacaggatcgttctcagtcgagtcttttagcaagacggcggacatgtagaggcccgcgagtgtgtccgggaggaaaagtcgtcgaatatgcaagcccaagggcgtctgtccgaagagcgcgagccctggccagtcctcgatgcatacgttcacaagaaaccggtccacaaaacacaagcgcggtggcaggaattgctagcgtgacgccttcttcgcgcgggtcatcatctacagtcaacacgggagacttcatgtgaacgtcagtaaacgaagagatgcgaaggatatgcatcgacgaaacggtacacttcacatgcgcgtcgacgaagaaatacccagacgcgcttctgcctgcagttccaaggcacgtcaagagtgccggagaaataggagaggccaccactttcgtgcaaaggacccagcggcagatctactactactatctctttggacttcgcgtccacttctctgtaaacgtcattgtttcaacgcgaattcatgcactccgggggcttgtgcgcgccaggcgacggaaacgcccggccgcgcgcagagtgcacacaaactcgagtctacttaatgcgtgaaacaaagacgcatttcgaaagaaaactcgcgttggagcggaaccgaaggcggtccgaacgtctccacggaacgtatgacgctgtccgctccgtctagaaggcagtgcacggaagtctcaactgtacacacccatgcgtcgacgcttacaccaaaacgctcacgttcacccgccttgaacgcgagttgaaaatgcggagttgcagatatgcacagaaagaaagggaagggggccagaggagaaggccatcggatcaaagcaaaaaaaaagccttggtgttcggcacccgttcgccggcacagatgctgccggatggacgcacacccctgcgtcgttccttgccacttgcactaatctgtcatgtcacgcggtggataaatgtgtatatctgtgggcataactacagaggaatcgctgtcactgtcccgtaaaacgggcaaccggcattgccttggcggcctccaacgtgaggaggaacgcccaggagttgcttttcgctcgactgagaataaagagtgaaataatatggtgaacttcaaagaccgagagtgcaatgcactctcgatctcccggtatgtccaaagtggaacaggtcgaaacggaggaaaactctctgcgtcgaggtgcacgtcccccgttactgccgcctcagcaggcgggtggcacaacactgaggacggggagaggcggcctcgtttccgtcgactcaaagcgacacagcccattccagagagtgttctctggattcccccgggttttttcctctttcttcccaccacaagaaagtccaaggtagacgcggttctgccgtcccgaaagatcggggaagtgcgccgaaagcgttctgccttctcgcgcttcgttgcgccctctgtttcgcctctttctcccagtttcagcccgcgttttctggcagagagatcgaccccgtatgtggctggaattaacagacagcgaacgacttctggaagtcagctgaactctcctctccatggccttcttcttccacagcctctcccgccaggactcaccggaaaaaaccgcagcaccgccgagctcagtgtgtctgggtgacgtcgcgccttttgtctcctttcgacggaaaggcggaagaaacggaaagcaactgagacaaagaggagcggcgaaaaagcgagacggtcctgtcactcgtgcgtcaaagtctccgccgagattaaagaaactggccgcgtcgcagttgctcgcgcctcgcgttttctttgcacttctccaaatcctgtgtgccaggctcgaccccttcccccccctctttcttctggggggcgagtgcgagacacacgcagacgagaagggagggggtgaggtaaactccgcgggataaacatggtcgcgcgagaaccagcagaccactgaccccacatttctatccgtccaggtcactgccacccggaaaaaaaggcacatggcagaagagagagagaatctcgagcactgtgtccagttcaaaatgggggatcgctcccgcgcgtccacccctacggaatccgacaaacgttccagcaccggggcgaaacgtccactaatacaaaaccacacagagctgcagcacacataatgcgtggatgagagtgcgaagatatcgaaccatctatcaatacgtacatgtatttcacaagcagctaggcacgaagcaatcgagtatttacgaattcgtaccccacttttagatgtgtataggaatgagaaagaaacgtcagttgtgccacaccagattcccgttcattttcctcctttttagcttcgttgtctaggctttcaactttcgcgttgtgtcgccttctgtgtcccccctctcctcgtgcccttctatctcttccgtctttccgtgtcgccgcttcctgtctgttctattcgcgaggagcgcactcggcacttttatctgcaagatcaatagttgaaggagtggataaaatttgcgcatttcgactagccaagaatccatcgacagccacatgattcgggtggttgcttcaaccgcagggaagacaaaggcacacgtcctgctacctgcgtcctctcagtcgtcttctttgtctctctcaaccagacacccgcccgcgcggcgaggcctttcggtgccaagggacgcacgtttcgtccttatctttcggagaaaggagacagtttgtaactcttgagtactttccctgctgactgactcgatcgctggcgtccaaccagaccggtccgccgcgacacggtgctgtccattctcgaattcctggacactcgtcccgcacattttcgagagcggacgagagaaagattcaggaatgagaccacattgttttaggcaagaaacggcttctaaatagaggcggagcagtgccggcaaccgtcaaccccctccccatggacctcgtcgatcttgcctctcgaggacgggagggtcgagcaatgtgcatggatgggcgactatgtattgttgagagactctctacgctggtcagagactgagaaaagctcgacatctgactttcttgcagatgtcttctttccgtttgcatttgtttctgtatttttttgtggtttgtcgcgctcattcgtttccttcgtcgttaaggtgacttccgcgatgggtgcccagcaggccgcaacggtgttttccacgcccggcatgcgggcgaaaaccttgtgaatcttttttccgaccaaactgttggtttccggaatcccgtcattccagagtgaacatggtgcgtggcattttctcgaacttcatcttcgaaaaaaagccgagagtgcgccgccgctgctctctgtccacttcttctgctcttggttgcctgctcgttccctgggtttcactccttgtttcttgcttctcctttttctctcgactctgtcttcgagttgtgagcctctagttcccccgtcgttcttccccattgtccacttcgttccgcctgcgctcccttctcgagtttttcctgcttgaccagccttcctcagagcgtggtgacccttccccttctttcgccgtacgcgtgacctccgggtactggcaagctactggaatcgcaggcgtttagcgtcttgagcaatccagtgcgggggtcgtgtgcagcagtcgtgaagaaccaaacctggttgtctgtatcgcgtgacggaagtcagtcgaaaactctagaccctctcgagttcgtcccccccccccagatgcca

SEQ ID NO: 699 - DNA, 3203 bp, Toxoplasma gondii
ctgatgatgaattcttcattgctgaaaacgccaccactgtactctgatgtacgctgttcgggtgcaggctaatggcaagcagatggatggggaaaaacggctgaatgtgggaaagtacctcacggcaacagcaactctggcggatactgtttgtctcataccaaaaaaaatttagagcttttcattgattccgcctaaacggtttcatcgtctctttgtgctcatgggggagactacgtttcttgtacaaagttggcagtgctctaaataggcgagaccttgttgcctcacagcgttttgatttctttcgaaacatgctgagtcacaaacttttcagccgtgagggcttctttgcttgccgtgcatctcgccacggcggcatctacctgatgttctctacaaccacgcgacctgcagccgctgtggactttacaattcaaggcctgctagtgcagtttgtcgctcactagaacacgcttcttcctctcttccacgtcaatgaccgcagcgatagggattcgtccactgatgttgcccaacagtaccctttgtaagcgttctaacagccgcaagcacgaagtattcaaggataggaacgcttctggaccagttagtgtgcctttcagagacaagaactcacaactcaactaagacttcaccgtcttgagggtagtcaagtaacagtcactgctttggatgttcttcaagcagctgtggtatattgtgtattctttagaatatccataattggctttgaattacagtcgtaacttacaatcgtcggcagagccctaatttacttaaaggctggcatagtcgccgtgcctccagatggggtggtttgttttgcccgaagccgcatgtttgtacccaccactttcccggagttgcctacgatctgaatagcgcacccgagctcattttacatgctgcgcaaagaagtcggtctcttgtgatctatttcgatgccgtataaatacttgattgagagggtgaccctgctgaagacataaccggtcagttgctttccgcaaagggcaacaatggagcttgaagccgtggagaaacggagtgccctttgatggttgtgttacctgaaactgatgccatgtggcagcttccacgagacgcgatgggtagtgggctggccccaacaccacagttttttgacaatttttttcagtgatcaaccgaccgtcctaaacgacaatattgatgaccgcttcaagataaggtcagtacgtctcttttgagcccaccgtaatgacctggcctgacttttatgtcggccctcaaagtggttttggctgcatatgctggctcgttgccgactctgacgcgaccgtatacctttgtctcttcctcgtgaaagaaacgtatttcagaatgtgaatatgagcacaagtgcggcacagaagggcttgcaaacagaagagcaaaccaggacaaagttactgctccaatgtatcgtggagtaccgccgcctcctcaaaacggaagtgattgtgggtacgacgacgaagaccgggcttctgtaaatcaggataggctaccgtccgcaagtggaatgttgtgcagaggacccgcgtatcgccctgaattcctgtgtgacggggaagtcgtgtgtatctgacgtgctttaacatcacgtgtaatacaggagttttcagcaagatcaacgagcctggccaacagtccatcagctatcgaaaaaatgaccgaggcacatgtatacggtgcatttcacaactgcttccactgcctacacatgtttttgaataacgtgtaatggactgggaacagcgggcatggcttacaaaaaactgagccagttctagtttctttcctttcatagggtgtgagatgtttccgctgtaggttcatgtcctaaaatatgcgaggaaaataagtcacaggctagcatttgttttcctttcagtgcagctgttcagggatcctgaggtgcagttcttcaagttttccttgaaacaaagaagactttgtcttcaaatgaaatggtaagcagcttttcccctagtgcaacgctgtgcgaggggggcagcccgcgccggggatgcgctgagtgaccacgtcgttggcaaagaaggaattttcttggggtgtaatttctttttaagattcaaccacattttcttgggcatatttccttctgaagaggatgaacaacagtacgaggttgggtcttattgagggactttcaaaatatcgtggtgctactgccgacctctattgagcgaatcaatcgagcgtacttcgtcgtgttgccgacagtcgagaaacacgccatactgggcacatgcggcaccgtatatatcccaaagaagaatcacctgctaaaacatcgtgtcgttgttcttcattttcagcacagtgacttcaaagaaggaagtcacatctcacatttacccgtatgcgaatcttggtcgtcactacgtaggagtcaactttctgccgactcctgtgacgtcatcacttctgaagtgcatccgccgctgcgctctgtatcagaaaagtacccagagccgtgttctcgcccgttaccagttgaaactggtatcattctcttcgaattttgcgttgtttctcgctcgcaggaactcttaccgacttctagcccttgcagagaactgaacacgggcgcatttcctgttccactccaatcggggctggggatacttctggtgggtggcacggagctgcgggtttttcctggagactttcttgatccagggacgcatgtggcagcaacggttccggtggcttaaccttgtaacggcacaagcagtcagggggaaactctgatgagaagcctgcgaagaaggcgcagaaatgagctccagcctgtatctcacagaatgcgccggcgactggcgggacggggtcagatggtcgagctactctgctgtcaacttctaggttctcagctccgtcatgtctgatgactgtggaagagtacggattcttaggggcagcaggtgtgtttgtccagcatgccccgacgcggcggcggcgcgagtgtcatggcacagaagcgtttcttggtgtgccgaagaaagaaggactctctcgttccttcgcatgcatccgatgcttagggcgcgtgtccgcatggcggaactagggggcgagcggctcggagaccttgtttttcgtgctcttttgaaatctttccgttgcgaaca

SEQ ID NO: 700 - DNA, 2094 bp, Toxoplasma gondii
agacaaaggaaaactggcgaacgtgtgacctcagagacaagcgtaaattaacgccaggggagagtggccagcacgagcctttaacgaggaaagagacacaacagcgacagccgctgtccgatggggtccaccgtcgaagggtatctcctggggacggacatggaagagaagaaaactcgagacgattcgacgcgagtggcaacgcgttcaccgccgaagccttcctctcgaactggagagaaagacaggaagtcgatgacgagtttgacgaggtcgttcagagtttggggagaagagaagaaaagtgacagagggcggcgcctcaaagagacccgtgtgggatcgtgggaaacggacaagttcactgtctttttatcaacgttccgattcgtggaacacacctcctgcctcaagcgttcgttgcctgtcgccggaacgaacagacagaacaccgaaatcaagcgtcgtctgccgaatggagagcaagcacgctactccttctcatccgagacaccgaaggcacaaaaaggcgaagacggcgattcttcaacgggaatgcttctctagtacaagagtgaggaaggacgctcgagccacacagccacagacgcctgacgcacagcgtcagctcactgacgagatactggagaacggtcggagatgaaggaaatcaaagattagagtgctgccgagaaggcctgagagaagagctacttcagtcagatttgagcgaggcagaaaaaaagtctctcagcgcagctcttcttcggagagagacgcgacactccccagggaaaagcatccattcaccgaaaaaggaagaaagcgagaaggagtggaagcgcatttccgactcacacaagcgaaggcgtgcgaaaggaaaaggggcaaggacattttttttgcgtactcgagttcgttcgagaatttgtcaaaggtcactcgtttaccagacgcagctttcgcgaaaggaaacccccgtagatgcgggtgtcgagcctacttcagaggcaaatgcgcgaataagatgcagaataagaggaagctgacaagatttgtcgtcaagaagcgaacgatggtgtgagaaaaagactcagctggaattgtgcagaaatgaatctccggagacttgtctcaaacgactagcatcgactacacttgcaggagtggtggaaggcaggagacggatgaaatcccgttttccttgacgaaaaagacgccctctcgtccacttgttcgtcgaacgaagggattcaagttcccttatcaactgcggaatacgatacaatcattcttatctaaataggtgtacaaaaggtgtcttgtctgtcacggttattgtgacgaggaaaccaagttggctagaagtcgcatgcagagccatatgcaacgactctgtcgttcgttaaagcgttccttcagtgattttggggagtagatcgccgccttcttgatgccgttcctctgtttttctcgagttttttttgggttcccaccgtcacttctcgacaagatacatgaatcaagagaacggcaagtggctaagtgactgcaagcgtcgtctccgtgttccgctagacgcagaaaaggaagaatttgaacagcttttcaagctgttgaatttgaatcccgttcgcaagcccaacaagtgacatatccgttgccacagtgcttgacgcacctttatgtctcgtttttacacactcgctaacccagccaactgtgcgaggcgtttctcgccttgttttgcctctccgcggattaaggtttcagagacaggagcaggagccttacccgaagggcagaagagtctcgtctactgcgccatgtttgtcttgaatcatgcgttctctatgcccctggtttcttccttggtaaatccgtttgagagatttaacacacaccggtgctgaaggaacttcgtccccggatttcgggcaacagaagagaaaatgcggtcaaagcgagcctccctgtttcctgacgaccacaaaagtgcatagggaacagaaaaaagccgtaaacgcgtacgtctgccccacagccataaggcgagtctactggacccgttcctcccttctttgtcttcatcga

SEQ ID NO: 701 - DNA, 3039 bp, Toxoplasma gondii
tgtaacttcagaataacgacgacaacgtagtgagacgcgagtttggtgtattgcggttgttctttcaggtgttggcgtcaaggtgggcattgtcgtcggctgcttgattgtaggtctgctgatcattcttgttgtttggtacgcgtggagacgccgcaggaaagaagaaaaggcgcttcgagaaaagcagaaagcaaatgctgcagaacgcagggcaaaccgtgatatcgccagatacgcgcatccgtgagaggcaggtatgagcgccacaagtcggggtgtacgtacaacgaggcagttgatgcgtaagctgctgaaggtcgtcagcttgtcaatccctcctgcctgtaagaactggaacaaatgaagcagccatggcaaaaaattgttatatcagttgttacctcaccggcctatcttgcgccgaagcgtgtgcttgacgagaaagccacgcggtcggatgttgtttgttcgtgctccaagagttttccatgctccactagtatcatgtgctctggtgcagtctgtggagacgcacttggtaccaaggattcacagacacactacgcttggcgaccgctgaattgtgacgcccccagcctgagcagtctgactcagacaaggtggcctttccgaaagtggattggcttttcctacggtgctccgtccaattccactcagagtgctgccgttcggatgccatgacttgaaggcacttccgcatgtttagttgccgaaggggtgaaacaatttacatgtctatgcttggcacgtattgttgtagtggtttcgaatttttgtgttcctgttctgtcgtaaagaaatgcagtccagctctcgtcaaaaagcactgcccgtgagctacgtttcggaaatttgcaccttctttattgatcacatgcatcaattgttttccatgtgcccggcgaaaatccgctaattctgtcggcgtgaccccaaacctgagaaagtggtgcgagcatctgctcggatgtgctttctaagtgctgcaactgtctgacaggcggctgcgcgcgtgtgctcagttcagagctataatggaagcgaattatattttatcagccttggttgggtttttgtaatcgagtacagtaataaggaacacaaccgaagaaatgtgtagaaacgatgagttgcgtgtaagcaacccaaaagtcgcttatgctgccaggacactacaaaagatgacgcacaccaagctgctcatgtaggtatgctattaagctttcacgcggtcactaagcaaagaaagaaaagctgagacgagtgtcaccggtgtcttggcctggccttaagctcacaacgatatggaaaaaacggagcgtcgtcgtggcgcagacgaaagacgattggcatcattccttcttttgcgtggttgcctgaccacagagaggctctaatttgatctcatctacccttatttgtgccatacaggaacgagcgcactgttctctgaccggggtgggccgatgaaaagaactccgggaggggagccaaaagagatcgacgatctagaacagtgtatcttgaatcgaatgccctgctgaatatgggggcgtcaccccatgcagttttcagttcctggcgtcattttaggctacaaacgtccgcaaaacctcgcgtttcgaagagcgtatcagtttgctcggaagcctgcttcgaatcatgcatcgtaactggagtgtgccctgaggaagtagtaggaggcagctctcccgtgctagtgaggtgctacattcttcctcgtgtatcaggttgacacagcagccccgtaggaagtccgatgcaaaatggccgtacggcagcggcaggtcaattcgacgcgtggctgttcgcgagctagttcccattgtacaacaaaggagggtattaggctctggtgggttagtgcttgggggtgtccacagcactcgatgactagaattttgcaaagcagacgatttctggctaactcgcctttctgttgtgtgcctcttccgacgggggaaactcttccacgacccgttcatacacccacggacttgcaaaccacaggactgttatcacgatgttcacatacagagccacagtcgcggctggtcgcggtgtctacgcaaacctgtttagtctggaacgcgccgtctctccctttgcatacggtcgctttcagtcgttaagcgacctcgtgtttctcaataaagtccgtgtggagtttcttaccgaatgtcgtccagaaccatgtcagactgcgcggcctcccctaacttgttggcgtattaccacgccagcagaccggttgttctcccgtgttaggcccgccttgcctgtttgtggcgggtgcacagattcggcacgtttagaaatttcgtgaaggcgcctccagcgggacggtgtcccgtgtcgcttttgaaaacatgacactctggcacaatgccctagcgacggtcgtccttagtgcggtcaggacttcgatgcgtgccgttttccgcttcttttcgaaactctctggagttttgtctccgcggccggaggcacattccatttcacagacaaaccagcgcagtcgggggaccagcgagtctcgcaacccgcatagtcgtcccgacagttctgcgtggcgggcgggccccgcaggtttccgatgcagaatagcgagtgacggaaagagtgctattcaagggttttttagggtcttattttgaactccgcatactccctgtccctttcggttgaccggaagtgtcagaaaacggatctgggacaggtaccacttctgttgcgcaaaccccggcgccggtgcacggcgtttcgggacggtgaaaatacgacaacaccgatcgaggagtctgacagattcgctatggctgtgaaagttcgtgaagtggacttcttttcccgcatgtgagaaccactatgtgacgactggaaagctcaattctcagtgggagaatgctgctgttcgaggccctgtctgcaggtgtcggtgcaaacaatcagttccctcggccgtttcctccgaggaagtgagcgttcacgcca

SEQ ID NO: 702 - DNA, 2399 bp, Toxoplasma gondii
atgcaacattcgtgaaaaggtgtcattcttcttggagaaactcaattgttccatctgcctcaaacggtcaaatctccagggaaactttagggaccctagcgggtaggtgggtacaggaaacagagtggctcgaagcgttaggccatgtagacgagaatgaaagacaggacaagcgtgcatttcagtatctgccacgaaagatgtgtctggcaggcgctgaagcctccgaaagaaaaagaacgaacaggaggcactggctgcttttcagcccgttttgacgagatttctcgactgctgactacttcttctgtctgttcgtcaatttgatcttcgtcgttgccgctttccttgagaatctttgatttacctttgatgattcgtacacattccgcggtgattggtacatccctcaatcaacgctgactttccttagcaagtctattcgatggctgggccgtgcttgcgcagttcctttttgctgcagtgtggagtagtgtgatgttccgtgcttgcgcagttcctttttgctgcattgtggagtagtgtgatgttccgtgcttgctacgttttcataatctcttcgtggtcgcttcttccgccgaatgactctctttgggtcccctggtgtcttttattgtggcactgctgcttccactataccgcaaaccacaaccgtgggctgccgaccgagcacggaaggacctttggcgcaacttcccctgagaagacattttgttatcgtcttccctcaatatgacttttgacatgcagttgttgggcatagtggccggtagaacaaagtctgaaatcagccgagctgttcacaatggggagaggaagaggaaacaagagtgcagccttgttcttccgctttctgtagtgttctgcatcgatggccagattcctccagtatttccgactcgcgaaaacgctacctttgctaataaacacttgtgcatgcattaggattcaacttcctgtcaagaaggattccggattaccctaattatatgcatttagacttacagctatgtatccagtcgaactcatgtgtcgactcattcagcgtgacaacgcgcgagaaagcgacctgtctaggtctgttggtctgtctaacgcatgctgtttcgcggagcaacccgtcgacccgcgttccacagtccgaggcaaacttcggcctgaaaacgacacacctgatcgcttgatgagcgggtcaccgctgtggacgagccgctttacgcatagggggcagaagcaatggctgccggagctggaccggatgctgcgcatcggtgtctatccgcttgagatttttccagccgattacaccgcgtatatattcgctgcgaaccgggacgcgaaggcgtgagcaaggttgagtaacggccactgttcgcgccccccccctgtacatctggagacaaaagaaggcagtggtgacgccagcgcacatcacatcgcttaacattcagtcaccgtaagggcgtgctacggtttctcgtgtcttcccccaacagagttaaacaaggaacctgcgtacctaacgtagcaaagaggcgggtcagcggccgggggttcgtaacagcgaaggggttgtagagtttcacgcagatacagcatgcgggtgccacgcgtctgccagatgaaatgagagttttttcagaaggagtgaatgcacatggggaatggtcactgttcacttgccacacgcacctgcgggacgtcgccatcgcggcatgtgtggactatttcgtattttcgacactgggtggatccctgtcaccaacacagaggttcggctggtaacacgtgctgccattgctgctagagaaatcgcggttttcaatctcttcgctgctcgatttttgccaacgggcaagtaccccgcccgacaaacgttcgtcactgaggtagacccgtaaacctgtttttgtgcggacccatcacagaaccttgacctttgtaggggaacgtaggggttgtagccaggaatatcttcaaaggatatccctcaattgcttacggggagaccccgtaatcgcctgatagagcgccgggcgtacgggggctggcacagcctgcccgacgggtgttcacagcgaatttactgcgtctctggtagcatgtgcgtctaaaatacgattctgcgttgaggccgtgccattaacggaaactctcttaacgaaatgctttatccggttaggccattcgtagtacccacgtttcgtacggtgcgagcgttaggattcgtgttttttctcgtggatattcagatatgtggatagtgagcaggtagcaacagcccacaaacctggacgtcctgtttcgagcccagacagccgccccccgtcgtcctgaaataccaccgaaagtgttatggttgacccctctcgctcata

SEQ ID NO: 703 - DNA, 4408 bp, Toxoplasma gondii
gaagagagtaccaacaacctaggcagtcagatctccatgtgcatgcactagagaggaagacgcacatacgtatactgggaagagcggcgttataacggggacgcagacacagaaaacgtgaaacgtatctgtggtggcaggagtcacactgggacacgtgtctggttatcttcgccacacagtcgcttcctgagggtgttcatgacggcgaaggacacttgaacaatcggataaaagagaggactcgataaaggaaatcggaaacgtttccggcaaactcacttgagccgggtttgtcgagctcgcggacgacgtgggtcatgccagccttatagcccatgaaggctgtgaggtgggggggcttggacgggtcatccttagggaaggcctttactgcagcaagcagggaaaaaagcaaaaacaacgtcacaaacaatgcaccagataaacataaaacacataaaaaaaaggccaccacttggaacccgaacttttcgcatagaaacgccacgtggcctcaacacacacttgcaagcttgccgccgatgcggatcgacggcggggctgggtttgatatgatggggtggagttggcgcttctgcaggaagatctttaaaaggaaaccagaaaggtcagtgaaaagcactgaataagacaccggaacttgaacaacaaaggcgaaaaagaataccttcacccctccgtaacccctgtggcagtcgcctccgttggaacccatgcggtcgcggttatcacgcacagtaggcacgtgcggaatcatcgcaaaaaaacgaaggcgtcaaaacggaatggagacggacgaatgattgatcacccttaggtgagtttgcttcaggaaatcagggcctttcggccacaattctccatgaaaatttggaggaagtgccacgtacgaaaccggcgaacaaaggccccacgcggggtacgtggcgctttcgcgtacacaccggagccagtagaattgaagaaaacagacagaccaagttacaacaagagttaggaactatatacgttccccctgcgaggagaattgtggacatcggtctctccattcttcctcgggaacgcgactctcaccttttcctctatgacgcttgcatcgcttcctgggcaggaaacccagggagccgtggcgagggcgctcaaacttccggtgggacatcttttttacccagaaaaaaccaagaacttgaggttctgtagagtccagcccctccctctttcagaagaatgttctgaaaaagtccgtcgaggcggtcgtgcggagaggaaaaatcacgggatccacgatcaccccgcaattttcgtttcgcggcgtctgcatgcgcggtccccccacgtctgcaggaccctacaccgcgacgggttatggccaaaccccactcagcgtcggctcttattcggaacacaaagttgacgatagaacaagcgtaggctaaacacctgtttgcctcaatcgcagaccctgatcttgcagctggaaccccaaaaaggcgctgttacaacaacaccaacttgcatctcgaaaaacgcaggagggactggggaagtttgccgatgctggtagcattaggaacgaacgcaacacatgaagctgtgttaagtggtgaccagaaatatcatcctttccccaagcaaaaatgcgattgggagagcggcccaactcacacctcccacctatggagtatgtgctcccagggaggaaggacattaattttccactttgatgtaacaggaggagaggcagtcgaattgccttctgttcggagaccaagggaaagaaattggttgacgtaacccgaacagggagttttgcacagatcctttggaacaaagacaccgctgggaggcaggacgaaaccgacgcctctgccgcgttgcgacctaatgcaagatttctcgccttttagggaaaacacagggaagtgcgggcagtcacatgcgtggagagagaaacgagttgattctctttaatttttggttctttgacacttgccaaacgcttcatcctaggagtgttgggaactgaggcacagccaatcatgcaagacactctccttggcacttcaaaacaaaagagaaaagcccctcagggatctgcttcccccttttgtccctcttcctctctttctacctgcccagcacctttgaaaccgatggtgtgtcaagcgacgaatgccaaatcccctatatacagataacagaaacctgtattttactacctatgcttgtcgatacgggcgaaaggtgctttttgtcgtttccgcatatgtagaaacgttttaaccacacagaacccttacttgtccaaagtttgcagaacttccgggagaacaagcggtacacatgttccatttccttggttcatgcagttctttcacgaacgaagacgggaaatatcgcttctgtgagggcaggggacttctggggtgctgctttgtatttcaaaagttcgttatcctacaccgaacacttccttctctggatcgtctgccgcgaagatacaccccggcttaacgaccgcgttcactgacaatttccacgcgtttaagataccgttcgtcgcaacaatgaggaaaaatcgcaaaagcatctccgcaaatggtagtggttgctctgactctctgtacctgccatggggctgacccaggatcgatccactgcaagaaaaaacggaattcactttgcgttgtgtctcggcgaatcgtgaaattccttcttttccccacacgagatgccgactcttcgtgttctagcagctgtaaatggcccacagaagacaacccgcacatctctccatattatagatagatgtctttttgtgtggacacagatatgggcggcgatacttcctggacagttcactcgaaatgttgagtcagcagcagggagaaattgttgcctttgctgaatagtgggcattccgcattaaataactatccgagacatattgtttgcttagccgcaaacatccttcttctcgatggtttgcgatgtttgattttttgccgggcagacgtctccggttttgtttttcctccgtattcgctatgctgtgactcggtaggtagcagtcccacctttcaccgttccccacaacagttccgggatttaacgaggaaatagtgcattgtgaatcgggtaaagatacctatttctgttggccgtaaagtcttcgaggacagatgattgaacgctgctgttcccttttttccgtatgtgcctcactctccaccaagaccaggtgctcgctccgaccgacaacttggaaagaacgcagagataggcgagcttggaaagttgaatgagaataacaatccttgctgtttggaaggagagacaagctctccaaatctgctcttgaatcgagtggagggaaggttgcaaagccatgcgctgttccaccggtatctccgggttccaaatatcctaaagccacacgaggaaagagcaggtgactttgcgtctttaaacccttctttatcatggagcttgcagagaaaggaaacacccgattcgctaacaaagcccttcaaaatttggatgggtagtcgaacgcgtaggttagacttcggagaaaaaagtcggttttagaaaccgaggaagctgtttcaaaatccgtttagagcggcactagcttcagctgtcatcctaaatgtaccgcatggcccctgcgaattttaggtcttccatggactctatatttcaagagagttgacttatcctccgtgcaattgttgggagaaaaaagaggaaaaactgttaaaacacttcgcgctgaacgctcggatccacacacacgggtctcaactgtctcgtctccctgtctctctgcgagcacctataaaggctggaaagtgcagtgccaagaaacgacaggtttttctagacaatcaaggcgtattttgccttcgttgctaagccaaagaaaaaacctggacgctatttctcctcctcgtaggtctctcgctttggcccttggtggtgagcaagtcggcagccacacaccagcgctgagatgtggagacaccgttggccttcctgcacaattttgaggaatctcgaccagttgagaagaaagaatttttcagcatctcacccgctcaatttcgaatttctcaccttgagaaagatgcgagaaatcctccagttttgtatcagttccttcgctcggtctgaccacacgtaccttgttgccacacagctggagcactgtcaaagagactgaggaaagaagaaagcctctgtttgtgtcttcagttttgttctttgcgaactctgcgtacatcttgtgaaatatctcgtcctcccctcttcggatttctctgattttccccttcttccccgtctctctgccgtgtctcatgtgctcgcttggtcgccagga

SEQ ID NO: 704 - DNA, 5000 bp, Toxoplasma gondii
atgccgcgattgcaaaacagccaagaaatcaacatggctcactacttctccaggacactgtttcggtccgcataagaaactcctttttgttatcatgagacggcgtcactcaacgaataggcgccagtgcaccttaccaactgactacgtcgggcgccgcagcgggtttccccgtgactgaaaggtagagagcagtgaagaaggcgaagtgccgatacgcttcgtaggaaatggaatattgctcctgtcgtttctggcacggaaacacaacgtccagatcacactcacgatcgagggaaagcagggagctacatagctgcgtcttctcatggaagcaagaaaagcaaacagagacgctggaaaccccaatactcgcacctgaaatgggaaaagcggaacaactcggtttctacctatttgacgttataccactgctgatagtacgcacttttctagtcgacacagtggcgtgtaatgacatgctctgtagataaagtagaacaccgtgtaacgtttcgttgcgcggcacaagtgtcgcggaattgaaggagactgcaccgccttgctgttcatctcttgcgcctcggggttctgtgatactcggcagaatccaccttaccttggaccctcccaagacgccggtctctgcgtgtgctgctcgaggaagagttgacttctttttcagtctctgcattttggcaaatgctacgaggaccgcgttttctttccggaatatcggcgcgtaggtgggggacgataaggaatacaagatatctttgaggagagttctagcgttccacagagaactgaggtgagcttcggaaacaagagaagcagagaaccgcccgatggccgcacaaaaaagtgaatgccaaggtagtcgaataaaaagctgcaaaatacccgggataaccacacgtgcgcaaaccgagaggcggacccatcgatcagtacaacagaactcgtgagggactactgactgaagaggaggtgccgacagcacacaggctcgaagaaaaaccaagtattccccgagatgtttgccgcaaggctgccattttgtttcattcaaaagttatacagttcagtgagggtgcgaagacataaaagcgtggcgcaccgaaagcatgccacacaggcctgcgctttccccgctgtcgccgacgtatgtagaacataaagggtggattttcgacagacaaagtgcgcagtagaaagaggagaaacgctgttgggtctcggcgcgactccgaaaacaggcttcaaagtgtgtctggtgaaagttgccgcctgtcttgcacaactggggggcacgcagccagcccatgcatgcgtgctgttctgcaaacgagattccccaagagacgatttcgcgcctttttgcggaaaatataaactggaaacaggaagagaaatgttcagaagtgtcgctatgctcgcacaggatgtcatactggtgaatttgtgtactgcgcgtaaaactggagtgtcactgagaaggccgcggcacgcagcaaaccgatgggtctgttgttgattgctggtgtgtgatgccacgacgagatgtgccacacaaaaggattgtaactcccgtgttttgcctgcaatatactgtagcaagtagcagaactgggctacacatgttgtcgccgatacatgttgttgccttctgtgtttcgaaattcgcgctgtctgtagttgcgtgcgacaatacaggcagcggtcctgatgaaatgcttggtgcagtgcccagctagaatcagagaagttcatcatcttccagtgattactccagaaacatcgccaggcttttgtttttccctctccggagaaccaacccacgaaggtgaatggcaaacgtagggcaatgcatgcacgacggttgatcgctattcgttcctgttaccaggtcttgtttgcaaatttctaacacacaccaaaggccgttcactgcagtcgaattcactgcctcagacattgcaatgcatatgatggtccgttgtgagttgacttgagatgaactcaccccctctgtgtccgtcgtaagttcgatccaaggcatcagaccaaaagggtgtaatgccgtgcgaactaactcggtcaacactgccgaggaaccagacttcgaatgcgcccgggcaatgcattaagaccagtacagttttctatcgacatcaaatgcgagaccgttcggtgtataagcagctgcttctaacccgttacagcatgtgcattggcacgaagttgtgtgggatctgcacaaggtggctgaaatcagaaggctttgcactggatgggaaacgaaacttcaaagctcttcgcatgtcacgaatgattcatcggccgctttccttcttgatgctttcttaccataaaagggatgtcttccactgctttgtcgattcacgggacaacgtgggcggcacctctgcaccccgacacggcatgagttggtgccagtctcgtcgaacacttcttgtgattcctgagcctggcaactctagtgcttggtgccccatgggaggccgtggcgctgtttgcaaaacaggccgttggtctgcccttttttcttttctgcattaaggaacccctcatgtgtgtcgaaatgcgaaagtcctgtcaggacttcaatctccatgctcggaagccttgccaacaggcggtttcactcacctcgttttcggggacgtttcatttactcgaaaaaaagacatccgaaggtttagcacttgaatccctggagagaatgcatggaccatagcgctgtcgagccacgttgccgcagcctcaatcgtgccatggcattttacctgctttcaaagtttggtaatgcgccatagccaggtgttcccacgaacaattcacggaagaaagagcctgtgaaccctggagttccccaacggcgtcctagtcttcacaattccacaccattcatgtgcggcagcgaccgcgtgccgcacccggtttctttcagggctgaaaactatcacagaaacagcctgtgacaactttttaaaaaacaagactcaccgcctttccgtgcttcccagtgtggctcttctgtggcctccactttatcagacatgcatcagtgttctctcaggatggctctgtgtcgggtaacacgaagcttcattgccagtatccgcgtgcacttaccgtacagcccgagcgctatcaacaagtagaattctgtgtctatctagcgctgcacggaagtggggatgagggaaggtcacctgtgaaccttcgggttgaaaaatcaacatattcgtggggcgatttgagagtctgcggtcgtgcaaatgctccacgcgtgaagaaacggcgccttcccgttgaaaatgatcgattgtgtcgctgtatcgatctgttttcggtgtgctgacgttcccggtaccagcaatcgtttccctcgtcccaactgctggtttcattgctcattttttgagcagcaagtgcacagattttgcccctctcttgctcacgcaaatccccagtctttttagcgcaaaaactgacgggaaccaccggtcgggtttcctatcggcgcaccgtattgagaccgaatcacatcgacaccagctacacaccaacccgtatttacgactgatgccataccactcgtcggctttccccccctttttcttcgcaggaccagagtttttccgaatctgcatgtcctcgaagactatgaatcatccgtcgataaggttcaatgagggacttgacattttgcggttgtgtcgtctatcgaattttgcccctccaggcacgcttgatcctccatagtagtagcggtcacttctgcgtcgtcgttcgcctctcccgcctgcttgaatagcggtttctctcgagcgcctgtgtttcagcgttttgtgtctcggttttccacggaccaattcgtttctcatcttttttcactggcggaggccgacctgattggtaatctgtatatcgtaccagccagagaggccatctcccactatctttcgcagccgacgtagctgttcatgtggcactggggaatgaaccctcggctgccgacaagctattccagtgagactctgagctaccctgaaagccggttcgaggtgcttttttgcccggaatttttctcaactgaaaaaactgccgaaatttcttgtcgagcgcatctttctccgaatgtcttcagtttaggaccgaggagaaacttttgtggcagagacacggcacctggtgcctacctcccgctgcttgttggcggtgcgtctttctcagagttgcggagaagccgcgttcgcccttttataactctctgcgttgagctaaaattattttgattttccttcggcggcatctgaaattcactattttctggcgtttttggcaaccaatataaacttgccggtggctacttttcttcaaagacgaggcatctgtctgaaaaaactgggcatggtctttgtgaggcgggtgttgtcgcaacaagtctgtcgctgtggctttctgtcggtcacgacatccgttttttttctcttgacgcaagcgcctctctctcggatatttttctgaaccgacctcccagtggctttctccagttaccttttctcctgctgcaaggctgcggcgcgaactggtggtacagcctcgagcatatagtagccaaggtagagccacgtctcgcgggcgttggacaccgtttccccactctttctggaagctttgttgggcgacacatggctagacctgcaacgggataacggtttctagtacacaatgtgcgtgagctgcgaatccaccttccggcgggggtgacgactgtgtgtgaacatcggacgcgcttcgtcctctgcagccgcctgtggagcggtgaagtctgccgtgcagcactctcgctttttcgtgtagtgtacaaagacgaacagggaatttctctgcgcctcgaaatcacggggcgtctcgcttccggactccgtagtctacgcagccccagacgacacgcagtgcaagcaaaa

SEQ ID NO: 705 - DNA, 2660 bp, Toxoplasma gondii
acgatgtgcagcagtttcgcgtcttcagcctcgatctgtgctgccaccggcgcttcttcgctctgctgtgtctcgcagagacgcgcccggtccctgagtccgcgcgctcgagcggcttcttcgcgtccggacgcgccagtctccgttcgcgcgcgtggaggcgaagagacactctgagacggagcctcgactcgagactgcagccgcgccgcagcctcggccctccggtgtacgaggcgacgcaccaacgcctcgacttcgtgcgcagccgccttcctcttctcctgacttttgtctcccagggcgcgcagaatctgcggagacaagagctcccctggatgcccagcctgggagccggcagacagcgcagccgaggccgagtcgcgcgacaaagaaaacatcttgagcagcgaaaagaagaaagcgagaacgagaagagggacgaggccaggacggtgcgagggcgaccaaaggaaaacaggagggataaagaggaaaacaggagcgataaagaggaaaacaggagggataaagaggaaaacaggagggatagaaaagagagagagagaacaagagggaagaaggatgactctctttcggtatttctccttttctctctcactcggcctctctctctcctttcgggacctgcgttgcgtccttcctctttcctctccgctctgcttccattatctctcgtctccgaacgctttgagttctcttctctcctgtagactcttgttcgcaggcgaagagaaggagaaaaggaaggacccgcccttctgcgatagatttccgaagcgtttatgtctgaagccccagctgtatcaggttagagagaggagatcgaggagggagcggaggaatacgggagagtaagagaaaatcggagaacaagaaagagagaaaagcctcaacctacaaaggccggacacagcgaagacgaggcgcgacggcgacagagacggaaagaaggggagaaaaagagactcgccagcaaaggaaaaagaaagccgaggaagcgaagggcagcagaacgagaacgaagaaaagaaagttatgagaggaggaatgaagaagaggaagagacgctccgaacgtatgaggcagttgtcgaagaagaggtcgaagaaaagaagaaaaacgaggacgccagcgtgtatctttcacaggaaggcacggacaactcagcctcgacgaggcgagctctcgtcgccacagagggatcagaaacatgtaaaaatcacagtaaagatggacgaaacagaacgagggagaaggcgaaggagagaaagaagacgacgccgggctcaggatttaccacagttcgttctccgttgatcatttataaagaggagaaggaaacgagggatcacagtttaggaaggaactggccttttacgacgaaaggaaaggaacctcttctgtgaaacagaacagatacgccagatctcgagtccggtgtcccgctacacacttccgttttctagttttttctgcctttttttctcttgtctctccttgtctccctccatctctctcgcctgcagcgagacagtcggcaggcgcgcgtctggcgctgcaccgtcgaccgaggaggagaagagaagagaaaagggaacaaaaggcactctgaagaaggaaatctgcagagaagaaacgctcgtttcctcactcgctcgtggagagaaatctggagtttctcctcttcgcttgggacctctcgccctcccgctgcgctcccgtttttctcttcagcctcgagacaaaacgagtgcctggtgtctccgcgcttttcgcgtcctgtgctcacttttttcctctctcttgccgtctccttcttctctttctctctgtttcccctagtcgaccgttggagtttgctcttctcccttctcagccgaccccctgcgtcttatcgtttctctttttctccagttttctgtgtctccttgtctgtccctgatgttccgcttcccctcctctgcgccgcccatctttcttctcttctcttctttccccctcatgcttcgtttccaagttctctctcgtccttgcaggcgttcggtctcgagtcttcttcttcttccacaggacaggaagtatttcgtcctctcctgactccgcagacctctcctttcccctacgcgtcgcctttgcctccctttgtcgtcttctttttgtgaactacgtctggctttctcttccgctggatgcgcggcgacatggaagcggagagagagggaagaacgcacacttgagaacttcaacaagagccccgcgactgtgcttccgaaaaaagaatcgtcttctccgcctgtctgttccgcttgtacgctttgccttccttgtccttttactctcgctttcgtctcctctcagcttcctcccgccgaactccagactcacagcagaactcaagtccgtctgtcactgagctgcaggttcttcctcgtcttctcctcgctgtccttctctcgttgttctctctcttttcctcgcgtgcagctgcggcttgattccttcctctcttggacctcttgtctgacagtctgtctctatggtgcgcctccacctctccccttccgtttctcttgcctctttttcttttttctcccttgtctgagctgtctctcgcttcttccttgagctggaaagaa

SEQ ID NO: 706 - DNA, 2630 bp, Toxoplasma gondii
acttcgcttccgggccttctgaagacttctgtgacgactgtctctgcttctccaaagtcttctctttctgcttctgcggcgtcccccgtcggactgcggacgccgagtctctgcgtctcccgcgtctgacggtctgcccaggtgtatccgtctgcgaggctccagcgagcgaggcggctctggagcaggtcgaagcaggtctccaagtggctcatggcagccgccatcttctgctgcaggacgtcgaagaggggaggaaggcggtagatcttcccggcgacaacggcgtagacgcggagaggcagagtgcgggtggcgccatgccgcgccgactcgcggcgcagcagggtgatgtgaaagatcgcctgtgcgttgaagaatgtgcatctggcggcgaagtcggagacagtgggagcctcggcctggcggtcgcgagcctcggcgcggaagaactggggtgcctccgcgcgaaggacgtccagattcgaatacgagaccgagaagagcaagccttgcaagtccgcctgcagacgctcgccgcgacgcatccgctcgttcagcgtttcactcgcctgctcgacgtagaagggggacaggtagaaatactccagagccgctccctcagagtccagtgcatgcgaacacagccaccgccaatcggcaaactccagggcgcactcgcgctgcagagctccttggatgtagcgaggaaacggcggagacgcagaggcaggtgcagagccaggcgcagagccaggtacagaggcaggcgcagcggaggggagagaagaagggagagaagaaggctcagcggagcaggcctctggcgcgcgcatggtggtgtgcaggcgaggaggttcgaggccttcttcttcaggttccagtgggaggccctcccagcaggcgtctgtacacccctgcgcgcgtgtgggcgagagcgaggtcgcctcggcaggggagacaacttcttcgagtgtctttcttcctgcttccgctttcgcagagagagaggacggaagtccaggacgccgcgttcgtctcgcgaaaggcggtcgccactgctcttgatggttttttctgcgtggagctcgccttcgcggcgttttctttcaaatggaagttcgtgcatgcaagtgtgacggacgaagggggaaaactgcgagaggaccatccgctgcgaaggcgagccgcctctgcggccctgaagagaaacaacgcctctctctcgccgccagacagaagaagagaagtttcacggagaaggaaccgcaccaccgagacaaagacagtcatgcgtcggagcgaaatccgccttctcccccagcgtctttcctcccgaagcgcgacaaaaaagacgactgctttttcggcgcgtggcgagatgcgctcggtgtctgtacacctcagagcgtgcgtctctgcgagagaaaaagggcgctgaacaggcgaaacgaaggaagagaaacgggaagcgagaaaagagactccctttccgttgttattttcgccagtcgagtttctaccgactccgtcacagagtgcacggaacaatacatgcaaggttttcttttcgacatgcaggtgtgagaggaagagaaacagcctggagtcacccattcgtagaaaacgcaaatgcccttttccctgttttcggtgtcactcgcgaggagaacatgaacgaactgcgtctgctttttggactcgtccttgtctcgtaaatcgcctttctctgacagaattccttcagcgtgcccgaacaccgccggcttttctcgcgtctctgtttcctcgtggatttttctttttccacctgctaaacgctgtcttgccgagcggaactgcaagctgctcccatcgccaggctcttctttttgcggacgtcaacggagagcagtccctctgcggcgtttctttccttctctgcggcttttctttccttctctgcggcggttctttccttctctgcggcggttctttcctcttttgcggtgtttctttccttctctgcggcttctccgttcctctttcctcgtcacgtctccttttgcctccaggtggttctctgtctccccgttcctctttcttctccaactcccttttcacacttctgctctgcgtctctgttcctcgtttcttcccggcgccctgggctctcgtctgcggtctcctctctcgcccccgcgtcgacaatggttccgtccccttcgggtgtacatacacctcgctgccaggtttgcgtcgcccggtctcatgtgtgccagcctggcagacgccgaggacgctcttctgcctcttagagggacggtgatttttcctcgggggagttggtggtgcatctttcttttctctttttttcggagaggctctctcttctctttttcgcgctgagatagtgcatctccttcttcttttcagagaggtagcgcttttctctttcccctttttctgaagagacaactggatggttcggggctttagcttgtgcccatgattcaggcttccatcctggctgtctcggctttcttcagtgtgtgccccttccgtgttctcttcccctgtcttctgcgggggatctgtctctttccttcccctcttctgggtctccccctctgtttttccgcaggcgggga

SEQ ID NO: 707 - DNA, 4317 bp, Toxoplasma gondii
aagacgaacaagggtcgtttcagcatcactgatgaggaaacatcgtcgcctgcctccatatacgcccgtctcaccattgtatctgattccaaaaacaaaaaggcgtctccaggtgtctacgtggagttcggacatacacccttgtttgcagcccagtgaagtgtgcagaacacaaggaaaccacgaattgtggccgactacaggcgctcggaagacaggaactcctcaagatttgacaagatctgtttacacagacaaaggtagcgacgcatacggaaaaatgcagttccagccagacacatgtacgcagttccatgtactttgggacaggtggcgcagcgttgcgtgcgggtgcatacctttaagtagtatgtatgcatagaaacatgctcatatgcatatgagtgtaggtgtggatagttttttttcgagggtatgcttcagccagctttcagacatctcaagagttttgccacgaaactccgcagctgacgttgtaaggcggctgttcacaaagcctacattgacatgaatgtgcacagcgacttgctgatgtaaatgtggacacaaagacgggaaagcgacggaattaacggttagttacacactcacacacattgagttttggtgatggatagaaaaaaccaagtttacatcgtccttacctccgagtgcaccagcccaggatcctatgaaaacgacgcagacccccgcaggccagagagcggaaagctcaccatcgtcctccatttttcgagtgtgtttatctgtttggtctaccccagttccttcctcagctctttgagtccgccgagagagggttgcttctagagagaagttgaggaaaagtacggcttctgaagacttccgcggtcgataaagttcatagctaagccgcgaaactcctcactgctgaagcccacagtggaacctcgaaagtgccaaggcatacaggcaaattatgccgcgctcgccataggcgccttcatttgtctccgctgcctctctgctgcacggaggaaaaccgaaaccttcatcctcgttgcacgaggctaagagaagcgcgactgtttctagcagagtgtctagacggagaaagtgcaacaggcaattgtcaccgtcaagaggcgagcacttcctctacacctgcagtatgcgaaaagcaaaatggatttcctggtatttgttcggcctgtgcagccccgaaggaactctttccagcaaagagaacgcgagcgattcggtgttgagctgaggggggggacgcaagaacgccggggcatggggagggggtttactaacgaggagatatgaagcaaagaacggagcttttaatgtggctgaatcacaaacggagagcctcgagaacgagggcattggtggaccctctgcgtccgggaccgggaggctcgccgtaacgcatggagagtaaaggcggagactttgcggtgaggcgagaaaataaatcgattggaagctccggacttcatgggctttttagggaacacacaatctacacttttccgccaagtttactagaaaaaattacccagctcgcacgagagggagctgccccatgaggggtggcaacgacccctaggaacttgacccgaccttggtatagccgctgtcagggaaccattgctccgggatagaagagtctttgaaagtgtgaagtatatcgagcaaaaggtcgtctgatgtgcatttcttctgcttcttctgtgaaagacaggccatacatgcggtaaaactgcaaagacacggtggcttttcacgctgcgaacgcgcggcccttgcaggcctctcggggcctctgaaagaaatgcagtttggtatagatccagaaagcggtagccgtcggtgcagatgcaaacgttcttcgttcagaagaagctgactgaagaaggacgccggcaacttgacgcacctgccgttctcatctgcacgttgaggaatctcatcgagacatgcaactccctcaggcatagtcgaccgcaacggcaccccggggggtaatctgttggcgttttactcgcgagagggttcggtgcggcccttaggagcagacacgacacgtgctgctcgtttttaagagttcgaaacagcaaggcagcttaaatttccggatccatctgcataccagaagaacacaattccgggtcccctgtgttccttgtagacagctggttcttcgggagggccgggagccgcacactgacaaaagccagcctgcccatgtgccgcttgtccgtcgacattcccttacccaaaagcaaatatatacattaatatttccaggcaggaaggaacgagcgctgcacatcaacactgagggaacgctagtggactgcctgcatgtttaggttcaccgctacttttgtgtgcccgcgtaagccatgcggtcgcctcactacaacattgatgctcccacaatagcagcgagagcggttgatcggcgcttactagcgtaaagcactgttcctgcaaaccggtaagtatctaagtcaatgttctcgtaagggtaataaactgtgctgcagctttgcccacgtacagttatggcagtgtgatacgaccgtgtcgttctggtgcgcgtggccgccgcatccagagatgtgaaacagataagtcgaagtcagacgggagaagcaagggacaggcagagacacagaaagggatgcgagaaggagaaaggcgcagttggtacggggaaagaatgcagggagaagacacagcgtcagagcacgggaaatggcaaaggtgaatagacgcagatgaaacgcgagaaatggtagaggtaaagcgcgacaagagctcaacgtttccaccatcagcagatacaagggaagaaagatcattggttgagtaacagagggagtacgaaaacagagcacactcgtcgactcctgtccacgtcagttcccgagacgcacagatcccatcctttctcgatacacaaccgaaatcacaacccctccaaattacgacagcattcctctcgtttgtctctttgaatttaccaggaacagcagatccgacccgcagtgtctctcggcatctttctgtcgtgcaagctggcttcctccggtagacggaggccggtgcctggttaacccgaaattcgcgcacgacagatgactgggtgaatgtagaaaagcgatcttccacagagtgtatgtctggtcctaagcattcgtttcctctttcgtgagtgctcacgaaagtgactcataactgcactgaaattccgttgctagggagcctcccgattcttgactcaagtctcgtgcctctccgacactcacgttcatttcgtcaatccaacatctttaatttttgatgcttcatgaaggcaaggctggctgtaagcaggcgtcaccttgcagtttttctgctgccagtttttggctcccgagatacttgtcccagagcatttgggcgcggcgttcctcgtccggtagctggttcttagagaggggaggaactcaccccactcagtgcttcccccgtcaccgcattttctgtctgaggagtcgcatgctttcgcaagcttctcaaagactgctgagttctcgggaattcataccgttctttgcacacagtttttccaaccagtcaaccaatattttgtcaaacctcgacgtccatatctccccataaggaaactgagggatgtacttgattcacaagtttaaggatacatctgctgaaatcactctcttggcaacaacaccatcattttttggtcagtggagcagcggttgtgtatttgtcagtgctccaaaaaggcggtagaggactgccctcacgttcgttttctccatctatcgaatttacacgttcggactgaggtgccgtgtctgtacttttcggaagacacctaccatttctcttgcatattttgagaacccagagagctaaatgtgtctcgtccgtattgcgggggcgaggcagtcacgtacatcgagtgccggtgtaagaatatcctttgcaagaaggcatatacatgcatgtgcgtattcggcggcaacttaagtatttacacggaagcgtgagagcgaccgaaacatagaaaagagttgtgtgcgtgaactccacgagcaatcgttgacttgagtgagttgccccacttttggcgttgtctttgacttcagaggaaacttcccagaacttcgttcattttccttggcgcataatctccatcgctttcctccttgccgctccacggctacttggttccttctttgaacgcaaactatcttgaagagtcgttcccctgagggaacccacgaaagctcgaaaacaggttcgaga

SEQ ID NO: 708 - DNA, 4845 bp, Toxoplasma gondii
cgacttcacagaagaggatgatgagacacatgaagatgcctagccctctcgcgcgcttgcagaggctccagtagacgtagggggtcgagacgcgcgtgacctcgcctatggcaagttcgaacgccatgatggggaggcaaaccaagaggagggctgctgtgtagatgaagaagatccagcctgcacattcatacttgagaacttcggcccagagatcctccatcgactgcgtgctcaccaggacaatcacgcacaggatgtacagacaggctttctggccccagtagccccggtttcgctggcggtcgagccagttcactgtgtcggcgtcgagcgtcctgatcatgcgagggtactccagaaggtcggagagcctcgcgacctcatctgggctccgcgatgcaatcgcagggttctgctccgcccacacaaagtcttgcggaaggacgtccatctgcgtcccgccagacaaccgcgtcacgacctcgtggagagcctggaggtgtgctcggctgtggttcgaagctgcgtagctcacacttcggtagataaattcgcgttcgagttctcggcgggtcatcgcgcctccgtctgggaagattcccgccacgttccggtacaagggacctgcgcgaaactcgccaatcgcctggcgatatagcccgcgccgcgccgcttggaagagctctgcaggtgtcgccagagtccgcaggctgctgccgacactcgtcgaggaaaccagcacagctgcggcgctgctttgagacttccagccaccctgccctcgcgtgggccgccgcctgaggctgtcggaggagcgatcgcgcccccggagtagggctccgtctgaggcgttccgccgcgggtttggcatccccggcacaaccgctgggaagctgttggaagccccaacgtctggggcgtggctgttgagaggcgggggcacatgattcccagaggctgtgagtctctttgtgtccaacttcaggagctccgtatcgagtgcagggacaggcgggcgaggatggggttccctggtggaccaccggaggcggcggggggtcccctgagtgtccgagcgcccgccatcggtgcggtaacctgcagagaggtcctccaccgtgtctgcagaggatcgctcaaggagtgtttgtcgttcacatgcggcacctggtgctcggccgccgtcaggaaacttcttctcggatgctgcgtgaacagtcagcagcggggatagcgaacatacgcttcgaagacagacgcccgtatccttggtcacgtggctaaaaccgtcgacagattcgtccttcgaagaggtccattctgacaagaaagctttggcacttcccgtcccgaaggagtctcttcgggatcgcgcccccatgctgagacgcacgacgcgaagccccaaactgttcaatctctcactcgcatgcgaacatccgggcgtgaccgcgcgacctctgtcggcgacacgcaccgcgacccctgcatcatcgaaggcttcctcttcggagtcttcgttttcccctttttcgtcgtccgcgtccccctcttccactgtggtgtgcgacggagcctggcgcgagtgccagggaacgagggcagaaatccagaaccttcgagattctccgtcgtccgcgagcggaggctcgcgagttgagtcacaaggaaagttaagggaatgcgacgggggtgcagccgggcttagaaggggagagacgagcgggctaaactgcgtgagcgtgtcgggcaaacttgacgcggggtcgccgctctgctcgccaccctttccacttccatggcagaagtggcggtggccttgtcgtgaagaaaacgaacgaagaagcaattctgcaggcacggatagctccgtctggaacaggtctgcaaggtcggtggtgctcagcggcggaatactggcatcctgcgccgccgactgggacgttgctgaaacctcagtgagcggcgcagacgaaactccttcgaaggcgcagtcggcgggcggccggccgcggatttccgagtgctcggtcgtcagcgaggagcactcccctcgcctggacatgttggattgcgggtgtcacggcggcgaccacacagcgcgaggagtcatgctgctacacaaggacagaatgcgacgcttggtggacgcagggtcgcgcaaggcgatccgtcgttccgatgtcggcgaaaacttagccgaaaaaacgagtctgcaggtggacggtgacacccgcgatagaacgacacaggaactggactgtctgtacaccgcacaggcgccgcagcgcagcggattttgaaccaggccgacggaacctcacaaaccactgtcttgactagtggcaggaaacgaaaagtcagctggggcggacaatagaacatcgacgggagaatggcgaatccgccttcttttgtttgatactcgaatttgaaggcgtccaggaacttggtttcgtagcgttccctatcctttgccagttcgtgcgttactctagaaacagtcgggggcgtgcgggattcgcggtgttcccactgccacttcgtcccgaaacggccaccgtccagcttgccgtccacagaagactaggggaaaatggtaaatgaaacaagggggtccattcgcggccgagttccgagattcctcagagcaagttctttacaaccagctcaaaaggcgaagatgagccggaagagacgcccgagccgacgtgcgcatgtgtctgcacagcgacctgtctcgtgtgcccctcgcagttcggcaacgttacctcttcgattctccagtaatttccgtttccctttcgcgtttcaggccagttcacactcaactaattacaaaaatgcgaggaaagggagtgcctgcgggctgtaccccagtctcccggcttctttcggggtcaagtagacatgcgacacacagtcggagacggcaccttacccccggagagtccccgcaagagacggatacccacactgcttttgagtcgggcaaagaaccgccaacgtgaagtcgacgtactaagtttcacttaaagagttcgagaaacgcaagaactctcgaggttctcagcatttcacggggcaaagctgcacgacaaaaatccaatcatgccgatgaggtccagcctgtagtagtgcaattgccgccagtcgcagatccaaggacgcggagaatttttatccgacactactctaacaggtgctcggatgcaacttcgctaaacagaataaaagagctgccaaaaaaggtcaactcatttgtcatctcaagttgtgagctagcgcctgccctttgcacatgtccattctagtctcacctcggtgcgactgagacgcggctggtgtggcagagagaacagaataaatgcgtggtgtgcacatcacaccgtccggaggtcaacagctgtttcttcgcagtggtcttgatgccaggcagctagaaggggcaattttcaagatgttgagcaggttcgattccggcgtggctaagacagagagaacagcagactgtcgggaacctttttgcttaacaggagctcgtcgcatgccgttttaatacttgcctccatcgcttttagcgcctgttggccacaccaagatagcagacgcgatccgcaggacaccaattccgttatcaagtctctagaaaggcgacgcgttagggacgtgcagcgtgtcggtcctgctcacgttactaccggaacagcagctacagcgatatgaagctgaaaaaactgtcgaggacctgaataatctatttgcctctattcttcgaaatctttttccgctgagtcaagggatgtcaggacctctgcatgtcttgcgagtgtttacttgtgtcaccatctccgtgtaatgtcctgttttctgacggttacggttaagcgcagggatagggaggcaggtgtgccttaaggaatcggccttcaaaaaaactactagacacgaacgagcaaggagcgatgtactttggagacctgctagcgtccagactgaagtcattctcgacactcacgcccagaggtgcaacgcaagaaaagcgccatagggtttttctgaaatgtcttctgtgcaaaaatcaatttagacgcgaattcgcttgcgatatcgattgacgtgaagtgatgatgcttcgttcagctaacaaccgactcaaaggtcaagaagaacttctacttcctggctgccctacgtatgtattcaaagtcggacggagaaaccgtctgccgccgcagcgaatcatgttggcaccacagaccgcacagattgaatccattgaatcaggtggactcatttcacagcaaacaacagacagatgcagtttccctttcggatggtggctgttcgcactatgacagcacgacgcgctcgcaagggaaatcaaagagcaggtttgagtctggcaaacgagtgtcacgaacggaccgtcactggatttgtttatcttcatgcctagtaaagtacacctgtcatgctacacaaatgctgcgcgcatccagatcttcttgtgcgcctgtggctagaagtaaagagtctttctgaaacgacactcacgttccgcagtgtttaacaattactcttacgtgcagagggaaagaaacggaaatttgacccgcagccgcacgtggttgaatcagtcgcaacataatacagttaggaacatgaaggtctctcaacactacgagcggggcaacggcctcgtacaaggcaaggctagcgactacaggttttcagcgagggctacggttagtcacaattttccttttgatcgtttttcgtttgatcggttgatgtgagattcgatttccctaatcgcacttctgctgagttgcaaagcaa

SEQ ID NO: 709 - DNA, 1468 bp, Toxoplasma gondii
ggctgtggtcactgggtgcctttctctcgcagaacgctcaagttttgagggggttgcttttgtgcagcaagaaacaagacagtcagttgcaggcctgttcggcgttagtctcgttctcaaaagcatcctcataaaaatccattagcggggcacgggagagtcacgaacaaagccgcttgagatgaaaaggacaacgcacattttcagacgcgtcatgctgtgccatgcagcgcgaagtacttgcctaggagtgtgcgaggggacctttcgtgtccattgttttgtcgcaaatcaggtttatgaacatccgctgtgtccaaccatgacgttcaaatttagctcagaataatggcggggctatcagttaaaattagttactcttgccattatgacacgtttacgtttcagtgttacatcagttccgtggcatcttccaaataccaaaatcctgcgtccccagttctttggcatcacggtttcgacaaagcactccgtgtatctcttgagcgtattccggacactcctactctaatccgataactaaagacattcaagatctaaaaccagtatttcacctcgcagtataggctcgaaaaaagagaggaacaccatatcaaacttttttgcggggacgttttctgaaatgatacgcggtatgtaaacgtcaagcggccggtgtgaaaaatcttcaacaggtacgccaacagctgttgatgtgcgccgtcagccgcaatcccacggacgctacgctgtgacttggcagtagcgttctgaagcaaatgttatattcggaatactctgaagcccaacgcttgaaaataatctctggttctcatgggaagctctcgtgtaaagttgtggtcgctgccagcgaacaaggcgacgttcacaagaaatgcgtgccttgcggtggatctacaggtgcagataaaaagaaaactacaaaatgcaggacagcaataacaagtagtaagcaacagtcttgaccaggtaaaaaacaagagagggcaaggaatcgttccagggtaatggagcaaactcgtcattcagttccaagataacgcattgcatgccatttgaggaaaagtctcgaattgtgtaggaacgcgacttgagtgaggcggcagaaaaaatatcgcccccggattttccactgagagtgaaatgctctggttgttgcttactcttcacgcttcacgcaagagaaaagtacagcttctgcgcaagacggcccttgtcagttggccaatcttgtttcgattggcagaatgcatgcccgtggtgagtccagttcatagaaagcgcgcgcgggttttacgctactaacactaggaggtttccccgcatctttgttccttgtttggtctgcccgtttccttgtttgttctctttcttttttgcattgagagagggggagacgaatcaaaaggtcgtacgcctctcgaacccggcgcgaggagagactgca

SEQ ID NO: 710 - DNA, 2226 bp, Toxoplasma gondii
tgtttgatcgcagaaaacacaaaacacactttcagttccaagagaatgaaatgagcaatgcgttttttccagaaaaaaacatctctgctgcgatgcccgtgcccagtcggctgcgaccggctgagaaaacaattcatatgaattccttgaccaagcaccggcaaaatccgggcttcacggtgtaccagtaatgcttaggaacgcagaccgacattacatccatcttcgttgacacgatagaccggcattctcaactcttccccccacgggaacagagaggagccccggaccctctgaatctaactttcatttccacagttttcgtcgaatttgaaaagtgcaagtcagcgtttagatggtaaggtgtccgaaaccgcgccgtccggaggaaacagacatgcgttcccggtgaagcgttcgcgtgtgcttgggaataaatattcatcacgtttctgctaccagaaagctcgaaaaacctccactgtcttgtaaacgcaggggttctctcggctcttcggttgctggaggtccctgaatttctcccagcccttccctggcgtctcgcgaatcgactctccgtctgcctccgaaaaaacgagctcctttgctttgttagaggagaggtctgactcctacgcagggaacagaatctccactactaaacaagtggagttcggcgcctggccagccctctgctttcacgcgtctttctcgtcaggcccagtgataaagtttctccgacggatgcagcattcctgtgcagcgaagagactgcgagagttgttgttaccgaagacacaaaaccccccagaagcaagtgatatttcttcgcgctaaatgccgtcctatcttccgtttcctgcctctctgtgttacgcaaacttgttaaaagctgttttcctgtgagcctttcccttccgatacagactgttggggtatcggacggtcatccctagaaaggccctgtgagtcacagagggcgttgcacctttgaagctggaaaagtagaagagtgtgtgctcatgtactgatggctagtcgtctccagacttaggttttcatggaattcaccggaaacctcacactcccgtgtttccttggcatttagctgccgacgactttccccgtcatttccttggagagacgccgtgacgttctgtggcgctgacacacgcctccccgagccccgttgttttcgttgtttcttcaccgttttcgatgcttttttcgggagtgactctgtgcgatgtctgcatctcaagaaagtcgcgctttctgtagttttcggcgcggtttctcccttccagggctctcccttttaactatccctgcatgcgcgcgcacatacacatacccagagaaaaagcctgaacggtggaaagggaaatgacatcacctccgcgagtagatgatgcgtatttgaagaagaagcggaactgacggaaacgcgaggaaagaaataacatgtctggtcgacagcaggctaaagagaaaggcttttcgtttgagaaaagaagaacgcagagaaggacgctggagtcttttttcgacggagacaccgagctctctcaggcgcgaaacgtggacaacaaacaaatgaagaaatactaatttgcctctcctttttgctcttctcaagtttggaaactcagaaatcgaacgtcagaacgactgaagaaaagcggtctcctcttggctgtctggtcgccgaacccccatcaccagccccctcgcgagtgctctgccgtttacttcttcgacttcgtatgtcaaaagaaagagccatatccatttggataaatatatgtatatgtatatgaatatatgtatatatatatttatatttgaatatatatgcacctgtacaagtataaatgtgcatgcctatatacacatgtggaggtatgcatgcatctgcaggtgcgtgtgtaggtgtgtgggtccacgattgttaacttacaggtgaggtatgtttttttcgtttcgttttgttttctggcattctctggggccttctttctccgccgattgtctctccacgcgccgtctgtcgcctcctcacctctcgcgctttttcgaggcctcgctcttggccacagcgaggaaaggatcctcagccaagaagcagaggcgaatagaacctctcacaaaggcgagtttctgggctgttcagttcgtcgtggagcgcagacgcgacttttttcctggataccccccgaagcacca

SEQ ID NO: 711 - DNA, 3225 bp, Toxoplasma gondii
atataggcagtcagatcggttttgcggtgtttcatcccgttgaaaagaaaggccctgagacgatctctcaaaagagaagtgcatctacgagggggccgcacgaaggcagcaggaagtcagcacgatgttccctgcaagcatactgccgtgtgtgcgcttttctgtagtgctttagtgccacacgcaaagtgcgtggtgtcattttatcactcataatggcgctttcaagtggcattgaataggacgttaaacggttttttctcgcgaacacgagcatctgtgacggaaacgtgtggaagcagcgcttgcttgacgccacaggaattttgtgaagaattagcaattcaggggatggttgccaaaacaggagttgcttttttttaagcagctgactcaggctgtgggtcaaggagatctcactaattttttgcgtcaactgcgccatcaaagaggtctgcgaggcaacgttcggtagatgattagttctcgcacgtcaaatgcagcaagaggaggcgaacgctgcagacatccgagaaccacggaacaatctgaaaatctggttttctgaagaagccattcgagcaccttagctcttacgagtgaaaacgtcgtggtcggcgaaccagtcatggtggaagttcgtgtcatgatggcgtcgcgaaatcgaatggcgtatttctgaggaagcggttctgtcagtgtacggttattgagtcaacattgttcgtgacgtttcggtgtacagttctggaacagacggtggctggggtgttagaacaaatgtgtacgattatttcatgggcgcttttagcaactttatgttgtcccgaatttcaatgccaatgcacgacggtcgcaacacgaggccggcgcccgatgcaggcctgcaactgaatgtgctggtaaaaatgcgaagaaaatccaaaacgggctcttgcatattcctgcagcgctctgtgacgatttttgagtccttggtcgtgcaagctccactgaacaatcttcagcctcctgtgaccgcacggtggttgctcgccatggtgcaggagaaccgcattcatcacggagcccttgagaaacgggcgacccaggaagctccttgtcctcttttatcgagttgtatgttcatctgctaaagatggatggcgggcctcagcgtgtcgctgagaagcaagccatcttcatgtcgccgtttcggttggtgtcaaagcacctctgcagctttcccacgagctctgtcactggactatgtagagagtcgcagtgctacagagcaaggccaactgaacagagtggaggctatttccacttcaacacttcaactagcgagcctgtagtgctcgctccagacgaaacacttgccatgtctacaggtggtcagccactcaagagtaacaggagtcgcgtcagtgctgaaaaaaaacggtctgggcaaacgcccttaccacgatgtaatatcaccagaggtcttcatctgtgatgttttctcttgacgcagtttgcttcagtagaatgatgcatatctcgcatactgttaacccgatatcacagtcgaatatagttttcccacagcgccagcacagggatgcgtactagtggaagggacaagttctaggggggctgcgttggttgtgcttacagagtttttatcggctggctaccgacaaattccctacatgcgcttagcagctatttccgcttagatacaaacacgatcggacacgatcgcttcgtctgagagggtggcagcattagaggccctagaagaccggtgtggaaacgtgatgctgttctgaaactcggtgtcatgccaccgtaatctgccccgaacacgttcgtatatataggaaagtgtagagtctgataaggaggcgctgttcgatgcctccaaggtcactacaggatgtagcactaaagtggatcctgaaaacagacacattactgctgatgcggcccgcagaagcgtgcgcaagcgcaacctcttgcgtgttacatgaagccgtggagattggcatggtctcgtccccttgtttcttgaagaagggcaagagggcgtttttctcttgtgtggtaacgtagacagagtgtgccagtgtgtgtcggttgattcacgtgctggctttgatttgaagcttttttctctccgtttcttctccctaccattggcgactgatgtcaagaaaggctgctcgccgacagccagcgctttggaaacacaatcggcctggcgggcaggacaacttcttgcgacttttcgcataccagagatcggaacgtgaaccgtgtatacagccttcttgtctgaccagtgttctgtctaccaagttcccattttctcttgtcgtctgggcctccggcaacgtcgtgctttttgtattcttctttcgtccttgtgtagcgagtctcgctcgcctcccacttgattggctgcacctgtttctgtcgtccaactcccgtctccgctctgctgggccttggcgttgctcggcaggtcacttgtcagcattgttgttcactagcgtggcttcagttttcaaaataacatacgacctttccttgttacaatagttcacacccccggcttctgcctcgggttccgttctttccgtggtggcgggaggtcgattattgcgggtggcctcctgtaccctgttgcggcgggtcgacctttgccgtgcacacgaaaaccatgtaacccagaactcgtgcatgtgttcgttcattttgtatcaagtctttcacattccacattcgccccgcaagtacacatcccttctgtatatttcggggttcttcatagcgcctccgcacaccgtcttgtctccgagacgtccagctccgctcctggcgggtgccgataaaatgcgtggagaaacggttctggcgatttcgcctcgatagacgagcaagaacatccgggacatcaggacgctcaggaggtgagcgtgcaggtgaaacgattcaactgtgcagacaccaggaaccagccaaccgtcgttgcatctagtgtgcgcccgccacattagcgcagaacaatcctcgaaattcggagcaccacgaaatttgggactgaaactcccatcagaaatggagtaacgtttatggaagtcctctttcgcgtttctgcgtgttgtttgaaggaaactcggttcggccgtgaggttcatttccgtttgttctgtctcattcccggttctcgcagagactttgtttcttcctccacca

SEQ ID NO: 712 - DNA, 2054 bp, Toxoplasma gondii
attctggagatatcagcacaaagcctgtcccaactgtaccctcgagatagccataactgcatgctatgcagactcacaaatatttacatacatgtatgtatatataaacatatatatatatatatatatatgcaggtgtatctgtagatacgactatgtgcaggcatctccaggttgaccatgtgtcccacggagaattgagtgaagttacttgtgtgaatatgttgaagctttgcttgttggtcacgcaaaagctcgaggcggggaccggattttatggtgtttttctaggcatgtctccggtgagacgatgcgcagtgggggtctgactgccacaggtaaacgcgttagatttcgttttctcactgcagttatttccactttcctgcgtcgagaagcagtagacgaggtactgctttcgctccctttcttgcgtcctgagaggagagctcccgtaagcaagtgatccacgagaaactgcaatcttggatcacatcctacggtagagttgtgagatacggaactcgcctcattttgcgtattcagactctgtttctaaatcgacgtcaaccttcctttcgctttcctgaagcgtccttgcactcacgcacaaccttttacgtcccagtggaaacagtcgcacagaacacaagacgcctgcaaaaagcaaaagtttacaaatgcatccttttcgcgtcctttcccgtgtccagtccaccggcctcgttcgttcactttacagacaactggcgatttcgttcgtggttttcgctccctctgcgatggatctccactgtacctacacctgctgcgagagccgcgtagcaggagggaggcctgcaggccccttttttgggcttggctgcatgcagcgaagatcagcgaagaaactcggggaaagccaggaaacggacacagtgttcaggagagataacgcagcagacaagagaggcaatgcccgccagaagaggagaagaagacaattgttttcttcggtgtcctgtcgcgtcctccagacaaggagatttctccttcggacgcagtctctggccgctgtcactcaaccgagacgaactgcatgcgcgcatatgcttctctcgaaccggctagcggcgttcagccgaaagatccacaagaggggagaaagaaaaaagcctgtattcttctctgactcggtcaaggttctcttttcgcttgccgcgtccctgccttcgtcgaggctgcatctgccttcgccgccttcgcgctgcatgcgccaagcccagcgctcatacgcgggagacaactctatcgagaagttgagccttgtcgacttccagattcgcaggagaagacggaaaatgagaagcgaagaaaagaagaagccgcgagagagccgatgcgggaaacggaggcgcgatactggcaatggggccaagcgtaaatgagtgcgaacctgtgttttgactccggccgcctctcgcgggtgtcttcaagtgagcagtcacccggtaaacttgctttcgccgaaagcagaagcaccacgcgtcatgatttctctcttgtgtttgcgcgccgacatcagcttcttcttcctcgaagaggccgacgccaccggtcccagctgacaacgcttttctctaaagtgggtggtgccttgtcggagaacgacgcagttgcggctcctcactcagctgtacgtacacctgaacgcccagtgtcgcggcatcctctgtctcggtcgcgcctggggtgtctgtacacccggagagttcgagtggcttttttatgcggggacgcacgaaagggttttcagaaagcgggaaagcgcagctgcgcgtcctgcgagacttgctaacacgggcatttttcctgtgaagcttgcatgcgtttcttctcttctttccacgaatccggtctttccagtcgatgtgaaaagcagcagcggcctcaaggtgacgcgtggctcttgtttcgtttgatcggcaggtcccccctcgtggagaaaccaaagtttccttgaccttctccgtctccttttcttccactttctccgttttccgcggcccccacca

SEQ ID NO: 713 - DNA, 4339 bp, Toxoplasma gondii
gagacgaagagcgaggtgtgaagttaaagattgtacctgcctccatcagttctgccttggcctggaatgtttagcgcgggattcccctcgcctctagttcctcctccgtcgctgtttgcttctggaaaagaaggcgccatcgacccccgagcatgcagaccctgcagcgcgttggggtgcaaggttgtcggaggacgaagaggacaaagaatcaactcttgaccaggttttcaggcaagaaagacggacctgtggagccgctctcagagggcagagagagaggccttctccaacatgcctacaaagtaggaatatgtctgtatcattatttacatgtgaaaatatacataaatatgtgggcgcatgtgtcgaaggatgcaagagaatgtatgccgggggatgccggttgcgtaagaccggaaagagggagtttatcagacagcgtgagcagaggcagacgaagcaaatgcagggggcgaggaggggaatgagaagagactgaaaataaagagcaaagtcgcgaacaagaaagcagatcaggtgtcgtacgagaagagatgcagaaaagaaaagatgaaaaacgaaagggacggcgtctcatgccagtgtgaggagtgtggagcagaggcgacgacttcgagtgaaagttcgtattgaaactcggaaagcagagaggcggggactccaagcgcgtaaagaaaacgaatcaagagacgaagtctggacgcaaaactgggtcggtttccgcgaagagtcgctccacagtgggagctcgaacatcacagaaagggaagggaaggcgagagaaagactgaacttgtgagggaagcaaacggacaaagagcgaagaggagagacgcgtgaaaagacagaaaaaagtctctgcaagcagacatccacacgtccgaggcgcgcgtccatacctcttgtgcaaatttgctggcaaaaatccaaaggcaaaagtggcggctgtggcgatgaacgaggacgtgcagacacacagacagaccggtttttcgatcgagaaattccggaaattcattcgtcgttgtttccagcgagctgctgtgtgtgtgtggctgagacgcggtgagtctccaggccggcaaaaagtccgcgaaaaagtgaaagagcggggaaagatccgagcaggaagaaaggaaacgtccttttttgagacatttcaaacgaggtgaaggacgaggatgcaaagcaaacgttgctagcttgcatgcaagctttcggccccgagagtcacgagcgcgatcgtatactgcctgtcggttactccctcaaaacactgtcagaaaaagaagatcgccttcataacgctttaacgcgctttagcgcgctttagcacagcttctattatgagcaacttcacaagcactgcgcaggtggcggacatctacatttacttcccttcctcagtggcacgatcttggcggctggagtgtttcgcacttaacaccaccactgagtttgttttgctattggcactccgattttccttcgagaaatcagtgagcagaactgcgtaaagtgtagagagagcattcacgtgtttgtcagaaaaagagacaggcacaaatctcctcaaatggtcgcccccctccaagaagacgtcgctggctactccccttctttacacaacagttccagttcgcctgtctgtactttcctcgtttcgcctgtcagacggcgcaccgcatagccatgaaaacttaggtctccactggtgagaacattctgaacggacgtgtttactgaggtcgaaacgcaccgaactttggtgtctattaagctggaaaagcgaaaggttgcgaaaatgcctgtgccgcgcaaggtgcaagtcacaactgggaaacagaatcatcagtagacgtgggcatcgaacaccttcgtctcgtggtttaagttccctctgttttcaaatcgtgacatgtgcatgttactcccatcagttccaagcacaaacgcgccgagatgctggcgggtcataaagtgagtcgggtcataaagtgagtctgtctgttcggacagactagaaaatgggctgagcttttcacaacctagtcagtacctgtggccctccggttcgctgctgccgttttttacgcgaagcaccaagaactcactcgagtctctgcggtttaaaactttcaagaagtacatctgcaacggtgaacgacaaagggaacctgcaaaactgagtgagaaactgtcgctcctgtctcacgtgcagattgcaccttctaataaagtctgcttccacgcgtgggaaaaggagcgacgcagtgccactgttcgcggcaacagacaacaccaccgactcggaaacttttacgctgggcgcgactgcaaacgcagttgcacctacaaacagtgacatctgactcggtgacacgaaagagagagcaagaaacacagcgttgaaatgtgccctttcgctactccacagcagtcaggatatcgatgtcctcaggaaacatcacatcgagcaacacccatgcgcagtggcactgctgcttctttcatagccactggatcaagaaaaggcaacttggaagttcttgtcatctgctctcggacagtttgtgccccaaagtaggcaagaaaagcggacaatctgaagcagaagttttcattctgaataagagacttacaatgggcaattgcgcaaccgtagaaacaaccgctgcttgttgtgtaacacttgggacggttcctgacggaaaactacgcataactctctctccgcccagcaagaatgggcgatatgcaactaacaagctgtatggggtggtgtgaaactactgagtgacagtagacagttgagaagaagagcaaaggcagtgattccaagattattcctgccaacacggccgccgtcggcaccggtgtgacaagtgcaacagagaagacaccgagcgaaaagaattttccgctgactgtcgctttgcttgtttctcgagtgtgtaaacgtcactattcctggcaatggcgcgggtctgagcacacactgcgaaagcttcgttatgttttctcgtgtctagtcacttgagatgcacttcgcattccgatcggagtttgtcagcgccacagccaaatggaacctggaaaagtgaagcaagtgcgatagatgaaatctgccaggtagagagccgaacaagaaaagcgtcaagagcaccggggccgcgccaccgtcgaaattcattcgcaaaatgaaggaaagccaaccgtatccagtaacctagccaggacgaggtccagcaaactgcaaaaaggaaagaaatgcttccaataacggctgttgaaagaaagccgctctgagatcgcgttacttaaaggctcttcctaagcaggaaatacttcgcttgtttttcaggagtaactttaaaatcttaacgccagagtggtaatgcttgccactacttacacagagtgcagaggccatgcaactgagaggtcaaagtcaaaagatgaagtgagattcaaagcacactgacaaagtgttttgagatatcactgctgacccgtattgcgaatgccattttcttctgcaggctgcatgccccggacacggcagccattcgctattctgacgccgcagattttttttcaggccctgaattttagcgcgtcgaatgacgttgtttttcatggcctttccccaagctttccggccacagcagagtctccctagagtaccgggtgtggagaacggtcaaagcagcaacgcgattgccgttgagctcgctggcaaaagctcctcaagaaggcagagagccgcgctggcatcctgaagaccgggcggtcacttcgtagtgtctcttggactatcgaggggactgaagaaggttgggcggcccccgagaaaattaggttttgctgaattcatgtgcccgtcgagttctggagggcccgaaaaaacgcagcggcgatgtggagcaactaagcagctgcgccgcggttcgttgcatgcccggagatctagttttcaagacacggtacttttgcgtcagcgtggtaaagcttgtaactagcacgggaccgcgaggtcgatgagcgtgcagtggcaggtcgattcgaattgaacggagtccttgctgcggttttgacattggttttcctttctccgtgaaaagggcaggttctcaaaaattccctccgcaaccgcgaagaggctttcctgaacgcccgtccctgcagtgtctgggcgcaacagccatgagaccgctggcgccagaaaacatccggcggaactcttgttgacttttgctcgacgtggagagtcgaggacgatctttctttttcgaaaatgcccagtgagttgtca

SEQ ID NO: 714 - DNA, 2659 bp, Toxoplasma gondii
ttcgggagaaagcatcaacaccggaatcagttgtctttctcgttctctgtgtcctcgtcgcactctcttcatctctctcggcgcccctcttttgaagcgcacaatggaggttccggtgaagctccacgtccgtcatacctcaaaaacgcccttctgcacctcgcggcgactcggaaaagcgatgcagccatcgcgcagatgcatggtgatacgcgcactgcaaggaacgtaatccgtatgtctatttatatctatcaatagatttcggcagacacaaactatcatatatatatatatatatatcttcttatatatatatatatatatatatatcttggttcctgtgcatgataagggagcgagagacaggtgttctcacactgtttgacgtgattcacaggcgtcatattccacgctgaacttttttagtatctcatttttcgctctccaggtagactcgttcttgatggcactgggcggacagcgttcttgccttttggcctgtctacggttgtcgattaccacttaccgaggaaacacctttcttcaaaacagatgcgaaagacagcctgtattctcgatttgcaggaaacatcaatgtgtgcgaccataaaggacccaagcatcttaattgaaatggtacagcagcagatgcactgatagtcccttttcgtcttctgctgtgtgaaccgacactgttgcttctctctcctcctctcagttgcctttaaggcactcttcgtgaactgtcttctcaatgttcgactgcaagcgttcgaattttttttggcatgacgacacacgtctttcaactttgtcactgaaggcgcaaactgtcggctgcatgtgaggaaaagcagagcggcttttcgcttttcgcgatttctgattcttaggctatcttcaatgctttagttccatcacccgatttgtaggatcacaattatagaaaggcactcgcagtgttaggtgggaagcctcaagtttgtgtgttttgaggtagcgttctactaccaaaagaccgagactcgagataccggaaatactgtctgcgcacgcggtacagatgagtccttgtcggaaaaacgaaagagaagggaataggagaaagaaaagaacaagttaaggcagaaagtaaacaatagaggggctctctgcagatctttatcggtcatttgctggagccctgtatgtgagcaagccgaggccggcggcgccattccaatcgttgcgatttccagaagctgtcctgccctccctgcctttgaagactctcaagcgaactcgagaaaaggaactgtcacccgcaaaaaagacgattccttacacagtaaaaagggtaccttcccttgtgacccgtcttttctgcgtatcaaagaccgggagagtccaagtcgcgtttgattcggcgaccaatgctagactctttgaaaggtgtcgaggaaagcaaatagaccccgaaggggtattttccgctaaacgaaatctgcgctcttcagttagacattaatggtaaagttcctcctgccacagaaaggccaaaacctgttttgcacggagtggggttcgaacccacgcggtcgttagaccaggggatcttaagtccacccccttaaccactcgggcatccgtgctcgccgtccgctctttttctcagctctctttttccttttcaccgtccgagctccaaaggagtgacgcgaggagaaaaaagaccagcaccggcgaattgaagcccattaaagaagagccacgcattttctgtttgttatttgcgtgtcgcgtagaaattggcacaggcaagccagtcactgacgcttgtgtccggggacatcatggagtcactggatttcgaatccggccggacagtttgcgatccgacgcggttgagtttgctaacttcagtttgagttatttcgcgacttctctcatgaggtctgaaggcagaagagaaactttctggaccggtgttttcccctcaacgaaacggatgttttatgtgttttcagaaaaactagggcaaatgcaacggtggcgctcgacaagcgtaccaacatgtacgctttctccaagtggctgccccatgtagcccgaagagagatgtgagagaatgtcccatcgatacgaaacagagggcagcgcgtatttctcgaatgctgcattttatattgcttgctcggcgtgaggccagagaacagcatcgttcattcgagtctcaagtttgatgcctccggaggcgctgagagctgcacacagcggttcgttcactgagattgtagcttcatcgaaggtatgtagcacgtgcttgaatcgaaggtattatgctcccgtgcacgctatgggtatgtagcgcatacatgtgcaggcacttcccccccgaacctttctcgatttcaaagtgttcccgactgttcagttgacggccacaattcagtcctcaacagcggcgggtcttgtatgagtttacgcactctcacctcacgacgatgctttccggcaggttgtcctcaggggcaaaagaaagtcacatagcggatgacaaatcgatgccgcggttttgtgcagcgttttgtgcagctttttttgctctgtttgacggtgtaagtcgtccccactgcggcgcaagctccattgcctcttcttccggttcacaagaaaa

SEQ ID NO: 715 - DNA, 2976 bp, Toxoplasma gondii
ttcaccagaatatcgatgtgaggatactgctggagtaactcttcgcagagagcggcgacggccggtccgtcgcctacatcgactgcatggccgctcgctgagaagccgcgcctccgcagatccgccgccgcctcgtcgcaggctgcctgacgcgcaaacagagaagccccgcgcaaggagtggatgagcaagcggaacgaggctgctgtagcgcgcagcattcgaagttcgtaccctgctgcaactccgctcacgagccgtggaacgcttccgcgagccctaggcgaggaacagaaacgaagaggggaggtgaagagagaagctacggagacagcatgcgcgacaccgacgcagagccaaagagagagagaccaagagagagaaagagaagaagagagaacaggtcaaagaagaaggcgagtaagcgagacaaagaaggctagagatgttcagccacctatgtgtgtacatctcgtaagagagagagaggcgtttccctgaggaccgcgtagcaccggtcgacagcgccctcccggtggtgccgcgcttcggcttggcgctcttgaaaggggagtgaactgtctggagttcacgacagacgaaaaggcctggctccgcctcagactcacttgttgtctggcgacgcagatgagatgggatactccgccttctgcgagagcgtctgcaatcgccttgccgatgccgcgacttgcaccggtgactagagccacccgcccgtccttctctcccgtttcaggtcccccgaaagtgagtttgtacgccgagcagctcgtcgtcgagagcggccgcgcatcagaggcctggcctcgaaggaaagaagaaggagaagaagaaggaagggcgttcgcggagtgggcggagccgtcaccgtgagcttggatgggccgggaggaggctccgcggagaggcgccgccgcggagaagccgagagggacgggtgagaggaagcctgaagcgccagagaaagaagacgcaggcgctgtagacgcaaccaagcgcgcggagacagttggtgcgaagaagagcgacagggcgagggtgagcaggttcagggagcgggaggaagagggccttcgggccgtctggacggagacaggtgtctccattgcggcttgggagtttggacgagttcagggaagcgagaaggtctcgcgaggcagagtgtgcaggaaaaacaacgcgcagacgaagaaggggaagacaccggagagccctgcgccgcacggcagagaggcaggcgcggcgacttttgctgtgtgcagagaaatctggcccgacgggtggctctttgtctccggggcgcgacagcagacttgcgtttcgaaaaagcggaaaaaacaacggggagtcggattggtttcgcatgaacaaactgaagacaccgccgtgaggaaagaggaaaggaggtcgggaggcgaaggactgtgtctctgtctctggctgacgcgctggggaggctgcgcacacatgcgcggcccgcgagtcttctcgagacaggagacagaacgggagacaatttttcgggcactctgtcgcggaggaacggagactcttccgcgcttttcgcgttcctcgctgcgacaggttttcctttcaggatatggcaaccgtaccctgacgttttccgaaacgtttcaaggggactctgcgatagaatccccggcctgcaggccggacgcgttcgcgtctcgactaccccccgggcgccaggagacaagacgcccggaaaagagcagccgagagagcaaagagcgcgagcagaggaagctagcgtgaaggggaaggagataaacgcgagaaaacgccttctcgtcagagagagagaggcagatccgatcggacgtcggcttcgctcatggaaaggggggaaaagctacgcaacaacgcaacgagaaacaggagagaaaaccgccaaaggaaatgcgtcaatgtgctgaggtttcccagctccctaaaaatgtgtgaaaagcgtctagacgcggtccctgcagtctgcagaagcgtggaactcccgcgcggatcgtttgcttgtcgcttgcgccttattttttgaggaaggaaagggaggttttcctcctgttttctctgctctccgcgaatggagcactccctgcgttccacccacccaaaccggcattttctccagtttcctcgccgagttctgagagactcgcgcgaggcgcctctcgaggcctctgtgcgatggagacgaactcgactgagaaggcaaacaagccacccagccaggggagaaagcgggggacggtttgaaggagaaccggagaggcatcaggtggagccgaacgcgagaggagagaggagctgcgacggataaatcgacaaggagaaatgctcgggaaaccgcgacacagaaaatccaaaagggagacgaagaagcgacacacaaccggaagtcgtcgagaagtcgaagtcgctttttctgctgaaacggctcctccacgcgggggtggtttcgtcacaggcttcgctgctggaaaaaggaggactctcgatacgcatatgtgtacgaaagaaagaagtcgagagccgagacttcctctcagaggaggaaagctgcgttgtcgaccagtcgtcgtttcgccccctttatccgctgttcctgccaactcctcgtcggtttttctttgctcttccctttcttctagcgcagttccctttcgtgacactgcgttctctcactcgcgcggtctctccttcaccctcttccttgtcctcaaatcttcgactctgtgctcctggcttctgcgctttcctctccaaggccccgcgagcgacctaccgtcgcgccgcttttttctgtgtgttcttcgcctctcgcttcttcttgccttgcaggcaaaacgaggtcttgtttttttttctgcgtcctcttcttcctgagcctctccagctgccgtgtcgtccctcgtcctcgatggccttctctccccacaa

SEQ ID NO: 716 - DNA, 2561 bp, Toxoplasma gondii
tgttttggcaaggagctcgtgagttgaccctcaaagctatgcgtgcccgcttttagttcctgcgtcggtgggtggcagcttcgtagtatataagatgcatgcgtgtatagactatacccttgcaacactaaatgttttgaaaagggtaccctctaccgcgcaccgctccagaacagtccgcggcgcggtgctctggttgagaatgcgtgttgggcagcgttacatcaaaggtgcatacttatctatgaatccttgcattctgcagtgtagatatcacaactgggactatgtgctgaagcgatccgcaggcgccgagcatcgatgtgatatctggcgacacgcatcgtaagcggtgcgcatctttctgcgttgtcacttatttacaccaggcagtagctgcctttgcacgtagtcagcatgttgcatctcgtggcagagaacttgctgcattcctcggtgccaaccttgtccaaacactgataatgacctgagctactgagtgaattgggaaatccagctgaacagcggagcaaacgtccgatggactttgtggcaacatgggcactagcatccgttagacgagtaccaacaaacgacacaggaggtttatggtaaaaggcgtaacttcgtacatgcagccttgatccatctgggaactcatcgagtgcagtatcgcgaagtggcggtctgatgcagaagcgaactccatcaacagacacaacgtcgctatagcaaacaagaccccaaaatcggcgtcacgtgatttgcaaggaacccggaaattgtagtcctgcgatatttccagaacacgggtcgaacagagggtcgctatgccacccgtttcaaggcacgaggcaattccgccgtcgctgggggatcgctcgcattgcatgctcgtgtatttccgctgcgcctcgcagagcaggtatgtgggagcttttttgttatgtacgaggtagacgtatgctccgatagttgtagggtcttcaccattttttgcggagatgcagggaaataattgcactacgtgatacgcatttcagtgtaattccattgtgaaagtgacgcgagaagttttgttcattgaagcatcaggaatcagaaaaccttgaatttacattgcgattggggcgcgacatgacgagcaaacggctagtgaacaccagagtcgtcgtagcatttttttccagtttggaggtggggggcccaaaacagcgcgtagtttaaggtggagtgaacttatatgtctgcttcgatttgtcctgtgaagcctattcataaaaccgaaaccgcagctggcaagagctatttttcacgaggtgctcgcgaagtccactggggccctcgtcccacgccaaacaagcgacgagctcgttccgtaaagttgcttttggtgtgttttaccctcgaggcacaaagtgtttcctgaactgcttttgccgtgacattgttcaaaaggacggacaaacacccagtcaacgcgcacttgaacgaaaatgtgtcatcttcctagaaaacatagggacgacaagatcggcttcataccgagggaagaccttgaaactacaaggacccaggatccaagcgagcaaagacccgcgtgaatgagttgattaagattcatagagaccacgcaaaccacattctaccgttggcttctctcttgaccctcgtgcaacatttccctggtgtgttcaggggatatcaggtgacattcagacacgaatgcgggtctttacttggaaatgaaacgtattcgtgaaccaatgtttgcgggttcagatgatataaggcaacggtgtagtgatattggctccaaggacgggtgtgggttgttttctgtctctggaatgcaaatgcatgcttaaatgctatagaacgttgaggccggtcgcttcctcagcaccctcgaatgatgactgaagagaaacgcaacaaagccatctactgctagaacggggaaaagtcaatcctgaaatccaggttgcgtgtgtggttatgtgcaaactgtgttcagtatacgtctcggtgtctgattccatacgtacacagaacgcagtgatcaccaatctgttctctttacgatggacatacttagaagcctttttctgtcatttggaagataaacagttacgctctctgcgtcgttcgaggcagctctcacacggtttgtgtgacggaacaaaagtgtagtccttcttttgttcgcccgtgaaacaaagcgactttcccgctcttctcttcttgccatgaccgacttggcatccagttgactatcttctttgccggaggctatagaagcattttgtacaaaccatgaagtatgcttgttgccgctgtttagttacctcgcaagaccatcaccgatttgtccatgcaactcctacggagtccctgagggatgcgtaacatgccctggcctttgagggatctaccctgcagaagcacggccaaacctcatcggcagtctgtatcgccaaccctattttgcccattctggatctgcagggggtactatccgaggctgttagagaacatgtgttttccaaagagctgaaaaa

SEQ ID NO: 717 - DNA, 854 bp, Toxoplasma gondii
aatgtggagttccaaaatgcagactttagagttttcggtacccggcttcaaaactgctaagacgcttcggtgtcccggtgccttcagcgtctggacatcgccctcaaacatcgcctcctttgcagctccagggggctccgactcagtctggggagcgtcttggtctttcacaactcacagtctttgtttttagagtcgagcagagtcgcctctctcaaagagacttcagggtccagatgctgttggcgccgctcgaggaacgggtgaagttcgctcatttgaacgaagtttcgcattttcgagaagggtgaaacgaatgcggcgctccgaagtcaccttcggccatgaaacgggagcaacgacggaacggagctctggctcaacgcgcgtttttgatttctgggacactgaaacttggaacaggcttttcacgaggcactgcgcgcggcctgcatttcctcaaaatgcagagccatgtttccgtacaaagagaaatctgcatcacacaagcacaaaaactacagcgatatcgtgcggtgtcacactttcaacttttacacggtttctcatctctatggaaagcgtgtgtacaccgacgaaacctgtctgcactcttcgcgtcccctcgcctccaacaacgagaagaatcttcacttgtgttcgcatggacagaggcaaggaaacctgtcaacctgatcctccgtgtctgagtcgcctctgtttctgtccggtgaaacgcaagcaggcgcacctgcgtctattgcgtttgcgttccactgtctgggtctctgctcgggaacgaactacaacggtgaaaggaggattgtggacgtggacgaactcgagctctcgga

SEQ ID NO: 718 - DNA, 3377 bp, Toxoplasma gondii
cagcttcctctgttttgtatggccgacaccggtggagcgaagaggaagcgtcggtaatcagcgagaggaaaagaaagagctatcgtagccgtatctcaggacttgtttcaaagcaggctcaccgcaccgtgccgtgtcaagagcaatgaaacatctagtttgaggcaaaagacgagttgctggagattgcgggtttcctcctcaatcctgatcggatatcctgtctcggagtgcagcgagaatatttgagactgccagcagtcgctgccgataacgcgcagatgagcgagttgcgagtaggagggatggcagtgggcggcaaaacgcggcgaaggaaactgttttccaggcaaaaacatggacagaacaaaagaagacagaaaagggggaagtgcatattcagagacatgtgtgtcagatgccgcgcagaagatgttttcagaagttccaagattgaacagacactgccgttaacaacaagaacagacaacggacacctttttcggaaatggacatttcaggccatatcgggagagtcccctacatggggaaaggtgcagtcgaagaaagaaaatgattgagcgtgggcagtagagagtcggcggatgcagatggattttcggtgaaactggatgaacgggtgatctgtgttaaaagaaatgaatcacgcgcagaaatgaaaggaatagtgaagagtgttagaattcgattggagaacggtgtttggtaaaaaggtgaaaggtgtcataaaggaaggaaacaattatgtatccgacagtgcgcaacagatcaaagataaacgagggcgaaaaaatgttgctgataatatactcattctaaatccgaacgagaatcttttcggagttctgttccagtgaatttagtgaaacatttgtgacggaagtgagtactgacagacaggcatgttatcttcgtgttcgtcacagtcccccgaagcgattctttttatggtgcttgagttacaactgctgattacaagagcaatatcggtaccgcactctctgttccatcggactgatccaaaagccggacacacaaccgctgtctgcagattcagcagagtgcgggtgaaaggttttgtgctgatcggaatttgacctcggacatctggtcttccagcagccgttcacgtgtccccttttggatcgctgtcgtcctctaagcaagaatacggagagatgccgagaactgcagctgaggcagcagaatgcaaaacctgccgcaaatattggctgaaaaactaaagtgcggaacctccagttgagaatcagtagtaccagcgagggccctcagtgtgtatgtagggcgcgaaaaatcgacacagttggcctcaagtgacataagtgtacgtggaggcacctttgagccgtcttgtttaatacatttcactcggtctgctgccgtcagatttccttcacttctggccgcttaattatttatgcgaatttacattgtcgcacattcaagcatacgtctgtgcacttgccggttacgatacagtgcccgtacccacgaggtgaaggtaaactaaggagtgctgctattgccgtgccgtgaaggctccagcgacagcagttgttgaactcctggcctctaagaacatccacgtttgctgctcgtgcgggacaggaaggaagaaattgcttatttccacactagggtcgtaaattaggttgtcttggcacgtaaagaacaagtcctggacaccagaactgccaggagcagtcgttcatatgggatatccaacagtcgagcaatgcccatctgccgtttagggtggcttcaactgaaacattgctaccatgtttagccgattatagttctatttatccatatgttagctgaagcaagagaataatagacataggttgcgtctcgagagtgcgcggcatatgggggcgcttactgtgttcagtattcagttagtagactgaacgcggaaggaattgcagcacaagccatggtgttcgccggaatgaaattcagaatgcagagcggatcatatgctgcggcagtggtattgtctgcatttggaagattcgaacttctctgcatctgggatttcgcaacggtgtgcagagtgcaatgagccaaaaaggatacggggttagggcaattgaaaaatacaccgacaaattgtgctcactggaaaccgctgcactttttgttggattgtgaaaaccagcaagggccaatgcgaaggcagttatcactgttaaaagacctgccgagtagaccaatagggccccaaagccaagtcccgcgcttgtactcttcaaaacgcccacctatgaaaattcatttcgaggacggaaccacaaacaactatatagacagtagaaggaaagacaacgatatgtagttctcccccgaaagcagtagcaaggagtgcagtcaagctaaaactagccatttgaacaagggacccggcaacgatgggtgctgcttgggggcgagtcggcagctcaactccgtttatcgggttaaacacagacaccagctgaagagtgcaaatcacagtttcggtttatgctgcggaagattccactgttttttccaaggcctgatacattggcatttccttgaatttttcggtcattctgccggagctgtcttcgttgtcttgccattttctgtgacttaccgagcggacacgggcaccgctaactagaaccagtgcatgttgcatctggtgtcttcattgtgcgactgactttttttgcagttcatctctgagtgatccgcgggagctatctttcgcctgaaaacgactttgacacgtggccaagaaaatatgtagtcactcttgagagaagaactggattttatggttgccgttcgttacactgctgcgtggcacccgggcgtacggcttgcccggcttcaagctcggagcaaatgaatctcttttttgcaaaacctctttacctcgtttccgttcgtttccgtgcttcctcaatctgattaccgaagagctcaactggtgacagcgagacagaccctcgacttctggttctccgtatgtaccggtcgcggttgagtcgatcctgcgaagtgaccgcggtccgcctcgttgattctacgcaacctcggcgtccatatatttgtgtcattcctcatagaagtctttctcacacttcgtttttagtggagctctttgcgtggcccaccttcgcgtggcgaaaaccgtataatattttccacacggtgtgttaacccgtgcctaaccccgtgctttcacatgcgccgtcggctgcgttccgcgaggagacatcggcctctgtcggcgtgaaaaagccgcgattcatggattttttttacctgggtacatgttcattctttttacgtcggtgaga

SEQ ID NO: 719 - DNA, 3015 bp, Toxoplasma gondii
acatgttcaaaatcaaatatttattcgcatggtgatgctcaaggtaggccacgaggaatccggtattcggcgcttcgggatctgggtagtcgatgatccagatgttcttcgaaaccttatacatgcctgcaccgcccacacagccacgacgaaacaaacgccaccgggcattttattggcctctctttaggtctggggaatgttctccccgacccgccctcgtgtcccccttgtcttctcggagccaaatgctggacacaaacgccattttcatgagcttcaaaccatatcttgttctgctatcccttcagagatagcggtgctgtacaatgcgacatctacaactggagtgttgaaaactttgaagcagaagtctgtccctcgcaccgccagtgtcgcaccaatctctcagaagcctatcccaaaactccgcaaggcgcctgtttccagtcactgtccttcaatttcatgtgccgccgaggggctacgcgaccgaaagaactgacaacgaatgccggacgtacctgggggtctgaagagttgctgagaggactgttcaatggattcaatgagtgactgcgccgctgccgtagcgaaattgaccaccatggacccgaacattgaggaactgcttggacctgcgtcgaagagaaccgaagaagtcgcagaagaggaagctccactgtccgcggtgtctgtcaccgacccgctgaacgcgccgcttattcgcttcacaaaactgtcgctgctggcctccctctccggcgtgcttccttccggggaaaattcccctgcagcttttggaaaagactgcttcggcagaggactttcgcgcttcgaaactccaccgcagcgaaccacgcgcgtcccggagaaagcctctcgagaggctacagaaagtcgagcggagttcttgcacgcttgaagcacggggtcggccgacatttcggagcttcctgcaccgtcttccggctgagaggcccgagacgggcgtcgttcctgtcccggcaggtacgggactaacaagggaggcgaatcatcttcgccgttcagggacgaccgttctgtgtctctctgttgccagtcctgcgacggctcagactcatggctaggctgaccagcagcctggagcagggtccgatgcgccgagctggtcagactgcgaactgcagtgaaaaaattcatgctgccgaacaggtcatggatgtaaaaacacttcagccaactaccctcctaataaggcatgcaggaaaaacgggctcggaacagcgttgccgcggatgaagagttgcgggactgaacggatgggaggctgtggcgaaggcggaggtacttgagattaacactacgacgttgataccttgggagaacggaaatggtgagttggctcagcgaactgcctccacctacttaaattgcggatgtgcaagagtttcttccaaaagaatgatacaagtggcttcaaccagatttcgtttctgtctcacgaacagggtaaaatgattcgaagggggtaagagcgtttgcagggccgctgcccgatgcttgtgacattctgtaacaccggaagactgcctcgcgggaacaatcaacacagggcgtgtatcggcatgctggaccgtgaagagtctcaggaaacaatagaaaccatcgcctggggaagaaaaagaactccggcccgcctgcctcaccatgcggacgctcgagacacaggacaccaaaccgaccgaggaggcgccacacagctccaacaaacacaaacagttacacagattgacagagttagtctagaaatatcagtttggctttcttcatcatggctatccgcatacagtcacagaagaataaggaaaagcaacaatagtgtcgttcctacttttttcgcatgtcctgcaggccagctttaacacacggcggaagtgtggaggctgggctgaccagctgcgaaactgactccggggaaacaagcaaccgggttctttatgagaaatacaaggcagcattgctgtttccttctcatgttctctgcttgtttgagaagagaattgatgcattggttgacaaggttgacaaccatttctagtcacaactcggaatacggcaagctctgcagtattgtctctcttgcttctcagcactttttcgcgacacgagaaaaggcaaacttgtcggtgcatgctcttgctgtgtgcctgaataggcgactacttgtgaagcagagacacgtgccctctcgaaagctgaaacggcggcgaattttcacttaattcgaatccggacctgcttctgtctccctcgagcatgcggtaaagaagcacccgcgtttctggctctccagtttcgcagcaaacggaatcttgtctctgtcttcgcccgtcagaaagcatctcattcccatttctctatttcttggtgtctaatggaggcgaatgacagggggctgcctgccgccgaaggagggcagaggcgtttcggtccgtccattcctctttcggggccttccagctcgggcttccaccgcatatatgtacgtgtatagcctttgcagcacgtaatatttcaagttgcgttcttctggatatccctgtttgtccacatcatatcatatacttcatccttacacgcgtatatttgtaagcatggtcatgcatgtgtatcacagaaagtgtgaggagaggaggtgcagaggtgttcttggctatcatgtcgcgctggaatgcgtgtctagatcatatgccgtaattcgtgccagaacgtgatcttcgtctcactaactcacaatctgtttttctcatcgattccgcagaaacctgaaaccctctggaggttgtatgcttggactgcggggtctgttcttgttgatcatccgtgtctcacccaaacccagagagactctttttctcgacatcggaaaagacccgcgaccagcccttcagaagaccaccatttcggtgggtcatcccttcagtttcggaacaagaagttgaaccgctctcggttcgctacttaccaaaa

SEQ ID NO: 720 - DNA, 1690 bp, Toxoplasma gondii
gagtgcgacagtggactaactgttcttgtgtgaatgtgatgtgaatgaacaggtgtgcgtgagctctcgccgagggaaggacggactctacgtgatggatttcagtggcgatgtgcccgtttgacttctcagttgttttgtatattccacggtagtgagatgccgtgcaatatgggatgcttgcctcataaaggactttggtacctgtcggcaacctgcggcctggtttccgcaaatgtccatgggcatcgagtctttcggtttaaaacagttattcctactctgaagtctacggagtagtggaactgctgctcggggcaatttctcagagcgttattgtcacacaagtcacaggggtacctctggatttgctgcttcgggtgaagctcttcgctggaaggtgatacaggtgccccggagaactcttatcattccacgtcaatgactcacaacttccacttatccactacgcatctcagtagctctacacatagaggtaactgaacgcctcatcttgagcatgcactccatatagctactcgcaccacttctatcctgccgcagtaaaacctgtgcatcggttcaactgatcactaatgcatagggcctctcgtagtgtccggtatttctgaatgaggtagagtaaaaaattaagcgtcttcgaacagaaatgaagatgcgtctatcaaggaggtaattggctacatctctcgtgcagtctcgaacagtgtgttacaggtgtcagacaacatgttcttgagaatggtactgcatactgaggagaacacgtggggtatcgttgcaaaaagctccacacacggcgtactgtagaggaacgattaatgaaagaaattggcgtggtaagaggtagatgataatcttcgagatgaagctccaacaagaattatcgatactgatcagtcacgaatattgtttctggtcggcagctgcgaagagcctggaacacctaaactacacaagcagcgcaggagtctcaaatacctggaggtgacatagtgttattacgcttactctggcgggtgtgtagtgggaacgcggcacgcggtttcctatctgaatcattgtagacatgcactactgttgtacgcctgtcgcgtcctgtgagttctcattgtggaggggcaagaagtgtggaatcttcttcaccagcatgcgtatcagttgtacaggaccatcgcgaaaccacatagaaacgagttttatgcgcagggcgctgaaaacgcgaggcggggtatgagacagatgaatgaagtaacttgctcgccaatttatccgatttgcggtccttcgggtaaagtgtgtgaccacgaattcccaaggtgactctcactctctagtcatctatccagcttcgtcacagagggggtgcagccgacattcgcatgccctgagaatttgtgtagccacgcatgcgcgcttcgccaccgtcgaaactgtagacgcctgatttccgccgcctcacacgaaaaggcgtttgtacgaacaactaaaacgttatccgtcactttagtcgatcggtctttttgtatcgtactcggaaaggttttgcgtaaacaacgcctttcttgtggtgcattttcgcgaaccggggctacggagtcgggttgcctggactggctaccaaaacaatttcggtgtttcatgacggcgacagtaaaataagtaacaa

SEQ ID NO: 721 - DNA, 2137 bp, Toxoplasma gondii
agaagaaattagatagttcaaagctttgcaggaggcgtaccgttagtgggtaccgcctgtgaggtgccggcgttttgtctcggggggctgaggaacagggaagggacaggttgggcacagtgaggttccgagaggggcgacgattttgttctttgcgtgggatatatgatgtggacaaccgaccccgcgcacgctgaacgtttttactgatccgcgtgcgcgaatgcgggaaatttggtcaactgccgtttttttcgtctttcttgtgtaaggatgtctcggccatgacaaccacggaatgagcgaagccactcagggcttgctttctcccctcctgacaaagcggcttttccggaggtaccttttacacgatgccgcccaagcagcgagagaaggacccgtgttgaatccactgttgcactctttgctggtactcgaggcacagcctctcgaagctcaagccttgtagtatttcttgaaaaactgtgtacatgaaatttcgaagtcgtgggggagggttatgttaaggaccgtaggaaatgtcacacacctcaactggtaatggattgatatactcatcgtacaagcactcagctagttattgacagtcacgcgcgaacgccacaactgtctgccatcgcctcagtgattgaaaacttgcacgctgcaagcgatcctcagtcaccagttcttttctgcactcaagaaggtgtggtagacaaggagtatctttctcgccacacgtccagctgccaggtggagacccccgtcgtcttctccatgagcccacagtagttgtgtttggaaacatgcaggttggaaccgagagggacattcagggtgcatttctgtgaggtgattctgtcgcttagcatgccgaaaaaaacgggcaggaatgctcacggagtagatgcgtactgcaaagaaaacgatatctcaactactccgcagccttccgtcctcgcggaggcagttttcagaggagagacaatactcgcttgccacgttcgatcaccaaatgaaatgcagttccctaatgcactacacaaccgttgcggcgccgtggtgtctctcgtttctgtgtcaacgcctcctttgtagtgtccacatgcggtgcggtggattgctgggggtaacgttcaccagcccgctttgtggagggcttagtgttgactgcgctgagactacgcggtcgcttttctgggagttgttggggaattctcgtttcgcgacattttgagatgagaatacaggggctgtgatcatcggaaaatgcatgatgtactcgaaacacagtgttgaggtcgactagaaaggccgggtgaccctcagtagcttgtaggaaccacgtcatacacggtgagaacccttgaatttgattgagttctagccgttgctgcgatgcacttactggtacacttctgaattgctgggtagtttgcgtgccttttcaagaggggctaccaatccgcggagtaagccactgtgttcgaggattccagtatcattgaaacctgttcttttccgttggcacccaccgcatctctaaccaattgtccaccctgtgagcgtctcacacattgtaaatgacaaataacctgctgaaatctatggaactgaagtgctccgtttgcttccctctgggacatttttctactttggggtgtggaacggaaataccaacttctttgcgtttccaaggcctcctgcaggtctcaactggaggccggagctgggtagctgcgagggagtgatgagattcgaacgcgaagaaggcacgttgtttgccaccttacccccgctcgcgcgccaactagcgggcgagcagcgcgtagtttgtttccgtgactctgtgatgcgcctttcttgcactttgttatcgttcagtcaggcgcatgctaacacaaacgaatgatttctttgcttagccgactgagaacggtacagagggagcaggaggaatactgggcaagtgaccatgttggtgtgtagctggacacgataagcatcgatggcctaagtgaggccaactggcgtccctcaagacctctacccgttcgatttgacctcgcaaacccatcccgaatatttccttagatcctctctgtcagctgtttacagccgcttccaggtggca

SEQ ID NO: 722 - DNA, 4665 bp, Toxoplasma gondii
gagcacataagcagaacaattgtggcttgagccttgcacagagctggccaaggaaacgtgtggtccccgatagccacacaggagtacttttttactgtcgcatgtcggcaaagacagaagcaccttcatcttctgccccctgacatttagagattggtgtcagtgtatgtgcacgtaaccggactcgaggtgatgtcacggagctgtaggttatacagcattctccaagtgggtggctgcagatccaaggcaaccacatcgaagacctcccgtcacaatattagggaatccagttatcgccaaaaaggccaattttttcagaaacaactgctgccgacgacaaaatggaactatgctatgtgtgccacccgtagatgactatctatttacacggaacctgctgaccaccatcatcttacgccgtgtgacgcagtgtctcccattgcaggcaaccgtgatcacatatatgaagtgagccaatcgttgtcctactggctaccaaacccacttttccagcttacacaaagcccctatataagccaggaattccttcttgtctccacaccatcttcaaggcgtgtcccgtggaagttagaagcgaacggtacactttagcgggagtacagtcggcagcctgacccaaagctgcgcctctagttggtcctcttgcctcgccgctcagtccctgctgcaactgcgccgtgcccgaagacatgattgtggaacaaggttgaatggaagaaaccgtagatgacgaacctagatattgccttgaggtcacttgcgcttggatcattgcctttgctgtgtcaattggataaaaaagacatcggccgacgaagccactgcaggcggatgcaaacatcaaggccctcatctttcgccagtcaatcgaggaatcatcagactcgccatggctgagatgttcagctgaaacagtcttccaggagcctgctccggtcgcggcgcatgtggcgtcattggtagaaggctccatcaatgtgggattcggtgcgagaccacgccagcacacatgaaatcggctggcagagatgccgatagaagtctccactcgcagatcaacgcaaaatcctggttaccttcgctgccaccactttcccagactcaagcgccaacgacacactcgaaccgtggcacacttgctaagcggcagacaacgacaggcctgcaacgagtcctagtacttgtggctgacccaaaagatttgagttgggttcgcgtgtgtcgcacgaaggcaaagttaataaaaaacagataaatggtgcgctgttgggtagaagaggatgcctggaaaaggacagcagcggacccgcaaaaaaacggtgccggcaatttgctcgttgcatgctcggcagtggaacatttcaagggaaagcgtggccgacttccacgaacggtacttgagctggcgcacgtgctgcagtatgtaagtggttgtagccgaggtaagcaactgagtcttccaaaaaacctgttgttagccgaataggagagatgaagactccgatatgtatggaaagccctaaagggccaggaaggagtgtgcgtcccgttacggtagaggaacctgggcacagtgtcgagcgtaccaactagcggtgtatcgacacgtcaggacaacattccgctgccccctgtgcagatataatccattacaggttcacgaccgaatgcaacacggtttctgattcgaggtgccccgaatttatctctaccgcaatgaagatgttgcaggtcttccttaccttcgcgcttgcaccggcacaccgagcgacttcaggtgtttgtgcggagcctgtttcgcaagacgtgtacgtccctccgggcgattctgaggaaccctccgtcataacaagcgccgatgagcaaagcaaacacgcgtgagacacattaaaggacctgcacgttggacgagtgaagtagttgaaagcgaaaatgcagcgatgccatgcagcacctcgtgtcatccataagaaaggcttatgttgacaacatccaagcagaagacaaacagatagaggaggatatcggttggttgtttctagaagccatccttcagttatgtcttacaaacacatggtaactaccagcggatgcgccagaagcctccggcgaccattctccagagactctgcaacggattggtaagggacgttggcagtcgacgttgttgaaactggtaactgtgcatctctccgccagaggaactccaaagaaaagcagcaaacgcagtaacttcgccctgattaacagatggtgtccattacatatcactagatgagacccaggaagcacgtgctgaggaccttcacgccgctgtgcgtgaagaagtgaggaggtgggacaaatacgagtgcaaataactatcaattcctagcaatgccgcagtgatatcagacatgaagagacacggccgcatcaagctctctataagaatcaacgactcaacagcattcaagcaaacgaaaagcaggttaataactcttcttcttatacctttgaatcaaagtgactaccgcgtacatcacgcatttaaccaactacgatccttggtggtgagtagcctagcaccagttttcgctgcttgggatctatgcagatagatcggaactcgcagaaagaggctgaggaagcaacgaagctattgcaggcatgctgcactagtttcatgacacttaaggcgcctttaatgtgtgagtattgcagcaatccagattccagacgcttccatccaggaagtttaccaattacatcggagtcctagatgcataagaaacgagctcgactctcggcatttgaagctatagatgcacgattgtatcatatgaatattctcagcacaaaattgcaacttaacccaattcccgtttgacgtccctgctgttgttgatacagacatgtaacgcggcgctgctgaaactcagatatttcggacatgctctactgtggcttagttgctaagataagccatgcaaggactctggcttagttcttgtcttcgacgtcctcacatcgacgggtggcgtacacagcgaggagcacgggctctatatccttttggcgtatgacagacagaagtagcgagagaaacggtttttcgcttatatattccgtttgtttctacagaacgtgttccgtgacacttcctgaagcagtgatgcttcaatctgcgcaaataccgtgacccttgaggttcaggtgtgcctccgaacagtctgctcatcacagggatgtgccgtgtggcagtagcttttccatactatcataccacaatctccacatcagatgtacttttaagagacgcgtttgcagggtggacagacgaggcaccgcgcagcagataagcagtgaacgatcgagaaaccgaacttgtcttgatgctccagctggcaggattcacaattcatccatggtgctaaactgtgcttgcacccgtcaggcccaaacagttctcttcaacagagctgcaggaagcatggagttttcagcaagaacaattccgaatatgtctcttcgttccaatacaggaaaaaaccttgaacaggcccagttaacaatgcacggaagtttgatctgcgctgcactttgcagtttacggagcattgctcttcacgcacccgcagggaattgtatttactcagtggcgatgtttttacgagtcctggcctccttggcgaaagggatggctggacaggagaagaagacatgacgccaagaatggcgtgtctgcatactgtggcagcgggaacgctagatgcgcgatgttcctggtgattcagatgcaagcggcaagcgccgctccttgctatgtgccagaaaaaagttggatcgcaccccatggcagccttacacgatactgggagagggggcgtgcaatttctgtttattctgcagtcggcacgcggtcgtaagcaatcatggcagcaactgcttttccgcttcgccgtcccgtactatgcagggcaggccagtggccctcccccgtcctttaaagtatgcatctggttgtgctaaggaggaaaggatccattatatgtcataagcatcggatgatgaacagtgtcttcaatgttgttctgcacactgataatgctatgaaggatttccggacactacagacacaaacaattgccagcagtcacgcccgttcgcatcggtacatgcctgaacagacactgcaaccgcatgcagcgttacgattcagacttgcgatccgttgtacctggactgcacacacactctcttgatgttttatccactttttagtttattgtttgttctcctatgcgtgcgagctcgcggcattcacgcaagcagacacactacggcgctcctgcttcgttaggcactggttcttgtgactgcatactcgacggaactctgacccaacacggtgtggagtgcgagcttcgttccagaaagccacgacgaagctcgcttttggcatcgcgccgatgaaaatactactctgttctctgctggcttttttcggaacggtgaccagccgttcaatgcagtcgttgagtgggggagttataatcgggagccaagtcctcgtggtggaggcaacgcagaccccgtcagcatcctaccaagattgaggccctgtcgggtgtttctttgtgcggtagaaatgcgtcacga

SEQ ID NO: 723 - DNA, 2411 bp, Toxoplasma gondii
ctcgtgcttctcgcgctctaaaagattcgatctgcgaattcagtcattggcaattcttttttatcctagtcaaatcacattatttcttatgtgcaagattcgtaaggtacgccggggatgaggccagatactcttggagtgctggctctcggattgtacaaagagttcagtaattcatcatagacgcaacggtgtttctagacacatttctggtatgaaaagctcgttgttaacaggctaactgggattcagtgtagaaggtgaaacgcaatgcggcatgtaagagtcaaacctacagaaagaaaggtggcttgcaattgataatgcagacgtgtgtctcgatagactacagtgctgcgtaatgaatcttcgcctcggtgagaaaatcaactagctcactggctcgtttttcaaacaggaaacagggatacttgtggcagctccagtgttatctggaacaaacgaagactatttgagtcaccatcacattagctgcttttcaaacgatttctctgtagaactcagccaatgtttaattctccagtcccgggctcaaatgcgagaataagtgctgagagtgtttacataattcatggacttctgaagctttgcttgctcaaagtccccaacgaacaacactgcaaagagtcccgagtagtcgggagcaatccgttccaagatgatgtccatctgtgcatctcagtggattgccggacatttgtgtgcgccgccaacttcccggcgaaacatccgttatgctgaaacagaagttcctgaagaaaatgggtagaacggggacgacactttcagctgcatggtaggctggaaacgcggggaaaagatccttcggcgtgcgtccagtcgctgcgcctcggcaagaaaagggaaaggagtgtcagcggtaaaccgtaagcccttagaagaaagaaatgcgtgacattgtcagttctggggacttcgcagtgtaaaaagcctgccactgtgaggaagaaggcaatacaagggaaagacgcgaaaacgcagaatgtgcatgttctggaaaaactccgtacgtggcgtgaacccacaaattttacaaaagtttttgcgccaaagtgaaatcatggaaactgcacagtccaaccttctccaagcagacggtatacaattacatattttgaactatatacacctttatgtatacacctatatatatacatttgtacgttcgtgtgaataaacggctcaccatctccctgtctatgtatatacatatggatctctgtatatgcatatatatagacatgtatatggaatggtgtatctacaccaaatgcggaagatcgtgttggtggtgtctgtcgattgcgaacaaagagcaccccgcggcttgttattgttgtctgttacactttctggattccacaattttggttgtcgcagaaaactagggtttacggttttaaagcgttgttccttcagaactgttgtttcgcagggacagcagcgatctgcatgaatgtagactaaaacatctgtttaggctccttagaatcgccggcccttcgttgttgtccgcctgctagtcgccgttcgtttctgtgctcgcgtgcggcatagccatgaggcctcgatcatttctctctttttaggagagaaacgtaggtttctctcgcttgcttcgaagacaagcagcgttttttctctcgtttcttgataggcgaaactgaggcagaaggaaaggtgaagcagccctgtgcgttgcgcgttcttcgattgcttctctggtgggtctaccgcgctcgttcggcgagttttcacttgcatgcgtttcgttgagcccgaattcttttgagtcggatccgagaaagaaggggaaagagatgaaacttgacagcatgagcgaggggagttttctcgcagcctcgtttcttttcctttttctcgaccgcgttctgtgaggcactctcctgtcgtctcttctccctttgtagcagcttgccttctcggataatgttaaccagagagtgcagacaagattgactgttgtcggttttctctgtggcattccgatccccagtgaattctcaacacactggtacctcgtcctttttttcatgtgtgtttgtctccttttcctctcttctgttgcgcgagtttctcctggttgtcgcccttttgtctcttccctcatctccactcaagctcctctcctttcatcctttcctcggtttcctctctcctctctccgtttgacgccctcctcttcttcatcattcaccgaatcctttcctctccctcaccttccccgccgtccttttttctcgccactccctccctgtctcctctgcctttctgtgtgaccctcgctctctcttcataacttctcttcgcatccttcaatctgctcttctctcgcgtcctcctcaaaa

SEQ ID NO: 724 - DNA, 2190 bp, Toxoplasma gondii
tctgtcgacgaacacgcctcgtctctcccggcaccaatttttccccctttcacacctttagcttccgcctccgctgcaggggcatctgcaccgccctcgtgttcactacctttcccttcttgcggagaggttgtctcactgttatcctctatttcgagctcctcagacttatcccacgctgccgctggagcagaatccgacgggccagcgtcatcttccctaagaaccttttggatgctctcctcactcacgacagccgccatccttgctccaggcaaggcctctccttcagtggaaacttcgctcgttgatcgtggctgggtttctgtggccaaaaccgtcgcagccatcgcgccgggtaagaaccggctgatttgagtgtgtgctctgaacagcagcacctggtaacgccactgttccttcaccgcgaagactatgctttgcgtcaatttctttccactcgtgctcgagacctcttcaagtgttcccttaggtaacgcgacgaaaaccagtatgtctttgatatgctcgaggtggtctacggaagatgtggctagcgaaaaagaagggacgctttagcctcaattcgaacgatctcatcgaaataaaatgcgggaaacttctcccaaacccaatttttcatgaattgaagtgactgtcactttatcccttcccgaagaatttctccacgtcactgagcaggggcctggtgctcagcgctgacgcggaagtccctgttccctacactagaaacaagcacgaagtggcctccgagaacgaagcaacgaataaagctagtctcgtggaagaacagaaatggtagaagatgccaaaaccggcaagcgggcaaaaattttgccttcgttccacccggtcactccgaacgggacggggttttgcgatggcctctaggagctagcggctctgctactcaggaaactgggaaaaggagcgctttctaacagttccagttcacagacgtccgttctgttataaatagttcaacagagactggcctgttgcggagactggattagttcacacagcatctcaaacggacaaaaaagagaaaaagcaaccggccgccggtcggccagtacaactctgtgaaagaaaacaggcaaggacagaagtaaagcggtggcaatgaaaatgagacacaaaaggaaaagatgaattaacacatgcaactgcgtcttttgctacttttcgtttttttcacccgccggacgaacgcgcgaagttgtggcgttcactcagtgtacagacagcttccgtaggcgaaagagcatactcgcctcttccttccctcggtctagcacgactgttctcgtcgtcctacgatgaaaaaatcaacaggagcaccctatgtgttcctaattgagtaaacattgcacagagcacgaagatatgcagatggagttacaccattggagtgtttcatccgctgacttaggatcacgcgggtcgattgcgtaagtgaggtcagtgccttgattaaccctgctgagatctcacgtcgagttctctattttgtcgcacgctacactggagctacgatgcggcggacaaccgccaaggccctctcgctcaaaagacggtcaggcgtcatcctgatttcgtcatctcgaactggggcgcgggtgtcaacgtcttcgggcttgttgcaaactaaccacccaaacctttatttgggtcgccttataaacgaggatgcacgcactagctatcacgcggcgggcggcgggcacaggggaggtggtgtcatgagcggttctgtaaaaacgtcttcgagctgcgcacaaagctgcacagcagtcccgtccgtgtccgtcgaatgacgggcagatcgcgcgggctgaggtctttagagaacgccagcggacggcgaccatatatgctgccgtgtatttcgttgcacggtgtttttccagtgtgtctcaacgtgaaagaacgtcgtgttggatctattgggaacttactgttgtgttcgcttaaacagctttgtcgttaggtcccgtccccgtttgaagtccacgggtgcaacgcgagacccccttcgtccactccgaggtcacatcacctgagagtcaactagaggtctggtgaaacagccgtcgttacgtttcgttggacatatcgtagggcgaaaatttttgtagagtgtagaagggattttttagtacaaga

SEQ ID NO: 725 - DNA, 2255 bp, Toxoplasma gondii
caattacgctattcgagctgtacgtacacgacgctgcccagttagcgagcatcaaacgcagtggcggcgctcgtgttaatcgaagacacagacaacaggtgccagtcccatttttgcgagacatcaagagctacctcaactctctctatggtttctacaacgactcctttcccccgcaacgccgtgacatgtttcggcagcgtgttgaagcaacagccagcatatgcccggtggtcttgtccacatgaaacaggtgcacacagagcctcgcatacaaccctgtcttctacttttccacgctatgtctatgcaatcgacacccaagtcagcgcattaacaacttcgttgtagtacaaacgagtgcagacagtgatgtacaacagacgctctccctgttccactacctaatcataatctactgttccagatattagcacgggacaccttctgtgtgcttgcacaatgtagaaattccactaaaaaacgccttcactcgctgacgacacagtttcccccatttccccatcgccagtcaccggacagaacagaccgtattctctggcgggtcagactgttgtggatgcggcagaacaaagaacacggcgcccagatgacctctttgaatgacaacaaagcatgcggatttttgaagcagagcagacacagaggatgcggagaaaagccaagtggaacacggttccgcgcctcttcacttctcagatccgcccccctcctcagtggcgaagatctgtaaaatgctgctgttcggcttcctcagtggggtccaagacacttgccactttgcgcatcggggcctgaattccaaaacttttccgctcatcgggcgttccttcccagcgtgtcgatcgcttccctcggggtcgggacacatctaacacatgcgggaggaaaaaaaacgagggctgtggagccgcagaatctggcaactctccctcaaagatcaagcggggcaatgtttcattcgtcttctccgcagttcactctctcgtaggtcgagaaacttacctcccgcagggatggtgatagtctcacaggcataaacagacttcatggtggcgacggagcgggagaggggagagtcggcagtcgaggggaaacgggaaccgccaaaaagacagcgaaaaaaatacaacgggctcagactccctgagacgcgtcgacaagtgtctgtggcgaagcgaggccaacccagagaacagtccgaagacgacgcgaagagaggccacttagttgccccgcaccctggaaatttaacaggggtcctagcaacctacatggccgcatgcacttgacaagcatgctctttttcgactttctttcgaccccacgcggccagaatacgcctggcaaagccttccgtatataagccgtcgggaatgtgaaaagccgggcgcgcgagcctggtcttgttggcaagccgttcgcgcagtgtcgaaaattgacagccgcgctggagcacgtggaatctacggtgcaaagtgacttttccggggttcagtccggaaggaaaacaatcgacggtgtctcgaccttgtggaaggaataccggcactcgccgaatagaaccaacattttgctggagccgtttttccttcctcactatcggccgacaagggcatcctgaggcaggcgagacacgcagcgcacatgcagtttctgcgtgaatcaggcagcatgtgacgctggaaaaacgtgagtgtgccagcacgccacaactgacgaaaaccgaattactgcggactgccttctgcatctctttaccatccggctaacaagtttttcgataaaccatttctctttgtggtgtgttagcgataacagccgcataacgtcgtaagatatgctgagagacaagctacggtccgtccgtgtgcaatggagacaaaaaatggcgtcttcgtttcgattctttttcggctaacctctccggtaactcggctcaaggtttgccaagaagggcgataatttggtcctggtcttggcacctacgaactgtgaaagagaagcagggtgtccggcggctcttcgccaggatgcagacctctttctctgtttctgcaaactcggccgctcattttcatggctgtccgccacttactgggagcgtcacttatgaatcagcctgttgacgtccattcctcttgcctatatcaatcttgtgacgccctttaagtgtttttctgccgcggcaagcgttctgacggctcttcctctgcttctacggctatctcaaa

SEQ ID NO: 726 - DNA, 2502 bp, Toxoplasma gondii
actcactcgactctacgcgcgtatacagccgtgcatgtgcgtctgtgtctcccgtgccgatctttacactgttgtgtccagtgtgtgagctacgtcgagtaataaaagtagaggtagccgtgcatgcaaataaactccgatttcttgtcggcggtggcgctgcctagtctgcgtcggagtgtatgtttttttagatggctgtcggtcacattcaagccgatttggttagagaaacagactttggaaaggccttgcacagccggagcgtgcatgcacagaactgcgatacggcctcttgccgctgctccattttcggcggtgcttcataccgctcgtatgcggtcccagttgccggagtttttcctttcagacaaaccagcagaaacaggactatccagtaggccttaccgttcttaaagttttgagggaagtaactcacgcggttgcttgtgccccgattctttcgcgcactcctcaactttgcctttagtagaagcgatgccttggcaggtagacgtcggtccacatagaaatactttttctcgaagtcactgggccattcatctcctccagaagccccttccgatcgcggagttacggcgtgctgttgagtttcgcataggcatcttcgggagagaccggggaacgtttttaataacccctcacgggggggacgcagaagccaaggatataaagagaacccaagagttttgcacgtgctctggtcagaacagtctgaaattcaaaacgtggcagactgttttttaatgccctgacacatcccctcgtatgtgggtcccccgagggggcggcggctcttcaatccttttacaatcttgctgcccattgaaaagcaccgtttagtcgactgccttcttgcgtctcttcggacagcttggcgtgcatccaggtctcacagaaacaagcatttcgacttcacgactaggtcgagtgcgggttgtccgcggtagttccaggattgcattcgtctggtacgaacgcgcatttctttctccaccgcaactagcacgctgaaacgccatgcacgagtttgttctcgtattgctattggaggccaccagactctcaaaagtctggacaactcttttttcgtctctgttggagctgtgggtggcagagagaagcgcgcaattcttgggatcgcgcgctcatggttctggctgtggggtctgaactagcgtttccttgacaggctggaggcgcagagacaccaacagactaaagcaaccgaactcctttcaacatcagtgacaatatcgaatcagacacactgccctgtgaaaaagtacgagttgccgccgactccggctcgcgttccacgacggccgcatctgtgagtgttcattgccaagtggctcggtcaagtctgtgggttcgcgagattcgacactattagctgtctcaagcatccagttgcgttttgtgtccatcagtcccgattaacttgactgttcttcgtagctggagtcagagccaggatactaggcactctggtcggtctgtttagtctgtttatccggtttgcgcggtgcagttctggatcgcggatcctacgtacaggggggcagaatctacttataatgatacacttctgcacaaggtttggttgtgccgcgcgcttttcgcgtgacaagtgatcccattttctctgtttgcatttcagaagcagagtgaaaccgtgttgaaagaccggcgatcccgacttgacggctggcagtcgctgcgttagacgagtaagccgcctgtttgcggcttgtgaactccacgaagtggagtctgcgactttagccgtgaggaacatttcttcgcagaccgccaagcctgtcagcaaacacgcgagaaagtcgcttctttgagtaagcggccagacgcagctagccagaactgagttgtgaatgctcgagctcaggtgtccaccacctgccccaaagggtcagccgcaccggtatgtccattcttttcggtttttttgtgtcgaagaagcgcgttctagacggtgggtgacgaggcaggtgtcattggattcgtgtggttcgaccacaaagtgatattcttttctggaaggacgctgttgaagattcgcgttggttggcgcggaaacagcgcgaacgacccgctctgtcccacgaacatcgggaagcaacgtcttgcctcgcgcgttactcgtgtctctggaggagcagcgagagcgcggaacgacgaggaaacgcggcacgtgtagagaaaggagaatttgtccgttctttaaccagacagtttcgaatcttggcaaaaaccgaactggcgccaacccccgggaacttccgaaaccatgtcttgcaacgcgtgtctctctggtaacaccggggagggtcacgggagagcgttgggggtcgctttttttcgcacagcgtgtcgaaagtgtttgtcaaaaaaaacgcaaagctcgggcgtcttattccgagacgggaggtcttcccccgctcctcgtttccgcaggaa

SEQ ID NO: 727 - DNA, 3241 bp, Toxoplasma gondii
gctcttcacctgccagttgcgagaggtctgtgcctacagacgaagacgagctgagggactcgccttcccctgcaaggctggccgctggggagagcgcgagtgtgcctctgttttgctcacagaagtccgggcagctctcgacgcgagtcccgcatttggagatggtgcgacggagtggcttttggaagaaactgcggcgagaaaaagaccctgaagatccctttcgctccggtttggagtcggagtgggacgcgggggcggcacagccctccgcacttcggtgtgaaggcagcggactgggcaggccggagagccccgagagcgaaggcgacgcgtgcagcggcctcagtgatccggagccaggagttggagaagaggtgtctttgtcatcgtcgtccaagaagtcgccccagaacgcgccttcccgcgcgacgcccacacctgcgtcagactcgcggcatttcttcctcaagagcgaagtcggcttcgcgtggaaaaagttcggaactgagaccgaggtcctcaaactgctcaagggtttctgcgagcgactcagccgcgacgcctgctccaagctcccagaaaccgacggcgaacctgtactctcgccctgggaaaagccggagctgacggagtcacggcgctgaaaggaacccgcgctgctgttgtgttggctctcgacagggctcagggaaagaaacgcctccgcacagaagggacggggccccgcgttgccagccgccgaggaaaaaatcggcgtgatcgacgggccagcagcagggtagccaggcgtcccgtacccgagcgcggctgtcgactcaggtgtctggacgaccgcccagccctgggggtcgggacgcttcgcgcggtcctccatcgagctgagacgaggcggccggtaaggacttccgtgcatggcgaaacggagcgaatgcggtgagttgctatctgccttcccagaagagggcgccggggtagggacggacacgcaagaactgcggaagaaaagccttcacggggtggagccgggtccccgcagacgcaggcctgagccgaagcgaaacacggtcgtcgatacacgaggagagaacactgaaaaaaactcagcagcgagaagatggaaccatgtggcgatcacatggtggactacggatgcggaagtagaccgcggccagcgaggcttctcacgcgtgtctgtgccaaagcaggctggcaaggaaactcgagacaaggaagacacgcaacatgtctgactacctctccctacgacaggaggacacaccctcctgcctttaccacgcaaaagacgacactttccgaggggacatcgaccccgggcacccgttcgcacttgaacgaaaaaaagcgcaatacacaaaggtcaagtacgctacacagttgctccgccgccaagaatgaaacgcagaaggaacatttcatgaatgtcacgaacaatcagatgtccacaagcgaaaccgccgcagcgccagccgtctgcaacccataaaaagtcgtcgtccgcggcaccaccacccctcaaaaatgtcaaggggtagctacgcaaaaagttgagttgttcaagaaaacactagcttctcgctggcagaccaactcttgaattcgtttcatttgccctgtctcggccaccgggaatagcgacagagacgacgcgagttgcatgcatcaccgctacaggcatgcctgctgtttttctgttggtggccgattccaacctgttcacgcagtgcttggcattggctggagctccagcatgcttcgcgccaactcgcgaatgcaccgatagtatcgcattttcaagatatcatgttgccacaacgaaaaacaggcatgtgtgggaatatcaatgtgaggaagggttgattctagggattcccgtagatcaagtgtcatctagtagttcctttctttgcaggcgccgggcacaccctctctcaccagccagcatggcaaagtctcaacaaccacagccaccagtcttgtcagccgctgatcgttttctaaagaaacagcgcatcgtttggtcgtccactaatatgttgctacccggcagcaaacgttgtcacgatatgtgccttcacgacgagttgagctgcgccattccgaacagtatcaaaggaaaaactcaaacggtggttccggagcacctgaacatgccgctgcagcacctagcagatggcacaggcctggatcaacagcgttgctatcccggtaggctcgaggatgcctgtggttttctcgagttatgaacctattgaactgagcgaacctctgcgttaaagaagggaaacttgaacaccgttcgccaaaccaacaattcgtaatgccatcgcgagagcatgtacatggcaatgtcttgctaatgaagctgcacagtttttcttctgcacacgttcatggtaactagtatgccacagaagggtcgagcggagtagcacatgacctcaaaacggccgtaccacagtaactctaaatttggctgccatcataactgccttttgtaggaatgagcgcgacaaaagcgacgccaactttctcacggcgccgcagaaaaatgcaactagttcattctgcttgcgttcggatgacgttcagcttcgtcaatctagggaggggttgacacaaatacctttattttcgtttcacgcccggaatgcacttgctgtccactgattatttttgcgtcccgcaagatgtatccacctaatgtcgtgtcacacccaaaaccgcgccgtaaaatgcgccaaaaaagccggtgttcgtcaccacattgtcgtgaactctgacaagttctcttgttttgcctaaaaactcaggtgaaaccccgaactccgcaaagagactaccgcagcctccacccaggaacggctacaaaggcgtaagtaacggatccttcctcacaactgaacagagcagcctggcgatggaggcgaaggtgtcatcacagagcggcatttctcctgccgatcttcatacatacagggttcaactacttgcggtgtagctactgccggttttcggacctgaacaacagcggcagctatcagagaattgaaattacacctggcggatgtctatggaagacgatagtcatcgacaagggtggctgccctaatgtatagcggccaagattaaaaaaagtgttcacgcccactccgccacgtttgtgtggacgtacttgccagcaacggcttcttcctgggtccatctgcaggagaaaaaa

SEQ ID NO: 728 - DNA, 3896 bp, Toxoplasma gondii
acgaagaaggcgagggcctcttcccaagcaactgtttctagccagtcgagcggagcctctgccgccagcaggcgctcgagaacgaaggcgaaggcgaagcctcggagacagcgctgactctgccatctttcttccgccacagtcgacagaggcgacactaccctctgttcgagaggggaggcacttgagcaaccggaacaggaagaacgggaagactgcgcgagggcgagcagccgcgcccgggctgcgagagccttgcagcggtcgacctcgtagacttcttggtcgactgcagacaacgggccgacgccgccccaggaggtgtacatacactccagcagaggcgtcgctgaggagaggacggcagacgccggagagccggcaggacaggaggcagaacgcgagagcgaagacgagcggaagccaggcggtagcaggtccgccgtctctgccgccacgcagtcgcccggccgccagccggtgtgcgtctccagcatgtcccctgctgctcaaaaaaaagttcggagaaaagcggctcttcttcgccaccagacacgcctgcgatgccttcttcagacgagggaaaaaaagaccggaggggaaggtctctctgcaagtgccgaccgagggtgcagtcggacgctcgcttccggtgggttctgcgttcggaagactttcacggaaacaacgacacctgtgaagagacgcagaggcagacgctgcttcgactctcgatcgaagaggttggaaccttggacggaggacaattttggaatggaaacacgttgggcagagagggaggtaaaccgaggaaagcgacgagccggggccagtaggagtcttctccggtcttctggggtgtatgtacaatcggctacgcgccagaacacgcggcggagagaaccaccacagaaagcgaagccttcaagaagttgcatccgccgtttcacgcgatctttgcgggacgcacggctttccggaagctccacacagcagacacgggagggattaggaagcaaagagagtccgccgccgcgtcgtcgggtgtcctggattttggggactcgggttcacagaaagaaccgggcttcgcttcgggtgaacgggatgatgaagcggttcccttgcaacttgccgctggcaaatctcttcgggtacagcagaccgacttcactgtgccgttcttttttcggaaaaaaaagcgcacgtttcagagtggactggattccgcccagatacacttcggccgtgttccagctgttcaaacaggaacctcatggttgtcttgcatcttgcaggaaaaagtggaagacaaccggtgctccgcgacgcagcataaaacgtaggtcgggaaaagctagcgaaaagattgcttgacggtcggtggtggtggggggggggggagggaggcctcgtggtgacaatgagacattgcgaggggcggggaagtctgagtagtcgaaagagaaacaggaaggaagaagaaaggggagaatattctagggttggataagagaaaaaccccgaagaaaaaggagattgatgcacagtcacaagttgccgaagaaggctccatctctatctgtcttgtagcttgtttcacgcctactcgagggagcgaccctcatatgagacaccggggaagaaaccgaacgcgaggcactttcctctcggttttttcttttcttggtgtgccgcaatgctcctccctcgatgccttttgcggccatctgttcacgaaaatctctaggtcgcctagcaagtctctcagctgggagttgaaggaattctgcatttcttccttttcattctagtcccacctgtcttctatgtctttcctcctcgtactttacagttcacgcctgttttctcgaggctcttttccttgtacttctaccgtctccattctttgccttctcgccgagagtggcgctgccacgatcgctctcctccacgtgttccaacgggcaatatgcatgcgttaaagccacatctcagatatggggaacctaggcatcgaaggcaagtaaaaatccactcataactaaggtaattcagattgttgtctgctctagctgcctcctttctttctcttctcctcgtctagtgtgcagtgaagctggaaggagttcgctcacgccttctgtcagtgcgacttttttaatgcgctcgttgcgcaaacttagagaaaatgagatttctctccaccaatatacattcccaaggaacgtgttcgatgcacaagggaggcgaccacaagtgttaacacattttcatctcataagtcttcaatcacttgcaggagtgccgccggatgtctgggcttctgattcagctgcgttttgttccgtcaaagaaatcatctgaaagaaaaacaggaaccgactcaacaaggaggcggctttcattttccgttcattctgccagttcagcctcaaactcaactgcgtgcatcttaatagaagttccactgttcagctcttaaagtgactacctagcaacatggacgcgtgcgaatggggcgagacaagcaacgctagactcatattgagagaagacatcacgattttacatgggctctacacagaatggaaacgtcaatgctaatattccacttaactgggataaacaatgccagactaatctgtgcgagtctcagtagatacaagcaacgcgagactcatattgacagaaaacatcacgatctcacaaggggggtacacagaatggaaacgtcaatgctaatattccactcaactgggataaacaatgccagactaatctgtgccaatctcagtagacacaaggagcttgacaagcaacgcgagacttgtattgagagaaaaaatcacgatcttaccaggggcggtacacagaatgaaagcaacgaacctgttcctaaactggcaaattaaatcgggtttagttctgtgaggatcacgggatttcagagtggtctcgcagaggcaaaacagagaggaaggaaaagtgtgtcacggccagtctccacgttttctcagttctctgagcatacgttgcatttacgagcacaggcgtttctttcctgaagtaaaacgaattagaggaagacctccacggatgtcaagtggtgactggagaatctcatcctgagtatctttgtcgtaaacagtacgtggcgttagttacaggttcactatgcgctgcagagtgtatgagattactgaagaagacgaaaaacacgcagaagacctgcatgcctctccagagtgaaagcgatgaaagaaagcaatccacagctatccatcttcagagatgaaacataagaacagacagtaaaatgctctctggagtgtgtgctcaagtccaccgtcgaacgtgctgcacatcgcaaagacgaccttctcgctgtgacagaagacacaacacgcggagcatgagccgaacaagaaaggtcgaaagtcctttattttctctttttctatatctgttttatgtgtcttttctttttgggaagatctccgtttttctcgcgggcgccttcacagcctctgagagctgcccccccctcttcatcgttgagtcggacaactttccgaactgttttttctcgctgttttgcgccggtttgctcttttcttgcatttccttccttcttctttctcttgtcttccgttccctgcctcagtccatcgatatttacaaacatgtatacccattttttctcatctccttctgctctccctcctgctagctgtctccggtgtgccgcttcctctttcacttcttccgagatattctatacaccttcgtctcccgactcatttctccttccctcttctctttccttttttatttcctcctagttccgtccctctctccacctccgtttccttctcttttgactcgagtcaaca

SEQ ID NO: 729 - DNA, 2061 bp, Toxoplasma gondii
aaaagagacagatttgcgtgtcgaagcgctcaggtagacagatctgcatcgagatccgtaagaaacgggatgagtcctaagtatctccgcgcggtgtacactcagatacctacacgcgcgtttttatctctcttaacagttgtttctctggagagaggagcaaggaacggaaggaatgatcgcggaacgtctttttcaggttgtctgtctgtctcgcgctcagctttgcgcagatctcaacagtgttcaggccgcggaattcaaacgagaacattttcttactggcgcaccgccgctttccctgaacagaatgctttcttcgctaacgggtacactcgcgcgacaagatggagaaagcgtcttcgcatttgactcctctccgattttacgactcagggggaactgcgccctcgttctgttccgttgtcgcgaaaactgcgttggcttctctggcctcggttttctttggcttctctggcctcggttttcttctctcgaagaagggagagaactgcagcgtgtgggtgtaccgtggaatctcttggaactgtgcaaagaggaaagaggaaagagaactgcggcaggtgcgaacgcgccgagccatgctgttccgtggcgctgctgcgggggcgttgcggggcgagagagagaacaagagagaggaagagaaacggagaagaggaagagaagaagaccgagagaagaagacgaagaagaagtgagagagagagaggagaaaaagaagagagaaacggagaagaggaagagaaggaaaagcagatagaggaagaagagagaacaggagaagaaagagagacggagaaggagaaagagaagaaagcttacgtttagattcgtctttccgggaaatggtggtaaggaacaaaggtggaaactgaccagagatcgaacagttgcagatgacaagaaaaaagactcggtgcgcagcttgcgcgcggcgagctgtcctatacaagggacgcgcgaaagtcgcatgtccctctcttctccagatttcctcaaatgaccgcatcacagagaaaccgctgtagaaagaaagatgcctcgttgttcctcactgggtggaacgagaaacgcaaactgcgtagccaggctccctttttccgaggtcttcaaggcgcttcttcgcgatgttactcacctgccctgctgtgtctcagcgctccgctccctctccgatttttaggtctcgttgtctctctttcgtcttcagagttgaagagttcgcgcgaacaaggagaaaggaaaggctaggaagcaaacagggggatgcgaaaacaggggagagacaaagggaggcctggcggagaggcgccggcaggccatgaccctcaagtccggggagagacggacatgcacgcaggatttttttcacatgcaaaggatttttttcttttttcctgcatgctcttgctcaattgaaacgcgtcttcaaggtgtcgtctgtcctctctttcgagttgaatcccgacggttctccgttttttctcattttccaacagagagagcgcaggagaaaaaggaaaggctctcgctgcttcaccgtctgcgagcgaaaaagacggactgggagaggagacacagaagcgcgtttcaggccgcgggcggcgtccttcacagaggcggggaacttgaatttcttcgaagtctttcgcgttgctcgaaagcctttgccttgcagtggtttctggagacgctgtcgacttcgtctctcccgctgcttcttgcatcgtggcttccctcccatctcgagcttttcctcttggtttttcgcgttgcctttccccggctcgttctctcttcgtcttcgctcttcctcctatacctctgttgtcgtctcttcctctctgccttctcttctctcgtcgctgactccgccgttcctccactctttcctctcccttctctccttctctcctcctctctccctcctcgtcgcctgcgagcctcgttgcctgcgagcctcgttgcctgcgagcctcgttgcatcgtcgtttcgttcttcctcgttcctcagctctgcgagcggacgcggactca

SEQ ID NO: 730 - DNA, 3664 bp, Toxoplasma gondii
ttgatgagtgccctagcgctatggactatgtggacggatgaacgggcactgagcttgcggttgcaatctcgagtaaaccacccgtttctcaagtgtgctcatattattgtgagcatgctggacatgaactgcgaaacgacgaatccgtctgactgcagatcgtcgacagtacaggaagaagtatattgtgccatgcatggccttatgatgcaacacgtcgtcccccgcgattatcttctcaaaacagagcatcaggttttattgtataccgttgacctactgctcattcgtgatgtacggggaggctcgggagaagtaccaggacaagacgaacgttcgacagggtgctcctcgacgattatctctctctcagaaacaacgctacagagagcaaacgacagctacacaaaaagggtgaacgctacctaagaatcatctatttccgctgtgaaaagacaactctctagtcaccggcctgtgggggcctaacttttgaaatggacggcggcaaatgcatgccgattttctgttgccgctattgccggacatggtttccgttgttcacccttctttctgtgtattcacgaaagaggcacattgcagctgacggagttcaggcggtgtgactaaccgcaagagtcgcctcagctcatcaggcgagaggcttagaagcagcacattcccgcactggtggaaacacctcaggaaaagatcttagttaactagtgaacaaacctgggaaaacggacaactgatgctgttattccgtataccaccgccgttgctcatgtttcgcctgtgaatcgagtgtggcttatttgcttacccactataaccatcctcaaaccccgtaacaccaatgaaatcgcgtactctgagacttgacagaagaataattacggtatgtacgaagttcgaaaaccgctgatgtagcagaagctgtggactgtcacgccgttgtcagcttctcgtattttcgcagtttaagcgtggagccatacgcggcttctacaaaagctgaaagcaacggcaataccgctgcagttgcctgcagaagccgtatggtgtcgaatatacgcatggcacaatacaactgccatggaagtacaatccatgtcaccttcagtatgttatgagagttatacctattttctactgttttccgacggctctcttcaggctgttcacttcaccagagtggtcctagcaccatacttcccggtaacgcatcttccgtcaacactcggaaagtgcactataagggacaacaggctgttagcttttgtatacaaataacctcttgttgatgagcagcacaactccaatacgtcggccgcactcaggcggccaccattcacataactaagctacttgacacacggtcagcagacgcggcaagtgaactggtgaccgacgcagcagaaaaacgatgtcgctttggaaacacggcgctaaacgaccagcctcaaactacggatggatctgttactgcgtattctctcgttcctccagaaaactaaattgttttgtgggtcagggtcatggagggaggagttaatgggcaagcatacagaggaacggcaattccgcgatacaagaactgctagtagccacttaggtgagtgtaatcaacctgaattgcaagcatccatggagctgcgtctactccgcaacgtatgagtgttttcccttactggattttatcagtctgctggtgaagatcacactctctcagcgggagtgttttcccaaccgatattctgtgttaaaagtactcaaatgtgcgcacagtacccgagattcactggtgtcttacgcacgtcacacatttttaggtgacgttcacattgtttaacgacaaataccagcaaacccgctgcgtgcagtcggtcgacatgacaatcgctatcgatggtagtctggccgtgtcttcttgcattctttttaccagaacagtggttcgcgaatagcggggttggctgcgtgctgctggcaggcctagcaacgattccgcgctctcgcttgctgtgtgaccgttgccgtggcttgtaggttgagaccccctggactgtttcctcggtttctccgtattcgtgagggatgaatccgccacacaagtgatgggaacctttaccgcgctgcacagatctacaatggatgcgctacgggagaagtgaacttttccagttccattggtaataacatccaccgttgtcaaccgcctttccaggagtgcgtgcacgtgtcttggccacggaaatgagtccctcggaccttgcggcgtgttaattcaccaccggtccgtcttccgggagagttcctactgtgggagcggctgttggcacgacgacgaacggtttcccctggctttcccgttatttcgccttatttacacccaacactccggagctgaacatcgtggtggccagcctcgtgtagcaactgcggcgaaaagacatgacaggcaaagctgctgctttgctcaagtaagtctgctagacacatcccgtcgcctcacactactagccgtctggtctccgtgcgcgttctggttcaggggtgaaaatcaaaagaaacgatgcatccagagggcttctctggttgtcagaggagcatctaacaacagaaccgccgttttgctccccttgggaactgacctgaacgccgctagctcggtgagatctacgtcgcacgcggggctggcggcacgtcgcagtcccggctcgtggtgtgagcgatcggtctacacactgaacgttagcccatctttccacgagtgggttgaacgagccggcaatgagtttaggcatctcagatatgacaagaaaggcacaatttgttacgggagtgttcgtttttggccgggttttatctacaagcctttgagcatgggccagctggtcgtggacggtgaatcacttcctcgagctgcgtgtctactttgcttggctcacttcttcctctcctaatgctacaggtataaatccgtcaacttcgtttgatacccttcttagaccgtgtgtttgctccattaacgcaaacgccaacgtgctttagttgccacaaacacttcgcgtcgcgggtttattggctctccatgggcgtcgccattgagtcccggctcgtcgcgaccgccacctctatcaaagaaaagtgtgctttgtacaccttcctttccttttcagatccaaacactctttttgcatcggagcttgtgccgcggcatcaagttagtctcttcagatgactttgtcgccgcgttggtttcgacttgactagcaaagctttcccatccgtcaagggaacgggtaaggtaaactgtgtcccgcgttgccatcgtggatgcctacacagagtttttcacagcttcccatcccgctgtgcttcatcggttagtaacctcgtggacgtggctatgtttttttctgtcgaaaactggctcggctgtagccagcattcacacgccatggacagggattcgcgcccatgagcacctgcacatatggcaaccttcaccacgcattgatccaaactcatccgtcgaattcttcccgcttcccttgtgcttgtttctgcaggcgactccgagacaggcgacgcggccctcaggcttccgtcgcgcacattctcgaccggagttttcaaatcaagccgttctcttcga

SEQ ID NO: 731 - DNA, 1252 bp, Toxoplasma gondii
attttctcgtgaacgagactcgacctgcagaacttggcaaaaggcgcctctgagaggcgccgcctacacttttgtaaaagagaaagggcgtgtacacttcactgtgaaaaggctacctcccaccttctttgagtctgtctgttgtttcccggtaaagacgaaactcagaggaaaagagagagactgctgattggatgtagacaagagtcacgagacaacgcggcgctcctggaagcagccagtgctgtgtacatacggagcgtcccgtggaagaagacagagagtacgcatgcagttcacaaaaatgctttaccgagtgttctgagtcgtcggaactgggtttctggcggttttttctggaggcggcacctctcgacaccggcgcattccagcctctctcctagaagcttctgacggcatcatctgggacaggtttcctgtcaaacgcgaacttctttcaccatctgttcccttccaccacgtagaatgtcgaatcggtccgcagccttctctgcggtccatccaaacgggcatttgcatgaagatcgagacctgcacatatgtgtaaattcgcatctaaaattcaacttttcaatcgacgtagacactacataattatccgtggatatatgtcggtttgcttcttcatgtgcaaatatatattcgtagatgtatggatatatatatatatatatatatgtattggtgcagctctatatatatatatatatttcggcggatctaaagtgggacttgcttacaaagcagttgcagtaaggaagcttttttcttgccaacaactgtttgggttggcaagcggcggggcaccttcttcagctcttttttggacatttgcataatgggtgcatctctttctaaacaccataaatgtatatatatatatatatatatatatatgcgtctatgaagagttggtctacagaaagagtttcttcggtgtgcagtgttttcctttttaggcacttttttagtgttgttcagagagcagaaaactctttcccggtacaactcgcttgttgccttggacgcaacgcggtgtctctgtcttgcttcgccagaaatgtcttcggtcctccggatgtcgcaacatagagacaaggaagagcttccctcttgacagatcctctgcagaagaagagcgagaattttccttgagacacgcaggtgtggaggcctgttttcatcggttttttcgcagcctcttcactctgttcgctttttcttgtgtgca

SEQ ID NO: 732 - DNA, 1110 bp, Toxoplasma gondii
gagacaacgacctctctcctgttaccgtctatattactagcgtctagcaagtgtcatgttggaccgactcgttgcgaaagaacagagcaagatgcttgcaagtccttccttctcgacgtcatcaggagggcaactgtcggcagcgcccaacagcaggccttaaatggtcatgcgccaagcctgtgtgtaactagcattttcgtctaacaccgatgtactctcagactctttccattcgctcggagcttcaggccgaaagatacatatatatatatatatatgcacatgtataggtacatatggatgcatgagttagatctagtggcgtcgctgtcgcttgctcaggagttgtggaccaattttcaaggaatgcaaagttcttgtttgacgttcctaagaaattcgtctcttgctttcgtggatacaagccacataatcagagagtgagacgtcttcactgctggaccggcgagtggtgcggcgaccttttagaaagtgttttgaaaaaaacaaatggacacgaagatccttcttcgcgtctggtgcttattgtggacgcatctccgtcgatttacgcgtccgatttttcgcgtctgtcctcatagacacccagcgagacgcaaggcgcctcgtaagagatctccaccaatgaggggtgcggtcttcgactagacacatggacgtcgacaaaagtacgttttgacgcatcaatcgtgtggggtgcatgtgccgcatttgctgatgtctgcagagaaacaagccaagaagagttgtggcttcaacttctttgcactcccttgtcctaccaagtgtttgtcagcacctgcttctgcgattctgtgtgtacaagtgagagctactcaactgctgattttcctctttgcgtcggactcggcggtcgacgggaaccgtcgttgcgtgagtttgacctggtgaacataaaggaagactcgcatgccctttggtcgcgagaggcccatccccttttgaagcgacaaaggtgtctctggtcctgtaattggtcatgatctcgtcgggatggctttcttcaacgccttctttcttcatttcacacccgctgttctcttttcctcctttctgggggtccta

SEQ ID NO: 733 - DNA, 2550 bp, Toxoplasma gondii
acgtcctctcgcttcctccgcttccctttctgggtgaagagaaaccctcgggaaggtgacgggggcgcaactgggtgtgggagtgtcctcgcgttctccgcgtcctcttccttcactgtcgagtggaaagcgacactttggtctctgatcctgtctccagagagacattcctgctttaccttcccggcctctgtcgcagctgcaaacgactcgactttccgcgccccttcgctcgccgcgccgggcgtcgccgcagacccgccagccacgtcttcgggtgtatagacaccgcgtccgcgtcgctgcggcgcttcacggcccggtgtatgtacacttgggcctggtgtgcgggcggtcgagagcccgggtttctcgggtttttcaggatgtcgaaatctgtcaaagtccacggctgtggcggggacagcagtcttgatttccgatctttttagcggaatcgaatcaacacaaatgcctgcttctgtatttccataggattcactccgcagtctcgaagaccgccgcggcggggctccgcccccagtgcatcgtccggcttctcgctttccttgtttcgttgtcggacgtcccgcagagaagtcctcattggtgctgctcccttccgcaggccttccctttctcgccctccctgcccccgacaaagaagaagaggaggaagaagaggtagaacgggcaggcagtctttgtgcatctttcatcttgtgttctggagaaggcgcatcctgagcagtctggggcctcgcttcccctatttttcgcgcttccaaaaagagcgagaaagaaaaaaaggttcggtcgcggtgcagactgttctgtggcttctccaacatgtaggcccccgcactccaggcacaagtggcgcgtttgcaagaaaaggaggaaaagccgctgtagagcggtcgaaaaaaggagaggaaagaaaagcgagaaagagaacgggacacagactgagacggagagcagtcactgaagggagagtctgttgaactgggagaagaggcgagaaaaataaggaaggcacagagtcgaggccgaatgttcagaggaggacgagtgttcagaggagacccaccgcgagggaagaaggcagcgtggcggggagacacgggactcggcggaagagaagccgtttgcatgcacgcagaaagtaatacggcaacccaggaaagaaagataaagtgaacaaatccattgaataagagatccatttaaaacgagaagcggcgccggagagtcatgggagccgacacccctgtctcctcgcgcttgctgctctgctttggtcccttctgcacctccggtctttctgcctcctttctccgcagatgtacgccgtccagagaaacaattatgtgccaacacgagctccctcaaacaagttgaaagttgcctttcaaaaaaaagccgcgcttcacaaagtcgccgcaccccggaccggcgcagagacccacgcggtgcttgagatactgttgagtgtagagaccaggaaagccgcgatctgtgctggcttttcgtgtgcaacgacggccgcatccaagaaaaggagtactctgttgtgtttgtgagaacgtttccctatggcatgttaattaaatcttttccgggatggaaaccgaaggcaaaggcgcgagcttcgagtcgtctcgtgcgctgtggcaactgatcgcatgcagccggatgagtgtgtcaggaccgctaaacacaactccgtgacttcggtgtgtttgtaacctgcagatgtgctaaattctaaatcattgttgagtttcctgtgctgggaaaggagcggtttccggtttccagggcgacttgcagtcaaaagttcgccaactgcttgtctaggccgacgcgagtttcacggctttctaaacagccagcctgcatgcacgtgtctgtccgtgcactagaaacgagaaacacaaacgcatgtgtacacgtatatttacgtacgcgtgtgtttatctctgtaaaagctcacttgtgctatatatgagcatgtttctgcggacatctgatcacttgtggctgcgtgtctccgacaagactcaagcgctgctgagacttaacctcgacgtcttaaaagctttatacaagagaagagagtgtccagatgtggagatatcgccatgtgcggagctcctttctcttctcttttgtttcgcatctgctcctcctcgtgtcgtgtgtttcctacgccttctgcactcgccttttcttgagccgatgcaaatacacctcaccaggtcttacggtccgcagtcttcttcgctttacctctcctggaccgcgcagacgacaacttctcccatggattctctgcggtctcatttcttcaagtctggcgtcgaaagcttacgccgcgcgcctacgaccaagtgtacatacacctggaccagcgagctcgggtgtctcttgacccgcttcacgcccttcttacgaactctgccgtcccgtcgcgtctcttcccccgaagtctgttagcctcttttttatatttttctgaagcaattttctccttttctctgacga

SEQ ID NO: 734 - DNA, 1591 bp, Toxoplasma gondii
ctctcttttgcacactagcgaagacgagccctgcataactttctcctcgctgttcctcacactggccagccgcccgccagaggcgaacagcagaggcttattaggcttaccattgttccgaatacgcgatagactgagttgcaaggatgacgaagctggggttgcgtccgctatccccacacatccgatttcctggcatatctgtaggtgacgcaggctccctggtcgcctaagatgtgcgacagtgtgggacaatgacatcaggaagagaaactcaagcacacatgtatgacgaagcgtacgcttatacaagcgtgcatgacatgcagtctatgttgatcgattacgtatctctacatagatgcatgcacttagacattcacggatgtatcatgtgagcaagccatgacagaaaggagccgctagataaaaggacaaacgacgaatacaactgttagccgctcccatatagaccgtgacaacaagacaccccggagacagctgcgtaaagtcccggacagcattgagggggagggggagttgactgaaaacagggaccgcctgaaacagtgattacgacgtgatgggtcccgtaccgcccagagcgttgctccgcaagtgacgacctatcggcgagtgttgtttgacgcctatgggccagtgagacatacgatcgtcgatcaagccaagtgacacatgctgaaaacacagatacccgctagagtgcgttgagttgtaagcactgggcagtgggtacgcacacacaacagaaactgactcacatccttcccaacacctgagtaggtgagcagttgcagaagagtcaaggatcaaaggcaaacaaaacaccagaccgattgtggatgttcctagaaatttccatctcgaacatgggttgttcagttcttgccatccagttgaattgttctcgaagctaaggatcaacacggcgcagcaagcttggaggtatttctcatttactccacaaataatcactcgttagaggtgtcaccactctacagtttctgcgcctcgcacagaatttgctttgtcaaaaccgcccaaactatcaaatttatgctccttagacagatgttgccttcgaatcgtgcatgcaccgctgtcgacgcgcatgcatgttcccctggtcgcccttcacagcccgttccctctagaaaatcaaagtaatatccaaaacgtccaccaagccgctatagaaagaaatacgtgaatattatcgaagtcagagcttgacgtgtgaagtccctttgtgccggtcgtgcgtcatcgttcaaatgtattgtcgatgaccccacttgagcaaagcggctgaatcttgagcagctgctgatcggttcgtgtcgttcttttctttccctcagcagcaaccccttatctgctgcatgtaaggggtaactcttgagtcaaatcctgacagacaaactcaccctgacagaatcctgctctggcatgctggcagtctcttgcggttcagagtaacaagtccgccgcggtcagcgtcaagagtcaagcataccagcagcattgcaacaagaagattacatcatatgcggagtttcatggagcacaa

SEQ ID NO: 735 - DNA, 3053 bp, Toxoplasma gondii
attcttcgtatcatgttggctttttagttgcagctcccttttgtcctccaaatagctagacgcatcagactagcgtttagctacacttcagaagcagcaattgctagcgtcttttcagaatttggcaagaagtgcacgtggttctcttcaacggtacacagaaaatcgaccgctagaggacgtggagagatttgaacgcaggagtcactggcacagaaaggcgagagagaccgggaaactaaggcatgtgaaattgcagagcgagacaaggcaagatgcacatgtcaggaggatttatattttctccgtttgcatgcactgtcatggagaagttatgcaacgccgtctgaacaagggaggcgagccttcctgattctctgtagatgcacagatgttcaagaacactgctaccattattgtaaagcagtcagctaattgccaggacacgagctcaaaaaggttacgtttttgtctcagtaatctgcgacagaaccaaaacacaatgacatctgcacatttcctccgctgtgtgtactgtatatgcattgaggggttgcgacagcgggacagaatggaaggggacgggaacgctgctttgtggagttctctcgagtttctccgcagttttgtcctcgctgtcggaaacgtttggagtgtctgtgcgtgggaaagtacacatagatttgcctgccttgttcgtcgccgaaggaccgtcaacgcatcttgtccttgtttgttttaccccgattgccacactcaaaaattcgagcattcaccgcagcctctcccgacctttctggcctccagctcatgctgcttcctcacaaaagagcgtgacgcttgtagagtacctctgtccttgttgttagatgcacgattcgcaaggaggcagccctcaggacagcttaccactcactgctgttcggtctgcagcttgtgtgacacttagatggagtgaaagcagaagcacttcttttgtctctgtctagcgtacacacatggatggcagaaggcgagtctggctgtccattttcagtttactgatctcaggtgagcactccgtttcacaaaatgaccagaacgcatctggtctatgctcaccagatgacgaccctggaaaactcaatgcattctgtttgacagaaatcgttctcgcggaaagattaagcgtcgtcacaaatgacagtaagcgcgtgaagaatcgctctcggtcgtctgctgttgtgaattttagatgcagagctgttgatactaactagctattaagaggcgtcacgagctaaacaccatgacagcgtagtccccattgatacaaaacttaaaagaaaaccggaaagcctttgtttgtcattgcgttttgggtcgcatggaagctctaggaggtgaggatcgctgcaatgccctacacaagtgtttttaggactccgagcgtgggctttcctgcagatgtctgcgattcgattatactactgttttctgtgatctctaacaatataaacgatccaagcgagaccatttcaagctgctgtcacctagatgcagataagagggtatggtagcatcaggaactctcaaggtatcttaaacgccctttcagtcgacttcgtttcctgtgaacgtttgtggtaaaccactatcacacttgatgagatgcgccgtttttacacggctgaagaacaatatctggaaggggaagttacttgtctccttttagctcactgtgtgcgtaggatcgagcgaagagagttcacaagttgtccttggaaatataggagatcgcgtccgttgctgggaaaatgacttccaaacagacactcgctgtttggggagaagatctgcacagacaggccacggaaaaaacaaggactctacttgctgttgttggcttttcagagctcacggaaatccagtttgaggcagagggtcgaggtagtacagtctagcttcattttccaagtaaatttcacggaaacctgaaatgcgcatggttgacatttagccgctaatatgcattctgatatgtatttatccattacaagttcggcatcatgtcccgttttttctccgcgtttttccttgctgatgttgtgtcggtcgccactccagttggtcgtgagccacatgacccgaacggcactccgaaacgatgaagagatttagaagcagatttttgcgccggatgcagagagggacacaacgggtcatttgacgaaggcaacagcgacttctttgacgattaggtcccaatgtatactccccaggaatcgctatcgagcattacagcaattctttgtttttttccctctcaacgtgccttttcttggtcacagctaaatgcgttggatttcagtatcctactacggagaggttattccacatccggtgcgttctcggtgcaacatatgaactactgtagtcacgcttattaacagcgacagaaacctttatctcgctgtcgtgtcaaagagggtgccctttctccttcgcactgggacagacacgtcactttccctcgggcaaaaggctgcgtggcattctctaagcacagcgaaagatagtcgttttgtcttttgaagataagcagcttcctgttttttcgaagaaaaacctaccctagagttctctttcggcagagtaccacacatgcactttcttagcctcgccacgacgagcgcgaggccctgcgatcggccgcgggcacacaacagcgatggtttgtcctccaagagatcgcaaagatccactatttctgttttcttcttcaccaacacactttctctcagtttcccgactcacccggttgcacaaagtcgtccgtggacttccattcgcttttccgagtaagaacgccctttctttcgccactccggtttctcgcattgcgagacaagaaaaagagacacgtgtgtgcttggcctttcctgcacgctgaacagagctaacaaacgcgaccttctctattagcggttttccccccgttgttgggatctgagtcagatttcatttttctttttctcttctcctaagcctgctttcgaagtcaagtcttacca

SEQ ID NO: 736 - DNA, 2465 bp, Toxoplasma gondii
ggcttggtgatgcacagtacagaatctctttcttcacgtcattcgtcttcatgctcccttcctcgaaatgctcaactgcacgtaacacgcctaggagaatctggtccacgctaaccagtgaggcaggattcatgcacagccaacaagaaaagggaaggggtgatctgtctgaaaacccagttgaatcgccactcacagcagaagtgtggtcacctctttcccccgttttcctctgttccgtgcggtcacgtgaagttcgcactgaaatgccgacatcgctcgtcaccccttccgttgctcccggcgatctccggatgctttcttcaaacacttctgcaccgtttgtgacgccgacacaaagcccgatcgtgacgtgaatatcgggacgcaacgggtcgagacaatatgtgaccagaggagcctcttctgcaggagtaccctcactccgttcctgatcctgcatgtgtgcagatggatagaaatctgatcgacatcctgagcagctttccattttcttttttcctcgattttctgcgtttccggacagagacgctttgtatacacaggcatcgcccgcgacagcgtaccctcttacgaaggcgcaaaactgttccttcaaccgcctgcaggcatatttcacctggtgctttccgttttacaatgtagatactttctaccccgattagagaagtcaccttggaggtagctcagtcaaagacccacgtgcagtgatgaaaatggcgagtacaagacagcacccactctgtcacatcccaacctccttgttgagagacatcacgagacacaatggcggtaccagaaaaaagacatacaaaaagcggtggttgttcgttttcaagcattcacgacaaagggtgcggcaaccgacttgcgctgcacacgttgaccgcctctctcttctgcaagcggcgtcactgacgactctgtgtcccccaatgtctctcaaccaccaagggaaaagtgcgccatttcgtctgtttgcatccttttcagataattccccctttgcgttgttgagcgtcaataggaacacagaattcaaatgcatgcaactctgctgcaactgttgagccagttttgctggcatgccagccacaagcacagagccgagaaacgtgctaaacggagaaaagcaaggaagaacagacccggtgccgagaaagaggcaactaaagtaagcatggtagcaaagcggcgaccaggcaagacgtgcggcaatctccaaagcaagcatgcaaagcggctgtcgaagtgctttcgtactcgagcctggcacagagcagtcagttctgccacccagccagactctccgaatatagggcgatattggtattttcgacagaaccaataagcggagacggaagtgataccaccgaagacacaaaatggcttgcctgcgcacacaaagtaccgctctcgcggacagctggttaccgctctagtctacgaacgtgccacggcgccgatgtaaggtagcgccttgcctgtcggagtttcgcgaaaaaccacgactgcaagcctctttctctctccatggatttgttccacgcttcggtgtgccacatagcttctccaaaattgtgctctttctctctcttttcggggtgttacgaggagtataacgtggcatttcggttgcgagttccgcgaacggtatgggcgcccgaggaccgagcagaaaaagagtgtacgttgtccgtaggcatttcttcgtctgaacgcacgaacaccgcatcattttggacgtgaagtgcgcttctcttctgttgtcgcggtcgcctccgtccccttccattgcatcggtttcccaaacgccgtgtgggtgcatttttcgctcctcattcccagagattcagtgccggcttgtcctcttcctgtggcgaacaacgaggaacgttgttgctgcggagtaatgctcaggaatagcaaggagagcagaggcgtgttgcctgttctactaatagtttcgcgctttcagagttttcgcgtccattttggtcgactggtttgctggtcttcctcttgtgaagttcccgcctttccgcggccctcgcgcttagcctcctaccccgttgtccgcagttgctaaactctttttctaccatccgtgacaactccaaggtccgttttcttgacgacctcattcctctgcggtgtccttgttctttttcgaaggaaccgccgcgcaggtcgtgtctgcggtctcagaagccgaagcacccctggtcaaacttcgggaaagggactgtaccgtcggcaggtcgggaagtctccagcctcttttcttttggcttgcattcgctgctaccccacctacttctcccagacgccgccatgtcttctttgacactggcccactcgttctccactaatacgtagtcggttcgttttctgcgcggaggtcggctctctcgttttcgcgtgtctcttccccttgccattca

SEQ ID NO: 737 - DNA, 3042 bp, Toxoplasma gondii
cggctaatgaatctggttcgggtggatctagactgcaaaagtcagagttttctagtgctgtttgagagggagattggcgagcctcaagtgtagacttcattgcgtacaagacctggtacagtgttaaaagtgtcggacttaacagtgacgcatgcagaacgcggtgactcgtgaaagcacctgtgaacacggcactgcggtatttgttttccccgtggccatctgactccagcggcacaagtggcgggagttttcaaagacaggagattggtcacttatttccggttccaatcgccgtggcagctgcatcctttgctttcccggacttcatcacaccggactggaatattccgtgtctttcagcaccgctttgagaacgatgaggacgccccagacgagagcccagatccatccaacgataggcaggagaagttggaggactccaatcatcatgttggagacgtcgttctcaatgaaaccgagaatgatgacgccgaggccgaagacgaagcaatttagcaatccgaggaaaccgtacgcgaccctgtctttcgaacttggaggctccggcaccctcaggtgcagtgcacgctgcccgacctcgctcaaagacattttgataaagcaaaaattcacacaaacccgcgaggtgaaactccgaaacgttcacggactgcaacagatcaacttgccaagtgtggagagacaaacagagagaaagacagagatgacaagctgctctgacgcgggcagtggcttcggggttgtcaggcgaactgagactcgcacaccgctcaaaggggagaccgtgaaaacacggacacgaaggtgtgtctgttcttgctaacatgcttccgagacacggcagctttggcctgtctgcggccaatgcttgcttctcggttcgggcgttcatgcggatgtcagtgagctgcgcttgttacgttcggaacatgaacatgtgtacaacgactcttgcctggcaatcaccgatacggtgacggtttgctgtcggtccaacagaaatgcttctgtctgtttgtcggaaacgggaaaagagcgaacagagatttcgttcaagacttttcacgaaacaacgggggaacaacccccacgtacccgtgtgtgtggcacagagaaacacgctgcctttcgagggaacgcggagggagtgaataacgcgaagctttggattcaagcagggaaaaaaacctccacgcagttgactggcagagcgacacacgttttatctggaaatgcgatttttgtgattcattcggagtcaaggaagcctagacatcgcggccttgcgtgagtggagtgcactcgagaggcttgcacagaaggtctcttgctcgcttcacgtagaatcgagatttcgtagcaaaacagaaaaggtagaaaaccccctagacgattctatgacgaggcaaaaggcactaagggttgtgtcgaatgcgcaagaagcactctcttcgcctttatagcccgttaaacgccacaacgatgactcaagaagagcgaagacgactctaggtttacctctaatgtcgcagcttgtcttccacgttttctgtctgctatggaaacatcgagttccaaagtggagaatccctcttcccccgtgctttcctcttgtcaggtgtgtacgactcctggcgctcggacgacactcttttccgttttgtgttccatcacacgaatggaaatgcatgcgtctacacggatttctgtggcctccggcacgcctgtgccattttcctgcagtcatcctattcgctgtcctcagcatctgtccagctgttgtgccggaggcaaaaactctgtcttagatttttggcccattatctttacagctctcatggtagcatttatgttacccgttctgccaggaggattcttaaggttctattggatttacatgccaatacagaatcctgtgactctatttactcgtgattgtgtattataatccaagtacagtttgcatctacctgacgcctcagtttacgcagagctgcagtttaccaggacgcaagtcggcataatcaaaagcttggtggccactgggtcaccgcaaactgccttcattcgacttcgtaccgagtctcagcgcgcatggacaccctaaaaaagtctcccttctctgaaaaacggactctcggtgtatgcacacccatgccgccggcgtcagccttccgggactgggacgtctaaaatagttgaagctcccccgatggatccaacgctatccctcgaactgtgtcttttcattgctgacaattgacgcacgtgcattcggagctcgactctcaaggtggttcgaggccaaagagggatgcggtgaagcgcgcgtagagaggtacacacatcccctgactggagaatctgaagacaaccagacaacagtgagagtgaaatgtacaccaagaagtatacacatactctaaaaaaattcggttgccgttgctataactcgaaaggccgaaattcataaagacaagacaaattccaaatgcggagtactttccagctttggcggaagcccgattcttcggtcgcgctggtcaaccctgtctcgcctcctcgcttcctgtcttcgatttcagagacatgtcgggcgttgcatggaagaaaaaaacctcacttttcgacgcaaagatcgtttgcgcaaatgcatcacgtggtgtgtgtggaccgcaaagccaagagggcttcgtttccctgaaaccgattgcactgcatggccgcatgcacactgtgcaactgtctcgtcgcctcctctccgcccagaccccccttttctcgcaggcactgaggcggaggtcgcgttttttttcgagacccctttttaagttgttttcgttgaccgcgacacattagcagggcttttcaatttttttcctcgtcttctactcgaagctcgtcgtttcgcctcacctcgctccggtgtcttgacacctgtgccgccgggtctgtgtgagttgaactcacaccggcctgctgtgtctcttgtctcccgcgtttcaccctcgacgcaaa

SEQ ID NO: 738 - DNA, 1609 bp, Toxoplasma gondii
ctacggcagaagttgttcatggtaatgcagacctgcacgctgcattccacgatacacactctctgggtgcgcatttcccttttgtattgagagaggacacgcaggctacagacagcttaacacccgaaagtggaacaatctggattttatcctcgactctctcgtttactttggaatctgagaagaatatcatggtgctatcagcaaacaacgctgttccttcacttcgtcgctgtcgggtgcacatagattagcctctggtttgtataaaactcaagagctatataatgtgccctggttaaggaatcccaagaggcagcaccgataataacagtgcagcttgcgcggaatgcggaaatggtattctgtctgtttctccctcagagattgccgccagagcagtcggcggaagctgtggagaggccagcaacgctgattttggactgaagaaggaacctactctgtggaactctctgtcttatcggtaactcacaaaaagggaacatctgccgttatttccgttcgaaaactcgagactcctcagtgcatccgaatatcacaatgactacctcctaacaaactgtaccgtttacgcggcgtcacatttcacagccacagtcaaggcaacgtgcaccacgtgagtgccgattcattcgcacagatagaaacaaattcttggtcaaactcgcggtctctgtggatcctgcaacgtttcccctaaaccgtgaacccaacaaagcagcacccaagcttcactacctagagacaacgagaggtgcaactggcgctgtctcccaactttttcaacagaacatgtcagatgtttgttcgtatctcagtccacttcgcgctctaaccacccagtgaacaagcttacagatgcatgtgtgtctgtcggtttacatgcaagtgtgcacaaccgatgtgtacagatgcgtgcgactgaatgtatgtatggcatacgaaacagagagggagccaggggggaatagtaagggccttctgtgcgtcactgccggagagtaaaactggtttcgctccaggacaactcggacagcgcccaagaaaaaagtcgtcagtatcgtatcgtcgattctttgcatgtacttctcgcatgcagtcgcgcgcatgttgacaagactcggcgcgctgtgaaagcaggtggacgttgtccggatgcccgcagaaacgcacttaccttctttcaaactggataaatttcccagttctttcgcgaaaaatttcgtacccacttttccgcgggaggaaaagcatctcgctcggccgccgttcgccacccctgccttcgagtgtctggacgcctcaagacaaggttggccctcgagttggcgggttgtcgaccgccgcaactttcattgtccgcgattttttctcatcttggtttttatctatctctcctccacactttgtttgcgtttctcagcggtttgctcgcgtcctcagcttctgtctccaatttgccgcgcgcgagtctcccgccggggctgcggtgttttcccggccagcagccggaaacgctgcgccatggccgtccttcttctgcgagttttctagagcgtttcgtccctttttaaaacgcacttgaaga

SEQ ID NO: 739 - DNA, 4748 bp, Toxoplasma gondii
tactctttcaaggctaaactgcgcaaccgcaagtgaaagcggatgtttgcgggaggtcgtggacgcgccgatacggcgcagcgccgagtagagaagacaaagtcgctgaagagaggagtgaaagggcaagaagcgaatcgccgtaaaagacgccaactggacgtgtatgcacacacggacgcttgaggcaacgacgcttgacatgtacgcagaggttcacttgggggggggggtgcggccaccttcacatacgaaggctcggaggagtttcctgaagggagacatcgacgcagaggcgcgtgtgcgtttgagtcgatctagaaagagcttttcttcaggcagaaaatgagtcgaggggcggtagtctagagttgtcggtcttcgacccaggacgcgcccgtggttcccgacgccgggaaaaaacaggttgatcacaaagtctgggggtggcggggacgagctagctacgtgacatgtcagtcaaaagcgggtgatctagatgaggggagagaactcaccgaatgaactttgctcgcaacgtgcaccgatcttagctcgatttccacaacaggtcggtttgcgtgaggatcccacttattttttgagtttttgcagaagcgagaacccaaaatatccaaaaaatcgcgtagctggatgcgacgatgtcctttgttgtgacgggataaggtacgatcgcagacagcagccccacctatttttctgatagtgtgtgtggacacccgaaaacgtgtgtgcgaagtctagacttgtaggtgcatctgtgtgttcgtgcacagtgcacagcgatctttgcggagaaacccgtgaataaagacgcgaaataagtggagtaacgtgggatgaggaccagcggctgtggtatatatggggtacaggaaagacgggggacagtcatggtgtcgtccgtatttctgcatggcaaggcgcctgcatgagcgcatgtgcgtacagactcgcttgcgagtggcattttgcggtcttctggaattagaaccactagtcggcaaagcgggaagcgaacgtggggtatcagcgagtagaaaaagcggggaaagcaaagcgcgaatttcgcgagacacgaggcgacgggtccgcaactgagtggtctcggattttttaaagttgagaaatgcattccgcacactcttttttggtcctggatcgcatttggaaggcgacgcatacgtgttgcacaaaacagagacgcgcatgcacgtcgtgccgcgaccaacggggttgaacagacaatccagtcgacacggcgaaaaaacgaacaacaaacacaacggatgtaaattctcgtcactgatgcgaaagcaaagcgacagaaaaaaaagcaaatcgcggatcgccggtgatcctggcagctctccatttaacctcgtgattccgcttcggaggcatgccttcttacctagtctgccacaagatagtggacagcccaaagagaacacacttgttgaacagagcgcgtgcgcagcccacggttgagacactcgtgcagacagaacaaacagaaactatgcttaccaacttactaaaatacaggtatatacatatacacgcgtcgcgacggaccacgtgtgagcgcggggatatatatatatatatatatatatactgatgcatggaattatggaagagtgttgaatcatacacatcatggttgtagatcgccgttttttttgaatctgtgtgtgttctgctttgtggggtgggcaagctatatatttcctcagaagttccgcgtgttaccacgggactgtcttgaggtgacgctttatcatagacgtccttgtgacgacagaattcagaaaagaacaactaacggcccagcaagtctggcgggctgtgtgccaagagcagcaggggatcagttagcagcataatgctttcagaaattaaaaagaaaggttcggtttttggccaactccctgacgacactcctcgtcacagatgcacccacatacacatgtgtgaactgacgcacttgcatattgacatccttccataggttacatggttctgtacagcccgcatttcacgcaggcacagatagatctcgagggtaaacattagtcgtcgagttgcatggaggtctatgtcgcctgtatttacaaacgaaatccacacgtatacacacacacatatgaaaacagtaaccactgggtgcacggaaagaattctggagttatgcagagtgttctggatattttccgtggtcaagtcacacattctgttctgaggcttctacggcagcgttagagcagcgctggatccacgatggttttgagagttttcgggcgcatggagaaattgccgatttcgattttttgccagggtaggaaaggcgagacggcgacgaagactcggccttcgttcactcttactgaagacgggagaaagcgtccaggctccactggcgcgacaaagacaagaataaactcgggatcgtctgcggggaagggaacttcgatttccacggagagcgcagcgaacggctgtctcttcagctgccagacagcaggcgggaacgggtggcgttggttcgccagcggatcggcgccgcggccgattgccaagaagccctctctgttgacatttagtgtcagagagaggtccttacgggcagccatttcgagaagggcgcggaaaaacggatgtctctgccaatccttccgttgccccttttgcccgatcgacaaccagcggcggaagaagccagctccaccttgagtgcccccgtctccggggtgtccatacacctggctggcgagctccgagaccgctagctggaggttcacctcgacattccactcgcctcccaggctcatttccgtcacaacctcggaactcgaagaagcaatgaagcccgcaagccgcaaggcaggaaacaaagtgccaggcgggcggagcgaaccgctccgctttttattggcctgtctcgtctctgtcgtctgatcctctggagaccgaaggagacgcagaagcgactgttcacaagagcggcgcagagcagccgtgcttgccgcgaccttgcattctcgagaacgcgaaagtcgcgtttgggagagcagagaaagtcgggcaccaagtcgagagacaggagaagacataccaggcgaggcgagactggtggaagctcgcgctgaggacggtctccccacggctactgccaaagagagaggggcacacacgcaggagaaaagacacagacacacgacgaaacatggcaaagcagcaaaaaaagagaaccagccgcgacacagacgcccggacacagagaacagacacggaaaactcgaaagccgctgcatcgtgatggaaaaatcctaccaattcagtcgcgtacagcagcgtacaccacttgtaaatccacacagaaagcagatttgctacacagtacaaggacgtggatcttgtgcatgtctggtgtgatacgaataggtaaatgctcatacacacatcgaatgatatatgggagatacaattatggacaagcttgttcgcttgttctgatatgcgcgggcgtcgatccggctagtgtagacgaagtcaacatggcactgttccgcagttgtgtcgtcctggaagttacgggagtatgcttttgctttccaaagtcgctctcgactggagaggcctcatcaacgagaaaagaaccaggagacagacagacgtaggcgtcttaacctcctcagagtccgtcaaaagtttagaggcattcactgcatttgctgaggcagacgaggggtagacgaaccggtgaagaggcgttagtgtagtggcacgtgaagctcctgtctccatgcacagatttgaccagtttgtctctcctttttttgtgaatttccctcggagttctcagaccattgaagggagacggagacagaggagacaagcagacacgaattcacggtaaacccccgacgagtgccgccaggccgacagacagccggtcgttttccatgtcgtttctgttccccgccttatctttatccagtcaaacgaagagacgaaaggaaaagcgaacagaaaaactagacacaggtctgttctcgacagatgcgcagcgtcaagcccctgcatgcgcccgtatgcggcagggcgctgcgagtcgcgcatgcgcgcgccgttttgtgcgagagcactgtcgttattcagtccttctgtgctcgtttttcttggttcctcgcgtctttcgacgtctcgattgtctcttccacttttgcggctcatcggttcctccatgttcagcgaacacagggtttgagtatcgagttggggggctcgggactgcatgctccctgagcctaccgcttccgcagcatttctctgcgatgaaaacgcacgtggatgagatagtctcttcgcaactgtcgcccttgccctcattctctgtccacttctcccattttctgtgcatttcctctccttccacagtcacccctacggatgctgtagttccccattctgcgcgccgtccgtttaacagacgcatgtcgttcgctgtgagcctttgtgagttgctgcgccgctacaacccgtaagcgtttcgcttttttgtgcatgcgctgccttctggggactgcagcctcgtcaccgtccgtgaaactccgcgtttcgttctcttttccacgagggattcgccacactcgtcccggagcgcttcctttcggcgcgaaagactcacctttcttcccttgacccccagcctgcatgcacga

SEQ ID NO: 740 - DNA, 2022 bp, Toxoplasma gondii
gaaattgacagcgtgttctgcgcatcaaaggaccagctaagaaaccataaaaacgagtgcgcctacacgcaaatcccttattttcaagaataagaatatcggaaacctacctcttcttcggccgaggaggtggtagggcggtcggctgtgagaaacacaaacgcggacggagacacagaaaaaagttcagttcaacaaaaccttatggaatgagtccaccaagaaaccgcggtcaggaaggacgacgttgtaccacagaaacgaaagtcttccaagactccatcgcaaaggtccttcagccgtgataccagacagctcactccttgtgaagtctggtcgagctacttgtggccaaaaacgccacacttgctgagtgtatcaatctacgaaaatccagtagtacattcgactcgcagcgacggaaataagggggttgatgtcagaaaatcaatgggcacatgtcagcacgtcgcgttacaaagacagtgtaacgatttacagctcagttgctcacggtcactgccacctctcaatctggtagccactcattcgggaaaacgacagctggagcctgtggcgtaaagattacagtccttgggtaggccgcggcgtgagggaacaaacttctgggagtgatgcgtcacactctgccaccgtacctgcgtttgttggctgcgaagccgccgcgacagttccgttcagccgagtcggagttgccagaaagagaagggtggcgccacttctagaaacgaagttcgtgcctaggttacgagctgccaagttccccagaaaccgccgggtaagcaggggcgagtaccctcccaccggcgcgccggtaacaatgcagggtggctgcggtcgtatttgtcccaaaagtggatttgcgggggaacgacggttcgaagagtggagtgccttccttccgagagacagcctcctctgttgccccgaattccagttactcagccccgacaccgacttcggtaaaccggcacagcgagtgcgcgctaccgtcagtggagggccgacgacatcccaagcgatgctcgaaagttgacagttcatcgctgtgcagttctttcggagatacaaaccgagcacagattttgcgaaagaggagggaaaagacatgcgcgaaccagcttgcttgagtcactttttcctgctggccagtcccgaatattcacccgaagaaacgaaatgttaagggttgcgagacgggcggaaagcgcgagactcaatcaaatatggagacgattttctagagttcgaaaaggcgaatgtgaccagagttgcagacagacgagaaaacaacagctaggaggccaaagcagaaacaacgcagcggcagagacgagaagaggcaatttgacgttttatccatccgcaacacaaaacactgcaaaaccccatgtttttagcgcgcgatgatatgtggtgatctgcagagacgaaacccgacgtgcgttttcaaagaaattgatgcctggcgattcctcgtccgatttccgtttttcgcgctgtcggcgggcgtgcatgcaaatctcttggtgagagttttcaaaaaggcttgcagtgcatctattcgacaaagcagctagaggagttgctttttcgcagctgtggccacttttgttaaccatggccgaaggccaacgatcaacagagaacttcgcagtgcaacaaaagaaaattctggcggttcttccactacggtgccagtagttcctttccgtcgatctgcggtcgctgtttgttcgtatgtatgcttttctacaggcgtatgtaaacctgtggactttcgagtcggcctatttgtatacgcttgtgtataaacatgcgttgtgtcagaagttgcccttgcggctgatgaggggctatggttttctccagtagtcgaagttactcccgtctgtcccgtctcgcatggtaaactctaaagcatctcttttgtcgctcatccaaacatttttccacggtaacgcgtctccgtcaaaaagagttcgtatcctggtctcgaga

SEQ ID NO: 741 - DNA, 2006 bp, Toxoplasma gondii
gtgagcgacgcagcttaagcaaaaacagtgtcggtaaccttaaagataaacgacaaaaatggtaagcaacaccgacaaaaacactgactgcacgtcacacgcctgcattcacgtgcaccgtagcaggggaaagagaacaaccgcgggttctgtaaaaacacggaaaatttggaaaaaggtagctggctagggtgtagtatgtagaaaactgtggatggcattaactactttttcacagcttcgaattaggcccaatatcaattaaccgctgtctgttccacgcccccatgacactcgcaaagcatcactttttgactctctcacaccatgccctgcgccagtttcgggtgttcaggcgattgtcgagaggaagctttcaaactgccgttatcgcgagcccttcccatgtcactgcttcatgtacttggcttttgccagggtctatccgattatatgtttctaataatttgcaagagacgtgcccccaaaagtccttactttagcagcgtgaacgatttcatgagacccacatcgtcaggcacttcacttttagtttgtgaaatgatctactctatcatgacagccactgaacacaaggaacgaacactgacgcagttggtacattggagctatctggggaccccgcattaaagatcctgatgtgactaccccatgcacgctagtttgggttccgcatcgtctgcgcttcattctctgtgaggcgcatgtatggccatctcgaggtgactcctaaggcctcggtcacgagatagggacgggtttcacaacgagcttgaggggtacaacgcacgtgagcagcatacagtgaacacggctgattcccctagtctcgagacgcaatcctgcaaagacgggagatataacattttcttctctacgacgtgtttcacggcctgtagctatacacactgctctagtggctttcctccagtcccatgaagcaactagaggtatccaaagaccgtcaaaaattccgtaggacctgatatgttggcgggaaaaaacacgtcacactgttacaatatgtctgacgatccggcagcacatgcctcttttttagggacaaaaatattctgactcctcaatgcttccaggggcaacgacggaaacaagacaccaacggagtttttgtaaggtgatgctgtaacacaaacgggtaaagccttgacccgttgacgcacctgcaacagcggtctctcgaccatccatgcacatttaaagcttcattagtgttttattacaaaggggtggcaggcccaagcagtacagcaggcaaatcctggcacatatgtggaattgtgatgcttttcgagattcttcggggacattaacgacatgacaaccccaaaaatattgagatgtccgcggcgaatagaaatctttcaggctcgtgaggtggtgcattccgggaagatgtgcagtttgtatcaagctggcgcatagaaaagcagaaagcctttcgtttttcacatgccgagattatcatgaagtgccggcggtacatgcgtggcagtgacctatataggtctgttcttcttccgttgagctgagaccagcccttgaccttggagggagatagtgacagtatgactcattatgactggcttttattgcttttagttaattcacgtctcaggcagacaattgtcttcaatagtacaaaaatctcgacaaaacaaccactaattggcgtctggcttccgacgccccgtttggactcgcatcctgttacaggttctctagcacacgcgaagtagcaaggacgctagctgcatgcgtctatacgcggcgcgcgtgttgagactgccctcattgctggccgacaacagtaattcctaatcgcaagagcgtgccacgaaaagtggttgtatccttcttctgtttcgatcactgacgcgtcagaattaatgtggctctgaattttggttgagacctgaccgtttgccactgttccccgagcgtgcggagggtgagcacggtaatca

SEQ ID NO: 742 - DNA, 1053 bp, Toxoplasma gondii
ggtctgtacctgactttcatgtaaatacagaaatccctgaatctactctggtaacagtgtcaacaccgacggttttacgagactgtggctcgtggaaagctcagccctcccattccttgttttaaaaaactgctttgtgtagaggacacaacggagagaatgcctttcccctctcgttctgggatctaaatttcctttcgtagaacgatagacgttacgtttcccagaacgcaaactacgggtctttcttgccagtgaggtgtttccccgaatattagccgaatttcgcgatcccgtgtgcgagacttcttccacgtgtcataacgaaaaaccacccgggcagttcttcttgtctttagttggcgatgttctctgtcaaatttgtttcccctttgtggttgtaaagttaccgggtgtttgtgtcgcttttctgcaatcaagagagtccagctgctggagactgctctcacgtgcagtgctgaaacacagagcccggatccggactgaggcgagtttagagctgcgattctcgcgttgtttgcgaacatccggtagctttccttattccccttttgctcgctctccgtgtgattggttcctcattcctcccgtgtgtttcgcagaatctgtttcggcttcctccgtgagtgagaaacttgtactcgtgtgtctcccgctggacttccgtcctttcgctgcgcgttttcgcagcttttgcggaaaaggcgcaagttagctgccgtctgagagcttcgtttcacatttccccttttccgtggaagataatcgcgcaagaaccaccatttgtctccacagtcttttctgctgttttccgtcgcggtttgctgtccccgtcgctactttttctcagcggtggagtggggctcactgccgtcctcttcgattttcctcttcattttcttcgaaaccgcggggggaaacaactttctcggcatctcagtcacggcctgactcggaaaaggactgctttctggtcagcgcaatcggtttttctggaaaaaccatcctctgtctgtctaagagtcgccaaca

SEQ ID NO: 743 - DNA, 3479 bp, Toxoplasma gondii
tcagtcatctcgaaacccttccaaagggccatttctgccgtccattggctgtggcttagttgtgtctgcttcctccctaggacgaggaagcggcctcggcgtctatgccacgagagcgtacagtgcccggtcacgaattggcgagtatgcaggcttgtgtgttgacaggaaagtggcaatgatgctccgtggtatgggcacttccactcatgtgatgcgagtagggatgcagtatcagtatttagttggctacagactcccttttgtcttcggcggtgccggcgcgtttgtgaatgacggccgctggtttgcagatggacggaaggggcctggggtcaccgccagatttcatgtcgcttatgacaaaaaacgagccaaagatcgcgtgtatgtagtcgcaacacgggacattgcggagggcgaggaagtcttcaccagctacgacaatcagtactgggctctcctacactgaaacgaatttgatgcacagtcagacttttttcagttcggctgcaccaacggccgtgtccactcgtggatgtacaacagacacctgcggcttttcttgaatggtcctccttagttttttttgtgtttgagaagccgtcgaccccgacgcctcttgagtggatgcgcttgtaaggaaggccgcaaagcgacagtagagggaaaacagacggcgggttgaggagacgtcaggggtaacagccaggtgaaaaaagtcgtgttcgtctgtcatgttcacggaacttgcatcaaaagccaaggccgtcgagaaggcgaatcgaaatttttgactggtatgcgggcggttaaataccactgacaagacaggcaagtgccacgatttcattcaccggctacgacttggctgctacggagcaatcgcagcactttagtccgttgacgtaaatatgcattctctcctgaataccaatcaggtgtcagcagagttctgtgaggccggcaaacgcagaggagtgctagcgggagacgtcaacggattattcaagttcaagagcaagtttcaccaatgccaaacacgtcacacctcattgcggatgcaatgttaacccagcgcatttgcggatacaatttctcgaattttctgccgagagtatgtttcgctgtgacacactgctcagtttttcaacgtcactcacatgtagcatgattgcagcactcctcgttacctcttgagactgtgtacaatgctggaacgacctggggggcaccatcgtagacaaacacagaagacttcgattctcttaggctgatgataccaggcatattgtgtttcctttgtggtgggagtgatgctgccagcagcagagttacctactccggctggcctcaaaagaggttgggagaaacacaacatcggtagcaaaaaaatcgttgggttactgtggctgtgacttgaataggaggattcacaggtgtttcacggcagctgattcactgctagtactcacaaaccggtgtgcgtgtattaggagtcgtcttgcactcgtattgcaacgcactgaccgccagcggacggatgtatcgttcgcgttccaagagcgtttatgccgggaaaaacatccaaaagaaaactacattattggagcaatgtgcgcaacagctctgcgaatgcgttgccactttttaatctacagttaaagccagtgatgatgcaaacgcgaaatcctgcaactggaacgtctgctgcaaagtgcctcttgggtgacggtcgtaataaagcccgggaggaaacgcatctaccagtagcatttttcgagaaaccgtgcgtcttttctcttcgtccacctccagagaacgcgcctgtttatgaatgtgaatgaagggaattaagcagaaagaaagatttggctgagcgttccctcgatctgttaagactcaccgtagacaggatggggttgagatgttggcacttaccctcagaccgtcgtcttcgtccctgctcagctttcgcgcagggtacacatttgaccgccttgcctcagccaagttccaagttcaagggtcacagaagtgcaacgagagactctatgtgtactacatcattttacttttcttcaagtgttgtgcaggcatgtagaggttcgctgcggtcttgagctcaaaccgccgcgaggtgacctgcatgtgtctacgagctgagtgagaggacacaaaggtcaccctgtgaaaaacttgcctggaccacgtttgtgcgaaatcccacactcttgacaaaacgcgtatgtttcgttttctcttcctaaacacttttttttattcttcaagagacacagtacgacggaaggcgtgggtcctatacggtgagagaactgcaccgcctctagcaaaaaggcgagaaaaacgtggctgcgagaggcgccgcttcctgtgtcttgcggaattcttcctcatggcagccgtgctcaaggcgtgaacgtcaagaatagttccagtacttgaaaacttgcgtacttttcccttcatttgtacatttccatttcatgcgcgtaaacgatttaccgcatcgcttcgtaatgggtggcgggccgccgtgccactttgtcaatgagtactagcgaaggctggccgtcttgcctgcttttcacagaaaaacgagcatttctgcaaggatttcccgcatcattctatctcatttcgttctttgatcacccagcatgttccggacagaggaatagtaatatgcggagagtggccgttcggaggacacgctacgtacgagaaaagattgcaacctttctggttttacaaccagtttaattcttcttctggccgctcgaataacctaatgttcgagctttcacacgttcttgtgcttcatcttgtttaagccttggtgggttttttcccaggacggcgtgcccgtatcgcggctgtcttccgcggtggatctcgctgcggacgtagcgccttttagcgcatttctactgtcgatagccaccctattcccctccgtaaagaggtaaattcatcatctatgcacacttcagcaataaggtttctctgcagtttctcgcgttctgctccaccgcgtcatcaggttccttgaaatgtgcccaagttgaccttgaaaccgccgatgcgtccctgtgtcgaccagcgatagctaccacagatgtctatgtaatgctgtttcccacttggtcgtcctcaaccgagcgcgaccactctctcttatcaaagcgagctgtcaccagtaaacctttctcaacgcacgctttaagtaacttttcgactggagacatggaatgcgtttccgtctgattcccagcgaaccccgggagactgcacacccgcatttgtcgcctgctcctcgcataacaaatcccctcgcttaacccggcgcttttcgattcctgtttctccacgttgccttctttctgcaggcacatacccgcagcacctggtgacctgcgaactcccagcgcaggaaacagttgcttcttggacgacaa

SEQ ID NO: 744 - DNA, 1728 bp, Toxoplasma gondii
tgccgtctttccgaggccagatacacagtagttcagtcagttttatcacgagacccgggcacctcgcttcagcgtcgtctctgtagaaacagtcggcccccgcgcaaggagagtcggcgggagaaaagttgcgcatcgttcagtctgggattactctctcagatttgggttgaaaaactccacctgttgattcgtcagaagttcatgactcgaaatgtcgtcagcaggtcggggattagttgagttcacgcgcagaacgtatccgacgtcgaattccctcaatgacggaggctcctgaaatcgcagccccgtagggtggtggcctacgacatccttttcctgttcgtaccgcatttgctgcaagaaagttcaggagcctctgtcgtcctctccggattgcgctcctggagcgcatgagttacctttgcaccagtgtgctgcaccccaacatctgggtcgtgtgggctaggtgaactgatcagagcttcacagactctatacctgtgaaaacgctgcagatttccgtggactgctggacagagagtcgccgttcaaacggtggatttccactgtgcatgtagacgaagttaagttgaggacagaacactggtgaaggcacgcgcgatgcacgcacggagcgcttgcagacgacaaacaacgaaaagcaacctcttttctgtcgtggaaagggtgcgacattcgtatcgatggagcccgcttaaaaaccacttaacctggatctccaaaaaccaagtgaatctgcctctgtaggaaagttgagcttgaaccgaaaaatcagggtcacttctccgaggtgcccgtctgcaggggaaggtgaagagcagtttcgtttgtgggaggcaagagtctcaaggactgtctctgctggtggttttgagtgaagaagttccatgctcgagtccccagaatccatgggactggggattcgaggtccctgacgggaatgctaaagtggagagatatttagacaccggacaccagactttctttgatggattcgtgtgcagatacgatatgcacaaatatacatgtgggctatttgtacctctatgcacatataaatatatatatatatatatatgtatatatatacattggatatagcgtatcatttgcctactggttttagtatatctccgtttttgctgtcttggggaaaacggcgatcaggctaactcatcttgtgcgtactttcgagagggaccacgatttctcttttccaagaggtaggaaacactcggaaaacatttgcgagcattttctcgaaagagacacttgagcgcagaggtcacctgttcttcgcctcgcacgcatcgcgagggccccgtctcgtcttctttcttgcatgtgctcctggcgggaatcgaattgtgcatgcatgcgcggtgtgcccttccttcaagcaagattttgaactccacggcaagagagaaacagaaatttccttctttccacttgtcgttaaacagctcacaaacctgcgggggactcctggggtgtcattctcccccgcctcgtaacggcaagtcggaaaactgctgcccagagcgcatgcagaggaacagcccagacccgctcttcttctgccttgtttctctttttttcattctcctcgtcttcttgtaagttgtcaagcttcctagatgacggccagcacttgaggcgcgtcacttctgagtagtgatccatcttgccttcaaattgtca

SEQ ID NO: 745 - DNA, 2692 bp, Toxoplasma gondii
gaactccaaaaggacccgacggacatcgagccttcagaaagaaacgagaggaagaggaagcacacgaggaaggacggagggaagaaggagaggacgaagagagggaagaaggagaggacgaagcagcgagagaaggagaaggggaagagagggaagaaggagcggatgaggaaggagaggaagaagcggatgaggaaggagaggaagaagcagggagggaagaagacgagaaagaatggggactcagcgtggtgacgcgaaatgagcacagaatgcaaaggggagagagcgcttgaagactcgcccctggattaaaactgagggaacgagacgtcggagaggcactcgcatgggaaggttctggcaggggagagatgcgcagtttgtgccggtggtcctctgccgtcttggggggtgggagatctgcaggccgcgaagcgttttctcccctggaagcacgcagcatgcgcgcgaaagattgcgggtttcccgcagacaaggcaaaagggtcaaacggagggatggatgcggaaaagcgatggatgcatgcgtctgtagaaggctccattgtgagtccagaggtcgacggcggggggcggagtcttcgggtgtacgtacacagggtcgactgtggctagccaggcgcaagctcagacagaagcgaaaccggccttggagaggtgcacgcgacgaggccgtcgccgcttccgtcgactccgcgcgagtcagcgagacgcgtatgttccgggcaacggagacgagtgatcttcttcgagaagaactgcgaccagcagacacgtgagagtcacgcagcggggacccttgaggcaagttctacaaggagggcacgatggagcgtccacgccaatgcagaagccgaggaagcagacaaggaagtcgtgtgttccacaggtcagtcagacttgacgaagaaagctccattccactctcgggcgcgcgttcgccggtctctgctgtctcccgggtcccgttgtttttgtggttgctctctgcatgtccgttgacactgttgtttcctgtatttgccattgaaagtcgagcggaaatgcccagacattaaaccagtctcttggccgacgtgagcgtgagaatgactcctctttcttcaaagcaaagcacacactgaaacgcgcatctgtcaaggaacgcagaagggcttcgggactcggcacagaccagcgtcaaccccgacactctgcggatgggagcggcaaggtggactcgcgagaccctcgcgatccattcagtgttttcgcgcagaacaagttttgtctttgccggcacagagaccaaatgctcaacagaggggcaccttttcgtccgagaaaagagctttctccgtgtcagggcacgacctcgcgcacatgcaggcccagcagccacaccgcggtgtgcggccgacggagaagaccggaacgcggggaaaaatccacgacagaccctgtgtgtgtggcgtgtccctgccacagaggaaagagcacctctcaaacaacttggccggtctgtcttgcatctgactcggtttttccattcccagcaaggggagaggacgcgagcagcgcgctacgcgcccgacggcgcgactggtgaacttgactactagtgtacatggacacagagttctctaattcgtaaagggaactgcgcatgcaagccatctcgcggcctatttggattggttgatttgcattaaagatgaactttgcctgtagcgtccagttgagcgcacacacgttcgaactaatgtaacaatatagaagcaagggtgactcgagcgtctaagcgcgcatgcacactggcttgttgtgagtgagtttgaatttcttgccaggcagcacagcagagccggtctgtgcgtgttccgcgcgtctcgtttaaagtggcacttctttttgtgacagtgtcttcctcctcagtgtctctgctcttgtcgcgaagtggaaaaaactgaaaatctgtacagggggggggaagagacgtcgaagaaaactcgtggtgcactctgtttccctgtcgggacgcgggcgacacacaatgcttgtctctcacgtgacgatgttgtgcttcgctgaatttcgggagcaaaatccctctcttttttactgactcgagttttctggacaaataaacacaaagaagggggcggagaagagatcaggccgttcaacctcgccgcctctgtgtcgtcactgtggttaacggggttcgatgagcatgcggctgtgtaacgccccctgcttcattttcccaaggcgaatcccgtttcctcactttagaaactgaggtctgcaagtgaattcctccgggaagtaactcttttgttttgcatgcatgtggttgcttctgtgtgtcgtgcctgtgtgaacagacttgctccccaggttagcgtgtcaaacagagcacctttctgtcttctctctctgcacctccccctcttttccttgacctcacttgagagttgttggcaccatccgcgtgtctgcgttgtcttcgttttccggggactgtcgccacgccgccttgcactcctggattcgctctcgaagacggcagtttctgctgaacgcagttctaaacaaccagaaagtttgcgctcagtcgagggactgaaacgacgacgcatgttgcttaagcctaacgcttgaagcctgtgtttcaacagtcttcaaaa

SEQ ID NO: 746 - DNA, 4706 bp, Toxoplasma gondii
ctgactagtggtgtggcttcctccgtctaagcgaaaacgcatagagagtctcgtcctggtttaccagtcagaagtatgaagggaattagagctcaagaaacgcatggcactaaggtacagacgacatccattggtgcgtcgtacacatattttcgtggccatgcatttgctttttaaggcatagttgtctaaatatgtgtgaagctctgtttttgcagagagaggtttcattgtgcatgcctgccgtgacacgataggactcagaaactgtgtctgaacagatatgtaaaagacacctggccttgcctgtctgtgggtgtatctacccgtatacgttgagcaatctttcacgcacctttctggatatccagttacacgttcactcacaaagatcttcgtatgcatgcgcgtatatgagttcgtatatatgtagaagcgttgtcgtcgaggagtggtgtggggtctcgtagatatcttaaatttgcctgttcgactggattcaggaatcctgttcccatatatctacactgattctagctctccgttaggctctggtcgcatgggcacttacaccggtttaggcgattttaggtgtcagacttcaattttcgtttcaaactgtccgtggaacgaaataggcgacagacgctgacgagactgctaatggcttcgaagacacctgtttagctacctcctcatgtctataatcacatttcaaatgaacaagcgtatggagctgcttttctacttgtttccacacgtcccggttttcgccgaccggaggcacgctatctctctacagacatgtctgtctcagtcccatcctgtgcaacgcaacagaactcgcgagaattccttttctgcctcaaattccttctctgcatgccagcaaatcgttaacttctcagtgtagagagtttgttttggccgctagcggagaggagaagagcggagaagacacaagatccgtttctttcctttctaacagatcgcagatagatgcgttggtccacttttggagggcctgacgtcgagagcacctcgttgagaacggaacaaagactggctgagctcttcgacgagcccactgtcaaaaggctaggtcaattaggaatgaatgagaggcgtcttcatatttgatggcatcagagagagtcttgcaccaccgcaaatctctgtagcaacgttcgtcgaaatttggacggcaaaaacaacgagacaagaaacctcgaaagacgtacggttctcgtagcctatttccatgcactttgtcgtatcgaccttcccagcggatgttcggtacacgtggcatctttggtgggacacagacgaaaggcggacagactggaaggcgggagaaagcgttagtggtgctgcgcagcagcgtacgcaatgtcgtacgacgagcctattggtgactcggtttccacgtcggtattcgaaagcaggaatataacaacggaccaaatgatctgaagaagaaagacactcagagccaaagcggtaaaaaggatatccacagtaagaacgagggggagtcctgcgaagctgtaaacgtgggccgcgagagagaacggcgacagtgtccagaaccagaagatgagacttgccgagccagacttgtttcctgcggaccctgcggcgagcctagttcggttcacgtagaagaaagatatgtaaaagacaatgtcggcaggaagtaggtggagagcgagttcacaggcatagtacttgtagaacagtaggaacgcatatagaacgggacctagccagttgacgagcaggcgatctatgagaaacaaaagctccagaaagacagagctgctgaacacatagtacgatggagacatgctgcctacatttaggtttcgggtctcagatttcgtcagagcactacataaaacggatgggtcgcttttcacacgttttcgcgacccaaaggaacagttctacggaagcgtagacaaggacggagcttcagtatggcaaagatacccaaagtcgacgaacccggtaagaagagcggaaagatcgtagaaaccaattcctcgagatcagcgacgtgttatatggcatgctgtcaaaaacattcgcaaatgccgcacgtgtcgttgtgatacggcagcgggtagagggtgtagtacaccatggaacactttaaagcagtcgctatggcgcaggaattccagcgagcacatacacgaagaactatgggaaattatagtgaaaggaaaaacggcacattcctgttgctggtggcaaagcatcgatgtcttcttcgtgatttcaccatggacgaacagaaaccgctttgtgcctggccgagtttggacagttgaatgtcccgagcatatcatcatccaagcaccgccgttacagaaataactataggcagtcgatgcagtcaagaaggagagagggaaccagacggttcaagcgtgaatctgtcgtggtagccgaacgcgccaaaccagcaaaatttgtctcattctccgaccacagcgtctgtcaacggtccgctacagtgaggtggacgctgttgaagaaaaacgtgaagggctagaatcaaagaagaaatcaaaagcgaagcactggaacgactcaagtcaaagacgctgagtcaacgcagcagagcttttcttcgttcgttccctgcgtgaaaccttcttgctaacgctctaacagctgtttccaagccgaacacgctgccggatgtgggtccccgcaaagtacgttcggcagcactagcgtgcttcgttgttgtccttacgttctagcaaaaaccacaaacgtttttaaatgcatccacatgtcactcagaggccacacacgctgttcatttctatggaggagaaaaaaaaagtattgaccacaccgacaagaacgaagcatagtgaacaaaaaccagcaaacgtttctgtttagctatatccttgcagagggaacgaccctcaaaaccgtttcttatcttcggtctcagctgaagttgaaagcaaaaataactaacctcctacaggtggaaagaatgcatgctcggaggagttagagagcatttgttccattaggcgaccgtaaacgatagcacacaaaacgtttaccactgtcagtcattcacgcatcgaggaactgcagtactgaccgaagcggaaagtcatcagatagtccgttcgccttcagttctgctgcaaaagggaggtccagtgtttgcctcggggaacatctcacgcagctaaatcactgtaaattacctcctcgcaaaaagaaacaacccgttttagtgcctgttggattccgccagtctggaattggccgttctgtaatcagcatcttggtagtgaatacgtttacaagcgcactgacccgagggaagaatgcttacactcacgcccgtaaatagcacgggcatcttcgatgagcaacggaaacttctctgacagcatactttctatcgaacgcttctagtggtaggctcgcttcagaaaccaccaagcctacatccgtgtggtgtcggatgctgggaacacgacgcactgctcagtcaatagacttcgttgtgtaaaaaacgcgactgactcggaatacttcctgaaaaccgaaaaagtattgtctcaaatgctatgatcgctccagacgtcgagatgtttcattgatcaagtaaagaatatcactaacggcgttttgaggtatgccagacgtcggaagttctgtgtggcttgttagatccagcccattctggtgcaggaagcagacctgcgcagcaagatctcttctagtactagcaacaccacctctagaatgctgtcatgtcatgccaaggaacatcggtgattgccgtgagcgctgtgagtctccacccccggtgaccgccaaccttgcgtcaccctgtcagaccgctaccgagcacacttcagcagtccacaagagccgcatattcctttggaaaacaacatttggggagggagcattaagtgaagagctctaagttcgaactttaatatgggttgccaccacattttttccgctcttgccttgtcgtatggcggctagctagtccctcggtcgatgagaactgcaaatgggcagacttcagtcgtttgatttgtttcaggcagagaacaaactgtttttgtttcgtacaaaagctcgccaaaccatatcattatgcacatgcaaatttttatatccaataactcgatgggttggcgtctcattccagcgggcgcgcatgtccggttctcccaaggattaggataccgcgtttgctccagtgttgtacacatccgaaacctctgcaattcgtcattgtacgtctgttagtatgctgtacaaatggcgtattcagacagaagaattgtccttccagctctcgccattgataccatgacccccgtttagaatgagttgagggacacagaatataggaagttgggaggattaataaagcttgacagaacgttccctgtgtgtgcacgccatgtatcttctggtcgcaaccatttcacccagaaatgctgttacagttatccatttcctctttttcccgcctcccgacagggtcatcttctccgctgcattgtgcagttcaacacaacgcaaccgcttcaggattgtgtcgtaacacctacggttcaagtgtgtcgtgtcaacaagatgcaatgcgagatacgatgcataacgacaattgctgttttctgccttagtaaaga

SEQ ID NO: 747 - DNA, 3237 bp, Toxoplasma gondii
catgcttggacggacaatgcaagctaccgtattttctagaaacagggcgcatggggactgtgtatgagaaggtctgccacttagcgcccaacaaaatctcgtcatcaaatgtgcactgatgagagtgccagcaaaatcgttcctatgctagcaaagccggtcgtggaacggctcgcggtgttgacccccaatatgaaggttgcccacttgtgcgtgcgcttgtcttgcactcggaaacagaaataagggcttgttcctggctcaatgtagttcttagcagggaactggaagaagtacatcgggccaacggcattccagaggccaaatgtgtaagggaggacggggaacagttcatgccacgttaccgttcggctagcatcgcagtctgacatttcctcattcggcaggtaggcgtcggaaaataacgtactggggtctaagatgtgggcctcactctgggtcttaatcaagagcacagaagacggcgtcatggtgaagttgtacagcaggtacgtggacatggtgtcaggcaaaaccacttctcggttatacttgggcataccctcgccgcttaattgacggaaatgcataccctcccttattcgcaggaagtccatctcagtgttcagctccaaggcatgttctgcacttgtggaagcgaagccgaggctgtcagtgaattgccatgcttgctcactcgggaagacaagcatactcaaaatagatgctgtgctgcataaagttgcaaaacccgggctcctcctgtcaaaacgagaagcgatcctccttcccgacattattgcattcgtctctctcgttggtcatgcaaaaattcaacggtgaaactctcgccttgctggacgccccttcgcgcagcctctcactctcggttgtgagtccgtgccagtgaatcaagagtatggaaagggcaacagatgagggacttctccgaactcccactctacgggcagggaaatcaccgaagaacaaagtcacttggcattttccggacgctcagtcgaaaagctacaacaacgggggcacctcgggcatgcgtgggcacaatcgttaggccggcgcctgaggccattaattattgagagaaaattggcgaatcggaaaaaatcgaggacaacatcgacgcggtgtcctacacagaggcgagacgaaggtgttgcccttgtttaaatctgcactgaacagacaaaccgtcgcagaagtgggctcaagaagggaactttacctctcaagagacctccaacgacagcacacttcgagctaactgatgcccccctcctgtcgttcacgcggtgattaagagacacggctagttgttcttggaagccaccggatgatgctacgggtgccggagaaaccgtccacgcagtgggggttctgagaagagtgtcctccgcagcgatgtgccgatcccgtcgacttaacagtgtactcctcttcctcgcagaatagatgctagtactttcgtgctgttggccctggagccttcactctggaaaggtcgctaaattgagacacatgctagaagggatgcgtgtgcacaggcgtacaagtctgcacgaggggttgggccgtctcgtcgttaaaacccaccaaggcaccgcgcttctgcagaaacttaaaaagttaatgatggacacagatgttggctcactagcaaacaagccgtactctctcatccagccgttcaccggagacacggagaggcgcgtatggattttgccggccgaaacttgccacatatgtctgtcgacaccatccccactccaaggactaaaatattggtctcagtggagaccagtgatcacaaaagccaatgatgttattctgtttctattggtttggtgcaatccctcgcgttcactggcggcactatctcatttgtgcggcactctatacaatcaacctcgtcagattgtccgttgcagctcgtctctagtcactgatcgacacgaaaatatcttaatggcttcatcgttcaatatcgcctgttcctgtaaaacacaggatatccagggtcacccgctgccagaccccgggaagataaattttcgagtggtcgttcctctaccgaaatgatctagacgaaggccgtacaaattcccgcgggccctgtctcgacaatgacaggcaacactcgggaaacccaacacggcggatgatcgaccacggtcgcgtcgatgagagacgttacgcaaagatagtgtgtctcggaagtttaggatctgaaagatcccgagagatttaaagcacaccgatacgagacaaggtgtgcccaaaatagactcatagatgtattaggtgttctcacggtgtgtttagccgttttgattcgaacgtcgtctcccctaatctcttggaagctgttgttctcgtgtagatgttcttgttaatgttcttgttaactagccactcgaaacaaaaatgtcgcagtggcgtgtccctttcaacacacgtgaagtgtgaggctcttctcggtgaaacaagaaaacatctacatagcgaatgggtagatgagaattagttaccatttttaacggttctcaccgacctttccaaatttcatgcgaatttcctcgaacagaagttggtggcagcagattcttaatgaatggctcttgctgtcactcggttaaccaagtatccttcgtgtgaactgtttggtcgaggaatgaggaataccatcttcattcacgcctgcttcctgaccctcgaacgtgcgctggcgctgttctatccgatagtaatcatcaacgccatggatataagtctacaaattttaacgaacccgtgaactatacagttgtcactgtgtcaaagccctatggttcactcaggttctcttggaatatgaggggattcgaccgccatcacctgagagtctagttcgatgaggtgaataaaagtggaagaaagaacgtagcgggatccgtgtttaaggcagacacacagaacatcagtactttgcaatcggttttcttgtagcatgtacaggccacagctatcaccgtaccgagactgagtcaccgctttgagtcttatagaaggatgcaggttttaccgtgccattcggtaaccgccacccactcaagtcgcgctgggggcaacgcgcttccagctttggaagcttcttgcgcatctcatttatcgttcgtagtttaatcaacgccgctagttacagttgaccgtccgtcttaactgtgtcacactgccggaaaa

SEQ ID NO: 748 - DNA, 2145 bp, Toxoplasma gondii
cactgccatgtcatctttccgctaaaggaactgctaaagaagcaaaataattaccgttttccggcttgccgaggcaaaatcggctggtggggatacgtggggatatgcatcccattaccacatatttagtggaattgtttcttgattcgaattgggaaatatctctgtacgacgtcggagcagggagacggcggagtgttcagaagggtggaacgctccgcacggcatcgttttagtgtgtctgcgtaagagggaaatgtagaggatccatatcctatgagtattttgaaggtctctattaattcatgatagctgtgagatgaatggagaaaagcgttttgggtagggtaagtgtctgagagttgtgcgggggaacaggccatgcgggaaagcaagctcttgctggattctgcaggatttctgagatgacttcccttttttcttagcgactatatttgttttctagcgttgtttgccgggctctcctagtgactgcctctgaagccgtcacggatgagagcatttgaaaaggcaaacctggtagtcatccggtagcaaggatccctgtatatttttttcgaagtcagagacattgccagattaaagcagctttcctgtcctgtttgcagtctttgaagtgcaggattttgggttgttgcaagagaggcatagattctgtcgacgtaggcagttggtctctcgtgtttgtccattccatggtgtctgtctaaaggcgtaagtgtgcttgttcccctgggagactacagcttaaacttgtcacgtatgtcgaacaacagttggaaggatgtgctgtgttgatgggggcttgataaagtcgagttcgaagaaactttacccttttcaatattgtcgagttgattaacaatcctatacaggtaagatatgtggatctgtcgcccgtcttagtagatcccttggtttttcgggacaccatacaaactaaggaattatacattttgaacagtaacaccattccatgtttctccaagcaatgcagttgtgactctggtgtacattggtctggatgggcaagctgacccgagattagcctcccacgggaatccacacattgggcttcgattagtgaggtatggggggcatccgattaaatagccgtttgccaagatttacagtcataggttatgaatcaaccgtgtgtccactagctcacttagggggttctgccaaaacaaatgtcatctcttaccacagtgctaataagcagctttgggggatggatagaagtggtaacacaaaaaacgatgttcaatattacatcagaggcgtagtttcctctaagcggccagggtgaaaaagtgtggtattggtcaggcgacttgcaagcagcatcgcgtctttttgttcgaaacgcatcgctgcgacgactaccactctgcaggaaaatgcttttgtatcatcagctgattttggcctctacctgcgccacctcaaggctcccacgggttcttgctgaaacatgggttcgtagctgtggtgacgagatgtgtgcatacacgtctgcgttcacttcagtgacgatacatacggtcccacctggagaaaaaaatcagacggaagggaaccactctttttagggagcactgcaaaaaaaaacacatctgtgcagacgtgttccatggatcccgtatgtatgtgacggaccatttgaatgactgaaatcaactggccgctgctggtttccatacttgtgtgagtagaacggccacataatttttctagctgctgactcgcagccgatgaaacattatgcactacaagcaaaaaatagtcgccacctgaagacaggcgatgcttgtgcacccattcacgttgctgctgacgttgaagatctaagctgttgaacaagattcgagccttgcgaaatccccaggtccgtggttcaagggctaggcgagtccttccacttctggcaaccgtatctacacgattgaatcatctggaactgcatggtcaccaaaattgccgaacggtagcgttacctttacatttctgttgatatgcgtttttgtgcacgttcaattgtctattgcctccatctttcaactagtaagtaaacgcttgaatgagcgaaattgtgtgcagcaggctacgcttgcatgtcag

SEQ ID NO: 749 - DNA, 2683 bp, Toxoplasma gondii
agagcgaagacacaaagtaacagaaaagcgaaaagggaagctcaaaaagtggactttcccctaccgagatacacgaaaaccaaaatcctaactccaggacattgaatcatatatatatatatatatatatatatatatatttgtgtgtgtgtatgtgtgcgtagagcgagagtttgacatggatttgaggcgcatgcttcgtcgaagaggaagtcagaggagagacgtagaacattttcagtcggtcttcctcccagcttgtccgtgagacgcgccgcgacgtctgcgcgtctgcgggcatccagtgcagcgacgcgtttctctgtgagcaggaggccctgacagaaacgcgacgtaccaaaccaggcttctacttgagacgccagaatctgcagaatgaagagatatcttcgaggcgcgttgagtctgaacggcgccagcgcatcgcaggatcgagcgcggctccagtgcagtcattcaggataattggtctggaagttcagtctctctctgtcgcccatgacacaaaaactttatttatgtccattgacgtcggctgtggctccagctgctcggggacgagacaaacggcaagacgagaagctctacaggaaggcgacgcttcgcccccctcgggtgcgccacgaaagacgaagcttctgtctctcgttcgacggagttggagagacaggagacgcgagactccagggaggagagcgaagagaagaactggggaacagacagatggctgaaggaaaggacgcacaggcggcccggcgatggagtaaatctggatcgactcggcagagcgtcgccaggagaaaccgaatgagtctcgcactgctcaacaggagtgcctcgcggtgctgccgccagcagcttaccggcgaggcggtgagagagtctcgtgtctctttcctgtcccctgacaagcacagaggcggcaaggtggagacgcagcttcgtcgcagagagtcgtctttgcgaggaagcgacagcagaagaacttgccttcaaagaaatgcaagagggaagagaagtgaagaaagctaagattcgcagaggagtgctctccgggtggaggtacacctgcaggaagacgccgcctgaggggaagcggcagacagacgtctactggagctcctttcgaaagaaacgacgaaacctggaaactctatcgtttgtttgggaccgcctcgcgtctggagaagtgacctcgccaaagcccaccttcgaggacagcgctccgtcgccaaccccccgaagaagcgcgtccggcttgcagcgaaagtcatgcacattttttgcggagacttgcagaaactgctccctgcttcttcggtggcgccctctcctcagactgaggaaaagcgaagaagaaatgacggcggtcaattcgcacgaacttcctgaacaaggcgctctccggcacacacaacctgcacaccgccttcggggaaaatcgcgacgagagacccccgagcgaagcgagtccgagtgtacatacaccccagaagtcgcgctgaaaagctgaaagtgatttcgcgttttttctggagcgtctccagacagatgcagctgcctttgtctgccggtttcatctctggcgtgcagccagccactgggttgtgacttcgcgccgacttgggcaagagcttcgcgctggccttgcttgtcttcgggaggaaagaaaaaaaagccgcttcttcgccaaggtctcgccagttcgaggctctctcccgttcgattggcgttgaatgcttctcgcttctctccccgttctgtacgagaaaaggccgctgccgcgccgactctcgagcctcatccgcgtgtcatgggcgacttgcacaaacatgactttctgccgagacgaatcgtgaaagcaaaatgtctccgcggctcctgcgtcgagtctgtgaagacagccggctggtaaattgaacagaagcgaaggaagtgccgcgtgtctcgtcgccagctacttgccgagcctctcgcgctcacgcggttcttgttcgagctgaggcaagtccactttgttgggagaggttcgtcaaagggtcctcgtttctctcacaggcgccgccttgttgccaggggcaatgtgtaacggagacgccgtactgatttctgtcttgctccgcccatggcttcctctctcggtgctgtcgttaccagaaagcagcagagcaggcgcgcgacaagaacgatctcggacaggtcgattggcccaaccgatggcctcattgccgtttacctagtttttcagtgaactccacttcggctgcatgcagtcccaaaaaagcgtggaaagctttggaggttttggggatttcgacgtcgctcgctgtcttgttcaaaggaggtgaatctctcgagaaaaggagcctctatggagaaaggagtcctttgattgtggctctcgaggccatgcggattcgtcccctcgtctcgccccagtgaccccacgaccgcgttgggctccacaggcgcgctcgcaagcggagtcacctgcgccgggccggcgagagagagagagagacaggagacgaacgcggtcgcagacggcggtgtgctttctgcggtctttggcgtcgcacaaagtcgagggagcagacgcttttggggtccttgtccagatgtgagctctctgccgcggctcctcctcatcccacgaacacaa

SEQ ID NO: 750 - DNA, 2100 bp, Toxoplasma gondii
gcgtctattgcctcagcttcagagattgaacgtcttttgaccagaaaacgcgtcctaagtgcgaatcctctggtgtaacctgtggctctctcgagcgtgtgcgtttttcatcttttccagagtcttcgcctttgtatcgaagtcgcgaactctagccaaaaacacaagttcctgtaaaagctgttgtgcgtgcatatatatatatatatatttgaaagtatatgtgtatcgtcgcgcttgtagtagaagtatggtaaaagagaatagcttcaaaatagacggacttgcctatgctttgcgacgctacttgcaccaaaatcataattcaactcgccatgcatgcagcacaaacgggaaaacaactagacctaggctccatgtacacattgtatataaaacgggatttttaggttcacttgaactacctttttctgagacaacaattgcattgcgacgccctttacacattccaaagtggtatatctacgtgccagagcgcatacgggaagcgacgctgtgcacgaatagcaggcgtgtgttgctgcttttttgcctcaatgcaaaggaccacagccttccttccacgtgttcgacttttgtgaagaccgaggccctctgaagtcaagccaagcagcaactgaggagagtttcgctgcagaacgacggggtggcagcaggcaggtcgcactctccgtcaacacaacagcttgcgtttcggcgacgacctgaagcgacagacgggagcgattttccttgctttctttgcagaccagacgggagcgattttccttgctttctttgcagaccagacgggagagaagcgagaaggaagtgccattcggggagagcgcagcgattgagtccagagattcgtggagtctcgattcctccttgtgaggggaaacggaaacgattcattcgcgtgtcgctctgcacacctgtcgggtgtacatccactcgagactggagactcgcagtcaccagtgtgcagaaagctgccaagtcgagtggagtgtccgtcaattttttctgcgatacacagttcgatctcgcggcgaaacaatgggggaggaacggagactgtcccgtttatgccgaaaacctttcgggctgcttctcgcgtttcgtggacctctgtgttttcgcctcgaaactcacgcggcagcggcaacgcatgtacgcatgcgcagcggacttcggagcggaaagacgccgcttcgcagccgtctctggactggattttcgactttcttcgcaagaattgttcagttccggcgtctgccgtattttttccgtgtggcatgtgttgagttgtgtggagcaaccgccaggtttctcggcgagctcctgccatgctcggccttcactttttaaatcaagtcgaccctccttctgcatctactatatctcgttcctccattttcacgactttacgttttcttttcgctgcgacattctgaggcctgaattcgaagaaagacttgtcgcgttctgagtcgtcttttcgtctacaacgctttgtggcctccgcattcgtcgcatgcagtatcgcgtccagcaaagacctgcgacgtcgttcattcttgaagttgcttctttctacgccgacccttctttgctgtctccccatattattttcgagctttcgcctgtgtgtcttttctgcttttctttcgcgagagttttacctctcggttttctcctccgctgtctcgtttgtcgaacctctgggaatcggcagaatggagaggccctcctctccgcttcgcgccgggtttcgattccctttgactttctcttgtttctcttctgcctctgcgtgacctccctgctccccatgtctgtctgctaggcgcagcgagaggcgtcgccttcccctttcttctctgtcactctctcttctccatgctccctctgctccttcttcactttttttcgctgtctgctggccttgcgtgcgtcacaagctctctccacgacgcttctcgtctcggttacggctgctgctctgcctcctcatctaccgcgagtgtgtctctctgactgtttgcgctgctgtatctggagtccgaattagcgtctgctctcgtcgtctcacga

SEQ ID NO: 751 - DNA, 1625 bp, Toxoplasma gondii
catcgctcctcttattctttgttgtttgtcctcgttctttgtctgcatttttcgtctatcgaaggctgtctctcctggccattctttgcgttcgttgcacttgtattttgcgtctatcttgccccagaaaagacaaacttttcaagtgtttccggtcttggcagcgattcgcgcggcggtaggggcctgtaacccgtgtcgggcatactacaacggaaagtcagaatcatatcgttacgagacgacctccccagtttgtcaaaagagcctgtctgctttcgcatggcccttgccatttcgggtgcacaaaacacgggtatactccgaaaaatggtgtcgcacactatcacgagagaagccgttccggggctgtccgttgccttagaactcgaagacaccgccaactagcaatttgcggtgtctcagattttgctgctgaaatctctggtttacatttttggaaacacaacagttcttctacgcaataaccgagagcccacatgctgtcgcgacagcccagcctgaaaaggctttatccagaattcattatcttcgttcactgtgaactgaggatgtgttcgtctgtttggtgaccgacatatctggaagataaagcaaggcagcaaacgccgcgtctactgaatgaaacatggggaaaactcaagtttctcttcctaggttagggtaaaaatggaccacgagtgcagcgtatatgagagaaaaaggcagtctgtgccctaccccatcggtacaattgcttcctcctccggaaagaaagaaagaaggcaaacaggaggcagacactctgtgtgcgatgatcatgttgcagtcacggatacgcggtacagcgtttaatcgttttctgttgcgatttcgcagcaaaacaccttccggtcttcatatggcttgcgacgtgcacgacaaagtcaacagttacattgatgggctacgcgaaacataggagcatgaccttcgtgaatttctctcactgtcccctctgttgccagtatacacatctaacaagagaaatggatgtccgccactccaacgcaggaatgagaaacgtgaatactcaataaatccacaatcattccaacggtgtcctcctttgacgctgacctccacctgtcattggagagtctcttgctaaagaagatgggatatgtcatagacgcaattttcaccaacttctagatgggtcgtctacgactctatctacccgaggcagcagtagttggcggttaccttcggttaagctctctgcgtgatggctttactgtcgttgacacttctgtacgctggtacatggacgccctctcagttattgaatttgccagtgaacagctgtgtttccctgtctcgtcgctatgcgatagtggcgtactccgggcacctaaacaaccagtggctcaatgcctgtgaaaaaacaatgccgctgaacgcttttattggaaactaagacacgaatatctccacacgtagcggacgtgtgcaactatcgtgtgtctcgccgtgtcgcagtagatctgggcgtaaaggtagatcatctcgcagtagcttagttcttcatttcctggttacagggccgcccccaatggacagctaggataattgaaagcaatcca

SEQ ID NO: 752 - DNA, 2806 bp, Toxoplasma gondii
tgttatggtagctcattctcgggaaaagccgagcggtcggtagaaaaaactgaggaaacggcttctgaattaagtgagaggatttccctcggtatcggcatcttcctttggactgcctttcacccggcactgtaccaatctgtggtgcggaagtcattttcctcaagaactaacgtctggaggccgtcgcgagctttgtcaatagttttttagctcgaagtagagaatatttttcttcagtggagggcacttcggtgccttacaaaggaactagtcgtttgacggggttagttgaggcagaactgtcctccctatcaaatgcaagattcggaatataatggatcggatatgcagtaggtgattgcagcaggacgttatctttcttttcaaggaatgacggcgctgtccctattagctgcctcaagaaaaatatgcatagtgttacggttgccaacagaacatagggcatgcgttctaatttgtaaaacaagaaagcttcagtgtcggtcatggcactggtggaaggtcgatgcacctgtactctgttcatctttttctacctgtcatactcgttttccgacgctgcaacgttcgtttatcggccgttctcgggcgaaacaggcaaattctgcgggattgctacgtgggcggtggcggattacccattttcctcggattcctcgcccgctgaagaacgcgttttgggttctgggtatcctctctaatcttcaattcacgaaaactcttcgttgtatatttcggtaaacctgaaacggtggtttgtctacgaggtacggtgtgtcagttcatgtgtatccagtgtcttatcccagagaaacgagttcatcggccgtcctgacgcgcgacgaaaggacgccaactgtgctgcctttgtgccggcaggcggtgcatagtatctgatgaagacccctgttgaaacttgcctaagggaaagcggcctaacatccctgtggcaactcaccaggcgatttcaggcctccacggagcaagcagtatcgcccaacgccacatgaaatcgtacgagagacaattcgttttataaaggatcctcgcgtgcagggaaaaaagagcaccctttcaggccaactggaatccctgtttccacgagttcatctagattcccccaacgtattgactgttaacgaaaacaggacagccgagagggggaaccaatttttatttcatcaagtcagagagagcaatatcttgtgggtatgcatttcagtctcgatctgttgttctgctgaggaaaaagtgaagggcacgactgaccgcacacgtctcgtatccttacggagacagctacaagcggcgtttctgtgtcttctgggcaaattctcatgcgttttatctgagtacgagaacccacttgcatgatcccagttcgagtattcctattccttcattttctacgggtatcctagtgaagagctccactgtagagaaagcattgccccgggctgaagaaaccgacgccgaggaacaagcgggcatgtccaggagaaagtggtggacctacggatgtcttctgttggttgtctacacactagaagataagcaccggatctctcttcccataccacgaattccacaactgtttttctaacggcgtcctctccaaaacaatccaaaacaagcacgctgtcgcgggcctctaagaaaggttgctttcgtctgtgtcgccgtccgtgcgctaccgcgccgcgcgtagaaccgggccggcttctctgcggctgttctccagcgtggaagaacggaacggcgctgaatgtgcgtgaataattttattttcgtatccctgcttgatagaagatagcatttctcctagttctgctgcatgctttccgttttgcatcgcgttttcgtgaataataaacgacggcgtcctcccgttctgctgatggaagacggggaaagctgtccttttcggaaagtaggtcacgcagctgggcagtgacagcgctctctggtgtgtgtcttcacgacagtatgactaaaagggcgatcccggcaatttcttgatgcgcattttctcggagatccatgtattcttcgtgggtcggcgacaaggagaaaggcagaagacgatccatacccaaaagcgcccggaagaggcggcaatgagggaggcgggcgattttgccctgaataggagatgaggcgaagaagaagtggcggactcaaatccgaaccttgcctctcatctttgtttccgtgtttctgggtccggaagcggcgtttttctctgaaacacctccaaatgctcagtccgtagcttaccccctgacgaccttgcagctgtaaaaggcgactagtcgtgcatctgtgaccaatggcaagccacgttttccttcatatgatgtgattttaacgtcttttctcaatttgacccagtagtttagggctcgacacgccaggttgatgttcattttgcggtcgaaggcacaagtgacttggccgtcggattccgtggaatcacggctgacaggaagaacgcgttcccgcgcgcttgcttggaaacaggcttcacagttttgctgcatcccaaacgtaccatatttcctgtttctgtcagtttccccagccttacgctctaattgagcgtctcttctcttcctgattcgttttttcctggcattttccccttcactcgccaccgcacacatgggtctgtgaccctgcaaacccggtctgcagctgcgcttcccggtcgcatgaattcggaaaatcgtcatgctttagccatttctttgcgtgcggtttccgttttcctctccattcacca

SEQ ID NO: 753 - DNA, 2336 bp, Toxoplasma gondii
cgatgagaatcccagaggccaggacttttgctctttctggatgagagggtggcattgccgatggacggcaaaatggtgcaagaagatttgttgcctcatttgagtgcagtttgtttacaggcagggaaatacatatttgcacatgtgcgtgtgcatttgttactggattcttcatttaaaggagctacgggaagagtccctgttcggactgcgcgtggcgacagagcgccttctcgatttgttctcttcactaaagaatcgaacgcctaacggacgtggaattaacttttttcccgagaaacctgcttttggtctcccgaagttactgatggtctttttcaagttttttgtcttcctcgggactggaatttgtctctcgacttcaccttctctcgacacagccgtcttcacccactggtggatttcctggtggtcgaaccagaaaagactgcgcgggagcaaatcacaaaaggcgaacacagtggaactcagccataccaacggaaaggaaaaagagggaattcataatgtgcctacagactgcagctgtaaatatatctagaaacagcttaaatgagtcttatctgttgtcactagcatgcatctcctggacggcagaggtccacattatggttctgaagacacgtactgcatactgcctgctacctggctctattggcatctttccaaagtctttttcaccgcaggtgtgctgccattagagcctaggcacctcaagtcctgatagattggtgcaactcacaacgtcgacaagcagtctgtctatccggaggtttgtgttcgtggcggaacccgaaactcggaaatattccactgaaaagccccacgagaaagaacgcacaaatctttacccctgtactgcgagcgtgcatgcaatcgttcttctggttcatgcggagccgtttaactacatttgtatcgttccacgtatcagccgaacggggtaaaaaactcgcttttgtccagcgtccaacagcgctggcgcagagaacttttctgtttacgagactagctgttgcgtctcccgcgccagaaacttcacctgttttccataaaaatcagaccggtgagcagcttctggccgggcaaacatttccagaaaaccctgccattccagcaagggcggctgtgtatgtacaccccatctagctggtatggttaacctgcagcttgctggtgtgttcccctttgttgtcgaaaaatgaggacatgtctcgcctgaacttctagtgagagttctgccccgttttcttgcgtgtgaacgctgattttttccggcgtagaactgccctttcctccctcagacgaacgccctcctctatcacctcgttccatctgacgtacgtagcctgtcctggatgagtgaaaagcgtcgttacctccagggcaactgccttttctcctctagctttgacagaaagaggatagcgggaaagcgttgctctctctcgacagaaatatcttcgcattttaggaaagagaagacctgcgtccagtttttcgtccgggcaatgactgaattccttgttcgattgggtcgcgaacttgcatgcggctgtccgtgcagaggagcagctgagatcgggttcgctactcatcgagagccgatgagacctcgagaaagagacacgcgccagcaagcacccgttgggatccgtttgcaatcgatttctctaatcggtgtttcccacgtccgcttctgcgtggcaatcgaaagcgtcgcggtctccggctctccgccggcagttgcacccggttagcttttctctgcttcacttctctcgcgttatttctctccccggcagagccacagttcgctggtattctgctatctctagaagttcatttcccccccctcctttttctcggtgcgtttttgacacagctctccaccagacttcggtttttcctgccagaagcgagatgccctcaagtgtgtcgccttctcatgtcggttttacgcgtgctccctcaaccatcgctctctctttttcgtcgcgcttcgatagtaaagttgctttaaagattcggtccccctctttgctgcgtaccttttccgggttttgtgacatttcgagggaaaaacagagtcgcaagaatttcgtcacggccctcttgcttccgtaaacggccagtcgttcaattctctcttcgtcgcacacctgtgaaagtctccacatctcggtatgaggcgcttgctaggcaaaaatttcttatgtggacgcatccttctgtatagctcgttcttcgtcgttgcttctctcgttctctcttaaaacaggtccccagtcctccgcgttttcggttttcctgca

SEQ ID NO: 754 - DNA, 1770 bp, Toxoplasma gondii
tcattcggaagtgggtatgtttgtgtacgagttcaagattgctctcttctattcatgcagtgcttatgagagaagcagtaattcatcagccaagcccacgtcgttcggggcggacggtgctctaggaaataactctcggttttcggcgaatgcatgaagcaaatgccgagaaatgtcggacggtgtcagggaaagaccggagttttggaatggttttgtttcttttcgtgtgcatatcgcgcactgtagagtatttcccagttttttctgcagtagacaggcagacctcggtgatgaacaatgaagttttcccaccgccacattgactaagttttccaaagaattgccaacgaggaaaatcacagccaacactcggtcactcacaccgtggacgagacagactaccgaatatgttgtcaggattggttttgtttttattttttatttgctgtagcgtcaccgtgaggtgaggttgctttggagatgaagagacttgcagtcaaggaagattgttgaccctggcgtacgcgctgctacggcaggaagcgggtcacgagaagccggatgaacagagatgtaggacgcactgactactgtgacagataagtatcgttggtttcatatatttaatgagtttgctgtaggtgacagaacccgtcaacagagcagtgtctgtaccagcacggttgtccgcgccacatgaaaaacagtccctatgaaaacgcggtcatctgcgccattagcatgaggtcgcttgcagcaagcactcaggagaatcctgcggctaaggagtcttcactggtgaagtcaaattctgggctagatctctacagctcttttgcatgaggcagattttgtgcgcctccgtttgtacacctgcacgactaccgcaccttccagtaagggaggtaatgtaacttccctcacacttgtacatagtggaccacgttggctgatagcttggtgtagtgacccctcctgtctccaacttggcaccagtttgtttgtttaaagtctttccattcgattcaccgtccaacagtccccggcacccttgccaaccagactgcatgcgcatcgacggtaacagcagcgctcgcgagccacatggccacgccacgatgcacgttacgttttgagaaaaaatctcaagtcggaggcttaaaataggggtgtcctttcctatgagcaccagacgtgtcgaaaaggatgtctttgtctcattaaagtttgtgaatgtgagggtgagccccccccccccgacgcaaagttgcaccgcaccacatctactcatgagaccccgcggcaaaatagattgcccgaaagcttccaacgagcttttttccgcttcatctttgctgttacatgtcatgcttgtcggaccacacgcgtttgtctgtcggagctgacctgctttggttgtttacagatcgtgtaacacagccttgaatgacagcatgtctagcaatgaaccgttgccatcgtccgttcagccaattcacgattggcgttttcccttggggatcgagttagttagaccgtgatttctgcttgaaagactcaacctcgtatatatgttcgtccatgtttgtaagttgcttgctgtactcgatttctggttgggggcagtaaaccccccgtggaagtggcgcactgcttcatgtgtcactccaaggcgataatagcggatctgctcccctgtctcaggagtgtcacaccgcagagaggcggcccacacgtcttgttctggctttccctcccgcgaaacga

SEQ ID NO: 755 - DNA, 1938 bp, Toxoplasma gondii
tttctctgtgcctacttccatctacgacgtctttgctgtaaagtgcgttttccgtgtgtttctgaaagcgttgcttttctagcaatgcatctggttcacgcgtttcatccgtagacgtgtcaactgtcagctgccgtaaggaaaagttttttatcaagagggaacgggacggtgtcgcgatgacgcgagccgccgaaaggcagcacaggtggggcgtttgcccgaccttattttgccgcaacaatcagttttagttgacttgtgtttaagtgctttccttcgaaattggggtttgtcgctgtcactaccgcactaccgcactgagttgcgggaatggcgctgtggcagaaagtggaaattcgcttgagcatcttcagcaaagaccttcgctgagacgaggaatagggatgtttctggagcactcatattccagccttggccgcgaggacatttaaaagtccccgccgtcgtctttcctttcagaaaaactcaacagcatttgcatttctcaacggctttcgtgtttagaggggctcaagcgtgtgtcctttccgcgttcacgagcgaaagaatcacagaaggacgtgtatgatgtaacaggaagaccatcctttgtagtgcacttcatctagcctgtttttgtagattgcatgatcgtagcttgacgtgccttctcgttacatgcaaaagcttctaccgaccctgcagggatagataccgcacttgaagtcgagtgcgccatccaagttcacgttttgtctcttctgccttttaccttatgccttggacggcaactcagttcaaaacagcttaaagccacttcccgatccttgcgatccagaagaagttgcacgatgcacgcaattacgaaaagtatcctgttaaaagtggacgcggatatctgtccacagtccaagtcattccgaccttcttccccagtgccgatgagcctagacgtcatagtgaagttcgcgggcatgctatataggcttcaacgacagcaggaacttaacgaagagaactggaacaacgcccatttaacaacgaaggagctgtgtgtggaagaagcgagcactaaaacgtatccagtgtaaagtttggtcgtcataccgcttaactccgctgtgccgttttttaacctatccatcagtccttgtggcatgccacccggtcttttccagactcgctcctagcggcactgtcgtgaatcaaggtggaagaacccctcttcccaacctagagttcctgacacgaactactgatgagacagcccagtacgaatcataggagacacatccacaggtcgaagagaaacgctttgttattgctatcctccaaacaccttctaacaggttatgttttcacaacgacgaaaatccaacaggttagtttgtctcgttccttagaacgtgctttccatgtagcgcggtttagggacttctgcggcctaggtcgctaccacgctcctcctttcgcttttcactggccttagctaacattgcagtgcagatgtactgtagtgagaacgtactggatagaaggcggtaatccagaaatttgtgtcggaagtcgcgcgagagtttcacccgcgatcggttcctcctgttcttgctactggcactctgtggagatgggtcagaaggccccgacgggaactgaggtaattcgttcttgaattgacaggtttggagatgcggaaagtggcggaataaaaagaggaaagcgaagctgaagacaactcccttacgatattgcagctcgagggtgcacagcttgggagaccgcgaggcttcccccgaatacacgccgaggagcggtagtgagacaccacagcggtgaaaccagtatttgccgttggcaaggaatttccgttctcctttgcatgcggttgtactatgaaaaaagggttctccgtggacaaaattcatgcttcgtgaa

SEQ ID NO: 756 - DNA, 1869 bp, Toxoplasma gondii
aatgcgtaatcttggtgcccgtgatgccagttctgtacggcagacatggtggcgtttttgtgcagaactcttttcggaggcttccgcggttctccagaccggggatcgcctattgtccactgcagacagagtgaccgtttttgcctgatttgactctcttctctcaagattcgcagtggcgttcttgcagatacacttgagctgtctcttctcgctaaagctttcggaagtccagcgcgagtgaacgaacgaccggaaaaagtgaaaatctctcctctttctctgtccttttctacatgtcggtctttgccgctgtatgtatgtgtgtgtttctctcggtatcgccccctctccccctctgtatctcaactttcttgcgtatgtctcccagtcagtgtctctctttctcctgctcctcttctgtatctctctccctccctcagtctctgtcgctcggtctcgctatgcatgtgactgcgtttgtgtctttctgtgcatgtctgtctcttggcaatctttttgttcttgtcggatgcagcgtcgactctggacttcttctcgctgatcttcctcggtgcatgcgttttttcactgactcttgtgcatctctatgaaaccccgttgcaaaggagaggcgacggcggtgcaacatgttcgccaccagttcagacgtccaaaagctgagtgccccagcgcggagcatgacggcacctgaatcgaacttgcgacaaatgcatctttgacgactgtacgccagcgacgaacggtcaaacttgcagatcttaggttctgcgttgaatgaacttgaaagacgcaccctgggatccgtgaatctgtgtttcttctacgagctcgccttcattttcgtcctcctgccttcttccagtcacactccctgtctctctttcaccatgccatttcttttcgtgaaaactgagatatgtggtggagacacagccaattccccagggcgaagagccttcagtgcatgcaaacgagccactgacaaagaggaagtctctcttgccttgttcgcgaacacactggcacaaatgaagagcgccccgataatgacatcagtccattaccaatgaaggtgtgtagcatttcctgagctccttattattaacgtcacagctatctgttgcaaagttcgtcgtctcgactacgcatgcggacaaaacgcacactgaaattcctgtcggaaagtctccgctgcggaagcatgcacgcgcctttctccgcgccgaagaaggcctctgcctcggcgttctttcacttcttgttccgctgactgcgtgaacgcgattcagacgcgcttttctggaggacgagtgctctgtctttctgtcctgcatgtttagaaaggcgaggaattccactctcggtgcgtatagagcccccgggttgccctgctttgcatgcatcctcactttcaagaagagtcgcgcggcgcgaagcgcttctgtttcagcttctctctctctctctcgcatgtaaatagcttgaaaagcagactttagcgaaagtcgccttcagggagaaaaacgaagaaagaaaacgaagaaaaactcgccacgagaccgtgtgctgcgacacaacgttaagtcgctgaggagcgacacaggctgctctctcttcctctcaatgtagagcagaaactggaactgaaagcgaggaaacgagaaagcatttcgtcgttcgtttcccgactcttctatttatcgtctcgcgttgcctcgcgtctcctctctttctctgctcttttcttctgtgctgtcctgcccttctcgctctcgttttcttccttcatttctgcgattctcctcacggtggtctcttctggatctgtctcgcttgtctctgcaa

SEQ ID NO: 757 - DNA, 2078 bp, Toxoplasma gondii
agatgttttcgtgtgttcacgtccatagagagtcgaccttcaattcagtggcgccacgacttcacaaaactttaatccatcagagagcaaatcacgaccttcacaaagctctgcttcactgatgctacagaacggaatcggtattgcttcgaacggaaagacagacaccctaagacatctgacgaagagtttcctgtcgacagaagtcgtggaagtcttgcactgaggaacaaagcttcttgacaacccacaagtttccatggtttcagccctgcaaactgcgctcatggatgcatgggacactgccgcattttgaacgaaggcgattgtgctgcgaaacaaattctgacaccgtacgaggttgttagtagactagttccgaaccacagcttcagattttctactgaacactctacgatcgatccactactctctaagctgccccgaacatcttctttcggcaattgtggcagttggcttgtgacactagccactcacgagccagcaatcccggacgctggtaccgcagctgctacgcattccttgctgaagtataactaaagtacaacaagtaagaatcactttcgaccttggctttagcacaagttattcatttggtaacgctctttcgcagggaagccgaggacggggctcttctgtccgcaaaatactccgacattaatgccttgcggagcatttctcaatgatacagacaagcgaattcttttttgccttcacaagctttgtctggagtttaaagcgataccgagtgtgcagttgcttcctcaatcccctcagcgtagcactgcgccagcggcgttttccaacctccttctcgctatccaagaggtatatatggacatatacgatccttttctctgtctgaaaggcatcgaagtgaaccacaccagaacctgctccccttccgaactcggtttttccctcgtcaacgaccgggtgagacccaagttgccctcgctgtcaccgtgacgttaatttgccgcgggcattgctggcaagaagacgcttctcagtggagcaatccagtccgattgcgagagtgacagaagcctttctgccgccccctgaaaagcgagaggataagtggtttcgtccccagaaatatcacatcgtcacgtgtgccgttagccactccgtctgctgacagccacccgccagggctaggggggggggggcgcgtgtcttgtagtttcggcgcgacacctgcatcctcccctgtagctcaggggacctattctgtccttttccgaataggttttcttgcagatgcagctttaattaacgtggtgaaaaaaagactagttcggctctggtcggggcgctttacctgtgttcctcttgacttcgcggtaaagcactactctctccaggagttcaagagtcgcccgcctgcatgccgcttcgcctctcgcatgcctgcgcgcttcgaccctcgtcatccatcccttcactgcgccacgatatccttcgtcagatctgtggttctgctagctttcttaacacacttgtttcgcggtttgagtgtctctgcatcgccagagcatactcggaaaaagcggccgctctccttcaagaaaacggataggtgttcgcggaggcgtgctgccactgcctctggctagttgacagaccacggggtggtctcgtcctttccgtatcagcctttcactagacgcgaatgtccgcccgagcagctccgtctgcgctcccacctcaccttgggtggcactttagcacactgtcagtgcacgcgttctctggatctttgcgtctcaactccggccgagaggctcaagggcgaagacacacatggaccctccttttccgcatctccccaaagccccatttctccggattggttcccattcactcgtcctcgaaacgtcgccaagactctcgccttacgcggcccccccccaccgacaatacatgactgaaatgaataccaggacagataagtagaccattctaccaaatccactgtcactcacactgatagttcgacctcagttttcctctgtacccagcgacgtcgagcgtgcccctttgttccccaa

SEQ ID NO: 758 - DNA, 4060 bp, Toxoplasma gondii
gaagccggcctttcctcttggcgtgtcaggtgccgtgaatacctacgatgtagattcagcgatacgcgatgagaccgactctctgatacagtgacacaagtctagttcgacgaaagaaatgggaacgctgatacgcacggccagtggctcccggcgtctccgagtgaggcagagtttcagtaattctctgcagcagacgcaagcacttcacaaaaaaaggctttttgccgaccggtgtctgtaaatcgacgtgaatctaccaacggggcagccagttagcttccaagggtgggttcgcttgttttttgactgtcacgcgaagtcgaggcgggtgattggaggtgtcgcagagaggccgcgatgtgcctcttcagcacgggaaacggacgttttttgtcgccggcaaagacggccgttccgtgtatgcaatcatccaggatccttgagactctttttaacaggtgggttttcctccataggtgctgtcctcgcagttcacattctgtggtcctcgctcgccagcgcgggaaaactgaagctaagactcttgtcaagaaacagagaggactgacagtctgcaaataccagtcaagggcagccctgctgcatgggtactgcacgcgccaagaccccgaacacggcacgaggacgcaaacgttctcagcctagaaacaatttcctgcctcctgtggacaggccgctcacatcgcagttccacgcttgatcatggagacagttcgaatcgacatgaagacaataggaaatgtggccgcgagagttcttgggcttctcagtcttcgcagctcgaggggctgttcgcgtttcacattttttccacctatttctttagacgttttatccactctcgcatgcttatctgagcacactctgcagttcccctgcgtgccggcagtcctttgtgtcggcaatgtcgcaggaacaaagtcacatctaactctgcttttcaacagcctcgtgcagactctaggaaattcactcccatccaacattcttgtggagcaaacgaagtattgcccaggttggctgcggaagaagaacactggcgggctcatggcggatagacacgaagcccctaactttggcggttctggtcatgagaatcgaaaactcaaaaaatgcgaaagatctgtaggcagatcgttaccgcgttgcatgtgtggcgtggaaatggccggtgacctcccaaatccagagttgctggctgaagtgtagggtcgcttcaaaagcacgaagatatttgtgtgacaaaaaatcgcttttcatccgtgtagtacaggcggcgacgattcgtgcgtcgaaaaactttgagtgtcaggagctcggttgccgctgtaagtctacgataccttgcgataggtaggagagagctgtcgtctttacagctagtaggccgtttatgcgttcagtttggggaagagactccgaccacgggactgtctccctctttaccggaaagtcttgagcggcatcttttccgtgtccgagctattgtgtctgtaggaagcttcacgcattcatcactacgtcgagaaacaagaactgtgcacacgcaaacagtgtcatcttctcgcagcagaaatgacggttaagcttctgagtgcagagaaaggacgaaatgacgaacacttcaccatgacagctgcgacggatacgagaagtgcaacaagatgtcatcctttccttacataatcgatccatactccttccctgttccttccctcttgtttgtgccacttctccctctatccatttttcagagtcttctcatggggacgagacatgcatgcgtactcacaccaggatcttcagctctcagcaagcttccaaaaaaccaggggatccgtctgctccccatggattgccagagaaatgcacctacgtactccccttgccaaaaaggagagtttttgtttcctaggtttgagttacccagttctggatcgtagctcatttgcacagagacgccctctacttgggaggtgatgtaattaaattgcatcgtcgagctatggtcttcacgttcttaaggccagcccctttgtacggaggatatggtaacttttactaccaatcttatttattggtaggaacaatgaatctccaagcacttccaataccttgattgcttatttgccgctgtactccttccagcttgatatggaccgaaagcaacgaacttcaactacttgaaccgacaggaaaggctgcattcgttgctctgaacgtccagctccatctggaagacaagtatttcctaagcaaatggtggggagctccacaaatcttggatgaggtaaacgaagacttctgacatctacaccagtagtccaactcgtcgtgtagactacggaggggaagcttacgaacaactatgggggttgccggaccggtcttttgcgtattccaaaccaatacaaatgtcagtgactacggcttccaagcaacgctcttagttgtcgtagccgagaaatttgcccgtgcgctcccttccacacggacaatcatcacttgatgcgcccgaaccagggaacctttttccgtgctatgtgtgttctaagcctgcctccaacattttccctgcagtatcggagggccgcagcgttctctgaggcagcagccttatgagttgagcgaaatctgatttctagaaaaagatttaatcctctctacagaagtggaagctcacgcaggaacgacttcgataatccaagcaatgcaacgcgcgcctttacagacagaaaactcacagaggcagagcgtacagctcgtggcactttcggtcctaggtcgtagtggtagactttttaacaccctgaagtcgaaaaatagctgtcgggcgttgcttgtctcatcatagtgatctgcatgagcgccttgcgggggagggggtgtcttcccagtatagtaatcttaaaaacgccgtaaacgcgcttcgtcgccgcaagtcaggtgtgctgtcgtctctgaagaagaggtatcgcttctacctcgctgaaactcacaaccccccaaaaacacgcaaacaccgactttatacaaacacaacgaaataatgacaaccatgtgcgcatacagtctccgtctgaacaatacgtgtatttatatatgaatacgtgtatgcagagattcaggtgtgcaacgctggggcctcgcacgagaggtgaagacatgcatgcttttttctcagaagaagtgtgccttgttgggtccgccgtcccgtgagctagcgagacaatgaagaggtgaaaattcccattttgtgcgtcgatgtcaacaggtcgtcgtcaccgcttttgtcgtttcgttttgttggttctttgccggccgttctcacgggcgatacgctttccttcctctttgacttgcaggcgggaaagggcagggcaacaagtctggttcctggcggcattctcgcgtcttccgtctactaaaatcgcggaggaaagttcatgcatgtcgcttggagtctttccatgttttttcaaatgcagaagatgtaaaatccgtcgaggaacgtttggcttggcagccgaggtcttggcgtgcgtctcgtgaaaggtttctccatccaaacgcactcgccagttccctgattttgtccacttcttctgtcacaacgaaccacgtcagttgtccggtctgtgttttttttcttcatgcaagtcgtctctagacgacctgctgctcttgtcactcgaaaatgctgagaataatccgtggtgaacaaggtccgcaggggtcgctaagttgacggagaaggtttcctggctcatgccttcttccgcttggttgcctcgtgccttcctgattcttttctcttcgctctctcttcaactcaagcctgtgattccgcttcctgtgaatttcgctgtagaggcttaagtctgtatagtttcaccaacatgcatttctgtatgagaggcgtgtgtcggtgctcctgcatgcagtggttttgttagcccctgcggaaggtctgagtaacttgtttcttttctcggcagtcggtcctgtacgggcgtttcctctttttccggaacga

SEQ ID NO: 759 - DNA, 2363 bp, Toxoplasma gondii
agcgagtgctcagagactccttcgaagggatccacctcttcttcttccgtcctctgcgcgcgctgaagagacttgagcaactttgagggaagtccttcttcttcacctccttcttcaccctcctcttcctcttcagcttcttcctcttcagattcttcctcatcttcttcctcttcagcttcttcctctgcacggaggccatcccaactgtcagagaccaggtccttcatgaggcggcagatcgagagagcgtcagatgcgtctttgtcacgagatttcttctgtgcggatatcattgctttccccctttgtttcaacactcgcgctttcgaagcgttcgcctctccctcttcttcctcttcttcttcctcttcttcctcttcttcatcttcttcttcctcttcttcatcttcttcttcctcctctttttcttcttcctcttcttcatcttcttcttcctcttcttcatcttcttcttcctcctctttttcttcttcctcttcttcttcatcttcttcttcctcctctttttcttcttcctcttcttcttcatcttcttcctcttctttttcttcttcctcgttgtcatccgcctgagggccagccgtcagccacggcgttagttcttcttgctccttctgactgcgaggcggcactcgccgcgctgtcctgcgttcgagcgccatggaggccagcaggatctgcgtaaggaagggcgagaacgcgagagaaacctggaacgcagagaagtcgaaagagggtgccgagacggagtcagagggagagagcgaaagctgcgggtgccggagaaaagacgcctgcagagcgttttctctcgcagtccagactccggagaaggaacggcgttcccctggctctttttcctcgagagaggagttgctgcctggcagcgacctgtcgtccttctatccttgttcgttgcgcgcctccagagagtgcatacgataccgacgcagagaccttcagtcttcgaagcagcgagtgagtgaagcctgtttgcgccgcagaaaacgcattggttctcgctggccgctcgacacccagtagtccgtctccggtttcgcctgcgagacactgtcgccttctgcgaagtcgagcgccgcgcgtcgttctcgtcgggaagcgcagcagatctgggcgtctcgaatcgccagaaacgcactcaacggaggccggagagcctcggaaagcggcgaaaagaaaagaacctttagctctacacatcacctcccagcaacttgctcgccgcgcatgcaggcgccgcggcctgagcgccaggcaccccacagagaggccgcatgtgaccggtcgcgcgagctctctctgcgaggccgcgggagaggcgccggtggaacaaatgcagatggactctttgttttggcagcgtcattttgacagaaaaagtgaaaggaagtttcttccatcatcacgcgtagaaagcctccgccttccttgtcgcacgctcggccctgtcgacggcgcagtacgcgagcctctacccttttgttgtctaggttttttcgcgcggcctcgatttctgttcgcctcgcgccggcgacttccccagttcccaatttcttcttgtcgaggaaaagtcctttcttcgaccgaagcgatctcttcgtcaattgctttgccgagcacttcacccgccctgtccgctgcagccccgcgagtctgcgctgcccgcgaacctcgaaaacagggagcgttttccagcgaagagaaatcctcttttccgcggatcattcctcccgacgcgctcgggcgcaggttcaccgcgttgaaacttcgtggattttgggtctcgacggagcgaatttctcgctcccgcgcatatacggccgtcgcgggctctctcccgcaggaatctgcccgcgttctgtgctgtcgcgtttcgccgacgagagctgcccagccagcgcgggggcgtcttaacacagtaaatcaggcgcgcatctcctcactctccactttcttttctcgtttggcagcgctctcgcctcttgggcggactctaacacatcgccgtccgcaacagcatgcgccgctttttttcgcgcagtcctccgtctgaacagtctttgttgacgactggtctcgcagagtctctcctccacctcgtcagtccacggatcgagatctctgccgagttttgcctttctaaaaaggagaatcgattcgctcttgtccctctgacttcctccttcgcgctgcccagcggcgtggtgcgtccgccggaacgactctcccggtccaggtcgactctgcactgagaagtggaggctgagaggccgcctgtcttccgttctccggccgctttgtctgctctttccccgaga

SEQ ID NO: 760 - DNA, 3833 bp, Toxoplasma gondii
ttcttgctcgaagctcgtcaccttctccttcgactccgccacgttcacctggtacgacctcaagtactcgctgtacccctgttgctgactttcaaacagtgaaccgactggcgccgtactcagtgcggtgtctgcgcggctcaagagctcctcaagctgcgccaccacatccgctatctcggcggaacgcgtcctgatcgcgatcgccgcctgcgcgccttgctcctgcgcgaggcccgcgtgctggaggacgaggaacgccttctgaatcatcgccttgtccccgtccgcctgctcgagctctttctgctcctccgcgaccttgtcgatctgctggtcgatggagtagaagttcgcaccgatgaactgcagcccctcactaagaaccgcgatgcccgccttcgcctctgtcaacagtgcgctgactacttcgtattgtttcttcccgtcctcgaaccggagcgtctcctcctgcaactcacgcagcgcctggtccagctccgcgtgctgctgagccctcaagtgactgatcttcttgtcatacgtcatcttgtgctcctcttggtactgcttcagtcgcgtgttcgcctcgtccacgatcgcgctcacgtccgcttcgtggcgggccttcaacgctcgcagcctctcgtttgccgactcctcgaatgccctgtctcgcataggcactgccaccaagctcgatgcagctgccgggaccccctccgcctctggtttcgacgcctccttcgccgggctctccgcctggggtcgtgcctccgccccggagcttgacgcatcggatcccgtcggctctgccggcgcgggcgcctcagtcgcgctctctggcgcaggccccttcctggatccggagtccttcttcttctttttcatcgcttcaaagcgacgggcggccgctttgtatcgcgccggcaactccacccgcttccccagtacccgggagaacagctcctgcgccgcgagcaccagatgaacacctcgttcctggtacgcgtccggcaagttaccttcgttgtgaccagctgcctcgacgagctggaggtaccggtcgacctcctccgagagcgtctcgagctccaggtggcggccggaccgccggaacaccgacttcacgtgttcgtactggagtccgaagaccgtgcatagccagcgcgctcccgtacgccatccctggttcgctgcgcgcttcattgaggcgaccaaccctgcagcctcggctggctggagtccagagaaagacgcgagagacgcaggggcgggagacagggagggcgtggagatggcgacagcgaaggccgccaacgagacgaccatgcaaccgagacgccacggccgcgacttcgacgcgaccggcgctgaaggactcccggcgtcatgcgaccggaccgcgccggtactacgccccccgctcttcgccatggtcttgtgggacatgacgaccacagtgtggccgaatcaaacgattaccgcggcgatgacctgaacgcaaaaaagagacaacagtgctcgaatacaggcggcgtcggaggcctgcgagactgtcggaataatccgaacggaacagcacggaggcgccaacgggaaaatccattctgaaaaaaattgaacggagaagatgtcggggtcggcaactcggcgggcaaacagaaatgtacgtgtccgctggactgcgcgcgagtgcgtcggacggaacctgcgactctggggggcggcacaaacctcctttccacggtagcaaccacctggatgcgggaagaagactcactgacaatgcggaaacgattgtgcaactggactacaatgaaattgccctttctacgtggtcgaggggggttgcggggcaagagagtgggctaccctcccttcggggtccgaattggccctctttccgacgccgttgctttttgtatttcgtatggcgcgctggcattcacgtccgagcgacgaaatgctaggtgcacacggaaaatcggggaaatggaaaaagcaaactgccaaaatctggtatgcgctcttccgcggtgagtgtggccccacttcgcgtgctaagagtgtgagttcctggctagaaagaccacgtgtacatacacctgaaacagatgtgcgtatccgcttccacaaatcattttcacgccagaaaattccacgtcgccggtcatcgaagactgtgaaaaaatatccctcgcggtctgccgcctcacacccgcttccaggttctcgtctctcgcggtctccagagcgcggtttttcccggtctttccgatttcagtagaaaatcggagaaacggcgtcgtgcagggacacggagaaggcagccagaccaacgctttgaagcaacagtcagagagaaccacgaggaactgcccgagtgaaagctcgaaaccggcggttcgagtgaagccccgaaccagtgctaagcacggtttaggtgcgcaatccagtgcctacctgttttgctagagtttcagaacgaaattgtctgtgcttctgcttcgtttcagaagccaagcgcggcgcgtggccgtcctctcgacgccttctgtcgccgaattgctggaacaagtggcggcatccgcagaggacgggaactgcgattcccggtagtttcacgttgcgcttctcccgttgaggagacgcgagaacgcagcgcatggattcaccggcattcgccaactcccacacaaacaataatgccaacgagaaagagaacctgtacgtagtgtgcaaaaaccgagaagttccgcactggaaagtccgacggtacacgtcaccgcagtcgccagcttttcgtctctctaccacattgtcgattcgcaaattgcgtctgcagcgtactgcagcggaaaccgcggagagcgcgccccattcacgctctgccgcaacttgcctgtcgacagctctctctggaccggctgtccacgctgccttgccggagatcaggctcgctccctaaaaaaccgacttcgagttcgccgtgtatccgtcgcctcacaaccgctggcgctgcgacggcagccctggtttctccttggctgaacccccgggcggcagacctcgagggcgatagaaagacgaggtgtcgaaaggtgagcgtctcgcttgcaggtctaaaaagcctcgccgaaatgaaggctatccggcttgtctgtttgcggtaggctgctaaaaatggtgtctgcgaggctgcgcatttgtgcgtatgaatacccgaaccattttatggcctctcgagtgcctctcagtctcgtggcatcattgtgtgtgtgcctcattgagaaacgcatgcgcgcgcggctgggtgggtgtcggtctattttcgaggggcgccggtatttaaagtcacagctcgcgctcggtctctgtttagggggacatgacctcggaacatggccaagatcatctcgccgtaaaggtgtggagagaggctgaaacggacttttggaccagccactgcggatttagacgttaggagaaaccactgggacgaaggggacgtagctccagttcctggggcgcaccggcgcgccgcacacgagactcttgcggcggcagttcgcgtggcaaaattgcgaggctcggcttatactcgaaacagggatagaggggagggatccagagagaggggggaaaggaggctattcttcttcctgctttgcccgcaagaaacgtagagtgtggcggactacatacactctactggccgcgccctgctggagagacagtgccggttccgtttggagagatttccaggtcctcagccacttaccctttttctcttctctgttgcgcgtcctccgcttcgtcttcgtcaaaaa

SEQ ID NO: 761 - DNA, 2396 bp, Toxoplasma gondii
tctatatctacctgtgtagatttgctcatgtattcgtgtatatattcgtggtgtaccggtgtattcatgacggagaggttttttcgcatccatcagtgtgcagtgatgcttacatgcgattgtggggagggtagagctgtggcctttctcagagacttctcgcattctggattctgtctcttcatggtcgacttttcttgcgacgttgaggtcatacgaaagatctaaaccaatagcccttttcgtagtatcttgaaaagaatagggatgcttagataggaagcaagctgaaaatcgaaacgcctagagtgtcaacagaggaacagcgtctggcaacgttttcacgggtttcctcgcccatcgagaggactggctcttattcatcagtggcttctccctctagcttgctatccttcttggctttccatctttcctccgactcttctccgtcttcgtcacgcacaaactctagcgtgtgggcgtatcgtagtcaggttgcaagcagtgggcaccccgatttttttctctctgaaactgcgttcaccgaaagtcaccaaacgggtgaagccctctcagagctcctgtttctgcttgtttagtgcgcatgcagcgatttcttcatctcgagccctgtgctcgcgacatgaacatttccacgccaagcacgccctttctccaagcacaaaacagccagtgctgtcgcgtgctttcacctaaccgtgagactacactcatgtcccccgcctcatctactagagacatctatatgcagatatatgcatgtttatatacatatatcaatataactaggtgcacatatctgtgtatgcctatgattgtatgcattcgtgcagatttaagtgtacatgcgagatgaaggcggagtggaaacttgctgcggcgtccggggtccagtaaaagccggtccgcagaatccgacaggcactgcggacgtcccggtggtgtgtggtcatatcgccatacacccactatatcaacactaaaaaaacagggtattcatgtgtgtgaaaagcacacaatttagtccgagtttcctctcgtgaatctacaagcatggatgtgtagcccagaccgacgcccgcccaccacgcagacacgtagggaaccagggacttgcgcacgaatctgaactcaaatcgaaatttgggtatccttgctgatgatctctttcagaaaaggtctctttcacatgcactgcttcgcccctgcaacctcccgcagcgtcggtgtctgtggcacgtgcatgcacgcgctaaaacgtttacttgatgtccctttgtaccccgacagaaccgagagtcttccactttcctctgtgttcttcttcactttagttttgtgtctggagtgtccctctctctcctctttctttttctaggtgatctgcatgcgacagcccagtccgctctgatccgcaccaagcggtttcgtctgtgccggttcgtggcactcgaacttcgcatcctacgacatcaaatttattccgcgtcggttacgtgcagtacgcttcatatctgtatctgtgcttccagctaaattgaaagcgggggaaagtgccaaggcggagacagagaaaatggagttttcctaacactctcgacacgaacgctggtcttgtcaagaggcgaggcggaagagaccggagaagtcgttcccgtttgggagagtccgtttagcacaggagaaacgagttctcttcaagtccttgcgactctaggtgttttggctgctgtgtttatttttcgtctcccaaatttattctaaatttgaccgtttcctttcttctgtccagacacctgcatgtcgcctcgggtgctcactcggtgctgcgctgtgaatcaggccggtggtgatttgatcagcgtctcttattggatgtgagttcccccacgtttattcgccctttccccttcttttacccactgtttcctctcttcgttcttaacaagtttcctttttttacccgcagcttttcttcctctgtatccacggtcttttccgctcgattttcctcgcttccctttgagactgaaaaccactttccctccccaccaccttgaaccttctccgaagaacagcgccgtctgcttcgtcctggagttccacgctcgcttgtttctctttcgttttctgtggcttctcggatttgcgttcgaaccttttctggggccgcctctttggcggttttctgtcgagatgttggtgtcggagaccgcgagagtcgctgtgtacgttcaccttcgcgtccgttgaatctgcggcgcgcgtgtcacttttcttctgaggtcttctttccatcttgttgagtctgcggcgtctcacttgtcctgtgcctatcgccgaactcgcccttctctttcgtctcgctctgaaaa

SEQ ID NO: 762 - DNA, 1644 bp, Toxoplasma gondii
tcaaaggtccacctcggtggtgcgactatcaggcattccgagagctgaaggcagctacagttgccgcttggcacgttgcccaggggtagaggaaacatttagggaaaggaatttgaaggaaccggcgtgtcataggcagaagcgggacgacaaatggagctctctatcttgtcggctacgagcgctctgaacaaagacggttcctgaccgcgatgtaacgtgctgtctagttcagtgacgcagctggtctgttacgaagatccacgtttttctctttcacgtcattttttgtcttcggtcccgcagttgtggaagcgtcacgtacgtagactgcaaaagtaaactggtgttagcataagcagttctcgatcttactgatgaagtcatcggtagagtctacgaataaagatcactaaccctgaaccttaaaaaaacgagaagtggagaggtcgcaaggtaacaacttatggaatattccttcattgttttagtcttttagtctgtaacaataaatcgtaaagtctggaatactgtggcattcggaagcaatgtcacttcgtttgtcgacagtggttccagaatttgaagaactgctgggcggttatacctttccggtgtcgtctttgccaacgagaaaaacgtcttttactgtgtcgtcaggaagaagtgatggtgtgccagttctctttcctaagaactctcttgtgcagtggatccgctcgtgaaaattggaccaacgagcctaggcagaagtgataggcatcgatactcagacacgggttcagccactgaatggaagatttgtgttctggcgcctgacgttgtggctcatctgagaagaacgggtacactcccgtttcacaatgcattatgtggaagatgctctgattcgcggcgcaccagcacctgcttgcagaaagtacgtggtactaacggagcatttgcctcagcccgtgtcgtctttccaagatctgtctggcaaaaatgcagcatttcaaacacaaagatcatcgcttgaccttcgaattaaattatgcgctaacccagtgtacgagggctttgttggttccgctgagtttcatcggcgcgcgggaactactccggggggcaaaaagcagcgagcgatgcccttcctcagcagtcccaggtacttttcaaagagtatgcgagtcgttgaaccgattagaatgtctgattttgacgcaggaaccttgaaaaaccgattcccctcctaggtcacctcgagtcctggatcaagctcgggtcctctgtgcaggcgttctatattaggtccaggtagatgagcatcgcagcatcgatttgttcgctcttcgcatgcgtcgatgtgtgctctctcgcggctgacggggttccagcgtcaccgccatcccatttcacagtaaataatctggatcccgctttccagttccactgtatctcgtattccacagctccccgacgaccgtctgcctccaaggcatctttatcacgtctttccttcgcttattcgcaccagttgacagactcagcatttctgcccaaagtttgtgtactcgcggcctattttttgacttgcttgcagcgttctcagtcgttctaacttggattcttgtgctctttgttgtcggattgctatctgaccaa

SEQ ID NO: 763 - DNA, 4563 bp, Toxoplasma gondii
aacgagagaggcaaggaatgaaagcggacgcaccttgctgagacaaagtccaatagttgttcgtataccagtcgagttccagcttccggatttccacttgccgcttagccacggcagtgacaacctgattcttgtagagttgcagcattgcggtggataaaagggaggaaaacaaaaaaagaatcgcagggcgactctgcgacaagagaatcctctggaagagcaggagatagagagaggagacggggatggcacagcagagactgggcaaggcaaggaagcaagtgaaaagcaaaaacagaagagggaagcgacgcgcagaaggactgaggaaggatgtagatcgctgtgagaagacttggaacagaaagtatcactagcggatgtgatagaggagacagagatcgaaagaggatgatctgcgagctgaaagagatggagaaaagcaggaggcgagaggcaacgagaagagacaaactcgaggaaaacagacgaacggtcatgaactccagtgaaactggctcttcgaagaagagggggaagcgcaagacggccgcaaagaaaagtttttcatggagattctcctcctgcttcgcctctcaatcttcttcttctccttttcctatttttcgttctgtcttgttcgtcttcgttctcttctggggtgcctgcctgcctgtggcaaacgtaaagtcgagagcttggagagggaaggcgaggtcagtgggtggagaaagcggcgagtagcgactgagaaaaaagatgttttatgattaagaggagaatcgaaaaagggatgcaagataagtcacagagagagggaaaacgagccgctgctgtgtcttgagagtctgaaagctctcatccgcgagacgggtggagaaaacgaggaatgaacgagagaaagcgagttccgaaaactgaccagcaggcgtttggtcccagccaggcgcacctacacctcaagaagaaaaaaaagacagcacaaaaaggagcaagagaagaaaattgagaggatctgcttcacttgaggtctctcgctgtctccactctgcgcaaaagggcgctcccttttcgcgagcgtgtcttgtcgaaatttctggggtgtacatacactccagaaggtgaggagcagtcgttttttttgcagcaagaagacacaaaacagatacttttcaagaggtgcaaacggcctcttgctctccgagactcgccgcagaatgcgccgctctcgaacggcgcgaacaagacaagaagccgttgaattgggcctccctgcactcaacagtccgatgcgaagcgcgagtcgaggcggggtgtgcgtacagctcgcgagtcgcggcgcctggaggagaacaagctcgctgcttctcgcagttctatcgaatataaatgaagaaaaggaggcgtttgtggcgctctctgttgaccagcgcgaggcggtgcaaaagccgcgtcctttgtctctgttgccttccggaaccaggaggtagcaaacgcgcggaggcatgacgcgaagaacggtgatcctgtcgcaacgaagaacggaaaaatattgccttttcgactttcactcctctttcggatcccgtagaggtccgagtctgcttccgaggtcgcttccttcgaatccgagaaaaaactcaacggagttgcgtcctctatgaaacggggcgcggcccccatctatatacaccgacaagagcatacgcagtggaacaaatacgcggatctacgcctttatatatacgctgattcaatctgcaaaccaatatccctgcatgaatccaagacagagacacatccattcatttacatatataaatatatatatataaatatatatatatataaatatatatatatatatacagaaagagagagaggcattggagtgacagatctcccaaaagtatagggacatgcatgcgagaggtattcgcatgtgcatctgtatatggctgtcgacgaggtgcgactttgtctacgtttgtgtgtttacatgcgctgcagtgcgtccgtcatgcagcagggtggcggtaaaatgcgagtggagactcacaagaatgtacgaagaggttggggcagtctgaagaagattgacaagagcaggtgtgtgagacgagtcttgactgtggagaaagaatgggtcgtggacctctgttcacagagagtcgatgcaatgtggacgtgagactgcgaaaggcttcgagaaagtttatccggggagagtcgacgccgagttcaactcctgctggtccacacccccctgaaaaggcctttttgcctgcgcaggactcgagtcaactgcgacgaaacctgaacgtttgaccagacaggaaggtgagtggaggcgaaagacaagagatttcgcagaaaagcctggccgggagaaagctgcggggaaaatctttttcaccaatgagtgccttctccagtgcatgcccgcagccagccgtcagcccagccaggctcttcttttttctcagcaagcactggcgagattcgcttctttgcgtttccttggtctctgctctgcggcgcgttcttgcaagttttgtgtctctctccctccgttcatgtctgttccgaggccccaactcgcggggagatgtgaggcgagactggcgttccgcatatcgagctgcagaggcagatcctgcctcgcggaggacgtgtgtgtagacaaaaagatatcccagagcatttcctagaaaggaaaatagactgctctcggatctggaaggcagagacaacttctcttttccatatgtctgccgctcctcacaccgtgctacataaacgacacagcgccgcgcatgagcaaagagatggcgatacgagaaagcaaaaagtcgtcacgataagtacgaagcgaggcatctcgcggttcgactttccctaggcatctgtaaaaaggcgtactgaaagacgtacagcggcaaagcgactcgcggcaggtcgtctgtgtagccgaaagaaaacttggctttgtttgccaggaaagaacatgcagtccactctgatccgctccgacggttcaacgtgacttctgtcaactcttcttcttgtctcctgacgccgcgcttttcgcctttgtcacagagctctcaaacggcgaagcgcgggggagcctgtttggcagcagcgaggaacagagagaaggctctgcctgaccgcgttttcgacttcttcttctccactttctccagagaacaggttccttctttctatccgttcctttctcgggccgacaggacacaaacgcgcaccccgtcaaacaaatatttaaatgaactcagatctaaatatgtgaatgtacatccacctgcacatctgtatatttttatgcagaacatgctttgtacctgtatgtgtgtacatgtaaatgttcgcatgcagatgtgtgttacatttgtttgtgtctggttagaccaaagtgtatatctgtgaatgtacaagtcttgtaggaaggctttgacagaacttgaagggaagcgtgagccgactggcgcgcgaaagactggcacaaaaagcagcgagctggacggagcgcaccccgaggcgagattgtcgtttttcaagctgtgtcgagcggaagaagggaactgcgttgagcgagtgttcgattcttttttttcttgtctttccagcacacagcaaaggccctcagaagctggtatgttgctgcaacgcgaaaagacaatccaacgttcctctctcagcctcctttttcccgtcgttcgctgggcatccgccttgcccgccgtcttccgggggagctgccgagacggcctttcggggctgcatcgcgcgagagcttcgtgtgtttcgtcggttgtgtttgttttttattgagagattcgcttttctttcgaaacaagaatcgccagcgacgccgctcgaccttttcgccgtcgccgttgcatgcctcgttcccgctgtgtgtgtcgtgtggatgggcgcagagatgcccctgcggtcggcaggacgggggggacctgagatttttcacggcgttttccggtgaacagtcgaggaacctttcgaatttctcggaactttcttcagacgggatttctgcaggtgatgtgcagcaaaggaaaccatattctgtcgccagtctcagctcaccgagagcgaagctgacaacggggagattcagctagtgatacgctggacgctctgtcgctccagaaaggtcgccttctctctcctgtctctcgcgtcaacatttcttttttcttgatccccgtctgacctacatgcttcctcgtcttcctgttcacttgttgccgcagctctccaacggcgtgtgtctgccttccactttcgacgaagacctctccttctttgccagccatcgatcttcaccagaagctgtgactcgtgaaaggtcgcttttctctgcttcttctcgctctggtgtgtcgtccaccggttcgagctgagttctccctccccctgcgtactgccgaccttccttttgcctctcgcctgtggatcttcttggcctcccgtcgtctgtctcctcgcgcgcctcttgtctggagtttcgcaaga

SEQ ID NO: 764 - DNA, 4941 bp, Toxoplasma gondii
cttccaagtacatgccgtcgtcatgccaacagtggaataaaacgtgcaacaccaacatgggtccctacctccacctgtgcagtgttgtggtcgcaggaacttaaaaatacgcgcgagctcgtgtccagccgcaacgtaggcacagacgcagaaataattgcaaagacgagcgaaactacctcgtaagagagatacaaataaactgtaagcccaccacgagtcgcctttccaccactggtcgtccactgccttcaccagtggaggatttctcagccggccaccaaccaccctggctccggtcaagctgtccagttcacattaatgtcgaagcagtggtcgtctctctggattccgctctcaccgcccgttagttcataaaacggcagccatgatggccaacactacgctcttcaggaatgttgctgatgaccccgtacgagccacagtgccgctagactttgtttgtacgacacccgtcacgggcaccaacttcttcctcgctgacacaacaacccggcagatgttcttggtccgaatgtataaacaccctagcttgatagtttttgtttctgctggaaatacactgagcggaatagtgaaggtcatcccttcgtggggtttcgtgggatctccttcccaccaagtgctggagaaatcgtcgaagaactctggaccgcggtaatctggaccctcgctaaaacaagcttgtaaagacgtaagaacagaacaaaagctatgagtgaacacgtcggcagaggggacgagaacgcctccatcagcacaggcgattgaaaaggaattgcggccctcaaagggttcgaggacgacatgaaagggaccatagacagacgatgtgcatgttacagactggcctaccacacccccagtcctttcatgttcgctcggttcggacctagttaccacagatttactgcccgtctcaaagaaagcggccacgaggggcaagaaaaaaagacgagccaagcaagggcttaagcaaccccgccggtatcctctgtgaagacgcgccatcaacgccgctccgcaaagaagtacccaacctgcgtctacctctcttggccgagaactctgcctccgtacaccgggaatcctccttgaacttcgaaacgcagaagaatcagttgctgcgtcgtttcccacaatcgctggaattgagcttgggccgcgaagatcagctaggaagcgaaaacagcgaacggggactgtggtgattccgcttggccttccggcccgcggatagatactctgtcagtttctggtctgacatacaggaacgataactggatggccttgagagaagtcggaatgtcggagccggacccagtgcagacagccctgttgcccggcgcacggttcgcatgcaatcagccgttgctgagtgggcacacttcttcgtcagggtgaccgggcagcagggttcgctggtcctagcattcgccacgactctagcccccggttgctttggcaactgcagacaagacatgctgcatggtgtacgaacccggtttcgtccaactgatggatactgacgttgtgcgacaagcaactgcaaaagcgagtttctcggtactttccacacgacttcacggccctcaggaggctactggcagggctacttcaggcagactcaaatcttgagggtgctgggacccctgcgccttgcctcttcactcctcttcttcgtcttccatcaaccccgcgggtattttctcgcgcgccatgctacgtgacgcgcaagtgcgcacacactgatcagtcagttaacagccaattgtaagcgcggatgagaaggaagacgggaaatagtcctgtgcagctactaaagtaacccgaaccccaaaactttcttcgtgcactttcggagttgggaccttaaaacggtcaactcacgactgccagtctgttcgaggggaatgttgcccccaccgaacgaacagaaaacgaatcccgagaaaagggacgaatttttttagctagcggcgcatacactgaatcagggtactgtattgtcgatgttaactcccagtctagacagtgatcatgaaaaggaatcccactccattcatacggcccggaagacacgaagcacggaagcagctctccctcggacgggtcgcgcttcattagagggcatcatatcgaagaaggatcataaactgaccgacacggatgcagaacatgcgaaaaaggactgtacatagagccgagagcctcgtacgcatatccccattttcagctatcacttgttctggctcgggattagtcgcattttcaggagaccagtcggtctgagtaacttcacaaatggttgagggaagtctgttgtacattacgtggggacggcatcctttggaaaacaccttgggacccaaggaggggaattagttcgccacatagaatccatcaggagacagactttctggagctgtatctaggtgaacatgacggctatacagcgactttccttcccctgtgtttcaatctttaaagggtttcgtatgcgtctcctcgggaatgatgtgtcatgaagtgcaacggctgtctctcgcaccggcgagaatccagggcctccaagcgtttccaaaataacgccagcgcctgaacttatctacatagacttctcaggtatttctgaacgatatatatgctaagaatgagataaactgcaggtgttcccacggttaatcaagtactacgctattcagtctgttgtaggtgacacaggcgcacacaaccaagtatctaacacctccactgtaagcatcgttacttttctgtgtagacgaggtaccaattgtagtagagaactcggtcagtaaacgccgtgcaagtaggtctgctttggtcaactcatagataccactggaaaatcctcctagagtaaatgacacgaacaccactgcgtgcgagacgttgcgggtatcgtagtttcgaggctgagaagatctttcttgagtaaaaaaaccaagttacgctaacaccgtcacctgtgccatgaatggtggcgacgttttgtggttcagaacgtgcgtctctatacaaacgttacgcgacagcttcattacgaatggatgagaggtcagattgtcatcatcgtgcgaactccctaactcagtaaacttccgtggaccgcagtgggcttgtttatgaccagccgactgtaagcacgaataataacatagtaacgaagataatttcaccttcgtgcaaccgttagggccttgagcacgacaatggaaacacactgtttctgggaatggcttatctaccattgccgctcgagggcgcagtctctttccgagtatatgtcaacgatttgagtgaatcatgaatctgacgtccaaaacttccctctgttgctctgacttactgttctcagttcataatggagtacatgccgaaccgacgtacaaagaacgggatgagttttctatttagagaagacagttttttgcttccgtgacttctggaggccccgacaacaaccagagaacgctaccaagcatacgctagcattgtcagcaccatcgtactgggacccatcacctctgagacaggatcattaataagctggttctggtgagcataaagtacgagttggattactggttcagaccgtttagctgcttgtttacgaatcaaatcacgagctggaacgagtccaattgcccagctttgtaaaggctctaacaaggtaaactgccagttccttcgccgtctatgtaccacagtacacccagaggatgcatcgcccgtggacaaaacagtgagaactggacaagagagctcgacttcatcggagttggaacgaggttgggcggctgccgtgcacaacaagagacgagtgagtttggggcattacgaacataaaactcatagattgaccatgttttgcaattgtaccattgcgagtagataaaccgagcatcacggaatccagcccgagcacatcattctttgccactctagcatcatggctcgccaatcttttacctgccacgcttctatggcgtggtcttgcccgcaagctggaggctcctcgcgaaagtcagagactaagcatgcgccttccttgatatgacgcatgctagactccaagaagagacagatttgcagggtatcctcgagcttagttctgtaaagtcacgtgacatagtggttttttcgtataaagactgcctctcgactgaagagtaagcgattgagccagtagctcgccgacgtagcaccggtgaaatcgcatgcgcatgcgtcacagggcatcgactaaatcagccagtttgctggcgccataaattctgccgtttacctggcaaggcagcagacggaaagctgctccacaccacagttttctcttctcttgctgtgtgaaatgctttttccgggacacaatgggctcggctccatcctcagaatctcccgatgccgatccgagctgatgtaaagacctcatatcttcaccgccatgagccggcagttgccccaattcgctcttcgggtttatatattttggctgtccgaaattaccgtcctcagctgcttggtatatgaggacaaccgtcacccgtgtcgcttcgaaacgtaagaggtcgctaccgaaggagttaccccaggctccgctaggcaatctgcctatagttgaaactttctcgagtgtagtttctcattttcttttgcctcttcggtagccttcgttgacggtttttcaaccaccgaatagtcgacaataagcttgtttgggacgcaaattcacaactgatttgagaccgtggctgacggtcgccatccccttccgcgccagaccctcgccccctgtaccccctgatgggcgcctgccctaaacccatcatcgcttgctcgaaacgaggcaccaggctatcgtccacgatatagcttcttcatactcgttctctgcagaaa

SEQ ID NO: 765 - DNA, 2535 bp, Toxoplasma gondii
cctgtgtgtttgcctttttatgcggtgttactttgtgcagacaatggggcattccgaccttccagccgtcgtcctggactctcgtggactggaatggcctcgtcggcactgactacccctgcggggtcggggcgctgcggaacgttgtcatcggtaagttggagcttctgtttgaggattacggaaggctcctttcacagaatgtttacaattgatgtatggcggcgggctctctcgtctcgttctgcgaaggcggggggcgttcacgcgtcgagtcgcgtagccgtttgcgcgtgagggcgagggtacgtacaccaggagataaagacgcgagcgcaaatccagctgtcgcgacggacatggacagcgagtcggttttgtgttaacagatgcgtccaaatgttgaagaatggtgtctgtctgtgtgatcagtatgggtgaatttggatagcgacacaccacacacgttctgcgtccgtgtttctgcctgcttcttgctgcagtcgagaaagatgaggacatgcctaagggacagaaagcagtctacgaataacttgcgccgatggagggaggagcacgctagggagaagactggagacaagcgatttggcggatgccagaaatggtagaacagagaacggtgaaagggaacctacagcaagaacttctccggaaccggagagacgctgggcatgtctactgcgagcgcgtgtcgccgttcggagctggacgtccaccgttctttctggttccacgtcttattttgcttgacaactgccgtggaaatacagtacatgtttcattttgttgctgttcgcctttgatgacgacgaaaaaagaacccaaattcgccggcagagtccgtatttcgaatggcgagaatggtgaagcaggcaaggtggggaacgtgtcttacggcggaaatgcctgtgcacgagcgaatggggtgtgttaaggctttctgactggaccattcggtagagtcctcacatggctgaaacagacagaaaagaagaccggattcttaacaactgggaaagactgctatttctgtactcacaccgttagtgaattgcagaccacccgggcaaagcgcatgcgtgtcacgtcgcatcccggcgtctgcggcagttgtttttcagccgaaaacaactccatgacggaggtttccctgctacccaaatctacatacttcggggagacgcagactccataaaaagaatacagatatgcgttaactcgggcacatctgaataattcatctgccaaaaagttgcagaattatttgccgacgaaatcgtgtactgcactcactataggtacacatgtaaagatagctgagtatcgttctatctacacaattcgaggatcagttggagctaactgttttccagatcttgccaatgcacatcgatgacggtgaatggtatgcgacactctcgggggggctgtcggttgcccgaccgaactggatttctaaacatcgaaagatttccttaactggatataacgtgcaaatgcggtggggacagaacacgcttggcatcgtgtggtacgtccccagatatcctttgcgcgggaggcgacaccaggactcgggtgactcaagaactttcgtaccacgttgcgtgaacccaggattctagacttcttcctctgttatgcagcatatcgagattctggaatgtggaatgtgtagctcaggaaagcgtagcgttttgaggtgggctgtgttgcgatcatcaagcgagaaacgtactgatgctgaactttgtcggttcaacgtcactcctttgtagctcagacaatgccggtaggaaacaatgaaggtgacgctcatcggcatcttcaaacgacagcacgaatagccgccgacaactcacagagcaggcgagcactggtataccttaaaaggatcgaataaagtgcttatcaaccctagtgctaaatgctacaagtcgtttctttcacgctggagccctccaaatcaacctctcgtttgcctcgttcaacgacacgccagttgagcgcgatcgctggtcgtagaagtaatgcaggagaaagaggagtttggggatataccacccgtgttggtcgagtgatgcttgagaagcttgagttgtgggatattctacgatatacagtcggccagggtcttccactcagcctgcactgtagctgagcaacaccggtacgcacctagaacacccgagagaaagcaactgatcctgaagagccacgcgttcgtacgaaaaggacttattttgacaggctgagtaagcccgcggtaaagcctcagtttggaagcagcggaattcaagaaacaggactcgcctcacacgagaagcggtgcctgtctgcaccctttctccagacttgacagcattttttcgtattaaatgaacagaggcgtgacgtattcgatctggaatattcgtctgagggaaattacgcatcgcagacgccatgaaacaactatcgcgcagcctttcatcagatggtttcactgagcatgctgtgagaccgggctgacag

SEQ ID NO: 766 - DNA, 2386 bp, Toxoplasma gondii
ctgcagcagctgttccgtttcgtcgcttcggtgtaaagcgagctttcaggccgcttgagacccaaggagagcaacacaaggcgccgagcggcccggcgcctcgttggggcgtcggctgccagttgggcgcggagaccaggcgaggagacacgcccgcaggccgcgcctccagagagaagcgcggagcctctgcggcgacgaacaaggcgggcagcgcaccgaggaaggagacgaagacgcacaggcgcaaccagctgcttgtctgcgtctgcagatgagctctgagcaggagcagcttgagcagagaagtccagaagaatgcgagaggcaaatccattttccagactgacgcgccagccgagctacgacaggagaggcctcatggcggcaacgagtggagaaacgggaggcgagagagaacggcaagacgtggaggatgcgggaccgagatcgattctcaaaccaaagacgacaagaagcagcgagagtgtctcaggccgttgagaagaagaatagatggagacagtcctgacgaagaagcacacacgaaggggagaggcggaggaaacaggcgaaggagagctgcaggagaaaacaggtcatctgcgagagacgagacgaggccacccacaggagcggagggcgaaacgagaggagaccgaaagtcaaggcagtcgacccaaggaggaaagacagcaagccgagcgactctgtcttggcattgagcctcagagacaggctctcccgacgggtctcgccagtgtgaagctcactttcacctcaaaaaactggcctttatcgattcgcagacgtcgccgttcatccccagtgaagtggaagcatttgtgtcgcctccttcgtctctcctccgaccctttcaaggacgcctccaggaaaagtctctttacactttcctgccggtgtgagacgcagactcagtccctttcgctcgcggcgctctgcagcgcctcggctcgggtgtccacacaccgcctggcattcggacggggatcgcgcgagtcgagacgcttcgcggcgtcttctggaacagacagaaacacagaaacccgttgcggggacggagtttttccccagcatgcactcgaaacgaggaaggcaagtcgtggtggcctccgcgccgcagctggcacggcagcgaaactgcgccgcggttccggtgcctgtacaccggctcctcagaacaggagacagtttcggagtgcgaacttttttccgacggccgaaaaggcttttctcattcagaggctttttctcgctggctgtgtgtggagggaggacccacgcgggcggaacggcaaaaacgctctcgccgcgagggtgtgagcgatcggcggtctttttttcgcgaacttgtctgtccaggttttcttcggttgtccttcaaaggtcctgcctcttcgtccgtgaaaggctttcttcttcttagagagagagagaactgtgcggccgaagcgacgagtgtgtgtaaaaggtttacggcttccaagtatgcgcttttcgcgagctgctgagcgcgtgcatgcatgagaagacaaacgggaaaaaggaccgccaaaccacacacaaggttgtgtgtttgacggactcaccgagacaggggctaggcactcgtttcctgaaaagcgaaaacatgagcaaatccacttgaaaaagtcttttttcgacacagacactcctggatgccgctgctttcgcttccagtgcgtggcgccgggaaggcgaaactgggaagactcccagactgtccgccgactgaggtgtacatacacccaaaaggttgccttttcgcgttgtgaaagcgagaaaagtctagtttttgaccaggccaaaagcggtatttacggggtcggaaacgcgggtcaagatctcttgtgttttttcctagtttcctcgagtctaaggcctgcatagatgaactcctttcctggcggccggccgtcccccctgtcgaaagccacggtcggccgtttgcttgctcgatgtacgtcgaggaacagccccctctgtttgtcgcgaagcctcaactctctctctctcgtgtttctcccgctcttccgaagcctgctttgcgcggtctcctttcctgtcgctccacctgcttcgtttttcctcttcgtctctactttctgcgtagctgcctgtcggtgtttcctctcttcctcggcactcggttcgagttccaccctgtaggacgaagagtcagcagtccttcactggagaacgggtctctcctcgtccctttctctctgcattctcctccagaggtcttggtctctctcatcttggtcgcctcccctctcctcagtctgccgcttgtcttcggccggtgaggtctcgttctctctccgttcgagcgtttccacca

SEQ ID NO: 767 - DNA, 1881 bp, Toxoplasma gondii
cgttcgattgaagtagacgccttctcttgggttgtaaagccagtgagggagcgttcgatgcatgtaccacacatcctcggactgcgcctcgtggtctccccgccgctgctctttttcactgtccccctgctgcgccgctcgaccttcaaccttcgcgtcgtcgctctctgccgcctgctcttcctcggtgtccacatcgaacggcgtctctgcttccccgccagcgtcggcgactcggtctgcagcgacccagttcgagtctgctggggcccagagcggcggagcttcttgcgctgccatcgaaggagatgagcgaggcagaggaagaaagaggaaaaagagacagctaaggcgcggggaggacgagagggaagagaaaagcagagagtcaggagacagcgaggaagaggaggaagaagaaaggagacagtcacgacagagggagacaggggcagacagcgccgagcgacttgagctcagatcagccgacaggaagagcaaagcattaaaacaaagggaagagttgggagagagaggaagaagagaataagagaccggaagtgaagatacgaaagtgaacgaggaccagcccgaacgacgaacagaatcgagaggaaatccaaggcatggttctttgctctcgcggtttctccctgatcttgcgttctactttgaaaagtctgtcgtgctccgtcttttcccctgggcctctcttcgatctctctgttctcctttctccttctgtgcctgtctcgtccttctgttctgctctccacggagcctccacacacagagaaggtttcgccgaaacttccagaactgcgttcgccaagaacgcaggggagatcctctctcttctcggcagaagtggacgacctcccgcgttcactgggagagggcagcgcggaacggctagcagcaggtttctgagagtgtgccgaggagaagtagaaggaaaagcgtaagaaggcgagacacggagcgagaagaagagaagaaaggagagaaaacagccggagacgcggagacgggatctcttttcggctgggagagagacgcgcgtcggagaagaaggagcctggcgcgtcaaagtgcgtctttttccacttcgttgacagagaagaagaagaagaaaggcagacgccacccagaaagggaccgtcgtttccgccacagtcagctcttctttcgcgttgcctcactcgtttcgcgttgccgttgcgcgcgcgcgacacacgcatgcagcgcgagacagaatctcggaacggacatctacgcttgcatgcgacgaaactctgcacagtttttcagggactctccgaaaccgcttttctgtgtcgtgagggactgcctgttgcctctcttctgtctcaccactgaggaagagcgcagctccagtacatgcgggagagccggactgtctctctctcgcctccggcgccctcgagagactgtcgcgttgtatgtctctgtcgaggacttcttcgtgaccggcctcgactttcatgtggagatgcgggagggccgaagagaacggaaagctctctcttcgcctgaatctccctgcgccagtgcgctctcctcagtctggtgcatctcgctcgcgtcggaactcgaagttcctcgaagagacgcaggccgcgccgctcactggggcgcgacgcgagtcgctccggtcgcagtgtctctctcgcctgtggcggagcgaatgcaaaccgcgcggtcgatgagccagtgttgaggcaaggacgaggaagcaggagacgatcagaggagggagaagaaaagcatgaagcagaggagaaccagaagtgagggaagaaaggagacccggcaggagacaaagaacagggcgggagtgagtggttggtgtgaggcaaa

SEQ ID NO: 768 - DNA, 2019 bp, Toxoplasma gondii
tctgtcgcacaagtaggatcggttttgtgtgccggtggctgttttcgcaggtcgacccgcgggcggacgtttactttcctctcacggctgttttggtgacgctggggcctctctacatgttctccaaagccttcttctgaagctggttctacagtgccgtggtgcgcgtctctcctctggggcgcgaactccaagaaagccgcgagaaaggcgccgttttgcgagttctgacggagagctcgactcgatgacttcgcgccgtctgcgctccggtggtgccccttcctgcgttgtccatgatgtgttcctcaagttcaactgaagccgaacggtcgtctctggacactgtttcacgaaacctcagcacagttgatgttaaaagcaagaacagtcactgttcctacgccgctgtccagtctggtggaaacggaacattgatacggatgagattccctgcagcagctttgctttcgcctagtgaactcactacagtcaaattcgccacaactctttcggtagtgttgtgtggcggctcagagaactggaaaaaggatgtttgcgggtagccgtgaccacagtcaccatcgaagcttacgtgcttgcactttgtcgtcgagcggaacgtgacgaaaaatataacagtccactcctttctcttcggacggaatcaataatgtgatttattcagtcgccacaagctgtcgaacactacgcatctcggcgtacccccagcgaacctttctgtgccagcgctgtgcgcatggacttccgcgctagactaccgtgaatcagcgagcatgatgcacactgtggagatcagaagggtagttttcccatacaagtacagcctcgaaataaaagacaacggcagaaaaccttaccgaggtcgggtgtccagaaacttacagcactgccgagtggaacctgcggaagtgtcggtggtccaactaaggctgctcaaggtggaatggcggtcagagagagaactttcgttgccaggtgtcgtcgattgtgcggattctgcttcaaagcttgttagaactgagccgaaacggttcttccgactgccctttgcaagtgaaatattgcgaaacagacggcctctgcatttatataatcaatatatatagcgacagagcatgtctaaactttatacgctcacgaaatcatctgctggcagatcagttattgagacgtgaaggtgacattgaaaaaaattccgaagcccgtagaatttcgtacgcgacttaggctgcggcgcatgcatgcgattttctcaaagagaggtgtcggcaacctgctgctcccttatcgttcgacgataacgttcaacttttattccgtcacacggtggagccttcggttcgatgttgttaggttgtcttgcactttcctggcaccaaagaggagctgtactcaagcaattgtcttgtgaacacccagagacatacagcggcgcgatgctgttcttgtctcgacgtttttcaagcttgcatgacccgtccattcggcacaccactacattcagttgaagagagctgagccagccatttctggcattttctttgacttaaaagaggagaaccagctcttcttcgctgaggcgttggctactgcgtgaacttcgaaatgtgcctttcggcagaacacagtaatgtggcggacgagtcgtcgccgatcttcgcgagttgtggctggggtagcatcctttccctttgccatgagcgcacatttcctttcacctgtcaagggatctcacaccgtaaaacgctctaaataaagaactcgagtcccccccccctcgcctccgcgtcaaagcggtatgacattccagttgtgtcggctgtttcgatgtggtggcgagtctccatctgccccagaagggcattgctcacaagcaggatgtgctatttgcagcttacttggactgctttcgccaagaagtctagaaaattccatggaactaccttaccctgtgcaactaacgcacaaagtgtcgaggtagaaagtcgttcctga

SEQ ID NO: 769 - DNA, 2612 bp, Toxoplasma gondii
gctacacgtcgatgtgttgtactttcggaagggactcgcgttccaggctccaccagcggcgagaaggaagaacaagaactaagaaagatgtttccttgactcggggaaacgaatcagacacagcatacagctcgtgaattcaggatcccgagacagcttggccacgcatgctgcattttttcgcttttcttcttaccgtgtctgtgtggccgtgagtgacgtagaggagctttccagattttgcagaaaaaaagcagagttctctggtgcgtgcgtcgaccgcgttctctgcctcgcctgtaaacgtttctcccctgggagtggcaagaaccttgccggaacagaggaaaactgaggctcggtggacaaggctgcctcctgccaatccccatgatggtttctctcgctttccctccctaaatcgctcttcagagacagaagctcgttcgctgccaagcgccttcttcttctttgaggaaggagaagcaggcgcagacgaaggagaacagggaaaagaaggggaacaagaggcagaggaggacgcgacgctgggcgaagtcgagcgcagagtgtcttttccaagtcgcaagcgccgacatttcgcagccttcgtctcgccatcctcgagaagcctctcttggttttctcccctcttcttttttccgctctgcttcgctgcagtgtctgtacaccgcgcgtcacctggcgagcttttctcttcggtgtacgtacactccggatcctgctccgcagcggtggcctccaccgacttccggcttttcttcttcatcgtgttaacagaggtttcttggcgacacgataggcgggaaagacgccctgtggctcggagagaaacggagaaacgagtggaaacggtggtcggaggactatgcaaagtcgaagcgacgacgtgggcgggagggcgtcaggcgtagcggcgaggctgtgactctcaaccgagacaagcaggagagaagaaaagaacgtttttatggtaagggactcaaaacacaaaatactacctacatgaaaaagaagaagcctttccgcggttgaccgccgtcatcgacgaatcgaccgcctcgctgcgtacgcgttgaaagctacttgaggagaacaggacagagacggggatcgcctcgatcctttatttcaaacaggctcgggatcatgaaggacgccttcaaaaatccttttaaaactgtaaaaattccgcctccacgccctcctttttcggccgcgtgtggggtcagacgaacagcgcagcgagtccccggcgggaccgctggggtgtatatacagctgggtcgaggcgcaggatagtatgagcggcgtttccggaccgaaaaagcagtttctgtttcagaaaacacgctcaaaacgcgtgtcgaaaacgcgaacgtttatgactgtcctgtcagcgctctcacgcgacgcctcttcgcaggcgttcccgcgattcgcgcgcttttcgcagtcccagaggcctgtctcgggtgctgttgcatgtgtacccacgccgtctgcggaccccctgagagcgagtgagagactcgagggtgtctctgccgacgacgtagagcgctctccgcgacgaaacggaacttgtctctctgtttgcgttcgtttttctgtcgagtcccccggatttcaataagacgcacgcgaccggcgcctctgagctcctcgtctctgtccgcaccatcgctgttcgccgttccagtgtgagcggaaaagaggcccactccgaagcttaacagcgaggtcgtttcgccctcccgtttcttctccctagttctctccacagctccagggatcttctgcgacgctccttcatctctgcagactgctgcctttgacgcgtccctcgtctgtgccattttgcatttctctttgtcgcggtcgatcttcgactcgtcgatccactcggcctgttaacgcgcagaccttgaaagggcaccctgtctctcgaaggcgcctaggcgctgcacagcggcccgagtttgaactccgtcacgggatgcgtccgcagctgaggagaaatcctctgacgacaagcgactcgagcttctcagacaggcgcgagaggaacgcgcgtgagtgaaaggcagcgagaagaaggcgagacagctctgcctcttcggattcccctttgtccccaaaacgtatttttcgtctgcctctctgcgacgaattgatctcgcggcttctctctcgactttttcgtccgtccgcgtttcgcagctgttcgtacacatctggtgtcgacgcgtctccttcctctgttccagtctctgtgtatgtgctccagcgacagcgttcgcgtgttccgcgcgtccccagttcgcgaaccttctctgaagtgagcgtcttccttcctgtgcctctctggtgtctctgcttcggcgtcggagtctctctgcgtcgctttctccaaatcctctcagcgtcggccttctgtggctgttcttccgaagaggcgacccggtagagttctcgagagacgctcgagagactctccagcgcctttgtggcctacgattcgaaggtcgacccgcctgcgtctcgaccggcgccgccgtcggagcctcttgctacggctcgtgcaacga

SEQ ID NO: 770 - DNA, 2067 bp, Toxoplasma gondii
ttgtaagtgttaaggtgccattcggttgcgcgcaaaggacgaactattcgtaaacaagaaccagtcgttgtggccgttttttgcgatttagttctgctcctttttccaccgtgtgactcccgtatactactgagtcgtcgctcgttaaccattggggcgatgggacgtctcggtgattgctgtcaagtcacggtggcaatgccgtttttccacgttattttttgtcgtacggtgcgtttctcgttcgcagttgtatttggaggatagcgatctacatctggcgcccgttgcgcggccttgagaagtggatgtgccgattattgctttgcaagaactcggtgtggagtttgtggagactgcaggaggtgcagggctccagatgatcgagcggttagctagagggaaattggcgggagtcttctactttatactcatttcatatgcagataaatcgactgttcaccgtagtaacgcgcgtgtacagagacgaactgcaatgttaacgcacacaaccggggatacgccgccggtggtccgagagatctcacagggccacataagaagccacgttttgtcaggagagatgggcctgccttgacttatattacgagagagttgctgactggtgtcctaattacaaaaaatcgatggtaatttccggtgaacgctttcggattccttgggaccatcgatagacagccttcgagctgttatacagttcatccgaaattatgtacaggctgtgagaaatctttgtatttttgcatccactttcgtttggcattcaagaggttctatgacatcacggggcctcacagccgggaccgccgcaacgatcaagtatcatccgggtggcatttacggtacataaactgctgataatatcgaataagcgtctgaggtaggcgttgactgataaccaataccttcaatctggcctgttagactaatatattgtgacaagaattacggacgtacaaaaacgtcgcgtaagccgcacaggcctaaatattgcaggtgacgcgaaatctttactgggagcccgtttgtacctcacgtaccacaacagacttcgaatgacagctaccggaaatttattcgacaaaagacactgtttttgtgacggtagaacgacgcacggatgaccattaactcaggacttatgttggtgcctgacaagaggggacatcggacacagctatggtcacggcggctaaggttgaatcccggtcagccgtcgatttttttaaaatttcatgtccctcaaatggaaggttccctgtcttctttgaacagtagtcacaggggagcatagctgcttgattcaaaaacgtcccagtaacgctttatggttgaatgtgactcgacagcccagcagagtaaaagtcgccgaggtataacagcatgcatgccgttgcatgacacgggcaaaaatccgataagacagttttcaggctgggcgccggacgggcggtcgaacttgagagcccacacacgcagaagcagcactggtagtccgaaaataatatgctaggatgcatagagctgctcagcttatgccgctcgtgctttacaaactctctccacaacaacatggggaaaatacttcttaccgctcatcaccatgttctcaggcgtctgggtgagccacccggctctgaagttgtgcagcagctctgtcgagcgcgcaccaccaccctggaagagcgagcgacgctcatcgcgcctagggtttcttttgtgaaccgatactactttgactggcgacagagctacctgttttctcttgaaaaaaagcggccttcccccccttttgcaagcttctttcctgttggcgcggtgcgtaggttgttaccctacggtggtgaaacgtgaactagcagtgcacaccgcgggtcatccgagactcaaccttcgctggactatgcggattgacggtactccctttctctctcttgtcactttctcgagatccctggcgaaaacgcgagtaagtcctaatctcgaaaggaggcccctcaactttttaccactcacgtggttgcacactatcgctgaggagcaaaa

SEQ ID NO: 771 - DNA, 2303 bp, Toxoplasma gondii
gccatcctcttggatcttcaccacttccgctgttctccaaacatcagcggcgtcagggacgtagatcttggttccaacggcgcagcggacctcctcctctcccgggtcgccgcctcccggggcagacgccccatctgcagaagatgccgtcatgttgtctgctgtttcgagagcgcaaaaaattctgcaccgagttcagctaccggcgggcaggactgaagcacacgcaaatgcctcggcggaagattctggtacgcagtctcctactacgagtgatgatgtgtcttcactcttgatggttaaggacgagaccccaggaacgggatttacagtaatttctccgacccaacgggcgcgcaccaaaaatgcaacgaaaaaaacgaatactcgaggcaccaaaaagctggcagatggccggaacagaaaacgatcaacagagaacacgcacacggcaacgcaccgcgacgaagcaggggatgtcctcaatacgacaaagtccggcccgccgggacgcgtgtggcaacaccgccaggggacgcggaatgaacggtatgaaacagatgaaactatggcgaagagaggcggagcgaaattcgagaagaccagtaaaaatgcaaagaaggacccaaccgaatgaaaacgaaaaacgtcgctactgaggcgaacaaactgctcgaggtaacgggcagttgtgtcaggagtacgaacccctctcagaactgccgtggtggtcgccgacgatgcattggctgaaaaaaacagtgcttcttttgagatgcagtgaatcgaatagacgtgtatgcagagaaaattccgtgggagagccccagtttgaggaggaaaactcgacaaaacgtcggggtgttccgggcgggaacggcaacgccacaagacaaacaaggcaacgcagattgcacgcggcacggaaaagagcttctgttcaccaaaacgaaggatcaggtgatacgagaaggacgtgcatttctgcggagttgtaggacagaagaaacgacggagaacacgagcacaaaaggcgtggacggctgtccgcagctacacggtcggccgcccgatgctggtcaactttaaaggctaccagaaacgaacgagaaaacagacgtgcttcaccgagttggagacagcatgggaaagccgaagtgtcgcaactgccgtgacaccgacgacactgtgttagaaaggggaaacgaacaggacacggcggaaaaggaacgcgttccgctgtgcagtacatgtgcaaggttcgccgaaaagactctcggcaagcctagagagtgatgcggttcctaggtccgaagagcaagtcagcaaatagggcaaccaaaacgaaccagccctgttcttccctgaggttgcgccgcaaagcagtcgatccactttgtcatgaaaaagacacgagagaccgtccgctgcgttggtgccgcgaacgcttcctctcagtgccgaaagaaaatcgcagcctgctagaaagcggacggagaaaagacgccgctgctcctgcaagagtgacgcgagcacggaatcccggtcgtggacggcagcaaatgtgctctacgtatcttccggaatctcctgcccaggtctgtatttctgatcaagagaaaaagggcaagcgacagctagaacgtgacgttctcaccatcgagaaaacaaggtccccagtgagttgacgccgcacacacacggcgacaagggcaatatagaatgcgcgctcttaaaatcggtgctctcgcccttgcgcaacctgtcaacagactggggtcccctgctgccgtcgttctctctgggagaaaggcggcggtccccagacggaacaggaagccgtggcgcctgctctcccccggtgacgtacaacgtagcgcttcgctacctctcgtctgaagaaagtatttgtccatggaatcctgttgtggtttgctcctccgctctgccctgcaagctcttctgctgtgaagaggttgcttccggtagcgagggtgacccgccgcgtcctttggggtatatataggcgccggtgttcaggcaacggctgtcacggggtacttgcatcgcgtactataaagacaacgtagatgcacagcacacaatatatatgatgtatgtagatacaatacatatgtctttcggtacccgctggcaatttttgacgtggtagaggagcgtgccttggaagccagccatctctctagccggtaccgggtttgccacgatgtgtcatctcggtctcgccctctcgtcttgaagagtagcatttttccttcgatggcgtttctcggttgcgaaca

SEQ ID NO: 772 - DNA, 2780 bp, Toxoplasma gondii
aggaagaagaagatttgcaacttccacgagcagcgcaaaggcttccctggcgctcgtgagctcctctgcagagtacgtcgaagaaggagctgttgaagacatagtgacctagggcgcagatgctgaagcttcagttgctatccaggtgcttccacctcagtgacattctcttgcatacattgcgctttcaagggacctcaaaaacggtgctttgcgagtgtcaatgtcatcaatatagtcaaggaaatagttggttctgcatgtcctgagtacgtaagaggcaaaaagatgcgaagtatagaggcaatttcatcggaaaccggtgcggtttaaagaggtagctacggcgttaaataccacacaaaacgctgtacacctctcaattggtaataaagacagttatcgtagaagtacccagccagttactgaggaacagccacgagcccgaaaccacaacttagtatgaatgaatgcacgaaaacacaccgggacctcagtgtgcgaacggagagagagggaagagaaaccagcatgatagacaaaaatcggacagaactgtagaggcaaacatgacacagcacgatgaagggcggaacaaggggagacaaaggatgcgtgactgtagggaagacaaaaggtcatacagggaataagggccaagagcttcgcatgataacgcaatctccacaaaataattcaatctagacgtttgataaccaagaagggatggtggtgacccggacccaaacctggggaacacaggtgtcgagatcgagaggaaaacgcagcgaaggaacagaggacgaaagatgctgctgaagcaagcagactggtagaatgttcaaaatgcaaaagcaggtaggaaacgtaaggtcgtgagtttttttaaatgggacgtcgttggaatactccagtagtggtctggtttcagcgtttcatagcggaatcctgagcacacgaaaaaccctctgctcctctccgacaccctaacgtcagctatgtcgctgttcgacccattcagcggtgaaataagtttagggagtgatgaccagttttctacgtccggaactcggcggcgtgtcttcgtcttgcagcaacccgaccccctcgcaacatcgtggatgctcatcccaccggccaatcacttgaatgtggggctttcttccatatacatccggagcgatcttgttgagacatgaagaaaaaacaagaaatatcaaggaattttttccctgtgaaccctatatcgctcacctgcgtattttcgcagcggagtctgcgcccgacctgggttggtgtgagccaccatcagcgttgtatggcatgctgcgcgtgggcgcgacttttcctcaatttgactgcctgcaagggaacggttgtctgctgcgccgtggcaaaaagtacagttcggtgaatgagaggcaaaacatgcagctacaaccgtgacagcgctgccgcgtctggggaatcacgatgcaaactgattccatactctcgctgcacactacatgggttagacgtgccgttcctgctgagttgcacgagttgagcccgtttcctcctctgtggcagtcacacagagaagtcctgcgaagtttcgcaagcgatggaagtggaaaactgagcaacaaagaaaccgtgacggagtgtagggaataacaaccagggcttaacatttcaaccttccctaaaggaggcgcgcaagacctgagagctctccagttgaaaaatcctattcctggtaggcgagcttccggttggacatctgcgtgcatggagcacgtgcataattccacggataaaagcgattcgctgcggagtattggcagaaattcgctcccctcctcgtagacatcgctgtcctcggtgtgcatgcacgggacagactccgtgcgcggcgctagctcctctcgcgtcgcgggaatctccgagcctcatcagtgcgccagccttcctcattgcagcttgtttagcgacgattcagcgcatcccctctctcccggtgacagaagtcatggcgtacctgccataattggaatgcggcatggcaccgctcatcttgtcactggtcaagagggtggattccacgatttgtcttcagctgcggaagctgtcacccggtgcgcgcatgcgctgcaactctgcttgtgtggcgaaagaggatggaatcgacgcctctgtgagctgttcggaactcactgtcagaggatgagacaactcgttgcggcatcgatccagcattaaaacgcgtgccaagtcgaagcttcagggcgaggccccgtgcagttcgtttcccgccaaatttaacggagtgcagttcctgcggtcgatagttactacggggaacgtcacaaggggcaggtaattcgacccgtttgtgctactccctgggaaacgcagcacattctttcagttgtcacgatgtttcgttgtctattcgcgtgatgattcactgtgctgctgccgcggctgccacattgccatgccggtccgggtttgacctctctctgagtgccggaactcacgttgagccgtttccttctcacccgctttgtaggttaccgcctaggcatattgcttgtacgcctatatatttcaccctcttcgtttgagctgtttgtttttgtgatttcgtgttcgctttgcgtgcggggtcgccgcgctgaggcttgccgctatcaccgcggtgagtactgtgctccgcgggactgtgcttggtttttttcagtctctctccgcctcgcgggtctaattctcaggtttttttcttttgaccaaga

SEQ ID NO: 773 - DNA, 2122 bp, Toxoplasma gondii
gcgtacctagggaaaacgtttctccgcagtggagttcttcttttggtatatagatgaataggtgtagtcatgagatttctgccaccacgggagagagaccaggtcgcagcagctaggctgctaatcaaatgattctcatgatctagtcgctgacgaacatttggaaggcatatgttgccattatcgtcgagttcgaacacaatagaccccgtttctccaatactatatttggggtgcacactagcgaacggtgcccttgaaggtgaaacggatagccggtcacgacagtattagtatttcaggacgttccggcacgtcttcagacgaattctttcttgtgcaagcaggaagagcttcgcttgtttctaacgcaatatttcagccccagcgaaggcaaggcatatcaccctatgcgttggtttattccgtcatctgtagactcggaccgagaggcccgtaggttgtcttaacttgaacttcccagtatacgagtgaagcgccttatgccaaatgcatgcgtcagagacggcccaaagtgcgagtgtgaatgaatatgtcccgggaaggaaatcatgaatggtgttcattactgtttcccccagtcatcttcgaggcacggacagctctactctgtcctgattcgtcgcccgtggcctttcgccgtttccaggaaacgaaccagtacgtattcgggggagatgagttagcactacacaagcaaacgtctggaacgcgcagcatggctggcactttcacactgattcctggtttccaatcctatttcgcatcagcaggtggggacaggagtctctgtgtgaatctcgtgtactgtatcctatcattcggggcaagatagcagaacaagcctgctcggagttccacgtggttccaaccgacacaacggagcacaaactagctatctggagattcaaggtacgagtgcccttccgcaacgaggctgctgtgtccttctgtgtatcggatgttcactttttcaatgtcactgccgccacacgcaccagaacctggagagtggaagcctgcattcttgtggaactgctcagatagaaagcacagcaggaaagtgaattcgctgccgccacaagtgtacggtgtggtcgccacatccaagaggtctgacaagtgtgccacggcagaaaagcgaaggacgacgctgcacagggcgacgtaagttcatgttgcgaccatgagaccgcatgttattggtgagcgagcaaactgagtaatccatcgtttttggacgtaatacactcaaacaaatgcagtatctagggatgattttccgcattccgaagagaaaatttttggaactcgaattcagaaaacgcttctctttgtggaaacacaccaagtacttcacgaaataatctgcatcttaacaggatttaaagaggaggaagaaattggtcgtgggtttctcttcctgggaggctgtttgtctcgctagactggtgcatgcagtctgtgagcaaaaagaggagaggctacagacacactgaatgtacaaaaaggctgatcagtccgccctgttacttccgagatgacaacgcatcttcgttttccgcctcctgagctgtgaccaaagaagacttcccttatttttcttgagcggctacgcggtgcgtctctttttctccaggacactatcctgtcgcttggtgacactgtgtgttgaccgcgaacgttgtggtctttcattcgctagttgtttcggccgtgctcctcttgttgctcgtaacacaatcgaggaaaattatatcagtcttttgcgcagcgcaaatctttactcagcacatcaactggttgtcaaagaactctgtggttggccacgggcagtcccatgcgcccatcccagctgcacgcgcctttctgtctgttaaattcgtgctctgcgaattctttctgggcagaagggtcgaactgccccgctggctgtgtaaccacgtggatttgccgctggattcgggaaagcacaactggaaagtatggaatttctggcagatcacagagcggcttaacttcttgcatcccgccacacagctctgcacagaaaaagacggcactaaagcattagagattctctgtgtgttttgaggcagaa

SEQ ID NO: 774 - DNA, 1764 bp, Toxoplasma gondii
ctgatcgggaccatagaggagaactgcaggaagctggctgtggacagccgtggcgacgacagcaagacgccacagagaagtttcgagaacctcgcaaagtccgagaatgatgttctgcaggcgagtgcacaattgactgtacaggtgcctgtgacgccgcgagaccactcaagagcgggcggtcagctgtgagacatctacagcgtgcattggaggcggagactgatctctctggaaaggttttttgtcgagtcttctctcggaacgtcttcacactttcttcccttttcgcgtccacgtcttcacccagttttctgcttcttcgccctcctcgtcctgctgcccagacgacggctctccgcaccgcccacgtcattctgttggcgccaagagcaggcagaacgtcagacgggaaggacggagaggtggaacagcgtggatgaggcgctccagagaaacagagcaggaaagaacaggggaacagaagaagcgagcgctcccaagtggggtggggcggtgtacagcaatcaatcataaagaactcggttgtccggcataaaaagagagaaaaatacgcagcaagcgcggtcgactcaagcgaaagcagaggcaaaagtttccagagatagcggaacactcgaaacaggagacgtctcaagaggaagaaggagaaaactcaggagagagaagaagccttaagaagaaggaagaaggaaagacaagacaagggatacggagaatttcacaggaacgaagataactgaagggaagggaaggtagaactgaagaggacggaaaagaaggttgaagaaaaaagagaggactgaagagaaaggagaagaagatcggaggggaagaataagagtaaagagacaggagacgagcggataagactagggagaagaaatccgctcctcccgttcgtaacaactttcggccgcacaaccgagaatccgattagctactctccttcccatcagcccttgagactccttctctcccttctgaaggaagaagaacgccacagaagaagaaaacaacgaattggcgttcacatttgagcacgagaaagaaagccatcttctgcgtgtttccctcgcgacttcgctttctgcaacacactcaaagagcatgcctgcgaaaaaaccgagtgctgcatgcgcccgtttccttcgaatctgagcaatctgtccttctgcgaagcgtacttttcctcgtcgacttgggaaaccaacagttcctgagatctttgctttttctttcctccgtctcttatttcttctttctgcttctctcttcttctcgcttgttctctctggcgaacgcggttcccattgagctgcgaggctcggcttcaatgcgtttgttttggagaaacagtgttcctgataaaatttcaactcgtggttgattcatagaagcgtagttttcaaagcgcgagtgtcgccttctttgaacactcggaaggctgctctcgaactcaagaacctctcccgaagtttatacctgcgtgccattcgcctgacgagatccctcttggcaagccgcagatttcgtctcaaacctcacgccaaacatcaggcatctccctcgtcgattccagctagatagacccatagaaagtctctctgcatatatatatatgtatatgtatcgagtgtgtggtagtgcctgagctccggagaaggcgagagaagcgaagcagtgggggtaaaagatttgaaaagcagtttttcgctagtttgttacttttcggtgttagaa

SEQ ID NO: 775 - DNA, 5004 bp, Toxoplasma gondii
gcctccgtcatgaggtcgctgttttccattttgttgcgatctgcatgcgagccctggagagcgctgccgacgccagtgcgcaggcgcagagcgtcgacgtgcgttcttctctcgtcgtcgctgtcgctgcgtcgcccccgtttcgcctttcgtctctctgctccctcactgtcgctgtcggaagagcaagctgagtctcttccttcgtatcctctgcttctgtctctcctctgacgctgtccgtctcctgtcggaggttcactgcgagaggacagagcagcgaggcgcgcgcgaaccccctccagcacactgggaccggtctcccttgctttctgttcttcctgccactccagctcttcttcgtcgtcttctgctcgctctcgttcgccttctctgtccggcttccagctatctcgaaggagatgggggtcgtccagcaggtcgtgggcgctgagtttctttccagtctccggcgtggacccctcttcctcatcgccgaaggagagaagtttcttgtcggcttttcgcagtttcgctcgcgccgcctcggcctcttcttctcgcagtgcgctgccttgagatctggctcgaccttcggttgtgcgaccgccagctgctcgtgcacgtttccgttcgtccttctgcgccggcggtgcgtccggcaacctgcgaggcaccaggtcttcaaaggggttccagagaacatccacgcttttgatgaatggcggagtcatgggccggtcttccttgccgacttccaggtcgttgaacttcatcaagttgtacagagtgtgtccagtgactttgccgaagagtgtgtacgcgttgttcaagacgtccgcgcgcgccagcgtgatgaagaactggttcccgttcgtccccaggctccggcctcgctcgtcgttctcggcatccttcgacgaacgacccaagttggcaacccccaccaacccccggtagcggaacttcaggcggggatgcgtctcgacatcgaacggcttgccatcgaacgtcgtgtcggcgccgccgcgacctgttcccgtggggtcgcctccctggacgataaagtccttaacaactcggtggaaaattgtgttcacgtagtacccctccaggcagagctgcacaaagttcctgcatgcgagcggacactcccgcgcccaaagctcgacgtccaaatcccccaacgaagtgtgcaaaactaccttgccccgcgtcgacggctcgtgcacgtacacctcagacatcttgacgagagacgagaagccagtgaggtgcacaaacaaaacgcggtcgaaaacgtagggttgccgaaccggggagcggggcgagacagagacaccggacgacgaaggaaatacgttgatgaggacgaagagaggcacaaagatcgacgcgagaccgtggaggagacgtagacagagagagacggaaacgaaggagggagagaaacgcggagagagcaaaagtgaggcacaaatggatagagaaaaagagcaagggacagaggcggcggagaaagcgtaggaggaggtgtgagtgctggaagcagagggcgagagcagaagagaactggatgcatggacaagaaacttcgccgggaaattggaaaaaacgcgggggagtctcgaagatcgatcgagagaattcacactccatgtaccagcactcggaggcgcatggaaaaaagagacaccccgagaccgaagagacagaaaaacgagcgggcaaatagaaaggaagactgcggccgcaaatgcaaacaaaggcctttacatctttccttggcacaaactcccggaaaaagtatcaggacccccaaatgtcgaggatcgccgccccgcccgtttgtgtctcttagagggagcagcgatggcgttgctctttgcaaacatctgctacaaaaatgcgtatttttttctttcttcctctttcttttttccctcaaggattccataagcaggcgcttgcctgctctgtacacagccgctgtcgctctcgttcttctctcgtgacccctcgccgctcgtagactgtctgcctctttgttcgtgcctctatatctttcaatctgagaactgagtgaggcgagttaagcgatctggtcgttcttttttcccattaagacgcggaaaaaaacatcagacggaaagcgagaagagacagcgtgtcagcgctgtgctcgactgtgcgcgacatgcatggaaaacccgacgtttcggagctgggaaactcttctcaaacatcgagcaaccaccgcgtgttcatcatggaaaaatacatgtattttaatatttcaaacaagtgaacaaaggggaaatagagttatacgtctgtcggtgggaatacgtcatgcggtatctagtaagcacacgcggactacacggtggatggctaccatggtgaagaagcagaaaccgcactcgatccgtagagcatttcggttgctgtaggaatacctgatgcatatagatacaatgctctatatatacctaaatgacacatttatatctgtctttctgtatccatatatccatataaatatggaactgcatatagatacaatactctatatatacctaaatgacacatttatgtctgtctttctatatccatatatccatataaatatggaacttcttccccaggaactctcgtgaaatgaatcgactatctctatataaggtaaatgcgcaggcatgctctataggagtgtctgtatcgtaaaagaggccaggttgtactcctggaaaagctatttttgtccggcagcgaccatgctgggcgtatctgttcattctttgtgccgctcaagtcactgacgcttcaagggtcaaaagcagggtgcctcagcgtgcaagctgctacacagctgcaggggagtcccttttcagcacgctcccaggtgtatatggatttaagtccttctcagagtcgtcgggtatgtctttcataccggaacctcgagaagaaacttctcctgtgtagtgagaacatcgagacatttcatgcttgtatgttcacccgcagaaattagagtgtcgcggtagacgcatatccatctgtgtccaccacgggcgatatgtatgtatgtatatatgtatgtatgtatatatatatatatatacgtagatagctacccttgtctttgtgtatctctgttcgtaagaacctgtgggtgagcagggaggggaacgaggctgaatcgagaggctcttcttcttcggcgcccactgaggtggatactgtgtgacaaacgtggcaccgaaagcgttcccgctagtaaagattcgctttgccttctttgggtcggtcacagcacactagaaggtcaacactaaagtaagtgccgaaatccgtacatacgaatagctatatataaaagtgtatacatgtgtgcgcttcttctgtactgaaaagctgccggtacactatggaacggggatccccgactgttggagtcatcgacgaagtccaccaacggtacggaacgaatcccaccatcggaggcgacataccgcctccccgttttgagaaggtttctgattcttgcgcttttcttcgcttccaaactcttttcgcgctttttgtctggatggaaaacaaccttgggcatatagagaggctcgttcattgcggtgccctccggtacaggctggcaaagacgacgtctcaccggacgaaagcgcaccagcggcgcgcatgccacaaacgctgccacgaaaatggggagaaaagacgaagtcagactgctttccagtggatttccttgggaagactcttgacggcgcgcgcgctcgaaatgcattctgcgtacctgcttggacattttcgcgcctctcactcagaaacaccagttccgctgtcggcgaaacggggtagcgggcaggccgcgacgagagacgagggaaagcgtgctcaaaaagcttccactactggttcgggtctcggcgagagggacgggacgactatgcgagagagacgggacgactctgggaacgaggacaggcaacaacgctagtagtggcagacacttcctgcgctccttttcgagcgatatcgccgcttcgcctctcatcgtttacccgacttcttgccccccgtccttgcgtccagctttttccggacgcacccgcagagagaacggtcgagctgttttgtcacgaagcccgaggaaaactcgggaaagtggcacattccgtgtcagcttccgtttacactgcgactgcgactctttgggtgtacatacactccgactctacaccgctttcgttttggcttcggattcgttccaccctcgtcggtcattccataccgcttactactaaacttcgtatgctgaggctgatctcgttaggctcttggtgtataccttcctggatcagggaaaccccggatgctttctcgtttccctactcttcttttcgagaaacatcgtccaaagcgcgacggctaaacgggacacctgcgtaccgccatcgacgtcgtcatcccctttcaatctgtccgatccaccggcaagatttgtgccatttgcgcttctctctctctgtcacgttccgtcgagttgcgtttctccgcgcgcaaaccgtatcgcggcccagtcgctccgccgcaccggcagttccatccctcgttgacttaagcagccatcgcctgtgcgcactttcgcgacatttcgagaccgttttctagggcgtttgccttttcttagcagggcgtgcaggcacaagggcagacacgcaccatccacgttctaggtgaaactctccttttgtagtccagcgtctctcgcttgctactccccgtacctgccgtctcttttcctcgagttttttctcacactccccctctttctttttggcgtttgacccccacttctcacgagttgaacttgcatcccgatcctggcttttggcgccccaaatcccgtttgtctttcgggccgcgtcaaccgcaacctccccgtcgttcgtcccgcgcctctttgcccaaggtccacca

SEQ ID NO: 776 - DNA, 3941 bp, Toxoplasma gondii
ctgacttgaatggcagtcgctgtcgattcgtggaaagtagcagcgacagctcaggctgtttcgaggggctgtaacaacagagtgaccagcacaagaagcgccgggctcgctggtcgcaacagaacactgccggcctgacagaaacctttcccatcgatcgggccagtacctctcaaggcacttgcccacaaagagcaccaaccgcaggtagtgcattgtaaccacggattacacatcattgtcttaccgctattcggcccgcacagtcccacgtattccgatagagggtatcactccggagtgcttgcatcatcatccggcgcctgtgtgagcaaagagcaacacattttggagcgtttagaggacggcttcttcagacaacagatcgatgaactaggcactgtcgatgggcgcacctgcagcccggggcaccatcgctaccagccggttctcttagttcatagccacctgactatacctctccgttcctagttttcaggcagttttcccagtcggacactgtatggacacacgagttcagagatcttgatttatcactgacatttaatgatcgatgctgacatacctgactgtgtcgagagggtacgcaataacacccgcagcagtttccacccctaggcctatggcgaagttccgcatcacgggatgattcaccttcttatccgaaggcaacatggccttagccgtgtcgtaaagaccaaagaaggcagcgcggtacacgatgataccggcgactgagacgaggaaaccgcgatacagacccggaatgccaaactgagtcgaaaagacacaccatcctgcggcataaatagattcgtccttggcgcattatggcttcgggctcccccgcgcttcgcgaagttcagctgaaaaaccaagattccgcagaaactccccccacctttttttaaaacacacagtgaacactctctggcaaataattcatgtcttgtaggttgacgacgaatctctcgcacacacttgggcgacgacggataatcgttcgtcagagccacggctgaatcgaggtcatcaaaccacggaaaactgatgcgaggacccgtccaatcctagtgtcaccacatatagtgcaccaaccttcaaagacggaatccccttcagcaaacgctatggtccatgcggacgctgctcgagtggtttgatatcactgcacactttgtcttatgaaagcaaatcgtcttaattacttagagccatcgaaaaatggaacgtggaggcgcacaattcgacgtacgcccgacatcgttctcaacgacagaaactaacaatacggcaccactctcccttggacaacgcctagggtccctgatgacacacctcgcctgctaacgcatgcaggatcgtacataacatatcctgttgtaagtggacccgacctcttggtaaatcttgcgaatgcagtcgttcagcccagtgaattgtcgctccgcctgcactttacccacgtcggctcctagacgagttcttgcaaagtccagggggtacacgaaagaaagtgaagtggcgcctgcgaatcaaagatatttccagagacgatcgttcatggattagtgcagcaaaagcccactcgtgcgccttcgcgagtgcggtcgacactaccattctggccgccaacactgttccgtaggcaaaaaaagcaaagaacgacggcagatacgcagcaaatcgtatttcacggggatccaaaggaacccccgctgttcttttgctgtccgagcacgtgcttgagcttactgcacgcacagaccaatatttttaggcatgcgtatcgccgacaacttgcctgcagcaccgcccgaagcgagcgtctctgcaaagaatttccagaaatcctgcttcggatcatgccggacaaagagcttctggtacttctccttgcacgcgaaattgagtgcttgggtggggaagtaacggacaacgttcgcccaattgcctgcagaaaagattgaagaaaacagtttccacgaaagattcattcttcttcagggatacacacacacacacacaccgtgaagacaaggccgaggcaaacagatagccccacccgcttccacatgcgaggcaagaggtggcaccgcgcctggtgacttggcttttttcaaagagacagcggtcgggaactcacctctccagaaagaatataacccctgctcgcggtgcaccctgacaaagcaatctttcaatccctcatacttttttatctgaccctcttgatggccgatctgcgtgctagcgtcttgcagctggagcagcagcttcacccgctccactggggcaacaaacgtcttggaaattcctccagcgagtccgcccataagaaagtcccggaggaaggacgccgatagggccttgaagtcggtagtctgcggaggggaagacgaactgggacacgccattgctaagaggagaacagcgtttacccgttaggtccgcaggctgtgtacagtacagatagcggctacgcgacagagcaaggcggtaagaacttgacctgcccggactgccctgcgttctacccctagcgcaacagagctgcctccgaaccaaatacagaatatcagccaaaaatgaagaactctccccaacaacacgaagactagtcaccaagatgagccgtgctgtcagttatcgtttgaccacagctccgcgccgaccctccacaagcaaatcggggttccccactgagattcaccagcttccgctactgtgcaggcagagtcagcagacagaatctcagcctgcacacggaaaactattcattagaagcatgtgaccagaagcgatgactctccaaactagtcatgtatgctgtcgcggactcaagtgtccgtcgtttgaacatgaggaacggaatgtctgcgctgtcaatttggtgccagattcgttgagtgagctccagagcgatagctaggaaaactgacaggtgtgaagcacattggaggttgggaaatgcaagcctacgtcaacgtgggcaccgaaattagtaccaggatcacgtgcttggcttaccatgagcgcttgctactttccccggatcctgcatggttgtatagcctgcatggcactcgccaagacacgatcccagatgcctcccttttttggacctctgattctctctgtttctcaacggaagagtttcttggcttttcgcagaacgaaaagagctccatgatgaatgctgtagtgtacaggttttcgcagcaaccgcaactcagcccttgaatttcgggatcgaatgtcctgccgcatctgcgtcctcgcgcatgcgactgccttgtggtcttgtccctagaacgggtcgacagactctgtgcttcgttgactgacttgtcacttcaacacttccactttgttaaatcacgagagctctcaagcgcggcattttggaggcacgcatgtgtttttcctcctccacaagtccatattgcgcttactacgggactgctgtgcaactgtggagcttgaaaacgtggacgccagcgtttgcctgtccagctccgttccggacgcgtagagcggtctttgaagttctcgctttcttttttcccatatatttgctttcctcagattttcgcattcaaattgccggaaaatccagcgtgctactgctggatcgtggcatgagcgctggccatcggccaagaaacggaggagttgtttaggcaacgaccggaccctccttacagtgtgtcccgactgttgacacccttcactctcagcggagactgcccgttcattttctccgcgaaactgtttttgctttagcgcacgtcgttgcttgaacagccttttttccgtgtggcttgcccatgccccctgtacacgcagagcgtctctgcggtaacctaagcgtcgcggtgcaccctctgcacatctctattcacagcgattctggacta

SEQ ID NO: 777 - DNA, 832 bp, Toxoplasma gondii
cgttccgttgccctaccttgttgctccgcgacttcggagaaacctcgggccgcgacgtcggagagagttgggcgtcggaaggcgcggctcttgagcaccggtcttcctcaaacgcctcgccgaggacgccctctggcagtagggaggaagcttctgcaatcatctcaattgcagagtgaagccacgaagcgtcgcggaccatcacagtcgaaaacgccagttgatagtgctgcgccgcaagcgcggccgaagcctcctcgatacgacatggcgctgacgaaggagaagaagcagaagaaggagaagacgcagaagaagcggtgtttcccatcgcctcttggaggaggggaagccagccaggaacccagtggagagaggaggcgtcgttttccttggagtctggaatctccttttcgggtgagtgtgcgcctggctctttgtttgtctctttctctgcagagcaggtcgcctgcgtcgcggcggtcgcagcgaggagaggcggcaggggggcttggcttgctccttcgtctggaacggagacagaagacggcggaatttggtgaaggaactggagcagcagatcctgggaatccacgcgtttgcatcttctctgcgtgtcgagacactccttttcgaggctcttccagaagcgcgaaaggtcgtcgaggttcagggaaaccagctcctcgaccgcaggcgagagagcaggagaggcggcggaagacccgccgcggtccgccatgtttctagcagaaaatcgctgacgttggtcgaagcagcaagggaagagagaccggtttagtgtgctgtcaagacacctcaagaaggcgca

SEQ ID NO: 778 - DNA, 3189 bp, Toxoplasma gondii
gccgacgcacactgcggcaaattagaggctgacgtgttctaccaaagaagcgcctgaacggtccagcggatccacctcgatacgcgttcctcggaacgcccatttgccgcggcaaaaaagtatggcaactgccgacgctttctgctccctttcctctctgccaaggtcacctcctcctcgcgagcaaggcaagcgtcaagtcacttgcaccgagttgaaaatgaatgaaatgctacacccgtttcaggaggcggatcgatgaaagaggcacgccgtgaagacgcaaaacgttgaaccagcgacggctgcgcgacgtctatgaataggctgccctgcatatggggcgaggggacgaacttaaggtacgcaaatatatatttgaatgtaactaagaaatctagagaaatggcccctgaggcacaatcgaggatccgacttatctgtcgtgctcccttgatacaagagcgacaacgcggtgccgcatggactaggttcccttcggaagtgttgccaatgacagccgccacggctgacgaacaatcaaacccgaattttcttgtctgggaagtcctggcaacgatcgggagaacagggctcggcagggaggagggggaggggcggaagcatgcgcgggttcgagtttaaactagtcacaaccccagcaaacggccgcccgcccggctgatgaactgcgtccgtagcggactaaaaaaggccaacaaagaggcaaaaaatggtatgcagaagctgtcccacgcaggagagaaatatgaaacgaaaagcggtagatcacaagggaacgtgcccggcacggcaactggaaatcgtcgtggccagggcagaacttgcagaagcacgcaacacgatggaagcagacccaaacaatgcatttcactgcgtagcaaagacaggaaacaattgttaagtgctcacgtaacgatgccgcagagatcgcgtacattgacgcccggacgtttaacgcacagcgccgacctttatgaaaggtgccggcgggatcaaattcaagtccacgatgcacgggtggccgctttgaggctttctttaccgaagacgattccgaccgaccacaaggcacgccaagttcttcaagtcgtcttcggtacggacgaagccgcaaacggaaaaaaaagcgcagtggatccaagggcgcgcagcaactgaatgtcagacgttttcggcggctttgctggaggcacgacgagtctgacggaaacgtccaaatttagaattgctaccattttctgacaaccaggaaggatgagtcggtaacgcaaacgagaaaacaaaacagtgcagacaaaaagactacttcgcgcgagatcctaacgtccgggatgccgcgtgcgttttccccaactgaattggtggggcacgcctggcgtacttacacccagcttgattggacgtcgattgcttgctgcgcgctttccgacacctgattcccaaggaaagcaatgccttgctgagagccaacgacggaaccgaaaaagaataggcgagtcaacatcgagtcacgacgcgcgtctggtcctagaccttcgtggggggaggggggccctcttcgggaaaaagccttgatgccctcctgccgtcgcattattgcaaagaattccggcattacagtttctctatccgccaaacatgccacacgccgccgcgcccccagcctctctgcccttcgaggcaaacggtgcatctccgttgaaaagccgacgcattcccctcgacgcgcagagcggggtaaacaggtgtgccggcaacggtctgccacctgaaccgcgtccccccgcaacagtcgacgccatacaacatgctgcatgccctgcactgcctcccactgcgccgaacccagcttggccggggcgcgaggggaaaccctctgccgcggctttgcgtgccaatctgggctacgtttgtctctcatcgccatgccgtgcccggagcgccgagcagagggtaactgcaacacacctacttcggctcgccctttcgttttgagaacgtcccgttgccgggaattaggtccttcgcaagaatttgacgctctttttcttttgtagcctccttctacgtctcgacgatggggttgtctgggcggcaaacccagttacagcgataccgcgttcgtttgtgaatccgcgcttgtaccttcgtggtatcgcgccttgacgccgcgccctcgtacaagtcttaaaatattttccttctcagttgcacgtggaggccgccacaactcaggactcgtgaaacgatttccctgtacaaattatagaaattttccccacgcaaaaaatcggaaggggagctgtttagggtcatgtcttcctctcgatgcgcttcctggcggggcagacggtcaagcgaccccgggtctgtgcctgctgggtttgagtgcctgtgcagtgatctcgactagtatctttctagggagtaaccgtttgtcagagaccacgtgtctgattcttctggtttttggcccgagcctcttttgtagatatgtatcttctctaaacactgtcttttcctggcagcctgggggtaccccgctccggcccttcaggtgcgcgggcagactcgccagttctggttcatctcctgtaatgcctctcagcgtagagttataaaaccagctgtcctgttgatgaaccaccacgtctttctcgccttcttcccttcctctcaatttctttgtctccccagccgacgcacaggcagcccagaatgcgtcaaactgccagaagttcgagccgttgagcgatccttcttgcactctggagcattgtttaccgcaggccactttgccggtggcctggaaattgttgccactccgatgttggtcgcagcactgacctacgaagggagcagagcgacacattctcggtaccgcagaattcgctggctgttgggcacgcgcggtttccccaatggcctggaagtagcacaccagtgagttatttcttagttcaatcttacatatttctcaaagcggcgagccccttcctgccgtgtttcccagtggcatccagccgtggtgaccaccagggtgcggcgtcgtgctgaggctgcttggaggcctccagattcacgcatgccagtgtttcaagccgcatcgacgctcttagttttcctagacggccgctcagaccaagctcattacgtgcaacaaca

SEQ ID NO: 779 - DNA, 1652 bp, Toxoplasma gondii
agagagacaagatgcgtgatagcatgctcgatgtccgattctctctcctcggccttctgtgtccatcccgttgggcgtggtcccgcgcaggattgaactcggctcaaaaaagcggcgctgagtgagaaagtcaagaaacctcagaggcgaaatggcagagtcaaacaaccgctgaagagcgacgtttgtgtgcggctcggctcgcgtccttctcgggctccaagttgtctgaaggaatcgcgaagaacaaatcgtggagtgatcgtgaaaacaatgtgatcgacaacggtcttgggtgcacttcacggacgctcggaggtggtggagacgcccgcgaagcgcatgtagagctgcaggcgcagcagcaaagacgagcgacggccaagtctccttgtgcgctgtgttaagccttcctggtggatcaatcctgagatatgaacacaaggcagcgcggtggagggagtgaaaggcgttttgagcctactcgtccaataaccgaagaaagggaaggaagaaaagacacaggatccgtcagagagtcgaaacgaagggagagcgacaaaaagaggatagtccgaggaagaggcaggtcgagatcactgaaagcgaagagacggagtccggttgagaggccgtgacggcttatagccccacataaaagaaggcagaggccccgagagagggacacgaggagacggaccagagaggaccaggagatcaaactaaagacgcgaacaaagcaaagaaggaccgaggaccaacgctaggcagaaaggaagagcgtgacgcgtcgtgggttgctcttcgccgcgacagggcggcggagccagagccagagaaaaggcaaaagcgaaaggccagatgcagcaacagaacggacaagaaagcgggacagagaaaaaaagaagaccagcgacagaagaagagggaaaggcgaagtcttgtcgccttcattcttccaagaatttgaggattttcctgtcgggaatctcctcaggccgctgactttcgccgcgcatgcagccgcgtgcatgcaatctcgcggctgcgggagaggcacaccgcggctagcgcagaagcagaaaggagacctctggacgttgccggcggtcataaactctaaaccctggtcctcttttgctgcacacggcgttcgatttccaccctttcctcgctgttcagacgccctcttcgcgtggaaggttggtgctcaggaacgggaagccgagaggaaactacctggaggccaactcgactgcgcgctggcaaaaagcccagaaagaccgtccagtaacagttgcactcaggggcgtttctcgtcttgcctcttctgttaggtttcgtaaaattcctttctgttccgcttcacacctcgtccccagactaagctgccggcgacgtcgtggaagccgggcagggtcgggtgaaaatcgattttgtgtctggctcgaagttggcgtgagttttcgccctttgtctgtcaccacatcgtttctttcctttccttcaagtctttgagtttgtattggctccgggctctcatcttctttgtttcctttcccttcgttgattttctgctgtgttcctctgccgccctttcttgttccctcccccatgtgtctgcggtcccgtggccacccacgccttgaaga

SEQ ID NO: 780 - DNA, 1611 bp, Toxoplasma gondii
gctgccaggcaacctctacacacaaacaagacgacagaaagaaatttttttatctctctctctctctctctatatatatatatatatgcatagcagtacatgcttcaatgacgaccacgccaatagcgtaacatcacaaatacatatacaggaatagatgcacatgtgaggacaactgagtctatgtcgacataaagaactatgctgggagagtccatgtatccaggacgaccggatggtttccttaccgttgcaaggaatctttgcagttgaggagaaaccttctgtcaggcgcgcatgtgtatccttgcgtgactccgagcagacgttttactccgtcgaggtctccggctcgacttagacgcagcatgtcctgctcctcctggtcgacttgatcagttttttccttcttgcctcctacggttttctccgctgcatctcgtttgtctcctttgtctccttttgcgcatgcagcatctctgctggcctccgcctcgagctgccgggctcgctgttctgcgcggcgagcagctcgtcggagatcggattcgctcttcttcttcttcctccctccgcgttccagagcatctccacggcccgctgagtgaggcacccacctcgcaccttcttcctccgagtctcctcctgcatgcgcgcctcgtgcttccacactgtctctctcctcttcactcggtccaggcaaaccagtctgagcagcagaggcagaagcggaagaagagggagaagaaaggaaggaggcagaagaagaggatgaagaggacatttgtgtggcagaagataaggagttggagggtgcactcgaatccatttgggagagaagaccagtggaagaaaagtcccgggcgagacggcaacatacgaagaaacgataaggcgatgaaacgaagacgaggctacgtgatacaaaaacttctgtctcggggaccagttgcgaacctgaggccaagaaacggagagagaagagaaacaggctttctctgtgaaacttgaaagaatttttcctcccgcttcagaagaacagactctctaagaaggaacgaggaagcagacaacgcatcgacggccgccgtcgccgctcggaggttgcgaatccggagggaggagagacatagtgccgccagatggtcgaatattagctaagaaataagcgtgtctgtttcacttttcttcgttctcgcctgcgttgccttctcagagaatttttctgttatgcatgcgcacttcgtccagagtctctgtatgtgcatgcacggcaaaaaggtctggagcgtcctcaagttttgaggcctctcctgcttccccgcatctccttcgccttcttccttcgccagttttgactttctgcaagaaactcgagacatagtctgctgtcgagacaccctcggcttcgtcattgtcctccctctagcctgtctcgcgcaaaatcggtcgaacccgtctcctgtgaacagactcaggacacactcgggagttctttcgcgtctccggtgaatcttccgatctctcccgcctcttcttcccgctcctccctcccgtctttcacttttcctcccttcctgcgccgcacactttccgtctgcatctccaaga

SEQ ID NO: 781 - DNA, 4025 bp, Toxoplasma gondii
atgaagaaacaaaagccggacctagcggtgacgttcagacgctgcccgacacagattccggcgatgcacctgtgaaatccagggggactgcgactggtgctgaggcgcaaatcaccagtggtggatataagttagcatcaaatgcgtgtccctcgtggaaaagcagggatattttcccggggctacgatctgatgatagtctaaaacaagacgatgactctggggaggtacctaaagattcccgcgctgcgtgtacgggggactgggtctcagactcttccaatacaggttgggggccagcggaaaagcaagcccgcagcttgccaggcaacacaaaatattcaccaccatcgtttgtcggtgatgcggcaaagaatcaagcggagtggcctgaaggtgatatttcaggtgacgatggtagcgtcaatttgtctctgagttcctccgaagcagattttcaaccctaaaaccccatgagaagtccactgacacgtggccagtcgtgttcacctatgcgcacgtttcctcttacacgtctaccgcacccgttcaggaggcagcctgcgaaaatgcacacacaaaggttttgtacggggagggtgcggtacagtacaagtataacatggaaaagcagcgcagcaacgcattctggcagcaatgatgtaataagaaaggaaatgccacagatggcaaaggagaggatgccacaagccaaaatggcaggtgaaagaccctcacttcttgaacagtttcgtcggatgtaggtacgttagaggccgactacggacagatgagtccctttgtgatcccctcactacatgaaacgctctgatttcatgtttgaccatgaagtcctggcggtgccaaacaagtgtccaataagcatgcgttgggagtagaattttggcgacgctcgagtgactaaggagaagaaatcatgtttgggcggctgggaattgagtgcaagatgaaacaggtgggacggttaaagatttttacacatttatggagtcagacaaatagcaccgtcttggtcagtgttgttttcacaattatgcattgtttgagtgcaagcgaacaggcaataccgtacacgattcggttcacaaaagtgccaatatctttttgtttttttcacggctgcggtattgttactgtttcccgctcgtgtgcagccagctcccacatctcacgaacattttggccgctggaggcagctttaatggcgattcgaccgaaacagattaattgtccatttcctaccatttacacccattcgaacactaactcaggtaccccagatggaaccatggtggtctcagtgaagcggactcaaatgcttagttccaccgcaaatgatttgccctataaatgcacagaaagagacgtggcctggcttcgaaagagtccaggaggacgccttgggccaaacggaaagtgatttattatttgttctggcatccgtcgtagttaccgtgtctgacagccaatcagggattcactttcgatcagcactgtcatgcacaagcgctggaacactttatgtaggttcgtggagatccacattctgcggaagttcgtacattccaagagtctctttcatgatgtgagcatactaggaaaattttcccaaatctttgttgtcgttcttgtcttggtgtgtttcgcgttctcctgttgctttgctcaaaacaagtggctggcttcctggcgaggttcttctgctacgttatccggcgaccggtggtcccgcaaagccttcatagatgagtcatcacaatcagtcatcatcattgtatttgtgcctatggataatgaaatccgtttgtatcagatgtcatttatcgtgactgccccggctaatttacggtggggagcggatagggggataagcaaacaggggggtgtgccagacacaaaaaacccaatgtaaacttggagcgagccgctgcaatgcattcagcaatacacaaagttgcttacgacagaacgaagtgcaatgaagtagtgaccgggtagaaacaggacgtatacaatggcgattggtgttgattgcttgtagctgtccactgcagctctccgcggatgtacttcgtgaaatacaccaaagtctttgaacttaagttgcgaaacgatataccgacttccctgcaagaaacgagcaatgcctgctgaaagaaggtaacgcttgcgagttgattggatggcattctagtcgtaattaagcatgccatgacaacactggcatttctgataacaccagggtggtttcccattcgacatcataacccattttggctctccctacatagaaaatactttctgtgttctgcaagaatccaggaagtctgtgactagaaggagtgtctatctgcttcgctgtgggggtctgagagctgcgttcttctgccccttcatgagctgtgggggcttcggttttctgtcgttgaacgtcaggaacagtgcatgcgtctcctcttcagatacgcggggagagaacccagaaaggcgcaaggcattaaactagaccagcgaaaaaacaggaaccgctcaatctgaaaacggcgggtgcgcggaaactccgataggggatggttgacggcattcagcgtgcccaaacgacaaacgaggaataaaccaccacaaaaagagaactgctcctataagaaggcggtacatggctagaagctggcctaatttcggaatgaacgtttacaaaaaggaccaatgacgagtaaagtgcagggctgcaaacaaagacatttgtggtgattgagatctctggtagctgcggggaggtgtctttggctggtcaatttgctgtgactcaagttgctcaattcgataatctgctccgtaaatccaagccaccggacacataaaagtaaataagaactttaaaaaaattagtttaattaggaagactgaaatggcgggaaacgacgacaagaaattttgtcgttttacaaaaggggagacggacagggtcaccttgtgtcttgcaagacaccgctagcgtactcgcgcgccggtgagggagtaccgcgcctgggcgtcgcgagagaaaaacctcaatagaagacctttctttcggccgggggtttcctagcttttcccttggctttccaccatggtctttcccgttccgtttgactcctttctctaacgcgaacaatagtgtgctcaaatgtaccggcaccgggtcgggtcagggacccaggcggactgggacgctcaagattcaccttttttctctgaatttgtcttcaatttctgtgtcatcatcccctttcattgcatcgtctagctctaagctagcacgtgttagagttgactccacatcacgtttaccatagtcacgagcatgccttgccatttgcggcgtctgtcgctcctcgaatcgtagaaccgcatgcggagggagacggtgaagaggagatttttctcatgaggatctcctcccaaaaacaatatgttttgtcggagtgacaagtcttcaaagggaagcaagtctactggcggtactcctcagtggagtatcaacgcttcacgacaagccatggcagcaaacagttgggaatgcgcgttgcacgacctgtccgttgttccttcttcgtatgcacttttctcgttatgttttcgcaacactttgaacatcttttctttccacgcacagtccgttctccgattgtctaacaggctacccggagatggatcccgcgtcgtaactggtctcctggctggctgtgaaagatcgagaactcgaacgggtaactgccagctgaagaaaggcacaccccccagaaagtctcttcgttgacagaggtgacatacatctccttctgcagctgcgtcggcgagacgcacatttcccggttcccttgttacctaccgagtaaattacattttgcacgcgatcgtagctgactggcggttccgccacccccaagatttgaaatcacgttttgtctgtgacttcttactttgcccggtctatgcgcttctatttgctcgctctgttaaga

SEQ ID NO: 782 - DNA, 4144 bp, Toxoplasma gondii
atgagtatgctagatgacaaccctgcaacaattgagtgaagtgttgcaggtggtctgcgcactctgcggaaattacttatttcgtcttcgtagtttgacgaagttcatggcaatggcaaaaaggtgcggtgtcagtggctgcgagaaggtgagaaacgggaagcgccctggtgccattttctcttgatgtgtgttttcagtgtttcgttcgattttccattcgagcgcgcgaattgaaaatacaccattaacacatggcgtatgcatccaatgcggtttaacatgctgctgcgttgtggctctaagctcagcattatgcactctgaaagttgaagagttgagcaaggcagatttaaaagcagttagtcgtcggttgaatgggttcgccgtgtcccgccacttcccggaaaaagcacggccttggactgttgcatgaacaagacgagacacaacctggaaacaagagtaactatatacagcacgggcaggcagcagtaaatgagatgcaggttattcgttgtaagaaacttagaattgcctaccgacggcgtccacttttcttggcggaaaggcaaacgtgcctcgacaagcttcatataacatctatgtcaggtgcgcatatgcagctgtatacgattaatttagatttaccttctctcgatttgaactttggtcgccctctgatggttggctacgaaatggtgcacaatcgtcttcagcgcgggtgaccaccgagagtgtcgacatcctctattatagcctgcagtcgcgtgtcaaagtagtactcatttttaacaaatagtgagactgcgacggcaaatagtcctgccaatcataacgcagatgagttatctccacgcgcagatctcgatcctggatcatctgtacacggccaacatctacttgtaacgtagtaattgccatgcatggtataatcatgaccttcatgttcttaagcattgattatcgtcgacagccctgctggcttacaaaatagcggcatgatcctgctgttgccatgccataacgaactggaaacacaacgtcggcggaattcgggtataatttttgacagacatttaaaagcagactcatacgctgctgtgcgatggattaggctccccccacctcagccacagtggcttccgaaagacatctttcaactcagccaagagtatcgtagacgagttgattaatactgcacgttttcctgtctctgttcagagccacgaaaatccccctccgcccgctcgtaccgcgacacacacgagacgatgcgaaagctgttggtctacaggtcgaccaaaatcggttgccctgctgacacccaagcgtctgtgaagggataggaatagagaacacgtccgcgaccgtaaccctcagtggacaaaaatggcaaaaaccacgtcgaccaagcttaatgtcagtcagaaatcaccacctgtgtaggtagttgtgtgcagacacatgctggcctgctgatctttcaggagcatatcaaacgtgttaaccttgtgttttcgtgaaagttcaccgacgacgttttcacacctgaaaagactgaagcggcctccaaacacattgcagcgtcgaatgcgcttttgctttcagagaaagaggaaccggcaaagtgctcatggcacaccctgcgtaacgggcatttgctattcagtctgttggtaagcgattacacacgcgtcagacgaaagagtatacaaatggagcactgcttgaaggcatctgcgtacaagttttcaaaagcctgaaagtcaccctcttgcagaagtatcctgctgagtttgcctagtttgcgaatgaggggacgacgaacgggagcctgtgacacacagacctcaaagagggcgcctggatggatcgacaaggaacaaaaggcttcaggctacttcagcgggcacgctttcaatgaaaagactcagtcggaggctccaacgttggcgtgcacatgctaaacagcgagtgggaaggaacgagtttcggctgtacagcggtgacagacgatgtatgtgtagtttgcgctaaccccagatccgcatgagtatgccatcacggacaaaacacatgaactggtgctgttcgctgagacgaaacatgttaatcgagggtaaggaattatccgctagacattcttgcacttcagagtggtagtgtgttgccgcctggcaagaaaggctgctaggcgagaaccgacaggaacgatataaaacccagcagaacgcagggcagtttcaatattgagttgaaggtggaaatgaaagctaatgaacggatctgtccataagacatcgatgaaacgttctacacgcgcacaggtccgcccacttctcctgtagtcggcaagcgatacgatgcaaataacccgtcaacgccaacgaccctctctggaacggcaactgaaagaaagacttgcgtcttttcgaaaacctattgctctacgaaattcaacaagctgaggaagaagtatcccgctaccgaaaaagtcgaacagaaactcagtaaacctggacaacaacgtttcctccgtagatgcgcatacgcatgtggctactgtcactcagggcaagtggtgtattatattgaattacataagaaagaaccaacagcgaaaacggccttctgggaaattgaacaatatcaggttggtcttctaaaaataagtcaaaagctgtttcttccggggaagaatggctcttatctgaacgggggctgacagtttgcaccgcatcgactctctgtatattgacatcgtcgccttggagatcgtcagaagggcatgaaaattcgacgtaattgcttccttctggtcatataatacccattcaacaagatctatgctcgactacacagcgtgaccctggcgtaattcctccctgaaactccgggtaacaagcgagcagtctacacgcgtcgctgccactgtgtacatgcgtttcctgcaaacctcttgtacaatctctgtaagtctcgatgcgcacgtgtgcctgtgatattcatcagctgacaagaggggagacattgtgctctgcaaaacgcacacgctgcgctctaggacggcagcacacaaagcaaaagacgaacctctgactggactgtgtgctctgctcgcccctgcccctctctgcctgactggctttcaccatctggaatcctactcgaccgcaaaatatccggctgtgttcgtcgccggttcctgtttcgcgtactgtctgagtgtgcggccattcgtgctttgagtgacgtcccctgcagtgactgtcagtaaaacacgcaagcgccagtggacactacgttttcgggggtcgcttgcgaaagcctccgttttgccgcggtacctttggagcattaaacgtcttgttgtaaaagactgaaactactggattcgccgttactgaccccaagctccactagcagctggcacgagcgaaccgccgcatgtaaacttgtttcgtccgcgcacgctgcatgtgcaaaaaattgtgtgtaacagaactggtgacttcgatgtgactactgctttgccgctcccgcccgtttccattccctcgcttttctctttggacaaaactgcttccaggagttgtttcccactatattttctgacgttccgtgcggccaagccgacaacgctgagatacacgttggcgtcgagagcgcaacgactgaaggcgccatgccatttctgtgtctaccaaacggaacggcacgctctgctcgaagtttgcagtctgccttttctcgtaaaacaaaaggtctggtctttctcccgcacgcgacaatctggtgaatcggccgttggtggcggccgcaccgaatcacatctttgtgtcgatgccgtttctctgccggtgtttctgactgcaagaaaaactttgaatgtgcatgctaggcgcaaatcccgcttttccctgacagttcctgggagacggggaaggagtagacgtttcacaccctgagacactgctgcgaaggcgaaatcgagcgatagcgcgttaaattgcgggacagaaaccccgagtttttgacggctcgcgctccgtgtccgatatcgctgccgtttaggtctgtaccaacggccctctacgctcgttaaagaagtattctgctcccgtgctcgtccttgcaaaaa

SEQ ID NO: 783 - DNA, 4838 bp, Toxoplasma gondii
ttgttcgtgcagactctcggctttgctgagagaccctccgaacgtctttttggctgctggcaatacggagacggagcggtgcaggggcgtcgccagcttctccttcttgtgtgtcagctccttctcgcctttcggcttcttctcccccagacgaggatccggcgacgttgtattacctcgcaggagagacgccttggcaccggcagacgcggacgcggcggcagcaggaagacagagggtcgggagcctgcgagcttccagaaaccgggagacacttgggtcctcatagataccggcgggaaggtctttcccccggcgcttctccaacggcttcgaggaagcaaaagaggtcttaggcgagagcagtggcgagtgaggaagcgacttgttggcaggtctatttttcttcagagaggtcacccgcggctttcccagaggaggagatgaggggctgctgtccggctgcggtgccgtcgatcctccacggggagcgaaactgtttttctcgttgctccgagcagatgtgtagcatgctgccgaaacgttcgcatccgaatctgcaggttggacaggaaaggaaacgcgacttgacggagaggaacagaccactgaagaaggacctgaggcacagagagcagcggagcaggaagcaggaagagccggcgaagacgcctgggctctccgcctccttttcttcttccttttttcgtccatcggtggacgatccagaaggagtgaagaactcgcgagaaaagatctgaaacgaaggcgaccaggaaaaacaatggagagtggcagaaacaagaacgacgcggcccttcactcacggcaaagaagtcacggagggaagggagccgcgatcgccgctgggtggaaggagaggaagttgaaacgaggggagagaggcgatgcgacgacagaacaaagtcgaggctggaatacttccacgtaactgctgcggtgtttccagaggcaaattcgcggcgggcaatttgaggggggcctctcggagacttggggggtttcgcaggaaggggacgaaggcagcacaagacaagaggcggattttggctggacaacaaatcacctggacaagtggaaagagcgtcagtgaaaccagcagcgaataaacgggtgtcgaacagagcagagggccgagaaacaatgaccaccctggacttgacgactcttcatcgtagacagccaatcgatgctcgcagctgctgcatgcgacaccaactggcatgtgccgtatttcgaggagagaaatggaactagaagctacaagcagaaacgaaaaaaacagcggtctccctggttccttaaccagaaacagttaatgcagctgcatggacaaaacgcattcactcatcacaggaaaagtcgcaaaagaggggagtcgagtgacccttcaacacccagggggaaacgaagacaaggtggacgacgagggtgggtgggctgggactcgccgtttaaaaagcgcgacggtgcctgacggtagttttgcaaaactggaagatcctttcgacactgactaaactttgtcaccgttccaggacgtagttcttgtcgattgacaaatgcgcagtgcggggattttggaaatcgtcggtttctctgctcgaactggatactctgaccccacaactccgcgtaccaggctgctggtgcctggcattccgtcaggaatgtgtaattcacctggatattcatactctggaatcaccactctgagcaacagacgggcggatccacaaagtatgacgccatcatccaaaatcactgcaaacaggactgcgatgcacagataggtgcatgctctctcacacatatgccagtacagcgccgagtcttggaagatcctcgcagctagctgagtgtgtgggtcattgtttctaccgacatggggtaaaatgagacgcttgatggtcatcagacgtggacaatctgcgctgtttgttcacctaaagatgctcactggttcacgaggcgaaccgggtgtgttgcgagctccgaagaccagcgagtagtggcaaaaaaggaaaacaggacgcacgcgaatccagcggacgaagcgttgattagtcgagtcggtagtcaatccttcttgtcgttcttgatgaaacatgaagaggcgcaaaggatagtcgtgtcatctggaactgcacatccatgtcgggcacacagagacttttttcttcaggaagggagcgctgtgactcccagggacagcctcttctcgaagagaccaacccagatgtgccgtgtgctggtcttgaacaaactcatccttcccagtcgtgaaacgcccggacgcaaagcggacaggggaacgacgaacgaaaatacgaaattggcgaatgtttggcagtcctatcgatacttttgcagaccaaccggccgtcggaatcagttgggcccggcgtcgcaagcggcgggtccttccagttcagttatgataagcaacgcatcatttccgctagtgagtgtcacgttatgacggtagtccaggagagaaactagctctgcttccggattcgtttgctcttctttacgcgcgcagtggtaattgagaacagctctccccattttctgtctttctagcgagttagctcatcgtgtagcaccccgctcccagccgattgagccttccgcggtgcctagggaacgtgaagctggtaccagctttccagggagatgataaaccatggatattgtaccgacttctagtgtgcccttcagaagctgtcatatcgcaatgcagtcatgcaaatttctcatatgtgacgaaattgggcgacgcgcaatgaaagcactgacccaaaccgtataacagatgcttgaaaagacgtcggctgcactcaagtcgaacatttggtttttcttaagcgacgagagacgttttttgtgtgtattccgaacaagaagacagaaacaacttggatttgataaatacaaacattggaaaactacacgcaaaagcgtctagatgcaggaggatgtcctcatcgtaaaacagaatttgtagcagttttagaatctaggctgatcgattcaatgagtcgggttactgtttgtcccatacttattcgtggggttacattttgaaatgtttctgcggagctgttcatgtttcttccttagtgcgacgttttctttacgcaattttcagcacaacagggactctttgcagttttacctggggactgtgcttcagtgcaccgtaatgcaaaaggatggcccgttctgtttcgaaacccgtaagttttttcacgtactctgacagaaactgaacgatagagatggtttctgcgacttcatagttttcttccatgaagacgatttcaaagaaatacatctcaactcttccgctcattccctgtctctttccttcaagcatacttttcgtacgcagtttccgagttcccatctgctgcttggtgacctctggcaagcgaatggacttggtcaaactctgttttgaggaattttagcatcagacccgcggtgggctacgagaatctgtgagaagctggatgggatggtccacctttccaggccagacaggaaggtttttttctcttcagaggaaaggaaacggggctgaatttcactgtctgtcgtcttctactgctgtaagggttgcggacgagaccctctgtgcgtggcttctctgacctcaccctgcaaggcttttccccagcctcctgccgcttacccagtgtaatacaaccaagttggcaagatcgataggagaagaagagtgaaagatctctgtttgaaacagtctcgtgttgggtcgccgccataggggtcgacagttccgtttacaaacaggtttggcgtgatgatctgcgttttccacgattcgcccccctccctcctccccctcccctccctcggttgcgcagcggcaggacacaaccattttccctcctttgttccactgaaaaaagtccaaacatggtgttgttgctgcgttgagtaagaatacaccttttactgtcgcgcagatgtgtgcaccagatgttgttgtcggtgctcgaccggatagttcggtcttctgtcttgtcgcagctgtcgagctcgcggcctcccgacgttcctccgtcacgtctcttcttgcgtctgtacgcttgtgcgtcttccttgctctctccagctgagtcggctttatttcctacgctgcgaccttgcctgcaaagagccgttgccttgggtcgttttctcgattgatcgttgcagatccctcttcgttctggccatgtgcaatctgacgcgttcggatgaacgacgcgtcctcctgcccacccccttgtttcggtccgcgcgtccgcgcgttttctcccgcctctgttttcacttttctctggtgtttctgcttgtgcaaccgttctgcaaggacggcgcagcaaagaagatcatcaagtatcgatgtccacttcgtttgccttgttttttcgctctctttgttttttcgttccacttcccctcgaaacttgccaaaaatataaagctcggcaaaaagctggcacaacttgcatgcttggcctgcggcgggggaagttcctttgggccccgtgtcccatggcctgcgaaacgcagccaatttgccgtcagttcgctgaccagaacgaataaaaataatggctggggcatctcactttgacccggcggtacacacccctgcctcggctgctgtctagacgcaaacgtcgttgttccctctgagcgatacagattcacctgcttccgcctcgacttctgcctcgacgcctcagttctgtgcttgggcggtctgcttctctttccgagcgttcttccctcctcgacca

SEQ ID NO: 784 - DNA, 2664 bp, Toxoplasma gondii
gccaccgagagagaagcgatgggtagagaagcctttcccactgcaatgatagaagctgcatttacaatcagacagtcgctgaagtatgtgcggcggctcgagtgagcatcatctgataccaatgaagctgaaagtctactcgatgtgcgcccgaacttccgaggcctttttcaccatgctttggaacttatcaatgcttgggctgttgcttttacacagggaaaaagcctttccagttaaaaaaagatcatgtcgtatcctcttttatggtgtctgtttcatttttggaggctgcgctcttggaaatgctcacgaaggtggggccttcgatcagtgctttgaccaagtgtcagtgtacaaaacccagcggatggtgccggttcaaatggaggtactagaaaacttctgaccgctaatcgtctggagtttccgctagaatccaatgccacgcagagtacagtattcctgccgtgctgagaaatctcagcattagatgcaaactgggtatgtatgaattctgtcttctcgacaggatatatactgtcaacaccgatgtgtggcacgaggagacaacactcactgctggtcacgtgtgtggtagtcagttaagcgtagcgaggatcccacgaaaacagatgacagctgttatttaatccatcagcgatgtgagctctcccaaaatccatcttgcttcgttattggggacgcatcttctgcagactaccactggcaggtcaatacactctgctgttagagtgtcgttctggaaattgtctccatctatacttgacgcattcggcggtctcggcggcagtgcgatgaagcatcacgttcaagtctcatacgtcacacccgaacaaggggcccctgcaagggtccgtccagttcatgtgtaagcatctgtcgccgtatgctccgacggtcgggtagttctagcgaaaagataagaagcaaggcggacatatacagaccagccatagggtgccgtccctgtcacctggtttagacagttctgtatcgatcggcttgccatgattttctctccaagttatggcatttctcatgtagatcgtttcaagacacgacaagtgagtactgaagtgtaaccgggatacgcagccgttcaacaccatgttgaagggggagagagtcttgtcccttcagggtgacaacgttgtgcagatccgtacatgctatcagccttgtttggtcggtgagtgtaagattttttgtacgtcattgcgtctatcgtcccgcgtcggcgttgctgtctgcagcgcatcgtggcctggcgccgacttcactaagcccaggagtgttccgccgagtcataaattacctcttcacataacaggcacgtgtacccgacagcggtgtacaacaaaacatgcgcctttgtgcttcggcatacttcctggaaggagagagcgtcggcagttccacagtaatacaacgtgcttgtcgacgctggagagttgcaaaagaaatttgtggaagctgcgcggatgtattccacttaaagtgcaactcttccctttgtttaatttttttgtgaaggatgggaaggactgtcgtttcaaaataatgttcatgtctgtcttttgttcaaaatttgttgattgcactgattcacgaatcatcgcctcgtccgatgcctcttgtgactaggtcaccggtgtccgtatactgttccaaccgagcaacgagccacattgggctcagctcgatgctgagtcatcgtatgagtccaccaataggcgcccacgatttcagcggctctttactcagattcctgcctcgttaaagacgtactggtgcccaggaataatagttgtgaatttggtacttctcatgagaaccgcattgcctgattacgaaccccaggctgaagatattactgtagaacagcccccgtagctcagttggttagagcgtcggtcttatgagccgaaagtcgtgggttcgatccccaccgggagcatagataataaaagataacgtgaatacagtaaagtgtgcagttataggagagtttttctgaaagctaaactagttttagttttgtttaaactcccaagagtctgtataaactccttcgactcttaaaagtaggcgcgaatcaagcggtgactggcggccaagcagagagggcagcagcagccaccccgtaactattggttcggaaactgcacctgaacgttcgtttccttgagtatttttcgctgcagctagcctctcattaatttcagataatcagttttattatcttgctgatgtcctgtgtcctgcgtctcactggcgtgagacggcatcgatttcacttggctgtcatcccatagtgcagcggaagagatgttgactcagggtcgcacattccacacgggacttggagctactacgacgtgttttggaattgtttccacggtcaaatgagcagtttggattgatcgaccatctctttcagcggtattttggagagacgggaactcatccacagcgggagggattgtcttgttcgcatttgccatcacatggtctcttcgacgtccaccttagtgaagaagcattgcagttcttgtattgtccattccgtcgttttcatccagcggcggttcctagataaaaggcgaagacataattagaactctgttggagtcgcttgta

SEQ ID NO: 785 - DNA, 2352 bp, Toxoplasma gondii
atcgtctcctcctgaaacccatgcaccttcacctccttcgtttccaagttcttcgtctcggcgtcctatgtctccacgttcgctgtctcgaggttcttcgcctggacaggagggtgctaaggaagaggcggacgctccgcaggggcgtttctcgtttgcctctcctcggtcttgacttcggtgactctggcgcctgtggatgtcctcagcggaagtcgcggtatcaagagaaacgacaggagacgtctctctgtcgctcgaagaagaaaagcggacactcttcccgtttcttgctgcagaagccttcgctggacggtcgccgagagaggcggaggcgccttcacaccacccctcttcgccgggtgtatgtacacttgacggctggctgcgcggatctgaggcgtcggctcccgcggacgcgtttcgcactgtctgcgcttcggctttctgcgtggcgagcgcaagaggagactgaagagaagctgcttgcgtctccatgatttcggcttgttctggaagagcagtccccactcactgcacgtagaaacactgctgctttccacgacatcatgcagccgcagcactcgtccagaagacacgcgagagaagacgggccgagattcccttctggctcgcagacacccaacacccgtggtgtgcagtgtatgcacacctcaacgagcgagttcaaagacgcaggcgctccagcagaaggagacgaacggcgggaagccagcgaggcgagagaggccgagagccttcgccgcttctgtgtcttccgcgaggcccgtgtgcttgaaacagacagtcacgcggagaaagtcgcagacgcaaacggagcaagagacggtcacctgcagagacagtatttgatacacctgctgggtgcatgcaccggagaaactcgtcggagttcctagatttaggtccacgttgtttcctccctcgaaggttcagacgatcaagagagaagccccgaaaaaacaagctttcacgcacatggagttattcttcttcttagctgagaaggctcgagcggtggagagaaggagacggaaggcagattcccagacctgacaaggtgtctgtacactgcaggcttcggaggggaacgcattcgagagaggcagaggccgatataaggtaaaagaagcctctgcaatcactcagccttaggcacttgcgtgcatccctcccgtacctgtgtatctctgtgaagaagaggcaagaaagaagaagaaaagacacgagaggctctgaggagtaagacggggacgagatgacaagctctgcttcacagacggattcgcttcttcgcgaagcctcgaagacgccggagatgcaaaggcacaacttcttcgactcgctctcctacgtcccctttctcgagacagaaagacttgcgagagcgaggaaaactcagtcacagattgtttgctaggcgacggcggtgacgaaaacgctaaccccccttcgggtgtacacacaccctggcagacgcaggaacgcgtttcgccgggtaccgcggacagtcagacacacgacagcttatcttcaaattcgccatcgacacacagctgaatttcacactgacgaacctctagcccctgcaacagacggaaaacgcaaggcatcgcacccaggttcatctgcagcgcccagccagagcgtctgcgaagaaagcaagctactcctcgtcttgcatgcaggggcaacgcgcttcttgtcggcggcttttcctgctctgccctttccgggacttcgctggtctgcaggactttcttcccgcccaaaaagccacacacgaaagacacgaaaagctgagtgtctcgtccttatccagttctttctcctccgctgcggtgcaggtacaccgcactcggtgagtgtgtaaaaagcacccaggtgcctctctgccgcgttcccccgcttgactcaccaagacactccgcggttcctcagagcaaccgtcggattctttctgcgcagaactcaaccgtgcacaggggagaacgaaagaaagacagatgcgctcttctcctccccgttcttcttcttcctctctttctcctgaaacagagaggctggccctgtctcgctctcgcaggtgtgtgctggtgtactgacaggcgagaccagggagagccttctgcgctctctgcaagagccacgaaaaaggatcttctctcagctgcgtgaactttgttctctcaccttttctctgcattttgcagagcaatcgagaaagggccaggaaaggatcgaactgggtggccggggaagaaagaagtcgcggagactgaagaagagacagtccgttaagggaggcgtcttgtttttcaacttctgtca

SEQ ID NO: 786 - DNA, 1561 bp, Toxoplasma gondii
gaacattcataattggaatgaagtcagtgctaaaatcctctgcagacaacagggaaaagctctttctgtcgcgtggacagcgccagttctacttccagtactttggagaaggaattgcacctatctaaaagcatatctgtctacatgtatatgtacatatatatatatatatatatatatatatatatatatatatttagagatacacatagatctattacgagcatgtagatgcacgtataggctgaggtgtcgaccgcaggcgtacaactgtatcttcattcgttttgctggaaaccaggattgatatgcgttactcgtactccgtggaaggtcgactgaactgcaagcatcgatgcagatatatctatggatatagacatgcttgtaggcatgctacgtctagtcggtgcgaactgttctttctcgtttctctccggggaggagaacgcagacggtctcctctgtccgtggacggcggagctcgcgtagagatccttcgcacctggaactgtgcagagtctcactgctgcctttccccagtggaactcggaatttagttgtatttcagttcattcagtgctgaatcaccaatgacgagagtgaaataaaagttaccagctccctcttacttgtgtagcactcggccagttccacaagttcttttttctgtctcttttctcttcttccagacgccactctcccgcttcttccttttcttgcttcgcgtcctgccctgctgtttctctttattcctgtaacaccccccactctgttgttcctcccctttctttctctttctctttctctctttttctctttctctttctctctttttctctttctctttctatctctctcgctctcgcctcctttctctgccgcggcgtggaacgcggagacgttccgccgacggcgacgagggcaccggagcaagctggcgagcgccttggactgaaggagcattcttttccgaaaggacaactgtgcgttgtcgcgagagatatttttgctgtctccgaaaaagacagaaaaggcggcgaacgcccgaggggactctcttgtgcgttctcaggtgtatcgacacctctcggacagcgcgaaaagacgcaacgaagcgcatgcgtttgaaagacctccacacacagcctgcggctgcattttcttttttctccacttctctccgtctccagggagagtctttcacatttgtttccagactgtcgacgcgtttccgtcgcctcatccggctcccttcctctctttcctgtccgctgcggcccggccttcatcccacaagccagcgcggccggccgaccggaacggaaggcgtgaggaggcgacgagacgagacaagaaagttctccaaaacggggaacagccgaagccaccggatcgcgcagcagaaggaaggtcagcgggcaagctgcgtatcgcggagacaagcctggagagcacaggcagagcgggcagaagaaggaggagaaggcgaggaagaagaaggaacaagaaagcgggatcctgacgcttggaaagaaaggaggttgtttttgcctggaga

SEQ ID NO: 787 - DNA, 2631 bp, Toxoplasma gondii
cgaaatcgtgtcgaagtatcggtgagtgtccgtggtcgcgtagagagtcgtgcaaggtgggttttggtggacgatgtctctgctttcggctgattttttccggaagaatcacaaggatcaccctgcaaagaatccatctatctcttgtgtcatgaaccgcttttttcgctgaagacaaagaaccgactacgcatgaacttcgtcgttgattctcgtctttcgagcctccgcttcgacatcttctcgctccgcagtctcccgcgtcgtcgactctctcttaactcggcattacgagtttcgccgttctctctttccaccattttcttctcacttctgtcggggacaagcattgccttgtcctattcaggcagtaggtagagttgttggccagcagacgtcgtccttgttccaccacctaatcataatctcctgctccatgtagtaaggactgttcgcaacgtgtaacggtaatagagaactcggagttcgtgtcaagtcgtttcttttttcctctcttctgtcacaccgtctctcgtatttcccctgtgtcagtggccgatggtgatccgagcggcggatgtcacagagcgacgccagagctctggacgtaatactccaggagctcttcgtttagagatgttccgcgttgcttcacaactccgggaggcgagtctctgctttaaccccctacctcttgtctgtgcacatgttgtgattacttcttgcgctctgactctctctctcttccgcctctcgttctctttcgcggagctccgttctcgcctcttctcgatcgaaaaaagagtccccgtcacctttggggacgaagagtgacaccgcgcttcaacgagcagcggatggtcagcgacacacgcagagaagcgctggacccgttcctgctttgtttttcttgagttcttgtttctcgtggagttcatgttcttttctgcctttccgtgatgcacagtcggcaacgtgtacagtgtctcgggtgcttgacgtcgcgtcggcatgccggcaaaaggggagcgaacaaatttttctctcagactgcccttcacacgaagtctcagaaaagaagcaatgcccacacaagacccgtagctttctcgtgaagaaaaacaagatttactggagacgcttctacctgcgaaaaaaccggagtcttcactgaaaaaagtacacacggccaccgttcgagagagcgaacaagactttggtcgtctttttctcttctcggatgtcgttcgttcttttcttgtcttcttctctctttctcgcctttggtcgcgcattcgttctccttcctgctctcgttcttcttcttccctcttcactttagtcatggccctccactgtcgttttgttgccctgtctgtggcgtctgtctcgcatggctaccatgttcagcgccgtcctccttcttctacagctacggcaactgctctgctaaaatagcgagtaggttccttctccttctccttctcggctctccgtctctctaacgcagtgtctccattgcggtctgccctctgtgtcgctgtctcctctctcttgcgtcacacatatataggcaggtacacttgggtgcattgtgcaagcccacaaaagtgcagacgagaactgtttgctctccccttcttctttctctgtatgcctcggttgttcttcctcgaagctctgtctctgcttcgccgctcgcatcgcttgactctttcgttgcgcggtgttgggtgtgccgggagcagcgggactgcatgcgctggcggcggaacagacggcggctctgcgtcgcagaaacattctttttctctccttttcacttgacggattctgtatctaagcgcctcgttttctcccttctttcctcttctcaggtcgccggtcaaacacggtgcgtgaagacatcccatttcatgcgcatgcagagaccacaggacatgttttctcgcgtgcggatgcattttgactttttccgccgtagttttgtcttttttcctcgcatgttttcttcgcatgccatgcttggttctcccgtgacatgcacggagtcgctggatcagtcgtcgtcctgaaatcccccggcttgacgctgcgagagatatcgcgcagcgtcgcgaattccttcgctgtttaaaagattgtgctctatctactgctgctctcccgcagcttctctcgttttcactctattctctgtaggctcttcgctgcttgtcaatccgggtgtctctgttgtctcagccgttctctcctgcgacctttcctcgtccgtctgtgcctctgtagcctcaaatctacaggctcaaatagacggttagacgtcgctttttccttgtcgagaaaatcttcgtttccctgcgcgcttttctgttctgttcctcggtgtttttctctttttcgagacgcgccatgactttttttcctggtttctcagttgctcgttttcgatccttctcggttcctcgctgctcctccaccgaaacttgccttttcgcgtctgttctttctttctccactcgcacgccaagcagaatttcagccgccgcagtcttctgattgcttggcgtttcgggccatccagcgctcctcagcgccgaacactctaagcggagacggagaaggagagaa

SEQ ID NO: 788 - DNA, 4764 bp, Toxoplasma gondii
cgaaacgcgttgctcgtcgcgtaacactgcagatcctcggagagttttttgatctgcgctttcaacaagcgaatcgactcgtcttggtatgcgatgcacccctccttcaacatgttgtctcctcgccaccgcacctcttgctccgccagcgttctctccagttcttgaatcgcatcccgcgcctctgctaaggcctggaggctctcgtcgggttcctgacgttgttgcggggaaagaacgaggtgcattcctggtgaggtagcccgtgccgaaggggaagtctcgactctttgcacggtggccgcggagcctgctgaaggggcaagcaagtccggcgaaggtcgccgactcaccacagtcaccttttgctcggtccctggtggagggcgcgtgcgcaacgccgcctcctgggaggcagtgtcattgtaacacttccaccgctttgctcgttctttccagtacatagacaacggccgctgtggttcctcgccattcgacaccacccaccaactcgtgcggcgagcgggagaggcccgctgcggcccaatgacgcagacccggtgggctccatagtaggtgccgacaggtgccgcctcccgttcaacaacgtacggcgcacgcacgcagtttctgtgtcctccgaacgaactgcggcccttgggagccccgagaaaacttggaggagcggagctcggaaactgagtatcctctgtgatttctgcaggcgaacttttcacttcctcagaatgtcgtgctgctacgcgcgtgccaggcggagcggcgatgttgtctcggttgccgctcgggactagttcagtctctggaggggaagacgccgcctggttccgcacagcgccagtcacagatggctccgatctacggagcgcaggagcgccagctgctcccagaacgggttcaaaacctgcctgtgccagggcaatgcctgcaccgggatcaggacacggctgccgagcgagcggttgagacggcattccgggcaaggcactacgagtgacaagcgacggctgagcgggtgctccagcgcgaagttcatcatcgcttgaaacttcctccctggggtacgcctcagtttcttgatctaccctccaaggtgcaacctgaggggcgggcctacttgctgcgactttcggccgcaggtctgattcacgaaccggcacctcgacgacactcctggtaacagggtgtgcactaacgcgaacggcgacattagcaacagatttccctggaaggagactccgagagggcggcagtccatctgtggtcggcttttctgtctctacatcctgcggaggtctttgcagggaaaccgcactttcccgctcgctggtgaccagaatttcgggccggcattcggtgacaaccgtagactcgcgaggggcagcgcatggatccggttgattatccgtgtgtcgatggaaggaggaagcccccagtggttttgattccaacgacggagagtcctccgatggcggctcctgcagcagcgccgttgcttgcgcaccttcggactcctggccttctgccttcgctgtccctggaactagggacacgtcggccgcgtatttttgcggaaatatggacaccggcggcgggtattcagactcgctgctgtcgaacctttgagcagttgtaccagcacacggttcctccggaactcgtgacactgcgacggaggtcgcaaaagaatctctcgagagcaggtgtgacggcaggtctacgtcaccgcgatcaacgacagtgcttcgcgctggggagcccaactgagaagacgccgtaggagaaacgtctcccgaaggctcttgaggctctgcggaagaaaggtgggggtgcatggtggcggaacgtcacccaaagaattcggaatctggccttacatggaacggttgaggcacggcgacttgttgcggcgaaacgctccgtgacggaagtagaaaaataaaagatttcattcgaatacggggaaaagggcgacaaaaaagacatacataagacgaaatcgggagtaacaagggatatagttacaaattttctgtcgacgagtactgcaggatccccccctcatacgcgttctcggctgtgtttgtactgaagagaagcttgtgtcagacaaatacacgaaaaatgtcagctgcacgtgctcctcgtacaggggaaccagaccggaggcaacacgtgcgtcaaatcaatataaactgtcctaggcgttttcactttgacagcatgcaagacactctggagaaaacgctcgaaaatgaggggaacgacagaggtctcgcgtttcactcgcccgtgtttgggtttggagggtcgtccgggagcgcgcgaaacggaggcagcttgaagagcgtggccacagctcgaattctaaacagacactcgaaacgattttggacaacatgtcgcattggctccttcctacaacacatcatctttccgttgttctgcgggctgaatcgtctgcagtcgtcaccttctacggagttcgaggagcgttcgtttcctcgtaggaccttgcacaagaggcgtgaggacggttaccaagtcgaatcaagaaggaacatcagttgacctcgcaaggaacatccaggcgtcaaggagaaaaaacagtgtctttgctcagtgaaaaaaggccgatctatcgtgtttgcagcgattcaggttttttcccgaagcttccgtgcgactccgctcatgaagcggccgagtgaatgagcagaggcgatgggtggtttccagtgcggtcgcggcagtgtctttgtcgtacatcttcgagttgaagaggaagaaaaaatacagaagaagtccagcatgtttttctgaacccttcagaaaaaagtcgttactaccttcaccatgtaaatgacgaacatattcaagacatgaaagccattggctaggccccctgtggaatcccgcgccacgtcacccgagccacctgaagtcagcgcggcacgcagaacgccggtcacccgtcacctacccctgcttgttagcaaggagacagttggagtaaatgagagcgcctcctcgcgtcatccacgcacatcttctagggaaaagaacgggctgttagagagacgtcacacgcttccttgagacgaaacgaaacagcagagaaaccccggcagccttgaaggggaagccgcagagagaccactccagaaggacggtccgccgcagtggccgactcgctcttggtaaaaagccgaccggaacattcgtgaggaggagagtcacatatctctctaatgcgcacaaagcaactgggctagttcgtgtgcaaaaattcacaggacatgctaaaaattgttgtaaaacggtaccccctttcgtgcacagagcaagtagattcattttgacggtttcaacgccgtcgaaaagatcaagcgatcgactttgaagctcagaagtttaaaacgcgcttgcacggaagtcccctcggggttgatcgattcatccaaaatctagtctccgagatcacaagtcgctacatcacacagaagaatgacacatgcacttgacttagaagattccacactcatgttgtaacagaaagcaacgtcttgcaagtgcaaggcctcccgtatcgcgcctttggtcttcggcagtcgactacgtgcaatcgctgcctctgcgatcggcccgttacttctactgtgcaccgaatcattccacaaaccgccatcgagacttcttatggttgaattgcgacttacttttcacctagagtctttctgactttagataacaattttcagcaccgtagagagaattgtttgtcttgagtgtgtctcggcgcccacagcgggctcagatgtcggactcttcgtctctgcagccggaaactttgctgaaagaacgtctcctgagtgccactgcctgtcttccccgtgtaccttcctttgtggcagtctcttggattatctatcatgcgtcccgatccgcctcgattttaacgagtttcttcttcttgacgcgtcaattcctccgcgttcgtcttctgcatctgccgcacgctgccgtttgcgcgttctactcttgcgtagcgtctaccgtgcatcttttttttgctgtaacacttcgttgctgactaccccagtcgcgtccgtccccgcgtttagtgctgctgcaatcttgctttcccggtccttggtcttccgtactgggtttcttccggttgtgtgctcacccgccaccttgtaccttttgttcatcaccgtcttaggctgctcgccggttgctcatcgcagttctgagggtcagccaacgcattttttcaactgcgaagttcttctgtctggttccttcctaccctttgtcgcatgcctttacttctggttcctttttgtcaagtcaacgattcgccttcaaaaagtcccggctgctggttcaacatagctcccgctgtgttagcgtccggattttcccgtgaagtccctgcggcagcatgagccagagggaactgcaatcgtagcttgtacttctttcgcggcttaacatagacaacagttaccaccttcctgttctctgttagttatcacccttcccctagcacttcgtgacccctcgatccgtccgccacagtatgtggggaggcgggcgggatatccaggttttttctcatcctttgcaccctcaatccaagtcgacgtgtcagttgtcacctggtatacgctgtgaggcggctttcttatcgatttctgtggtaaagctgactatttgggcatagtgttatgctcaaga

SEQ ID NO: 789 - DNA, 4756 bp, Toxoplasma gondii
cagagacggcgcgtctccttttcggctgtatgtacagtctagaggttcccgcgcttgactggggcaaccccgaagacaacgaggcaccgggcggcgacgtaaagcacggggaggaaacctgctccacggctggagaaactgacgatctgtctctggacgcggtgttgaacggacccttggggaaaccgccagctgacgaagacagaaaggaaggaaactcggtgtctgattcgctggcgaaggcgtctgggcacgaggctgctgcctttctcggcttgctcatcgacctcgtctgcgccactgcctgtctgtgtccatgtctctctgcacgcgagagagagacatcacaggacgaaggagacgcagagtctctcatgctcttcactcacttcttcaggttcttcgtcttcctcttgagggcgctcgacatgttgcttcgcgatcaacttgtggggttcccggctgcgtgcgagacgagagaaagcgacgggagcgaagcggagacacgcagaggcgaagaagccgaagaaagcggaaagccagccccccgagaaaaatcagatgcactcggagagccaaggggacaaggtgaaagtcgacaaacggtggaggagtgggaaaacggcagggaccgaacgggtgcagaaccggcttctgttatcgctgtgcttgatgcgcttctttctgaagaaaaactgaagctggaaagcaggaaaggaaacgcggacgaaggccaatcggcgaaagaggggaagcacatgttcgcatcagcaaccaaacacacatcgccagattgtgagactgggaggcaaaccgagagagaacagcgagacggagtggaggcgggcgaggccgcacagggacgaggcgagcaccttgaggtgagatccgaaggaggtcaaaaccttttcagcatgcgcactacaaaactctgtcgacgaatgtggatatacgtagtgagaattgtgtgtttgcatgcttgcacatattcattggtaagttggcatatatagaagtatgcatacacatcgatctacaattatgggtgaggtggcgtactgctgccccaacggttcacctttgcgctctctgtcaactcgcagagaacactgcattttcagtttttcgtatcgaacaatttcagcgatgcgctggggcctgcagtttttctccttggatcttcttcgaaagaggcaattttttgaagggtcagtttccacagcgtggctcctctaattcgcgtgcccgcgtttcggatttcggttttcccacaaaacggcttctttctcagatccttctgacctgtctggcgatcgccctcgggatccacgaccgcgcgcgaacacgcctggcagagacgcactttggagcgcgacgagccgagcgcatgcactggctgggtgtgtatcggaggacgaaagccgaggaacaatggcgaaaaagaaacgcacagctgcctctctggcggcgccatctcgcgacgcaaggcttcgacccggaaagagaaacaggagaaggcgaagctagaagacttagcagagaccagcagggatgcctgttcttttcatctcctgttcggaatggagagcaagtggcgggcagcggccaggcacaaacagagaggggagcgcgacccgtcctactctcagatgatgatgatgatgacgaggcgctggacgcattggagaggaaagagcgagagaatgaagaacgagagtggagcgtcattctgtgcagggatgaaagtggaggacaagtcgttagagagatctccaaggaattgcttcatatcactgtaagtctgcactcgaagcgaaaacagccgcgctggtatgtgccctttaccgcctcacgtttaagttgacaggaagcagctgggagaggaagaagtagaggaagtttgaatgactatcccgaatctgccaggcagcgtctgtggttctccgatgcagcggtagcgagagagaaatccatgaattcgtggggaagagcgactgcaaagcagaagtcgagtggaagggaccttcaaggggtacgggagtcacgggattgcgtctgtttgagaaacaggctgttgctttcatgcttgttctgttttgtatctgtggtgtgattcatttgcgaaagcagctgccgcgtgctgcgaagatgctgagtcgaccaggaggagagacacgaaatgcccgcgttctatattttatcaggcgtcacttgaagaggctctctgtacctccccgttctgttttaggggagagaagaacggcagaagacaagtgccagtaccaatagggctcatcttaagaaaccggatgaccaaaacagtagcctgttgtggaaagcataaatcaccacgaagcgaaaagatggtgaaatgtctctaaagtgtaccctctggtagtgcacttcagcaaagctacgtctgtatgagaatgccaaagatcagaggcaaaatctgctgggatcgttcttctttccgtccaccttggactcgcgtttcggggaagtcgaaacatgccttggctttctttcgtgcattccgttttccttcaagtgtctctcctcattcgtctacatcttctctgtttcattctgccgtttcttagcagcctcgttcgcgttcccctctcgttttgttgatcctccatgcctcgcgacttcctccccgtgttactctctgtcctgaccccattcgcagtatatttctcgctgcttcctgagcttatcttttttctctctgtgacccttctgtagcctagaaatcgccccccgtctgacgtatcaggtggacggcctccagcaaaatttttccaaaacacgggcggtcatcatctggacatgctgagtccccatcggaacagcaactttcttatcgagccgcgacttacacaatggaaagcaccagctggacagcattgctcaagactcgctacttgtcacatttctgaaacgcgtgcccttctctgtcctcaccaaaagatctggcgcactaatttatttaactgcaaaaacgcacagagccggagtgagccaccagcgaaacgctgtttcaataaacaataaacgcttccgtctgctcagtaggcggacccacacaacgcggacgtccagttgtgtttctatctgattgtggcggtgtctgaagaagtgggaacgcagacggggtgacgcagatgttgaatcgttgattcaaggcgcagtttggttcgcttttccatttttgctggtgcctcacaggatgggtcgccgaggcagcctgctgcacttgggggtcgacaggttgctcgtgatctcaaaaagcaaatatgaatctgtcatccttgttaaatgcacgtcttgttgcttaccagttgaagactgcccgtgcaccagggaccagcagaaagtcctagcataaagctccgtacgcggggagagcctagcgcagctccgcgggcagggtgtcgatccgcagtagaaagaagcatgagctatgaagttttcgtcaagatgcgtattgcggacatttcacgcgcgtgacagatccaggaggttcctcaatctgtgcggctgagttcttaagacgccaaaagtcgctgcgcaacattcttcgggacgggcgccagccatgtgccttccacagggtagaatgtggcggcaagccaccgccagacaaagctgaaacaaaagtgtggtaggtatcggaacggcgtcgcaattgacggtagtaacgggcacatctccgggctgtagacgaggacagtctgacgaggcgcatgtacccagaacgctgtgcggcacagctgctagagtagacgccgcttccgcgatgccaacgcggtacgattctggcgatatctggaaaagacaaggcgagtcgtcgcatattcatttccaaaatccaaacggtcgcagtctcaaagacgctgccccagctagagcgtccacatattatgtggagcaggctctttctctccactgtagtgatgcgtttgtcatttaaaaaatatcacagcgtcgacagagtcgcggtgttttaggtcgggtagacgaacgtcgattccctagcgtctcgcggtgctttgatgtgcagcctaatgaaaggacggtggcccaacaacggcggcagttcctgtgtgtgtccatttctaaccggacaaaggacgttgcacgatatgttgctgacgccagccacaagccggtggcgccacgtgaaatgcacaggaaaccagtcagccttccggcggtgccgtgtccgagttgttatgttagtggaagtccattggtcatgatttgtcatttggtgcgtgtcatttctcgtgtcagtcgtccgcatttcatgattcccttgtttcgtagcacagtgacgcggaagccggagtcaggctgcgacgcgaaacaagcgtcgccggccacatccgaaaaccagtaaagagtgagtttttgcttcatcagcagctgaagtataacgagtatcgtcagttaagtaaggtgtcccagactgttttgctcacggttgcagtcgtcagcgtgccggcagtggagcggcaacgtggataagtcgactcctctgtgaagttcactgtggaattcgtggatcaacatcgttcttgtcgacggtattgctgtaaataccttgaaccagcactactacgggactagacccgccaaagtgtgtcccttccttttcaaacgaacgcgtatccatgtgttgtttgcttggttatttctgacgtgttcttcgaatgttcattcccccccccctcccgacgtgaccgga

SEQ ID NO: 790 - DNA, 4864 bp, Toxoplasma gondii
atctccgcagacatatgtatctctgtgttgggacatataaaaacgtatgtacactatatatatatagatatagatatatatatatatatgtacataaacacatataaatatatataaataaatacctaaatatatatgtatagatgagaaagagggaaactgacagaagaaagcgggtgctgcaggagtttcaactttgttgatcacgaggcctgccgagtgtttcacaaaaagttaaggatgttgttttcgtttgccgtcttcttcacctgcctttgctctccgccctgtttctttctcgtaccagttgcatgcagcggtgcaccgtccgcgccgacgtgtttgccgttgacccagagaccttgaatgactcctcccgagaagttgagggagatgccgttggcaagagcgcgagaaactccggaaggtttcagatgaaattccacaaggatttcgccagcatagacacatcggccactgttcagaccgctagctgaaggcgccgtagtcgcggcagagggcacaaacgttgacccgcctacgagatgaatgagaagtgagtagtccacgctcctgacaatttcgctgcgtccacgagcctctgagtgttcttgaacgtctgggacactcagctgcaccagcgaaggaaagagtcaccggaaacataacgctagcagtcccgtgcagaggaaagaggtggaactgactcatgtacgaagaccgagtcacgagagctacgtcgagatctggacacgagagggccagactcctggatgaaaagaatgctaggatgaaaagcgaattagccaaaaaaggagcgtcacaatatttcttaacataaattcaagccggttcactagagagtcaagcatacgtgttgaaatacgtacgtgtgcaactggagaaagtgttacgtctgccctactgtctccaactaccgggctgcctctacggccgtatatatttccatagattacatgcgttccctcatacttatatattcagggcagtagaattgcagacccagacagctggatgggtagtcatgcattgtccgctgtctatgggtttgagtttgacagttgtgtttttttaggaatgacaagtagttttgttgtgggcgctgaaaacgaagcgaggcactttatctctgccaccagtgcaactcgcgatgttccctagtctgcaactcccggagagcggaagactctttttgtgtgaatggcagctcgttacacaagcaaaaggagttcgtcgtgtttcactgacttctttgtcatgcaaccacataggctccatgcgttccttcgtcctcctcgcttctgcaatccaactgtttagccaccatctgccggcgtagagagctacgccaagcaaaccaagaaggaccgcctggatgttcccgcctccgccgccttcatggaaatcacccatttttgatttgaaaaagaagagtgacagggcacagtctggagtgaagcatcctaatacgacggagaagatctattcagctcccgttcgcatggaggaaacaccggcgaaaaacgtgttagagaagacggaaccagctgctctgaaacatcagcctgatgctgaataatatatcctctatcacaggtgatgtccgaggcggctccagtgtgcctgcttgttgaccatgaggaaaagcgtggaagatacgcgcgccctctctcgaagcgaagtgatcagactcgcggaagttgcattcgcccgaagctttttaggatttggtggaaacgcgtgtaggatacactgaatatgatttgcacgtaagccgccacacaaacctacaaactcgtgtttacacggccgttgcgtcaaaggagtgtttcttccctatggattggctgtttgctacccaattgagttccggtcgaattcatcaaagaaccacgtctatcggtgggcctgtatccgtgaaatggtactaatccaaccgcagagattcgagtgaattatcgactcaggacaacgtctttgtctcacgtggggaaaagtgctgttccaccctgcatgaatccctgcttccatgtataagcgccaagaaatcctagattcgatgcgtttgcgaaggcaagagcagcaggaaaagaggaccgatcgaattcaaccgtttccaagtactgatcagatatggtgtaccagcagcagaatctcttgagtccgcgttgcactacacacgctcctttacacttttcggtgacagtcaagaacaaaagaggggttgcacaggcacaatgtgagtctgggaaacgcggagaatgataaaacagcaagaaaaggaaccattctcaacgccaaactcggacacacctcgaagcgtccgtggaccgacggcgttcctgcgtggacgagaacgactttttaggtggatcggaagcgggagaaccaattaaaggacgaaaatcctcaaaaacaaagatttaattaggttgcccgcatgcgtcagctcgtttgccgtatgtaagttagacatgatccaaacagtgcagttcctcattctttttggtctcgcgaagacggacggcgaaaacgcactgccacttttgccctacgggacgagagcgcaaaatgtggcttagcgtcgaagcaaccaaccacatctgccttgcgcttttgctctactacggcaacattgtgttttccagtctgactgcttctgagctctccgcggcagaatctcgaacacaggtggcaaggaactacagtcacctagaagatgcctcagaagaccgttgcctctatgggttgtgtggtctgcaatctgaaaccgaagtgaatggtacatcttgcacctagagacacatttgagtttgatgagcactgaaactgaagcggtaaatcgtgctcggaagaccctctggaggtttgctggtcagtcatagctacgtagtctcatgacaggaactcgtaggttaactcgaaatgcaagtaatacgaataccatcatactgttgtgtccagctgctttatctatgatacgctgttctagatccgaagttgtaaatcgtaggtcgccagtccagtacagatccacaaaatgccgttgagctgcattagccatataccactttgttacaccaccgctccactggggaatgcctaagacaggcataggtttggacttccacatcatgcgatatgatgtagtaggacagggcactcgaccaaatttacgacagatgaaaatatcgcggatgactgtatattagcggcaaaataccgaatatggacatttaaggttttccatgctccctgtttagaaaaagaggatagataatagtaccgtaagtacataaactattaatggatttgattatgggcaatctatactgcctggcatgcattccagtcatttcattgtcggtgctatctcgggattcttttatcagtgtgtgtatagctctctactggcagccctcaagccagctgactctgcagctggaccatttaccagcttgcataccttctgtgtcaactgcagcctcagtgactcctggcaacattcattttagaaagcattctttagagaggtatgtagaccagctcttgtagccgtctcgaaaaaggaagtcaagtttttttcataaattccaagcaaacgaagagtttcttcagtgatcaaccgcgtgtcaggacaacaagaatcccacccgtttatctcgtatagactagcgtcaggtaaagaggctgcggaagtgaatatcatgaaatctgtaccgctgttgtgaataagtaatagtggcacctcggcgagtcccggccacagacaaccacttggaactcacctgctagcattcgtcttcggggacagcggttcctctgaaacaaaccgactatattccagaatatactcatatataaatatatgttcgtatatgtttgttattttctaatcaatttagtgtgtgctacaaatgcttctagggggaaggtgtccggcttcggcactgttggagcgctgccgaacagggaccaaacaccttacatctctgcgcagcaagagatgcacagttcatggtacctttatatttccaccgcaggagtacggaaacacgtttttctgtctttagagtctcgtctttgtcaacagaagtcgaggacactgacgttgacagaagcgcgtctgtcgtgttagttgtgtccgcgtttgtgctctctgcagagcgtctgtgcctcttgaaccagcaaagggttctaaacggttgcaggacggaacggcagacggaaaatgcagacggatcaccagaatggtgcactttcaacctgtcttcttgtgcccttgcgactgtcaaggctcgcctgtagacgctattccacagaacattacgcgtattcaccgtctttcaggtgtctgtgttgtcagtaaaaagagcaggccgcgttgacgtggcacagagcaggcacgatacccatgtacgatgtgtcgtcgatcttggcgctgatccagactgtaacgacctgggttgttgcggagggggtccgtcccttcgtccagcaatacaaaagtcaattgaagggggaaagcaagctcaacagttgcaaaacggaaacggaaagatactttttcttatccgtggcggcacccttgcaacacgtcccaacaggtcctatagctcagttggttagagcatccggctaataaccggaaggtcgccggttcgaccccggttgggaccactttttgcgatgaagctttttaaaaaaaccgcatttttgtctcactgcaatagcactgtctttgtttctcccaaatccacgcgcgaaattcatattttggttggtgttatatgcatcaattcctcttccctgttcccgaaaaccccccttggataacacacca

SEQ ID NO: 791 - DNA, 2590 bp, Toxoplasma gondii
cctttgttttggctctcttgacgcgctctggctccatcttttctctgcttctgctacaacgcagagactgcctttccgtttcttgggacactcgacgcgtggcggcacgtgagtcctgctttccagttctttccctcggtggttcctccccaaattcatcgtcgcggcctctttcatcggcaaaccatttgctgcatgcatcgtgtcgcctagccttttgctctccaccagactcggatggaagacacagttgccatcgctcgacgcgcgttcctgctgggctcacgtgcagcaaggtggttgccccacctgcaaagggacgacacgccacagcggcaacaaaacatctcatgcagtgcgcaaaacgaattgaatgtcaagtccctcagaaacaaatagcaaacgttagatggcatcatacgtgaggagcagggtccaggacctcgtctacctgccaactggggtttagctcgaaaacgagacccaattttcaagtcggcagcacttacgcgtttgaaaagttgaagttgcagcgcatgcagcggcttgccgggcggccgctccggctcctggcagcggctcccatcctggcaaaggcacccacatcccctggggggttcctgacacccgtttcgctccttatccgcctgtctgcgtcccgcgatttcagggcgactctctcctttcagaggcaagtttgtttgaaatggaaacgcactgagtttccagagatgataggtctccaatgcgaggcctgatcactcttcaacgtactccggcaaattcagccgttctcacattgggatggctttatcgtttatatgaatcaacagcccgctacctgaagaatgtgttcctgtcggagaaaaaaaggagctgaacgaatcggacgtcctgttttggtaagcagtgcaacagctaagtcagcggtaagatcctcacggggtgtcagcctcctagttcaaaaactcgtcaagacatcggtaccttagtgccactgagatgggcgcgcacaaccgccttcctgcaggggctttactggaagagtcttttggttggtgcatctccactagaagttccatccaatggcaaacaatgagtgaaaggccacgcatgcagcaaaaagcacggatccgccagcggtgacggatgagccggtcagtaggaacgatgcagaacggacgacgccggtccgattccgtggttcagtggcgctacagtcgtcagtctgcctgcagaaaaaggttttcgttcactgaaagcgcatcaatccgcaaaactcccggtgagttgtgggcaaaattttgtagaaaatgtaggcagtatccacagaatcgagacccagatgcagtggcacaccttgttttcaggtgtatatacaacaagtacttcagtgcacacgtcaaaagagttgtgcattgtaagcgtggatactcgagtgtggtaatgcacgcgccatcgggtgtgtattccgtcgggctgtcgacaagaatcaccgtcggctagccgagtgtgtgttgacgtggatgcaatgcgtgtagcccgcagaagcctgtagtagacagttcacctgaatacatcaccgtcgaacttgaactagaaagaggctgcggtccatcaaacgtgaggagtcgacagatacacacaccgactgggtctgcagattggatgcggtgaaaaacgacgggaccaaagcgtttgtgtgtcagcctcagtctgcgtgcttgggcccgtgagcgaaagcagggggtgcgagccgcgttgaggggtttgaagtcggtgagacgaatttttcagagatgaaatgctcgcttaggaactcgaccgtcttgattggggctcgctggatcctcatttcaccctgcgcatgcaactgcatgcagctcggaagaaaaacgctttctcgtgctgagatagagctcgctgcacacagccgaaagtcttgtggtttcttcctacagagaatacagctgaaccgtcctctctacagcttctcgtcctgtagcgactcagttgctccaagaaagttagttgcacgacactctcgctcgtggagtttctcactcgcgtgccgcctcactctcgggctgtcgcgatttgctgtgctcaaactcttcataaacttctttgtctgaaccagttgaacacttgcctagcacgtgctcgctacggctttttgtgtttgacaccatttgaagaggtacggcccggacgaaggtgcaacaagaactcggaagaactgtcgttttgcgtcgcgtgtcttcggactgttctcccgggcggccttccagaacgctcttgatcgtcttgctggcaactttggtgttccgtgtttttcttgcttgcgtctttcaaataccgtgtagtttcgtcatgaatgtcgtaaacatcgattcactctaactctgtcgctgcctctgacccttccacgcatgcgagatccccttgtgagccgacctcgtacgggtgttccctgaatctccccttctccaagtattcccacttgcttttgtttcatctcggtcgtcccctgtagctttttcttcaagtcttttctttcattccactccacgttccaggttggactcaa

SEQ ID NO: 792 - DNA, 5055 bp, Toxoplasma gondii
gagagaaaacgaggaactgggtacgaatggctccgccagattttacacaagcatatatatatatatatatacatatacatcgatacatatatctacacatatattatctacttatatacacatatattatctaaatatacatacatatatatcaacattagatacatacacatatatatgtacatatgtgtatacacacatataaatatatatatatatatatatatgcatatatatgcgtatacatgtatgtgagtacacgaaggataaacgactagaggaagagaacgccgtcagagtcaaagagtatcaaaggtggttgactggagatgctttctttgttattttcagtggggtattctgagacggaagacatgccttcgaaagagagcctgcttctcaggtttgtcgtgaacatttactcaagagaagacgctgaaaattcgatcacaagctgccggtcaaatgtggtctccttgaaagacacttcatttcacgctggtcttttgagctagtcttttgaacctttatcggactcggcgctcgaatggttgtcaagctgggcaagaaacccagagagcggttgggagagaacttctagttcgatcggattgtcgaacgccgctctgaaagggaggtcgcaggccctttgcggagcgtctctgtgttcagaagataaagcagacacgaacgacgagaaggcgcgaaacgcacggagcggtcgaggcgcgaccctcgcctctcaacaaacgtgaagcgtcctcgctatgatttccctttgctctgaacaccttgtaggtggcgattaaagagccttctctcgaagatatagaggtgaaaaggcctttctggcagtgaggcgtggattgtttcagaagtctcatcgcaggtgtacactcggtctctgaaggggcttttctgccaacgcgagactttagacagtctactggtgggtcggcaccggggagaaaaaagggtcgagaggagcaagaaaacatcagaacgcattgacagagaagagagaggaaggaaaacccacggcagaagccaagatgaggactgtgtagccggtgtggatcgagaaagaaacgcacagagagaacccgacaggtccctcgcactgcagagggacggcggagctaagagcaaacagcggagattcctcagaagaccgcaacgacaacaaagaaagttaagaaatggaagaaaagttgtctggctggcgtccggatgcgaatgcggtaagcagggaaagtcctgctggagacaggaacggtagctgggacggtcccggcggaaaagtggaatttttaaacagctgattccccgaaaaattccttttttgcgccgctttgcggcagacaataatgctcatttgaactataataaagaaagtagatgcattttacgagatcttggcgcgtgcactgctgttgcaaatgggggctggcaccaagcgcacggagcgcgagggcaccccccagcttctgcgaagctccgagagagtgttcagggcgtggtattgtggcgacagagaggaattccttctctattccactccatgttgacacaggccggcagttaggaggccattcgctcctcagagaagggaactcgatgcggcaaaggctaacgagcaaccgagaacgttggtggagaagtcaaaaatctgtagggttccagttgacaaaattccaacatctaacgagacaagctggttgacggttttggacgaaattactttccacagcgcataacgagcctcaaaattacgttcaagatttaccgcgatgtgagaaacgttcgaaagaagtctgtcaagctggaaatgtgttcgtttcatgatatgcattaggaaaactcaaacctgttccttgtgactggagtttcacacgctgtgcgtagtaacaccgaggaagccacttcgtatctgcgtagagtgacgggacacaaacccaacctgctatagtcagcaatatcttggaggagtgtttcttcgcagagagttgtcaatctagcatgcgaaatggaagtgttccatgaagtctacctggaagaaggggcttgacacgaatgtcgcaagtgcacacttagaagtcgcagcagtacctgcgagcaccggaccgttgtcgagttctcgacattttctggaggaggcaaaggggataccgcactctgcttcatctgttgctcatcaggagtgatcaaagtgagctttgtatcgggtttctcggcggctagtgtgaggctgaagccgagaacgcaaggaaaacgaacaatgattgatttgggtcaaacgcggaaaaaacagttctgcatcaccaacggttcagtttcagcaaaacagggaagccaacgatgagggtgctgcctgatctaagacacctaaaatttacaaggcatctctttgtggtacttccttggtaacatggtttactttcgaccggacaaacactactagtgaacaggagtggagaggggcacgatgggtgtgtcgcgctgtctgtccacgagaaaaaccactcatgtgtctttgtttcctgcagagacggacagttttacgtggcagggaaaaggatctacctcagagtcaataagacgcgacatgtctttcatccgtgggcgcttggcccaagccgtagcgtcccggtagtgaacgcggtatgtgctgctgatttttcgcccgggtggcctacgattttccatgtgtctttcaacgcgaaaaaggccgtggaatcagtcgcttctcttgggaacctgcaaaacaaaaaaaaataacggaacagccccacagtgaagaaacactagaaaagggcgcgcacggaattgaaccatgaacctgccgatctgcagtcggccgctctaccattgagctacacaccctgtcgaccagctaacgagttagcttgcttctttccagaagaccgcgacagaggtgaggcagtctcatcctgtaactggcaaaccagacaacaaattaacccacagaagtccgattctcaagcgtctgagaagggcgcgcacggaattgaaccatgaacctgccgatctgcagtcggccgctctaccattgagctacacaccctgtcgaccagctaacgagttagcttgcttctttccagaagatcgagacagaggtatggcatccgctcatcctgtaactggcaaaccggacaacaaattaacccgcagaacccccattctcaaacgtctgagaagggcgcgcacggaattgaaccatgaacctgccgatctgcagtcggccgctctaccattgagctacacaccctgtcgacgagctaacgagttagccacgcgaagtgcatcttcagcttaaattggtaattcattgatataattatcgtccgcacgtactttaagcagatgcagggacacgaacggaacgaacgtgcgcatctatgggtttcaaaacttcatatcgccggatacaatgatcacgtatgctgtgaaaggaaaaaccaaacgcttttttgactcacactcagtaaaacaccgcagaaatcccggtgagtcggcacacattcggtctgggtcaccgggatgcctgctgtatcagaaaagacgccaagcatgcttcatggaatcggacgggtcgcccggcccctctcgcactcatgtcgagaaggtgtgggccagacaaatccgtagactcatcgctctcgcgcactcattcacgagtaatgtgaagcacatttctttcggctgtacacaaggaactcggcaccgcgacgaaatttctaaaggatgtggagttgttacgcatctaaccaggaaatttgcttacaagcagctgtttgcttcgctcccgtgggctttagtaagttaaaattaaaacgtatccgagtgtcatgttcacctggacgtccaaagaaccagcagagatgctcgtatactttccactatcttcgcaggatatgagcaggttcggcttcggatcgttgcagcagtctaaaagaaaaagtcgcgcgccagaagggtcagactgggtgggtttttgagctgtgttttgacagaaaccggacaagcgggtctgtttctcgtagaaggacatcgaataccacccccggctccctttccggtctgcatcagcagattgtggctgaagggtcgacttgcagttgccattgagtgttgcttgtagactcgttcatcaggaattgcgaactctcgcaaatgtcgaaatttgatgttttaggaagggatttgacaacgtaatcacgatatctgaaacgcaaactcttcagctgcatctgcctgtacttgctagcacaacggagagtctcctgtgatataccgtggtcgattcatctagtcgtaacttccaatcgactagtcaccctgatgtgagccgggcctagctcgaggcgtcgacgcagtcgctcctgagtgcaatcattcacctcgatcatttctaatacagaaagcttctgcaattgtacaccaccacttccattctggaacctagattatcgcgatgttccatttcccgcgttttcatcgagaaaagacaccctgttccaatgtaaaccgcaactattagatgggatccgatcggaaaggatttcaattataggtaccaccggccgcataaggtcttccaccctttggccagccagcagaagtcgagctgcactgaatccggggggtttcttggttgtctgttcgccgaattcgttttggttgctgggtacacggcggctcttcagtttcaggatttgaagggccggatatctttctgacgaccgcgcgcagttggcatctgtgaggaggtgacatgacagaggaacagaaaactgtcaacggtcagcgagcctttcctgtgactttgctggccccccaagaacgataagaaccacaggcattccccgctcggggcgtggcacactcgaagctcgagactgtgctcgaagaaagcccaccgcaggtgtggagtttcgctcctttctgacactcgcgagtcgttttattggattgttgaaaaactagcgacaaaacagattccaaattacctccagtgtcgagcagcctgctgca

SEQ ID NO: 793 - DNA, 4322 bp, Toxoplasma gondii
tcttttgttacgagcagggaaactggaaggccagtggatcacctttgttgctggcttattactagtctccgaggcggtactgaaactgttttgtcactatgttgctatacatggacggatcgaagaagatccaagcctgtgcgatcaagacgtctaagtacaatgccttcgcatatcgccgaacgtcaaatagcagtctttgacttgtcgcaaaaggtcaacaccacggacgagcaacacggcgtggcatcgaccacactgcgagatgcgttcagttagagacagaaactccaggtttgcactgaggtccatgagataaatgttcgaggacatgcaaggcgcctcttcctgcatactcatcatgcatgctgcagctgctctacagcagccgcacagtttgtggcttgtgatgtgcttcgtcgacctgaacacagagggaagggacagaacatattatactgtttccaatacacagacaaaacttcgtgacaagtgagacaaagacccgttgcggctgtcagtaatgcacatcttcagaagtggcatttccaaggttccaagaaaaatgcacatatttgcgcctgctccgaatcaaactacgtcgtggcaaatctggtgtaatatagttcctctagcttccgcctgctccgcttccgtacatctatttgcaaccctgtaatgcatcaaacaatcactggcggtatattacagtctctaaaaagttgcgtgcacgtgcacgtattgtatatgcatgggtttttgatagtgcttgtcgttactgttgttttgcccattttatcgctgtcagaaaccggcttattgcacaaggccttctgaacctgacaggcccacataactaacgttggaccgtgatgcctaggcggtacttcttgggagtaatcgtacaattgtgcgtttcattgtgtgaagaatgcaccgtgattattctaacatctgtggatttgttcgtgaccccatcaacagtcgttcgagccggtgaggcaaacggttgtgtgccgcttctaggagccagaaaggaccaagccattacaagttttgcgaacagtacaagggggctttagatccattgcagctgcccgatcacccggattccgtaccgtcacaagccacgtctgtgaccgtgtattttttttctgctcgagaaactcaacagcagacacgccttgcatcgtggtcacgacgctccgttcacaggctttcagcaacacaaagagaatcaggtgtccatacactcgtcagattttgctgctcccaggcatcacaggttcgtccttctggtgcttaagggtgccgcaacgacagagtgttactcttgtactctcgtatcgattttgaagatgcgattcaccgcgattttgattttgagcgtctcctttatggcgtatggccgcagtcaaaatatatcacccggcaaccatgtgaagcacgacaagcaagcggctcagcgtttccgggtaagaggcgcgctttcaacagtgtgggtactcattctaatactgaaaatggatgcaggcaatggtggggagaatcaggagcgtaagcagtctcattggatatctttatctttctgagacaatccccttcgcacgatcaggcaacaccgctcacggtcaacagtccacggcaagtgcaaaaagtgtcagacatccaggctggagagtcgctagccacttcaacagaagcggcagcgaggattcacaagtcaccagagtgtaaggtaggaacctgtggtggcagtgcagccgcagtttttttaaatcctccaccagcatagtggcttacacagtgccaccgtcccgcaggtgagagtggaaaccgcgtcacatgtcacggaacctgtcgtatgaccccatgtgtcttcccagttccggaaggcgaggttcactcaggctcccgcggtaaggtttccttccatccaaaacataaaattcggtaacattatccgtctcagattgctcctacgtccggtcctgagattagtgcgcgacgtgttaaaagacacaaggtaggagacttccgtcaacgattcagggaagtatcctatttctcttttcaagttaccacctaagactatgggagacctagaggacgaagaaattgctgccgaactgggttcgaacgtcactagacgaaagcatatcgcggcgccagagtttgtgtatgcggcacccggcgctgaagaagtcctttctgctccagcttcgccaagaacctccgcggttccgtctcctgcaacagttgccccgtctgaagctgattcacaaggggtaataactcaaaactttagcagcacgatttttttacgagctctacctctagggtctcgtgataaatgtgataacaggtgaataccttctacggcaatggtaaatcgtccctgttccacaaaaaactccaacggaaaaccaggccaagccccccaaccagcgacagtggaggcgcagcccacatcagcggcggtaaaacaaaactcttcgtcagcgagactcctcaatgcttaacaacacgaacagatgccagaagccatgcctgcgcctgagacccctccaccttccccagagattcctgatcgcgcggcggaacagggtcctgtctcgtttgctccatcgtccccagtaagccctaccgttaccctaacagcgatttctatgaactcctttcccaggctgacctcacacctattgtggaggccatccggcaactagagggcaaagtttccctggcagcgcctgtcgcacctgcgatagcgcaacaaaaggtggcctctccagccgagcctgcggcggtgccagtgaatatagaaaacaataactgcggttgtggaggtgataaaaagtccaaagtttacaaaaatcagcacacagcttttgggtgaatgcaggagactcctcggactccacatgaggggacgctgcagggcaatcggtaacaattcttttccaggcagcaacgtcgaaggtggtcaacgtaaaggggctcccaacatttgtgttatccactgcattctctcatcagtcgaagaaacactgttgatcctcatcactgggaaatgtgtgttgctggcgcgtgaccaggccggcttccattttgagctcaacctcattcacgagtgtagcggcaactgactgaattaccaatacggtgtattcattatttggactgcaatgttgctccttcacgcattacagttcttgcatgtcgaagtactgcgtggccttcgccccacaacgacttagatccggaaacgatcatcgcgagagtctcatggagttcagcgcttcagctagtattgcccttctaatgcagaccaaatatcatactgagcccaccagtagctgcgtcggtgggagcgttgcctttcacagcatcggaaatccacacttcccctgtcgtatgcatgtgcttatgtgccccctagacggtgcctaaggggatcgaatagagatgatctcccagtccagttagtgaggttgacgacaaattttcgatacaagtgttgatctcaatgctctttggcaagatatcacacaacgcatagccactggtgaacccgggatttcgttgaaagggaaaaaacaaaaacattcggggtctctgatggacgtgaagtgactgcacgcaacctatgctaaaagagaacgtggttcccattttgtagtctaaccgagctgtaggcgccgaatcatcccgagaccttaaacagactgatagctaagagccagatgtttgatctactttcgcgtacgattgatgctgcatctgctaccgcatgcagagttcttgattcggctcatctcgattcactgtaccagtgacgaaattcctcaggtcacattcacttttcttggcggcttctcgctccctcgtttgtctttcttcgagaaatgcatcttagaatgacaaagcgatgtccccttcgtcgtcacggtggcttgatcatggcttttctccacatttttcccaatttttgactcgatgaaggcgcatgcaaaccgggaatccgacacttaactcagcttactggtgtagatgttccgttgaaaaaaccttccgggaagtcataagtgctgcatactcttgttttgcagtgctagagtaggggtgtgaagcctaaagtgacctactggcgaaacacatgcaagggaaagctccttttttccatccttctgccgcatgttaggtagcgcaggatccctcagtcctggtgaggcgttccgcaccagctgtttcttttaggataagcgcttattcttccgctttattctgggtgctgccccttcggattcattcgctcttctcca

SEQ ID NO: 794 - DNA, 1789 bp, Toxoplasma gondii
aagaaggagatagaaggtgagcagaggacgcgcccaaggtccagacgcctctctgagaccagcgggcagcgcggcgagaagaagaaagagaggacgcagcaaaaaggcatccagagcgagaagaagcaagtggaagagaagaagcgagacgagagggcgcggacgcaaaactggaagaagaaagagacgccgcagagtctgtgtggggaagttgtctcgcgggagcgacaagcgaaggcgcccctgacgcagataacgcccgagaaaaaggaaaggaaacacgaatcacgtatgttgaagccattatcgagacaaaaaagcaacaaggctgaagacttcagacgatacagatctggatttgcaacagtccaaatccagacttctcttgttcaacgagggtacacaaaatgccgccgcacaactctgggagatggccgccgggcaaaatctctggggcagacgacgtggaaaagagagagaacgaagcgaacgccacaagcgaaggagaagaagaaagtgaaagaagaagtggacctgtccgcgtttttgctttgacggcagcgagagatcggtcaaagagagaggccccgcgcttgcttccgctgcgagagaagaacctctggagaaacctctctttttcctctctgttttccttgtcttttgaatccctcagtttgccttgtctcctcctttcgcatgggatctctgaactgcggaaggcgcctggcccgagaagctccagcgaatttcgcagggagacgacggcgactgcagactgctgccaagcgacgactagggcagagaactgcgagagagaaaggggaaggctggaggaaagcaaaaagacaaagaccgagaagaaatcaagagaaaagcacgaaaactctccgtgagagacgggaggagaacagcgtccgtctgcctctcgcgtcgcggaaatgcttgctgagagaggaacgccgcgtccggaggtcgtcggtttccaagcctctccttttgcctctgaagcgtttcaaaaaaatctcgagcaatctgagagacacaggaaaggcaacgaatgcgttttgactctcggaaagccgtcgccgaggccgaaaaggagactgcatgcatgcgaaggagccccaggctcagtgaacaaccccactgtctccagcgagacactggttcgcgaaaacgagcggctggagggcgacgcgggcctttctcttctcgatctttcctctcttctctctttctccaccgaaacgctgcgtgaaagaggtctcacggggtgttcagaggaaggctgtttccccaaccaactcctacacagagaatgagagaaacagctgcgagagacggaacagaaagagacagcgacgaggagacatggcacgaagtgaacgatcgtgagcgaggagacaagcgagagaaaataagcgaggaaaagctggaaaggcctccttcgtctctgctctcgcgatggtcagaggtgaaagcgaggcaaagaaacagacgagagcgagaagggaactctacatgccagtgtgcttttcgttgacggagtttgtctctgtctcgagggacctccgttcttctcgataaacctgtaccaagagatcttctccattgagctcgtgctatcgcctctcttcaccttctcttcagcattcgttcgcgagtccgtggctggagatccgcggtgtctctcgcatactttgcactttcctctcctcgtttcgtttcttctctcctctttcacaccatcaatattctctctccgcaccattcgctcctcaagacacca

SEQ ID NO: 795 - DNA, 4741 bp, Toxoplasma gondii
actgaaaatgcatcaacggaagagacacaaaaggacgcctgctttgccaggaagaaccataaaaattcgaatgagagaaacgttgtgaagggaactgggcgcaaaccagcaaggatgaaacgaaaaagcctacggggagtggacaaggcacaaaggagacgatgaacccacgcaacgcattgacatagatgtcgcagtattgtgacctgtggggaggaaagtggttgagccgaggcagtgttgaaaatgaacttgcaggtaaacagagagtcgctgttgctacttgatacaggcgggcagagacccgtgggagagttcgatgaataaccagacgtaggcgcatgtgcccgcagattcgcagagataacaaactggaattaaccggtgaatggatcaactcgcaaagaaactgagtgaagagtgacaaatagtgtctaatcgaaataggcacatggagaaaatgttcataactcaaccagaaagttcccaatatgtgtagatgaaaggtgcctgggtagaatggactccaaagaacgttcatgaaatgacgtacgaggctcgaaggttgtagcacacggagacgccatggttgcgtccgatttcgtcctgaaattctctacggtaggtccgctgttgacagacgatggaagaggggaagaggctgaaccgtttggagtacgcaggaaagagagccctcttgaaacgacagacagtcgcgaagaaaagcgggcagatggtcgatacttcagcagccgtggcgctgcactctttgacgccgaaatgacagctaaggaggccgatgatcgcgctgaatacctgggcagaacccactgggacgaagaaaccaacccttgtgaagaaggaaaagaagtcctttggtctcctgggattctaaaaaacttcaactggtgagcttgagaggaccggaagcgaaactcagggattaaacagatggcagcggttgccgggttgcgaaacgacgttcgtggcagcagcagaaccatgaggggttttttcccttagacgatctgtcaaaagcagcgaggaatcaagaaacaaaggactcgcggcaggaaacgaagaagagtgtaaaatgaggaaaagtgtcgattcggccaatcggccgttgagtgtgacatgcaagacaactagtgcttgcgtttccagcgcatgctgccagtcgacggacatatacggcaacgccggcacagccagcaccgagaaacacgaagaaaatggtgcgtagaaaaaattagcgaaagaacttctcaaatcctgagcagacgatcaaaccagaagtgtccagcccaaaagagaagcggattctgtggaggttggctggtcaacggccgcgtttcgacacatccaactctgagggtacccttttcaggtttggttcttgtgatgcgaacaacaacaagctcaggagaaaggctttagatccgctcatagaagcgattgaatacaaaggaaagcttcttagtccttcgataaaatgacaaagcgtgctatgtggggcggtacctccgtgcatgcgacagtctggcgcatccgaaagagacacactacacataagaatctgtctgtttgtatagtcttctctatgtgtgtaggaagtcggcacacattttttgcagggctgtacctttttctgtgtgatgaaaaaagtatgtgccacgtggcttctcgcacaaacgctgaaacacaggaactcctgtgaagtcacacgtgaagcgcctaccacaatgcggcgtggcaagccgacaaatacggacgtgaaagggcgaattgttgcaagaaatagtcggcaatatttagtgtggactgataaagacgggaatccgtgccaaactagcccaaatgcaaaggacgcaaatgacaggtgtgtttgctgccaaaagcctcgcagcacaacagctgtagactttgtgaatcagctcgacccgcccgtacaaaggacagttcatgatatcgctgaagaactctggtggacagaagatctccagtattctataggtcctcaatagttgttcggcttttcatagtgttgcgaaaccgccatacgacgtgcttgttgacctcaaacgacaaaaggggttgtagaatatcgcggtaccgccagagttcgaatgtcttgcctcccacgactacgcgtccagacgcctagtgctaagtggaacgggaacagtttacagatactgcacatatgaaccggtaatgataaagtgccctgtagtaaaaccaagggaacggaaaggctgtcattttcttcgggacaaaagcgcctataaaactagagatgacaatcagtcagacgcatctctgattaatgcgtcttaggctggaactaaccgacagaaagaaataactcggaaaagtgctttggctctttggagttggtatgtcagtggcggatatgatgcattttgtgcaggtcatcagtatcgtgcaagggttacatgcgaggaaacggtgattgttaactgtatcgcacgacgtcgtccccagttaactggtgctcggctcgcaggagactgccatgacggtgagggaaaaatgagcgcttaccaggcaaaaaccttcaaacggtcctcagcgctgcagcatcatcattttcgcaagcccataaatttaacaagcacgtcttccaaacgaaagcacgacggcggcaaccatagagcaatgtgcacacaagctatcgtgggttggcaacgatgtgagacggttcgttcgaatactggcttcgtcttcgcgcacataacgtgtctccgaggagtcaaaaccgctcccaccgctgacgaggcaagatcgacggtttattgattggggggtggttggttctttcctccgtacgcccgataacggatgtaatgtcaaggattcaaaagcgccaggaggaaactgctccggagttgccttggctggccaatcaaaaagcgtcagtccctgattcttgtcgattccgttcgcagagtccggatgccatggacgcatggcggccgacaatgctcgtagcggataatggaacacggggtcaagtgtcccacggggtatgtacacctcagcatagtggattgatcgacaatttttaaccctttctaaatcagaactacgtcaactaccgtcttgaataaccgtacgattcatgaagtgaatcacagaaccccggatctcaagaactcttttcacgggcacttctaaaatgcctgtttctgccgcagagggaacacctccctcgaacatcttttctgccatacggcagcagcgtggttagcccccgggatccaaccatcaagacggtgacgtacgacgaccagcaaaaacgctcccgctgcccttctcctggagaagcccgccatgtttctctcaagcggctggcatcctctcggacggtcgtgtccggtgcttccgtcccccaaagcgactgcctctgaccaacaggcacaggttccctcattcgtctgccgtgtcgacgaaggggaactcaatttggagccggcggccgcgccaaccgaccgcgtcgcctgtagaggtacgacacgtgacgccacggtgtgccgccacgatgcgcatcaaggggacatttgctcgacgccgactgcggcaagcgaggacatcggctcggagtgtgattggactgatgacgacgcagcagttgttccgtcgctgtggagcggtttcgacgacgaagcgcttattctacaatcaacgagtgccgccatcgcccccctctcgcgtaaaggcacaggcaatgaaagcgcgaccaaatgtgtgcccttgctgctctcctgagaaccggtagtccttccctcctcgctcagtcgaatcgacgaagaggggaactccatacggagacggagagcctgtgcaggtgtggactacagtgcatatgcgcaccgcgagaagcgacgacccttgaggagaaaacagctgacgcacgatgtctttgctggaaactggatgcgggaagcgaggtgatcgactcggagttggagaatgccgattgcgaagcagtggtcgtccgcctgcttcccgggctctgtcgatgatgtcgcacaggggcctcctaaagcgtcgcgtgctgtgcggcaagtgtcaaaagcgctctccgaggtcaccctctgattgtctcagatctgaagtggatagagtcaagcgacgagtttgactgtgagtccgaaatatcatcgaagaggcagtgcttgtttccttgttttttagccgagttggcacagtattggagttggacaggggcggtgacctcgtttatgaaagtcagcgggcgaagcagacaatgaagaagacgcgtggtcagaaacagggtccgaaggagacgcaaacggacctccgaggaatggcaaggtcttcactcaagccgacgaagatggccagagtttcgaaggagaccttactagtgcgaaccgcgtcgcgtcgacgcaggcagtcgaagacttctctggagatgaatgggagattccagaggagacttcgccagcagagaggatgtcggcgaggacaccaacccctcccggcggaacaccgggagactgctgcggagatggaaatgaggaaaaaatcttcggtcgattcgcagccctccacgcgaaggagcaagccgtgtgttaacctctgactcaggtgcccagagacatgcaggcgcctcctttggagcagtcggtccaagcgccgaagctgccgcagcggtcctgaagccaacctccagccaagctaccaccggaaa

SEQ ID NO: 796 - DNA, 3665 bp, Toxoplasma gondii
ttctctgcgatatcacagtattgacgtgttttggtcctctttcatcggcattctccgtcgccagcaacatagacacgattccagttctgctgtccatatggtaccttttcagtcagtcgcctccttggcttgactcagcaaggggcggctgagacggcaccttttccatcacctccaaaatgttttccaacagctgaatttcatttgcgtttttcgacaactcagcccagtgttcttgcatgaccacctcgttcaaaatcaagatgacctctgcctggcatattgcttcgtcattgttctttacaatctgcgcgttctggtccaacatggtcttcatcttccttactgcgcactcccatagtcggctggcgtcttcgaccttcttaaggtcatcctcaattaaacgggacacatcccgaaaaacacaggcagcccctccaacaaatcgcagcgcctcgcttgcctccgccatggtgtccttagtatggtcgcttctgtctggcacacgttcgcaaatctcttcgcgcattttgatgcgatgtctaacccgtgcaaacttcgaaccttccaccaggaatgaatgcacgtagtgaaattcaattctgaacaccttcgaagcagataggcggtctgcctaaggaaaactgctctataactgcgtcacctccggtttccacaactcggattggtcttccctcacacataccacgtgcttctggctccgaaaaagatttggatctcccctcattcaacagaactgttgcatgagcgtagaagagtgactggaatacgctgcttgtcttaacgtgaccaagccctctcgtaagggcagatatctaccacgggaagtcgttctctaatgcaagcgtctgttcttggccacccctatcagcatcggttttcacccaccacacaaaaatttctgcgagcctcctctcttgcttaaaattcacgagaccgaagggaaaaatcatgcactacgggacgtctcgcaaggaacgcaagaaggtagaaaggaaactggtcgcatcgctgaacttccctcgtcgcaaacccaggctacgtcattctggacatgcacaagggacagagtgtgggcttgcacagcagaacgatcgactgcggcttatcacaaaaaagtattccaagcatacaatatggtgaaattatctgttgtaatctaccaccagcgccaatccacaaacaagtcgaagcgccacgtggaagacgctgagggcgccaagcttcttcccatggttgatgggaagaggaaaaacgttaaagccacaatgcgaatggaacttgtcacagcctttgcacactttccgttcacgaaaaccaaacaccaaacggcaaccacgccattcctatacactatagcattggatggtgtggtggaacagagtcttgaaaaacgcgactgtgataaacgcttcccactgtggcaggtgtccccgtaggacaggcaccggtgtcgcccgcagctggggtggacacggtagtgccgctatgatcgtgactgaatcgtcgcggagtttaccttgcgtctctattgcgaaagtcttttaggagtgccttgagggtgctagcgaagctccatcttcccacgagactacgtaacagtccgtatcggctgctgagtttccgattagttttccatctggtatcttcagatgccagtacacaagatccactctgcttagcttgcgatgcagtgtggtttgcaaattacgaagtggctgccgtgtttgcagcggcagccgcacggctggcactgagccttatgccctctcgcttgtcagatctaacacgtgacggaagttgaaggaagggaaccaggagagacgttacgaggttccaccatgtacacgcttgtagtggttggttttgtaagggcagtatgcagtgggtactagtcggactgtgtgaggtccgttggcacggagcgctcacttgctgcagcacgacacaggcttgtggtagttctcgtgtgacgtgccgggagagcgggagggctaccttctttacttcttcacttgtataaaagacattccgacgttgcctgatccacacacgcgcttacatgtcaagaaacagggggtcacctggcatagttaaacttgcactcggggcgaatgtagtttctctcacgacagtcactgtgtccgaatcacactgtaagtttctctttggtcacgagttcatcggcctagtggacactggattgcttgaagtaaggtacattccttttaagcagtcagaaatccacttgcaagcgaattttgttgtaacgcgcgagagtcttcttttggtgctatgatgttgcagtgttaaggcggagggagtcggtattcggggaattccacaatgtcggccatctttaccggcgagacgtgtggtccagttccaatgcacatcagcactttcatcgcacgcccccgtcaacacactaaccgcaagctacagctttcagtttagaccccttcagtatctaaacagggtcagaaacctgatgttcagctgcatgaagtttcgggtgggggggaattatgctggaggaggatgtaagttcagttcgatggaaaggaagagcaggcgaaattcggctccggctacaaataacaattttcgcagaaacggtggtgcactacgctgcgatcgtatgggagagaaccgtgcaacacccaacactgtcattagctttacctctcttcttgtgaccgtacccgatcgctggcgtgcagaaggcggacagacaaggggggatgagagatggcaacgtcagctacacacacacacacacaattttctagaggcatttttggttcatagagtgctgacgttatttcgaattgaaggaaacaccgcccgtgtggcctcagatagggatggaatagatccagacgagacatgatacgataccggggcgcgtccctgctcccgaatccaaaatacggcagaaatgttgttttttattcataatgctgggttgcatccaacagcaacagtgaccgcggcatggcgatgaaactctcgtaaaaggttgaacgtattgcagctgcacgttgtacgtgggggggcttatggtgacgaaacagcttttgtagcgtcataacagcacaggcgaaacacgctaaccaaaaacaagccgggttttctcagtgatgcattcacggatcgaatattcatttcgtgtagcaaactcaccagtgcacctttttgcatactccacggctcaaaatttgttgagctttttggctgttctaaatcattgctaaagtgcctctgagacgttttcgtctttgtggtcggtgacgcatcagctgccgcctccattacgacactttcctgcgtctggccaccggatgcatggcagttgaaaagcagttgtcctttgtatgaacgcgaatcacccgccttgatgcttattatttcaaccatagcatggaagaagccgtactttgggggctgggtggaattacatcgcctaccagtgacacgtgaaccgatatgccggtttcaacataacgttatcctggttactcttccatagaagagcctactgtgtaaagtgttggcccaaaagagtagcgattaacgctcttcatggaactgtacactgaatagagacaacatatagtagttcggttggtgttgggcatcaa

SEQ ID NO: 797 - DNA, 2138 bp, Toxoplasma gondii
gtgacatccaacgaatgaaataagtgttgatggcgctactgtctgctgacaactgcgcgtgacaaattcgggaggctttgcgagaagggaactgcggcaccctatcaatagtccatgttgtaggttggcttgatgcgctaaccggtgtggatgaagtcgggcacacgcccagtgattcggatcgttatcggcttgtcttacagcaatagtatctgtgaacgaatggccggttgttttccgccttgtggtgtaccatccggaaactgcatgtctggaggtgcaagccagaaaggcatgtctttatgatagagcacattcggcttccgacgtcatttaatgtcacatagtcttcagcacatttgtgcgtccgcccaacggcgtgtaaggtgccccttgggaaggctttagggtctgggagtcgtcagctgtttttctttcctcactctccgaggacggtaaaacataataaatgcagtggttcgatatgcagccatgaacgagatgatacacctttgaacgtcaggatcaaacgaggaacacaccaggtgacgcattgttagtacctggcgcatgcgttgaaacttgcgtcctgtgtgcctacagcgacattcgaagcgggacgtgcccggtgttccccctcagttgtttcttcgttcttctgctctcagctacggccgcctggttggccttgctgactcgtatgcacttgctcgagcgataatgatgagaccgaatcaatctctacggcttttgtggtgttcatgcaagagcgctgagaatacccgtggtactggcagccccttcttgcgcgtagaggacggaagacggaacaccgtgagttatccttgttttcatgcaagagacaatgaaggtgcggtggtaagaaaagggttgacacaaccatgccagtagcgcggttacatatcgaagggctaatgatggacgttgcaaggtcaaaagacggcgtgcttattgctccagtggcacagttggaatccgtggcgtatcgggaggtgttcccgggaagactgaattagttcacttgagcgaaggacctgttcattttctgcaccagctgagaaaaaatccttgctgcgtcgatgtgcaaaactaaaacagtcttcgttaaaaaccgtccgagtgttcgttcgtcaggagtgtagcgaccgcactgtgtcgtctgtcgcgcgttttgacgggcagctgttgacagaaaaaaaatcatttcactacatcggtcgacgaatttaaacaaaagatatgtaggaactttggctccacatatcgccaattttgaatgtttttaatcgtacttttccggaaattgtgctattttattgtcgagtttctcaaagatatttacgtcgtgctgctgatacgttatagttcttagtgacatcactttttgcatgggcataagcaacaccaatttcgcagcagaaatgtaagtccaattctgaaataaatttattatattaccacggtagtcagcggcggatgaccttatttacactccgctgtgagaaagttcatcatcaactcgcaatggttgccgcgagttggaggctttcgaccagatgcaccgaaacagattcacaaacacagaactgctctaaatatgctttcgtgtatccctatcccattggccgtgagctggcttccctaccgtgttgactgggactcgttgtaacgcttaggctgactggatcgatgagtgaggtcgcgtttccacacgaagacacgtccgggtgtaccatcttctgcagctccctccggcatataccagcttgtgtactgcaaggagaaatttaacacgacattatttgcaaaagaggagagggttccatagatgtcggtatggtggtgaccagcatcttattagtgagactgacgacgatgggagctgatctgcttctatgacgaggtagtccatcaaaggcaaaaatctcagtacttccttcggcgccgtggcacagttgcactccctgtaggacgcgccgcgagtggctaccactgtgccgctgttttggcccccgacctcatggtgctggtggaggaatcatgctcgaaagtaattctgtcagacgcctgacacttgcccatctttgcgtaatcgtgtcaagtgagactctcagaga

SEQ ID NO: 798 - DNA, 2289 bp, Toxoplasma gondii
ctgcgtcgttcgatgaaagaaacgcggcatgcccatgtctgcttcctcgcttcctctcttctcccgcgcttcctctcgtctttcctctccacttgcgcggcgcgtagagccgccatacgcactcccgagagcagaagacatgctcccgtgtgaggaccgcctctgaggagcccccgaacctcccgtcgtctccggagaagcgtctccttccgcttcttctttccctgtcccgtcatcttctccttctcccggctccctctcttctccgccgtccctaccttcggttgtttccatcttttcttcctcttgtgtgtatccgtccagtcggtttcggcgactctgctcgagccgcagcagcgccgcgggcgccagctgtcggcgcagagcggcgaagggggctaggatatcggcgcgtcgtgtctcaggaaaagcgaaactctgaggagaggatcctcgccttctcaccgatgccttccgcttctgcagagaggacgcaaacgaagagaacgacgccagttgatcttgtcctcctccagcaacgctaccgattccaggaatgagtccgaggcgccggcgcacagagaaattcctgagaaaccaagcgcctcttccaggctggggaatatcagaagactcgagaattcgctggccaccttgatttcttctttcctctttcctcggtctctctctcccttcgcctgtccaggggtccttggcttctccgttctccatccatctacatctctcttcttgcctcatgttgaactttccttctctctcttcttgtctcatgttgaactttccttctctctcttcttgcctcatgttgaactttccttctctctcttcttccctcaccttgaaccttccttccctgtcttcctcctctcccctgttctccagccaattgccccccgccgccatgatgagaggcgacggccaagagcagaggaggacgtccccgtttgctgagcgaacgacctctgacacaaggctacaccgttgtatagtctccctttacgctttcctttctctccgatttctgaggcgcagcttctctcgtctcctccctcgtcctttgcgcttccctctcaaggcgccaacgtcgacactcgtcctcgtctggagcttttcgagctgctgtcgcaggacgcggacagaggacagagaagcgcctggctggtaaccttgattccttctctttcttccctcgcttcgtccccgtgtcagaccacaacagtgcaactggagtttccgcgcttccactgaggagagtctcgctaaaaggagaagcgctcaaaacgggtgcggagagacaacggatgttgcagaaacgcattctgcatgcaagctggcaaaaatgcgagaaagaggaaggctccacgggcagaagcagaaaggcacggttagttttacaaaaaggaaaactgaaactctcgaatttccccgtcgagcgtctcgcctttcgtcggtacctgcatgtgcgacgacagttctttggcgggtgacgcagcaagacaagccaagggagaaaaaggcgcaaccagatgcagacagcgtcgccggcaaagacgagaacatgaaaggttgctactgacttggaggcagaaggatctcttcgcttctcgttttttttccttgtgctccgctcgttcaaattcactccagcggctttctacacggaacacactccacgttgcattctctcgctgcttctgtccgctgctgctgctgcattttccaccttctcacccctcagcctccatacagaattaaatgtagtcgcttgtatatcagagcgagtcgagttataaataggtgtacacttcggcatgcattgctcctgccctctctcccgtccctttctttgaaatgaacttcccttctcgccgttagtacgatttcaaactgcgaaaaaccactccgttcatgaaaatcacaagaacagtcactgattgtctctatgaaacctgatcaattcacctagccaacacgatccggcggtttgggaacatttcccttatcattgggcttcgcgcctctctcttccaagttttctcatcaatctcttcaaaacacgtcggtactttgtcagtaactctccttccttatcctcgccttcctactgcttcctcctcttcctttctcttccggctggtttccttcgccggtctctttcgttttctagactgcctttccttctctcttgtctcggattgggtgggtccccttctttctccgtccggcattttctgcgtttcctcgtttccccgatccttctcgccagca

SEQ ID NO: 799 - DNA, 3159 bp, Toxoplasma gondii
ttccaagtgtacaatggctgcgtctcagtagtaagactgactacagttcatgggggggggggggaggattgttgttattctcgtgtaacttcgtttatggaaacacgggcagcacttccggggtggtcttcgtggcaggcggagctgacaatgtgcgtggggcagtgcgtcacgcttgcttgactgaagtgccactggtggtatacacgacttttgggcgttgcttcgttttcagggcggtgaattattcaattcggtgcaacggcaggcgtttttcagcgaaggcaagaccgtggaagactttttgcagcgacgcagagcaagacggagaaagggggcggacgaagatgacatcctcgcgacaaatgccgagcaacgctgagagctgaaagagtcgcgagctgccaagacatttttacatgtcgcatgccaagcctctggcgtgacggatacacatcatgctttagaatagaacacaccagatttgtctcaggaatttggctagggctgcgcagaatatgcaacccagtaccagtcaactgagttaatcattgccccggagtcagtgcccaagacagagccgcggcgagcagactttctgtggcgggggccgagcctaccgcagtgaatccctgacacagcaccctgctaggggattttcgttttttaccaacacatcaacgtggagggtggaaatctcatgcaaccgggcgagaacggtacagtcgagataaagtgctgcgaaaggtttccaacctacacgttttttggagacttgtggtggttacaggtgtgctgtgaaccacagagaaagcggccgtagtggtaaaaccctaaatgtagcactgtcggcagctcttatcttcggtcaaggatgaccgcgaaaaaacagacttccgcggcagggacgatgcaacatttttagccaacggaatagcatgtactgttgaagttagcactcattcgctaggggtatcaactgtaggaatctacaacaaaggacgaaaaccaatcaaacggcacctgacaggtggagacgtctacccggagtgccagacagcactgacgcagacgatgatcgggaggatgcgggaacaggaccaaatttcgcaatactatgtggaagataactatgtggcccaatcaaacgcctcaggaagaagaatctgctgcatgcgaagacaagcgggaaggcaaaacgaggatatacccagaagaaggcggggaaaggcagcgtctgtgctttcgtagcgctatagtacctacgcttctgagtgtgattccagctgcgagatacagacaccgaagttcttcatggcaaattctaggatatgtattactggagatgagcacatgctcgctcgtaatcctcggatatgtgctaccatggggacaaatgagtttctcgggtgctacattttttatgaatgctgtcatgcctcttcagcttctggtggcactgtctggcgccggttcaggcgtccagttccgccctggtttagcgtgcgttataccttttctgctagccaagaagactgagcatatttcgtcagtccttcattacctcgcactcagtgacgctccacacatgtcgtctcgggagaaaaaaggatgctgtgctacgggccaaacgtgactttatggtgtcgcttattccacagcaagcagtagaggactgggcagctccccgaaaccgtttcccgatcctctctgatacacgaacccgccaacaactaggtggcatcaccctgttcacattgacctcatgttttcttctgtcttttccgtagtacgagtggacagctgatatgcttcccattcgcgcaacgctttactgagaccacagtgacttcgtgcccctgtcatacaaaagtagaaagagtggacattcagcgcaattgactttgcttgtgtcgaccgtgtacgaagaaaacgagttacatgtgtgccgcgtcaaggcgagtctgtaggacctcgcatagttggttctcctggctgcgatcctgctgagcatgagattcagtcgctaccctgatgatgaagcaggcaaatacacttctgtgagtgataaaagacgttgaacaaaaacgatcgtgttctagctatcaagagacgttcgttgtcgaaagctgttcagccccttctccgctcagttgactgtagccgaacccttgcgagtcatgtagtggaagtctcgggagcgtgcttgaccgatctatcgattgataccagtttatagggacaaagaacgactatgcgttgtcctgtttacgcgacctgcttatctagtgatcaggaatcgtgtctcgtcaaaagctctctgacagttttcgcatattaaacaaaggagcagggaggtagttggtgcgtcgccaaattcttgcgacgggcttgagaaaagattacacgcagttttcaggtgacaaaacaacacccctcgatacgccgaggacagccggtcagtccctcgtttccattgtgtttgttgcttagaagcaaaaacggcttcagctttcaacaacgcggcggtgggcagttggcgtctctttttgtgacgccagaaactcgttggtggtgaatagcttgtcggggacctatgggtcgcgtcgaaccagcggcgggtctgagacgctaaacaaatagagacagttgaaatgttggcttttgaatttctgggccatctttatgcaagtatgctttttccagttttcccaagaggcgcattttgcagctggctgtgttgtatctgcttgtgttaaaaataatgcagttcagaaactgatgtttgtgcggtcccgctcgtagaacgctcttcgggaacttttgcagttgacgtcttctcccgtccatttatttaccgtatggtcagtggcgaaatgtccacacagttttttcagattcatttggaagtttgtgggcgttcatttgttacctttacagaaaaggtaacaaccctgacctcctgttagcgacaccgttccgggcagtcacgcacccaccactgttcgctagatttgcatttggtttctaccccccattccgcatttgcagtgtcagcagtttggcctcctttcacaatcgctcacctcctatctcggggccgtgcgacgttctccggagctttgttgtcccttccttagaggaacgacagccacctga

SEQ ID NO: 800 - DNA, 1827 bp, Toxoplasma gondii
caacaaagtgcgtgaagtggtttaatgagtggagacaatgcgcctgggatcaggagaagatggtgaaaggatacaactacatcgaagacagaagggcccggaagcacaagccatacattggagcgcccgatctgcagtactcttagatcgtgtgtttctcatgaccagactgttgtttcgttttttgtgtttcggacatccgtcctctcctgcacagtgtttcgttctctatcagcctgctccaccggagaaacttggggaaaagccagtttcagctgaattgtcgtggagaggcgcgaaggttcggaaggcgcgctgcaataacaaggatccacaagagagagttcaaataggaatgatccgtgcatagctagtccattgtatgtttgctcccactggctccatggtataatgtggctcacgtccatgtgaacccacgctgctttcaccggggcgaaatcttcagtcgattttcctgcctaccccgacacgggtgcccacagtgggacacggtccgttaagcagctgacagaaaaaacatatgagaactgggtccaactgtacgagttcggattaaggtctcttcctgtgagtatgtgaacactgtacgcgtttcggcgtcgtctccaggaaactatgttttacttctttccagattacaacgaaatcttatcacgccggtctccaaagatcatctaggacgagcacattagaaattgttgcggtgtactgctgtagaaagattcttagtgttttttggtgtcgcttccgaagaagtggtcggtattgcaagtaacaacagcttctctccattctgttaatgccatctacccgtcgtattggcgaaatcgattcaaaatagatttttgtgtgaccacatccaaaagtaggcgctacgatacaacgcaacatgcctaacaagtcttcacgataggcgggtgaatgtttcgcgttgtcaatgctttgttcacagtttaggtttctgccggttttttgctttcgcaagagaaggccatagggagacgaaactccatactcttaaaactgctgttaatcattcacaatgtgaagacggcggggagatatggcattcctgcaaccctccgccgtgtctgtagcaggagtgtagccagaacacgcgcaacgagcacagagtatttgaccatcattgtgtttgtaaaatatctgatagcgtgcaggatgttgcaatttggagtctcggagtgttttcgatattcccaaagctacgaaagacgaatctcggcgctagtctcacgtttcgtggtagttgttcactttcgtgtctcgcactgcaaatcctgtcaggcgtagtttccgcagtagagaaaccaccgtagcacctaatccaagttcgtttcaagcagagtcccgtcggagcacgattaagcgcgttcactgccatctgttctagctcctcgaaccagccggcaatttggcaaacagcggcttgttcaacgatcacagcgatcgcttaagcgctgtgtggtgctgcctattcgctaagtgctcgcaaccagatgggtcgacacagaacgtcttgtgctcaatcagtggggcgatcatgcttgctttgcttcgtcagagagcctgttatgcgtaagacgatgcagtggtgtgtgtttggaaattatgggcagctaaaaagcaactcggaaaagcgatttgaattactagctctgttggcagtaacaccggtcgcacctgcagtttccctctttataggccgattgcaaatgagtagtctatcctgatttctgccgagttgacgcgagaggaaagtgcaacctaattttctgttcgttacta

SEQ ID NO: 801 - DNA, 1362 bp, Toxoplasma gondii
gccacatatccaacaagcatatgaacgacgtatatgaacgaaacacgaagcaatcgagtgagacgaccaaacgtgacatggaaacatcttgaagcgtccacgtgcttcctgggccctgagaccattttgattcgaacggggctggggaacttgccactgaaaccgtgccacgtctgcagcgagcgacccccgcaaactatgtttgccttcgctgacgtcggcgccatgtgcgaaacgggaaacgcagcgcaggaacagcatcacaatgcggcaaatcacggaactgccagagagaggcttcacgacgctgaggaggaaccgttccccgagtcaacccagacaattctggtactggcaactgtcaagcacatcggcatgcattcacacagaacgcgtcgttgatagacaccggcaatgttacacagtagagcggaagaaacctgagcagtggaaacaggcagcgtttcaacacgagtaggcgctgagcatgcaacctcgcaaccgctgtccacctgccgtctcccgaaacaggtcgccgcacacgccagaacctccgcgacaaaaaaacacaactgaacaacgggacaagagaaaatgctgcagtgtatgtacactctgtatcggcccgacgcagttgagggggtatgctaattgccgtcggccccgcatttctgacttcgtattgcccccagcagtcatccgctccagtcgcccgacaaaggtgcatcgccgaagtcctgggagagagatgcaccgcttacaggggccacagacacactcaataagctacagctccgaaagccatgcagttctacgcgacctgtcccgcctacgctgttgtgccgcaaccagaaaatgcagacgctgatgtcacgaaccgaaccaaggcaaattccaaccagaacacgcggtctcgatccaaaaaaacgggagcacccgacaactaaatccagttcagatccattggtagataaaaacaaaccagacggctgcgaatgctcgtgaattgccggagtctcttgtccccacaaaaaggggttctctgttgccgtcaattttgctgtcgaagccaccaaactgcgaaacaagtctgacgccactcacttgtaggctcccattttgtcgatccggaagagctcccgcaacaagagaagagaatctgccttcttttcactggattaaaaactcagggaagagagaagtaaccgcgagcctcgcggggcttctttccaaaacagtgggtcgtcctcccctcccagaaaaattggacacgctggcgcccgcggcaaccggaatataagccgattcgctttcctacttgcgcgcctttggaggtcccagctacgactacgcaaccgtgca

SEQ ID NO: 802 - DNA, 1787 bp, Toxoplasma gondii
gtgtcgtgagtgaaggaagataggcggcgatttttccaaagatatgaaattgaaaagcccgattttcgaaagaggcagggcaaacggttctgtccaggtagctgcatgcatcgacccaggaggctcccccttgctacgggaagtgagaacaaggttaaattatggccgtatgtggatctacgttgacacttctcggttagaggagttcaactctgatcgagcttacctccctcaggaagatgccatgcctcagtggaaagaagcgttacgcagaagacgcaaaaaaggacccttgacatcgccaggtaaccaccgaagctcgaattccgaaacagccttccgcccattgctgtcgctttcacccttttgagtggcattcgcagatgcacgtctacttcatcaatgtgtaaaacatctatttacctccgtatacatatgtgcgcatctggagtgagtttcagcgggcgcagacacgaatccacatgcatgcacagggcgtagtcgttcgcggcatcgggggaagaatgcgagtcatgaaatccgtctgccctccatttcacttctccctactttccatatgctcaaaagtgggtaactgacaaacattcgttcacatacgaatagacgtacacatacacacgcataagcatacatgtatacggatgtatacaaatatacctatatatatacattggcaggggagggtcatatgtccacgtgcctgtttgaagcttgtcgagtaaactaagaagagaaaaactggaacaaaagagcgaagtacaccaagcgccgaaacggttacttggcgtggttgagaagtcggcaggtgccgacgcgcaggagttagcttgggcgttccacctacgggacacagattctacttgcgacggggaaaacgcgcagagatttgcgttcgcattttcttttcaagcatcgaggttacacacggttacactttcacaaattttgaaggaaaccacggaaatacccatgataacagtttgcgcgtatcagtggacgccgactgcggaccggcagagacaagcggagacaagcgtctaggttcgtggacgcagtggaggatccgcaggttgtttgaaaacaggggaatttaaccgattttttcgtgtgcaaaggcagtctcttagggcacgctacagaagcgaacgaaagcaaaagcgtggtcgtcgtaccgcgctttagccgctgtgtcacggcggaaatctgacgcatgcagaaacggagacaccacgcaacggagggcggggtagcgaattgagtctctggctcgcaacgaggaagcactgttagtcgtctctagacgagaattatgtaccgacacaacgacacaacgatttcgatttgcattgacatttacacacccagttactggagggtattttgactacagaatgaaacagcgtctgcgcacgacgaaggacagcaaattcgtaggaggggaattgttgattttcagagcgattttaaggcgacaattatgcacaccttgtgaaaagacagtggaaatttctttcaaatccagtaaaagcgtctactaccatcggcacactcactcaagtaggcgttctgttgccagcctgaaaacagggctaaaaaggtatcaagggatcctcttggcgacgttaaaactttcacgcggtgcttcgttctctgtgcggatgtgagtgtctttaatgccttatgatattgaaattaagccttctgagctgttttccgcggttcagtgagcggcggtgtacagcaatcgtcaagaactcggccgtcta

SEQ ID NO: 803 - DNA, 2885 bp, Toxoplasma gondii
ccgagcgaaacggagagtgttgttgttgtcttctcgtgttcacgtttttcgattcatcggtggtttgtggttaacccgagctcttttttctgctcgacacgacgttgagaaacacaccagatgtgttcctctagatttgttaccacgcgatgctgttgggtgcaggccgagaactgccagacacatgtggatgtgaaaacgatcgttgcggttgtccagttcaattcttcatcagttcgtccctctaccggcaaaggctcactcgcagaaaaacctcgggcatggacagatgatcagtctgccgcgtggtcatacacgccggaccgtctgcccatgaaggcggttcttgacagagcagaagagagcgacgcatgtgggtgttaattatggataaatcgtattccggtacccctgcggatttagagctccgtggtaggtcacaatatgagtagcgaatttccaaggcgccccaggcgtgtgccgctgcaacgtttgcgcacatcgcattgcaaagtaggtcaccacagttctgaatgcgtattccacgttgcacagggggcctttcgaggtcttctgttcgtggtgttggcattgccatccgtgctggaacgcccacagtgacagcgcggacgatgtgtgacaggaggtgctgtgtttcgataaggtacagtggcagtagcttcttttcaggccgtgtaaaacgcgttaccgaagtacatttacaattcaacgagggcaaacaaaggtgctcccaatagacggtttactatactatcaatcagaaagacgaggggagcatgttccactttacgagtagagatggccatcaatgtgttcctgcccataacttacagcaacacacacggggtacatcagagaatgcctacactgcagtgagtcgtcagtgattcactgctgcttgacatctcgttctttgtgcccctaaacctagtgagaatgccggcgaacacggcaacgcttgggggtgaagttcctgcccgtttgtggcaaaatgtccacgggctttgaaaaacgttaacgaacttgtttcacgtagttgtcacaaggtacaatgaggctttctgggggaacaactctgtagcaagaacctgcacctgtcttcacttgacttgggctaccgctcgcttgtctgctgggctgcccagcggctcgattgcttaatggaagaggggctttgctgtctatgatttcgagactgaatgccactgttaagctgtacctttaagggtggtatgctgcttcaagatccatgtcgcccatttgaggaagcatcccttttccaaggtagtcgaagaactcgtttctcagtgcctgtccggccccgttttttctccggtagtgtatacacccaacaaaacacgggggaaaccgttctgttctcccgtgttcacagccacctccgagactgcgtgttccgagaagcattcaaggcaagtgcatttgtggattcgcacgacacgacattatttttgattatgtttgcatgacacgccggcgaccatacggctcaaacagactataagtcttttcatattctactaacctagaaaggtgacctttggtggggcggtgaaggagatccagagaaagcctcacaaattctaggccttgttatgtttctgacagtatagcaccatgtttttcgataacgtctatcaactcgcctgcctaccacaaaagcgttgcaagtgtgtgtttgggggctggaaaaactgtaccgcagacgatgtggatatatacagagtgaacggcgacaacagcaaccggtgaagagccaatacgcctcaactgtcggtgtttcgatgaagctagagccaaactgacgcacatcaccgtactcgctcccaaaccctgggagtttgtgtatgtgggtactggcgggcaccgaaaaccttccttggaagagtgcggcctgcggcactccacacagtcatggctcgccgtctacgaaaaggcagccttgccgcattgtgtctaagcgaagaagcttttcgtgcgtctcgagtgtcgagtaatcccatattgtagaagccaatgcttttcgttgatctgaggacgtctcccgggcgtcgctttctaccaggcggacattattctcgtcgcccatgcaaaaaacgcatcgcaacccctgtaaacacggacgcttttaggccgttgccgctttgatgtatacggtgctagtgaacgatatttataagccacagagcattgttttattgcaaaacgttttccgcagtacctgggtcccctagtaacccttttctgtgtccgaatggagcaagctgggcgagctggacgagtctcccgtgcgttttagttgcatgccttccagcacggcctcatattccaaggtttggaggcttcctctttccttgatgtttagacagagtcccggctttttttaatttcacgttttgttccgtgtgtctttaaaaaacagttgagtcgtcaactcctccggtcgtcttgcggagccaagtgaagacactcgaaaaagcggacgctttttctatgttttggtaactacgaattcgcgtccggaggaaagaacacacactctttcctcctctatcggcagctcctgcatcaagatatctgctactcttcaccgctcgcgtctttcggcgagagatgcatttatcgccgtcgcccgctacagaaggcggacactgtaaacggcgaggcgagcacagtcgaaatttggttttttgttgaagtccggatactttcgggaatctcttcacctttccatttcttctcgggtgggcgcagagcttcgcctaacgcgcttcgcaatccgcaaacgcaccagagtccgccagcagctaactcgaggagttttcccgtggttgaacgtgagaaaa

SEQ ID NO: 804 - DNA, 1604 bp, Toxoplasma gondii
gaagaagaacttcatgtaaggaattcctaaacggctgtttcagatgcctgccccgtgagaagggactggctctacgtctctcgggtggtcgcatcagttcgctgttaatcggaattcacagtgtcgttgaagtagcgcagtggacgagcagagtctgaaacttcgtgatctgtcagttccgctgttatgctgctccattcttgatttagagttcgacaaaagtcaacactgcagacaaaggacgcgaggggcttcctcctcacccgacatccacgaaagtggactctggaccggccggcagcgtttcgccgcctttctccagtagctcgtctctccccacagcattcgccagaggcagagatgacgaatgcgacggcggagaagagggagactgaggagacaaagaagaaaaaggagaacgattggaggggggaggactgaaagctgcatggttgtcaagctcgtgtggctccgcctgtctcagtctccttttctctgcttcttgcgtcaggcgcgccgcagcagcctcgacgcgccgcagaagttcgccgtctcctacttggccggattccgaggcgaaggagcaagagggcaaagagagagcagagcaaaccgcagagaagccaggggaagcatgcggagaagcaggaaaagaaaagagaggaaacagacgagcagggggctgtcgcggaagccgaggagagacacctgggccaggccatgaacaagcagcagcagaagaagccaaatgggaagaagacgaggaagcgggcaaagcagaggcagataaacgcgaggaagataaacgagaggaagataagcgagaggaagataagcgagagggagggaaggaggaagataaacgagaggacgaggaggggagatgtaagaaggacgctttcgtgtgaggaaggcgagacagaagcggcaaaccgcgagaagaagacagtcggcgacccgccattgcgattcgacgactgagcagacgagcgcgaaagaaagaagaaagtgagggagagaaggtggagcgataggtcgcaagaaatgcaagaaatcaaagtgtggaggagggacagggttgaattgatgacgggagaacttgcgttgaagactttcagcagaaccgtattgaccgacgtgtctctcctctctcggatacagctctgcagcagagatgcttgagttccacgcaagcagttctcttcactgcgtttagctacgcaagggcagataaaaagctttgccgctcctttctctctctgctgcctctcagtccctctctttggcggcaaagaacgagagcgttaaaaccgcgcagccaagaacagaccaacagacacggcagctggacgacgactgcttttcgccgcgaagcgaaaaaggctgctgcatgcagagaggttttctggggcgcctgagggtgtctgtgcactccgcgaggcaggaaggaggcaggccctctccggcctgcatggttgtttctgcttttcaggttttctttgttctctttgcgtagtcgcttttttgctgctgttttggcgtcccctcttggtgcatcggggaatgccacgaaaaatgcccaacaggaacataagtgcggtcag

SEQ ID NO: 805 - DNA, 1304 bp, Toxoplasma gondii
ctttcgtttctccttcctcctacgtgtgtttgtctggcttcgttcgtcgctccctctcagtcgttttctccttcccccgcgtttctcttcttctgtcctcacctccccttttgtccagagcgttgacgtctgcaccctcgaggacgagacctcggacctcctcgacagcgcccttgcgcacagccttcctgagtttctccatcttcggcttccggccttccagcagagcgacgcgaaggaagacagaggcgcgcggactgcaaagagaaaacgagaaccgggagacggagtccgcgctttcggaggcacacggcgaaggccaagaagtcacggagacgcgcagagaagcggagaagagagaaatgaagtggaaaaacgcgaccgcgaggaaaagagagaaagggagcgcaaaagccgtgtttttcgaagacgcgttgtctctgtctcttccgtctgccccgcgacgcgcacagcgacgggagggaagggaggcggaacggaggaggaaggagaagagaaaaaaagaaacgaggacagacaaatggaaagaggaagaaaacagaaagaaaagggagagaggaagcaagagaacctagaaagaagacaagcccaggagaggcactgggaactgccgtatcgcgtcggctgcttgcagtccgaggcctctgagaggaacggccagcacagaaacgaaccgagaaagaaagcaggaaaaagagaagaaagaaaagagagaaagagagcaagtgaaagaagaaagcagacacagggcggggtctcgacgaagacacacacggacagctcggccgccgtctaggagcgaattggagagggaggggaaaaacgagaaagaccaagccaaaaacgcgacgtggacgcactctgttttgaaggatttgtgtgtaaaggctctttcaataaaagacgggcagaaagagaggaaagtgactatttgtcgaactcgtagcctgcggtctcgtggcgtcttgtctcgctgtcctccgagcagttgcatgcacattctgcatgcccgagagtgtctccttggaacccagagggatctcttcttcacatttcgtacaacaagttgttttctctcctcagatgttgccgcagagaagtcagagagcagagaaaatgtgactctgtgttcttctctcaacacacagggaggccgctgcagtacagggcctctgctcttgtcggtgtcttctgagaaatcctctttccctcgcttccttgcttttttctccgctttcacttcaccttattttccgtggtactttcgaggtcgcgttgatgca

SEQ ID NO: 806 - DNA, 3041 bp, Toxoplasma gondii
cactcggctgacaatctcgtacgccttgaggacgtttctagaggaaaaaaaactctctccgtccttccctgtacccccagcgctttcgccttctctcagtcgagcgcgaatctgcaacagcaagaggccgagggtgacttcaaattcctcaagggcttcaactggcatctgtccaaggcctcgcttcaacttggggagagccacctcagagccgtcgcctccctggggtgttccaagagccgtcagaccatcaaaaagaagcagcaagtctggagtcgtgtagttgtgcaggttcgcgcaaatcgcggcaagtagtctctgaactgcatgcatatggtgtgggtggtgttgcactggccagtcgtccaaggaagcgacaaagagagaaaaaggcggccgttttttcagtgcaactcgcgccgccgtgggtgcatgcgcgcgatacgccgggtcgggttttgtggaagtatctccggtccggagacagctgcggtcttcctctgtcacctgtccatctgaagagtcgctgaagggcgaagcgaaattcatcgacggacgcacaactgccccagcaagaaggcggtcaacaacccgaaagtctgagacgcccagacgcttgcacacgacgggaagggcgagaaggtcctggcctctgaaaaaaggtttcgtcacgagaaggtgaagcacgcgcaggagcgaacgccaagagacatacgggagcccggcgaaatacccaaacaactcgccttgtctttgcagcttcagcgactggcgccgaaactctcgaggggagagctgggaagttccacaaacgggcactttcctggcagaacgagacagcgacaacgtggaggcaagtgtggtgaggcgacggcggaaaagaaagcggtgagggccgtcccagtgggttggagacccgtggtgctgggcggggatacagacagagtcaggatccgtgaaggagcacttcgacagttcgttagactgtcgaatcgaggccgcagaagacgtggggaaagagattattcccgaagggaagtgtgcgaagccgcaggttgtcatggatggaggtaaatccgcgtttccgtgaaagcccactcgcgaggaaacgcagtcctcgacaccttgcgaacgcgctacgttgggccgtgtgcgggtgttcctcggtagacacggagagtcccgttgtgtcaggtacgggcgatcgaaaggggcgccacatcgtgagcaaacagaccgcgatgctgtctgctgtttaccgccaaaaccatcgagatttgcccctcgaaacggcgcttgttgatggagcccgcccggcgcatgagacacgcggaggccgggggcgcctccattggtcgccaagcagaagcatggtttgtgcagacagtctgtgaaacagctaggtcgaaccccacgcatgcttgtatcgccgtgattttcaaagtgcaacagatacttcagtcgactacggaaccaggggtcgcgcgcccgccggcgacgctgacatgtgtatagcaataaactcgctcacgtaagcctcgttaccccctcggtttttcgtccacggaactacagtgatatgttcagaacctcaattggaagacacactgaaatcctggcatccacccttgtctctatctgcttggacacaatccgtaggcacttgtgaaaggagcctcattcgcgcgcatgcagcggaaaatttgatcgctgccctccatcactgccgtttaagccgtttaatgcatggcacacgggtggcgcccgctgttgcagctgctccctacgatacgagagactgctcaggcgtgacgttccaaagaggattgtgaagagctcggaaagacaaggcacggcttctccaagcagcaaagtctcagtctgcaccgccttcgtgttctgttgctgaagtacatcttttttaaggtctcggccttgtggcgcttgcctcgccgtatacgactaacgccacattatgggcgacttgcataggactcccagcgagttcccaatttctgagtaacacataaacgggagaggaatcctcgaaacttgctaaatcaggttgtagctttacatctagggtataactctgagcgtgaaccgcggaagcagacgcagcctacagctgcctacgcgtggctaagctggtgttcaacgatagtggtgcctgcccttcccactgttgtgccgggaaagggtggtatttttcagcagaacaaactgtggcgcccaataccaattctagtcttcagacgagaggctcaactgtagccctcttcggctgtaggacgaggacgatttggtcggaaccgtcccggcgcatttactacgtgtctcccaccccattcgggcgacaggtggttaaccgggtgtaaaccttctgtgggctgtgagcggggggggggggtctgcgcctgttgcaaggtgagctttttccccactgtctctcgtggttctggtgtttgctgcacgcgcggcggcatggctacggacgggttgagaagcagaagcagaaacggcggcagcggttcctgcgactctcgtagcaccagcgtcgtagtcccctcatcctgtggcgggcaaccccatcgaggctgggcacatgatggcaaatcatttgtttggtgctttctcattttccgacgaatttgcgttccttttttctatcgtgcacgttttccagaatccgtttgtttgagtcggtgcctggcgtgcgctgtatctcggaggcaggtgtgggctatgctgcataggccggaacaagacgtcggaagcgacaaaattgtttctcttatccggtgcctcccgtttctcgtgtgggacagctcgtttcgtgagtttccttgtccacagagacagctgttcttttattacttcggcatctgcgcaccgtccgacgcgcgcagactgatcccctcggtgtcgagtatttcagtctcctctggtcttcggagaagtgctctcagcggtctctcgagaagctcttgggatcaagtttcctcatcgccttcacttctctagatacaccaaatccacca

SEQ ID NO: 807 - DNA, 3420 bp, Toxoplasma gondii
gtggctatgtggcgagcgctgtccgatatctgtcggtgtactttttcacctgtcttggacagtgacagttgctcgacagccggtgcggctacgtggtcacctctgctgttttcatgtttcctctctcttcccgatgccgcgttactgttgcccgcacattcctgatccactgcccgttgtcctggcgatttgcgtctccctgtgcatttcatatcccctatgccatcgtcctccgaggacgatgtcgttaggtccgatccttcctgtacactccatatgttctcattaatttcccctattggatccttcctcttcaaatgtgaatgctctgaatagtcatcacacacaagcgtgcccgtttcctccctggctacagcctcacggtgcggcagagtcccgtgtgcaccctctgtttcttcctcagaaagggcagagaaaaaacgtcttttctgcgctggtttcgcttcataaccacgggaaacatcgtcttgcgccgacgtgcaccctgccgctccttcgaagccactgcttctcgcagccgtcacgtcttcacacagcgtcttgggcggaacagaaaattccggcctctctacggccttcacaccgtccatggtgatccgatttttgtgtttgactaaagtccgcgttgacaactgagtgctgccagagctctacggcttgcactacatcttacacatgcaatggtaagagcactggaacaaactgtaatctcacttcatagccagcaaaaagccactttactgccttcgcgtgggtccaccttcgcgagatctcgactgcggtggttcccaatccgcagctcacggtcaccgagcgtcaagtccacgaaatctacgccacgtgcagaaataatagggcaaacaccttcctcaccgtatttttcacccagaaccgctctaaacggtgcaagattcctctcgaaaacgtcgaaatccatgcagagagccacctcattcgagatgcgaccttatccacggcttgtggccgaagggacaagtcgggagcactacgacttttgacacaaacataacgacgatcagcactttgaagtgacagatggacacacaaaagtttgaagggtgtacagccaactggtaagagtaaaaatgaacattcgcggactgcagcgctggccccaagaatttgtcacgttcgagataaaaacgacacagcgacacgcacgtttttgaatgtgtaacccgggggctactagagacgagatagccacggcagaaaaccagcaaaactagcagtgagaaagttgcaaccaagtgtgctaacggagattcgcccgtgcagggagcgagcccttattcctgaggcggcaagagttgtcttctgttttttgctgtcattaccacattcgtttccacattatttccacagaacataagaactaataactgaagggtagatctgcctagctaagaacaagttttccacgagaagcctccaataaaacccaggtcttccatcctcttcgatgctgcgtttttcctctgagcatgcaattcgcaacgggtctcgacggtagctcgccgcctctataaaccacttggacccgggcaaatctcgaaaccagcggagaagagtttgagtatatcagtcaacatcacaggagtgtaatgaaatgggaaacatgggagcgttaacccgacaaaaatgagttggaattccttttacaggagacggctcgacgtccggctgcctctgaatgtgccgagctatagcgatgtcgcctcaacgcagccatgtatcgatgttctcaacgtgcagtaaggggcgaggcagatatgtcagctgaaagcacgaaccactttccttctttttagactttcatgaaatggtggtatctttttgcttatggcgacatatgtcctcttctccctctgcacttttgcaaaggccagcgccttcccacattcgaaggatgaactctgtgaactgatgcaggaggcattacagacttttcactttgtagttatctttggggattcctatgaatgtatactaagcccaaagcagccaggtgcaagcagaaccgcttgagagaggacagcggcgggcatttggagctgctctgcgtttgcttgcatctccgttactctagccaaacgcgcgtggtgctttgcaaacatcactctaagtacacacactatcgtgaccttcccccttcgagtgggccgcgacgtaaaaacaactacaggtcttggaagtcctaatgcaaaactaagagggaccccagcatctgacacacgttgttgctgaaccccccaccagctaacgcccacaccgactgcagaaacgaagtgccaagcaacaaaaagctagatgtggatgtcatgcttcttccccccttttgatcttcgatatcgactcctacgcgcgggcgtgttctctttcgcttgctacaccaggcccctactgaaaatccattcctgatacgatggggcagctggattaacaggtgttcgcaggtggctaaccgagacaagggacgcacaggtttcgaagcatgcggctaggtgacagaatatgatgcattagaagctttatggtaacttttcttcaatcgcgaaaacgcgtaaaggttgcggtctaggcgcagttccgacgctaccgtgtgatgtacacggccggctggtatggccacgagttaaaacagtctccctcaacacaccagagcgcttcacataatagcgctaggaaggactggaggacatccgtttttgtgttcttccgcaaccgtcttagtgcttttcgaccacctcttcgtatagaagtcatggaaaatgcactgacactaagatgcaagttcgagttcttttgtccgattttgcatcgtcgcgatgcagctgccagtatgtttcatgatgaaatgaaccggcagtgattgatcccaacttcccaggcgaactgaaacgacgcaattcaaggaaacaactgttcgtaagcgcaattgtttggaagacacaaaaagcagatgttaaatttcttcaacgcaacaattccgcgtctacgcttcaaacctggaaccagcatgacgaacgaaattgcagtttctgtaagaacacatactactaagctcttactgtgaagaccgatgccgatggcttcgcctgctgtcaccaacacaaaggtcctgctgatgctcctgagatacgtccagaacgaggccggggacacacggcttcaaccccatgaaattagagacgcgtcctcttaacccaccagaggctcgcgactcttcgctgtggcgtctcagttaatatacgaagcgagcaaacggcgtcctgttgatttgtgagattgactctccggattgaacacgtctttctttattttctaagggatttcgtgaaccaaacgcggtgaagtagttcctcaatgggtttatta

SEQ ID NO: 808 - DNA, 5030 bp, Toxoplasma gondii
attcttctcgtccctttccctcgcgtttctagacgtgtactgctacgcccgcgacagttgcagagtggactcgttgtagttttactgtccacctgcaggggcctggggcaaaccagttgcgcttcgtttgagaattgaagtagtttttcgatctaaatctcgatacgaattcaacgagtgatacagaaaacctaggggttaggctacctgatgaaatgccggaggcagtacatcctagtatgtgtactgttggaccagacagttttcctagttgacgacttgtgtcacagcctagaaaaggcagtctttcttttctggaggtacggggaacgttcgcactagactgtgcagacaccttgtgacacagtatgaagtggggtgatgagacaaccagagagacagagtcatggcatttgtacaccttgctagtaaatgttgggttttcaagtacacgctgcttggaactcgacgcagaacttctcgagttccagtccccaggcagtagcaggcgggctgctgctggttccgcagtccacagatggatttggaaagtttcctgagagtgggttcgtgcactttcatggcgtttgcttcactccgatcaagcgagtttagctggaacactaaggaagaagtctctgtcacaaacgctaggggtgtcttttgtaaatatttttttacagtatatacgtcaggctgtcgccatcatttgctacaacgatacctctctcagagcgctacgtgcggtagttcagcatcctcccctagtacggctgctccacaccatttcgattccgcgctttatatttaaggattattgttgcaaatcgtgttgtgtctctgccttttgcgaagttctgttcgtcacgcgtaaggcaaatggacaatagcggatgggcttccaaatgatccttgataccacaacaaggccgaaaactcgggggcaaggacatacttgtccgtctcacaatacttcacacatgatgcgaagggaaacatcgatatatgggtatatatatatatatgtaatcatggagaggaggcaagagcaacacaaagtgcgtcaccgtcgactctcacgagaaacgaaaaacctctgaaaacgcagacattttccggcctcaagcggtctctttgtcgatctgccaaagacgttgttttgttgagtcaaccttgccgcagttcgcaacttgcctccttccttgtcggtgctctttgggcgtactgaagtctttgtcaagcggaagcacatgtgtgactgccagcaccaacgagttgcacaagctgcagacgcattcaaggatctaaggtgcagacagtgggtactgagctgcggagttttgaatatgcaaaccacgctcttgactggagcttccaacattgtgtggagtatttttattcgaagagacgtgtacagtcacaaacgaaaaagtactgtttcccgcacatgctggcattgagcgttgtaagcgacgagaaaaagcgaacaccttgcgcactcctatctccacagaaagttaaacatcaatatatgtagagatgcagagggaaatacatacagagaagtacattggtgtgtctcgtccttctgtgctggaggttcttcgatggccaccaacgcagtttaaaagacggaaaagagaggtaagaaaacagtggcgagtgcgatgccgaacgtggcttgtggtccagctgcatgaaacacgagtgtgagagctggcccggctgtttcagattcggttgtggtgccagttctcgatccgcgagcttgtttgttgtaggccacgagacagaagttgacggcctttcgcgggagttgctccattggcggagtgacgaatttgtagattttcttcacccctgcctccgcctcagcgggctggggagctacctggctccagagttgggcagtcgcctccgggaagagcgaacccatggaaatagtttggtctgtctgacagtgggagtcatcgaacgggagcgctgtcgtgtcccaggaggccgggttgaattcgagcccgtttgctgtcttatcgaccagagcgaaactctgtccaccgagcagggaaacttcttgcgtgcggggtttggtgattccctcgggctcaactatcaggaagtagcttgccggcggagaagccccgtctggccatacgcggtttgagcaggcaagcaaggcaggagaaaaggcagccagaaagatgcacacagacaaaaacctttgtcggccaacgccgcagcaaagcggacggagcagcggacgtgtcatcttggtgcacgttgtaaggctgagacatccgtgagttacctaaacaacgtgcaagcgcgggaaatccggaaacccgcaagccaacgagggagtttgcagaaggtgagaacggtttcgctctgtgaggagttcatatgtttgctcgaggcaacgacagtggcggtgagccgaatggtgctctattacatctgaaggcgcttgtggttctctgttcgtcacgacggataggaacaacagtgacaactgatctacagttggagaaacagtgggaaggcgcagtgcccacaagtgcgtttgcgcctaatacacctgtcccttttttgcgcgcgtgtggaactcagaaaaggtgactatttcgaatcttggtgagcccactaagataatgtgcagacatccacaagccgccgtttgagagtccctcctgtgctgcggtgtgggcccgtagggtcagagatgagaaaagtttctcgcaagtgttcacctttcgcgaatgttttggctgtttctttgtttcgttttgaactcgcagagactcaagaaaagccaagcctttgcacatgcggcaaacacgatatcatctcgtgtagcggcgcaagagtaccgactcgggcaaaaaagtcacagaccagccgctactgatagaaggcgagaactatgaggccagtgctggaatggttgcagcaaagtgaaaaaattgatttttttatgaaaacgttcgcaacgtttggtgaagaatataatgcactcaccaagttgtaaagcctggatgcagaggtgtgattattgcacactcacagtaagtggcaacgctgcaggcgtctcgaaaaggagtgacttcgcggataacaagtcgctcgatcagtgatatatggaaactgccaagtcgcctgtttgctctaattcaaagaaccgcttcagtcgacgtgcttacagccaccggagtcgcaactgcccccgcgactcccacacagagaacaactaaagatctattcatcccggcattcgtccactgtcaagcgacctaactgctgacgtttttgcacactgagtcacccaaagatgtcaaatgtagtgtgaacgcgggacgccctacggtttcgttgttgaatgaatacagtgaaaacgcagtacgagcttcgcgcggctttgcttctgcgccgtcgaatcaacgtactgatgagttactggaggaccgtgctgcgggaacgtatccccgagtggcatttttaaatccgaccacggacacacttcctacgaagtacgaagaaaactgcaggagaaggggggcgagggcaaggaaattgcgtgcagataaactaggggaacgcaacagcgaaaactactgaaagaaggaagtgatgagttgttgaaactctctattcttttctgtgcctaaagcatattaaaacgaaacacaaccggccgagagcatgtctgcgggtgccatattcgccttatgcaagtttctgcctgttaaagccatcttgcgtccacgaggagagtgccggaacttagcatcgatggtgcctcaagtcctgctctgggcaggagaccagctgcgtggcgttgcctttcgctgtctgagtccacctctgcaggatactgttaaactgaaagtcaaccgctttgttcatgcaagggagctcctgtgctctggacctcatgtatctgctgtgggatgtatagctttcgagttgatgacgaacgaaaggtacccataaatattcatattgcaagaagtctcgcatcgagacggaacctccagcgtccatgcacacaaatcaggaggggggacaggcttcactgattatctcggaaatacgttcgtctaagacaaatgtgtagcagctaccagtgctacggcgcaacgcacgatgcttgtcacaaaccttgcgccaaacgcacacctgacaaacatcgccgcggaaatcccctggttcttcgagaaccagtgactcttttgccggcagaatgcactgcgaggtcttcacgatagagtcgctggctgaggaaggggtgccacagtgcgataagtgtgtgtacggtcatgactccgggtgtacatacagctgcgaggaaaacttgaagtacaattgcgttttctgtatcggttggactgtctgagaaaagctcgcggactgtggcgctgcttttgcgctcacatcttacctttttacacagttgcgcgtattcgtggaaagcagagaaggcagggagtcatggacagacaagggggatgtttgttatgccgttggctttctttgaagcacatgtccctgtactacccctctactccacagctcctcgaggagacacgacggatgggatatctcgagccgcacgcaaagatggtgtctccgtagccgcaaagcgatttccggtgaggagctgcaggctctccagctaggcacggcgcggaaaagccgtccgtcgctttgttgtcttgtcgctggagcgcgggtgctgccagaggcttatttgttactaaaccacacagaaaggcaggaacataggagaaagtttggagagggcttttctctggtgagccagacgcgtttcatctgcaggtgccgcagtctgtcggggtcacctgcgcggttgcgtttccatcttcgttactggcctttgcatccgacaaagtgaggcctcgctctcgtcttgccggtaaagaaattttctggcattctgcacactaccgcacatgttttttgtgcaattctgcagggggcgtccgaaaatgaagaaagtcaccggcaaaaaa

SEQ ID NO: 809 - DNA, 2183 bp, Toxoplasma gondii
gcatgcgcgcagaacagtgaagagatctcagttgttacagaggaaggtcgctgcggatggcgaggaaaacaccgcacaatctaaaatgtcatgggggtcgcgttcacctatatgttcaagttcctgcgaaaacgccagaggctcttcgcaactgtgtctctaagggaccgcacacagtccgtcactgcggactattacatacgccttcctctcatatccgaaattcacttttctcccgctctcctcccgacaatttgccgtcgtctcgaggaattgcctcgaacagcgaaaggcatgtagtgcattcgttgacaggacgtcttttcctcggagagcgtagatctgtccgtgcgctttcgaaacagaagaaacgcagaaagacagagccccgtctttccacggaagacattgaggacgttcttcaactgaactgttggggggatgcagaaaaaaaaagctctgcacatctgataggagggctgcaatacctggaaacgtgaggggtctggccgcaaggagtaaagtgacggctatcgattttcgatcgatgttcagcgtttccagttgagatgcttaacctagatttcacagtccacgtcaactgtgggcacagtgtcggctgctaccgcaaggctaaataaacagtgcggcggtgcttagcctgaaagcctctcacttcacacagatgcgctggaacgtcgagttccgtttcaaagccttcctcacttttgttgaagccacaaaaagcaaggaatgttcgccttccgcggcaaaggctttacccgcaaatccgagtatcacagggacgacaaacattgaagtaaagcgtgaaagggactggtctcttgtcgtccctgtcggagatacgcgtagaaactggcagcgacgcacagcccctgccgtctttttccttttccagcctcggatctttcacctcttctttgtgtctgaacagaaacaacttcgagagatcgacgctcttctatctcagcttttcttcggttctgcgcactggccaagaaatgcgctggagttgccacccaggaaactcggttttcttcaacaaaaatatcaacttttttgacgctccgcttgcagcgcccgaacatacagcagaagctagattcactgctgcacctgataggagtcccgcacaggtgtgtgagggatttcttttgttccagttcaaacgcaaagaacgcgaattgagcttgttctctgccttgtcgaggatttagcaacgagctcgaacctcggatgctttgctcacggctggactcgcggagagtcgcgacggtcgctttcctttctgacggttttctccaaaaatgaaaatgatagagtggagatctcgagtgtacagttttgcggcgttgacgatctgcgaaaaatcagatggtctcgacgcatgcgcttgcacacgcgtaaattcatctcaaaacgccgaactatagaaacatgttcggtggttgcttggcgagtcgattcgcttcccgaatttaaacctttttttctcctctcagagagaaaatcctctttgttttcgcgtcaggttcggtctgtttttctgcgttctcttcttcgatcgcgaggcacccgttctcaggcttcgcgctcggcagcaagcgcctcggttccttccaggaaatgcacaagacagcaaatggcttttgtgtgtgctgctatctttttcgttcctagtttgctttgcatctgcgttttcttctctctcgcgcctccaccgtctcctctcttgttcccttttcttggcgcctctcgctgcatgcaagcatctggctgtctctctctgccgccctcgtctccatctcactgtatttcccctctctcctctccttgctagctttcttcggagaaacagttgttccgaaaagaacgccagagactttcttgcatgctctgtcgctcctctcgtctacagctttcttcggagtagccttaaagaaaggaaaagaagagaaacgtttacctgtgttccttctcctctcatttcgcgcgttctttggcggtattttatgtctttcaaaaaaacatcttttgcgtccagcctctctcctctcgtttggagctgtctttgagaaggaaatgctccgcataactcataagagggtaaagtcagtgtgaggcagacggtggtctctgacgcaaacctcagtgttttgcca

SEQ ID NO: 810 - DNA, 1533 bp, Toxoplasma gondii
cagctcgagtatctgtcaaatattcttgcacgcacgtctaacctgacacaaaatgcatacatttacatatacatatatatgtatacatatatatacatatatatatatatacatatatatatacatatatatatgcatctatgtatacatatatgtatatacccgcgtgtgtagggatcgaatatcaatgcccgcctgcgcgcatgcacaaaacagcatttgtgcatgtttcggactcacaggggaactggacggccgtcaagcgggaggcgacgtcttcgagatcatgctcttcaccgaggtgtgggaggtgacgcaagcctcgccagcgatgaaggagatcacggatctctgaaggcgacagtttgtaagaagttccattgtcgatttcgtccatatcagggacttctttgaacgacgctgccaacatttctctcccaacttgacctccttccttcagccatgcctctgttctcttcgcctttcacgcgtctctcctcttttcctcttttcttctcgctcttctgccggtttctgtgtgatggacgatcgcggaggcgcggggacgacaactgaaatgaggattaaaaggaagaatattcagtacagaggcgacgcgagaagaggaaggtgaaagcggtgaacagcaaggatgacgagcttatgttagttgcgagaagaaaatagaagtgccaagaggtacgaagcggatgacaggaggcggacgaaggccacagcggagcgagcgaggaggcgagaacgagaatggcaagcgaaaaagaggacagttccgcaagacaggcagactcggtttacagtcaccgaaatccttctgtgtgtctcatttccttggagtggatgtccgttgaaggctgagatcctgcaaaaaaatggacgacggcttgctgctctccggccacaggagatcacaaccacgttctgacagacagagaaagctaagcgcgagcgtaatcgagagaaagagagatcgaaaggaaaagaaagagacacagttcctctcttggcttcatttagtgggacgaaggaggacaagggtttctctgagtgctgagaatcgccaattccgccgcaaagacgctctcaaatgaggacccgccgcggctgtttttcgccgttgatgtagcatgcatgcgtgtgaatgcgtgtgagtgagtccggagaacagaaaaaactgtcagggtctcaaaggagaaacggtgacggaggaaatgtctcatattcatctgcaatttctctgtacagaggtgtacagactgcccttctttttggcaagcaactcgtgcatgcatctctgagcagaaaacacgaaactccttttcactatcgaccacgcacgtgcacgcatatccacagtgaattaaaaataaaaattgttacagatggtcagttaattgtaggggtacgtatctggaaatatattatatacatagacagacagagagagggagaggtacacagatgtctgtagaagagagggacgttgtactgcatgaacaggcgcatcgcgagaca

SEQ ID NO: 811 - DNA, 2059 bp, Toxoplasma gondii
gaagagaacggtggagaaagtcatcgagtggactgactgcagtgtctggcgtgaagggtgaatggagcgtggctaaatcgattaccgttgatgtatatataatgttctttcgcattcggcagaaagcatgggaaagcatcacgcagcgtcttggcaatcacggaaaaggacactacagtgacgggggccaccggaagtggcgagtgggtttcaacactatgttgtatgccgtcaacaatatcttgcagaatggggagaggctcgcggcagtgaggacgcttgccgcactgaatcggcaacgaagagagtgtgtgcactgtatctttcttctaaaccgtgcaggctcagtcgatgtggactttcctcccatgtgcatcgttcttttttccttttgggaggaaacgaggatgccctggttttttttttcgcgatgaagcaagacgtgcaaactcgagcgtggatctctgttcaagaaaaacttgcacggaatacgagttgagacaccaagacttgctctgagagcggccccgctaaaaatccacgaatcatcgcggtccgagaagggcgccgttgagcgagtctctgtttcacggcggagacgtggcgtccagagaacacataattggcgaaaggagaatctggaattttgtacagaaccttgtgttaagtcctccactgtttttacgagtaggcattcttcagctgtttctccaaagatctcaacgagaaaccggggcatcgaggcctggcggacggagcgaaatggagagaaaaaggttttgagcacggagcggcacctccgggtgagtctcaaaagacgtaattttgatcctctacggctaattctcttgtggtaaaagagctctttttttcaaactctgcaagacgcaaaactcagagagcgcgattcaacaaagtcccacacaacccgagggtgcagtcacctgtggcaacgtcttctcctgagttgcagcgatcgccagcgcatgttagttcgaaaaagcgccaacaagtggagtgtacaagctgcacaaataccctaacattctctttggtagtcgcttctttacgtcaagaggtgcgacacgagtacctgctgcccagaaaaagccgcgaaggaattctgtctcaaagaagactactacccctacgagagttctggccatagctatcctacgcccggtttagcaaaggagtcctttcaacagcaggtgaaagaaaatgccgttcgtctttctgggacgacaacggggtagggtattccctcccggcggactgggacgtacagagttgcttgggaggaaaagttcctcgtgtggatgccgaaatctgctcgcagaatccgcttaaatgaagggtctcgtaagcaaccgctcccttctcgaaaataatgagactctgagcgagtccgttttcctctcctttccactcagcaaactcaggtttgagaaacgctgccggcgatgcatgtgtgcatgcgtcggttgccggaaggaaaacccgtgctaaaaagactctaagcgagacgcccaaaatgttttctgaggtaggaacattttctgtcttttcttccttcccttctttcttctctacgggaacagggcagaaacccttctgagaagcgaccagttcgtagccgcctcgtgtctcgaaaactattgagtaacatcgtcgtctcgacgtctttcttccgcaagccccggttcgatgctccttgcctaaagcttcaacttttctctccgctgttgtggcctttgtctcaagctgaacgccctgcaggttcgtgtcgcttcagcaggactgtttcttggtcgacgcagggcggtggttcgcatcttcagcgcagccgcctccaccatcccagcactcgtccacgcaattgtaacgagacagggaagagtctgcggagttttgtgcgagagacgtgacggcgttttttcgctcgagacatccgagggtgtcgggaccggctccgcacactctgcggctctgtaaaacacggggagaaaaaccttttcaccactcgttttcaggcgtacacttctctttctgttcacca

SEQ ID NO: 812 - DNA, 2662 bp, Toxoplasma gondii
cctgcatcgtgactaccatacaattcttgtggctggtcagtttcaccgcgagaattctctgatgcgtccgtggcttttgacacagtgtcagcgcacctgctcgaactgccactgcgaacagttgctgctgtactggatcctgcatagcattgtcgaacgcggaaggccgtggacccggtcgcaggattataactcggaaaaagttgcgccgaaaagacacgccgcatccgtccagaagttccatccgttctagactgcgattcgtagagattgccaacggaaaaaacacttctgttgcatgggcgaacaatgacttggtcggcaggacgcggcggacagtcgctttcgtttggagccatcgggcgatgagccgtctcagacgagcgccgagagaacggtttccaccgaaaccacggggagaacaggctggacgagccggtaagagacgttgatgcagcggttacggcgtccgacagcgagccgtccagcctgagcccacctgccaatctgatttgccgggctgtggcatcatgttcggtggcggggttctgtccagcggcggcaagctgcggagaaggaaaggccatcgtcgcaacacacacgaaagaaagcagccgcctcctgaagtaccaacatttcgggctcgataatctactttccgaagcgtgcaaaaaagtgccccgtacaagcccgcccccagtgggcgccgagtccgaccgaagtcgtgagtactgaaacctagcggaatgccttttcctcgtatattcttccaggtgaacgtctccacgaccgggaagctcgctgcccgtcggaacttcactgaaaatccgacagatacgaggtgaggggaggctgcgaactgcctggaaaactggaaattaggggcggcagacctgttaccacacacaactgccttcaacgagtgttacggcgaaggaaatttcctctggcacgatgccagcctgcgagagatcgaaacaccagacacacttgaagaaaatgacttgaagattcggcaaggcgacgcagctattccaattcacgaagcgtaggtacaccataaacctgaccgactcgctaccgtgtgggcaacccgctacttgtgccgcggaatgcgtccatggaaggcttcaagaagacgaatcacaaagatatggcgcctcgaaactgcgatcatcctgaaacggatgcctgtacacatactttagtgcatcaccacaaaccaaaagctaacaacagcctgcgttccccaaacacactcagttcactagcactcgtagatacaccattcatcattggcgaacgatgtatacctcccatagccaccacttatcccggaagtgtatacagaagaaaaccccgtggtactttcccctacagttcctcttccagaagcgcacatagacacttcacagttaaataacagggccatcgtctgtcatgcaaccaactagcgcggtgcgaatgcatcgtactacagggtaattccttggattcggcaaacgctgttcacaaggactctgcaatacgctgtgcactgctggtctagattgtaaatcgacgaaaaacaacggcaccataccacatcgttgtatacagaaagttcatatgaacgaattcggagtgaatggaaccatcaattcgtagacgccctaaacaggggcttcgagtcgaatgaacgcgacaaaggtaggcagcccccccagaacgaagctggaacgaacccttgccactttttcacagcaggcttgatctaagttctcactggtgtagaaacggctaatggccgtgccggtttcgagccgagagtggccttcacctcgcctttccagtctcgtgtttggaaacttcttctcaccaccgcatattgtcaggttcaaaaaaccaacacagccgatgtcggcacagacgtcgataggatccccgttggatgcaagacgaagcactgtcgggtgcacagctcgacctgccgtagtacaattgaggctcgccagatagcaggaaagtacgccccttgttacatcattattctcatacactacctcgggaacgaacatctatctcgaataaaaaaatccaaaagggacagaataaattcagccaagctaacggcggtagcggtaaatttggcacagggccccgcagtgtacgcgtctccaagccagtcagcgacacacttgctctacaggacgcctgtgagaggttcgccacgcgcggcttccaaggcgggctgcgtctcttgcaacgcaacaccaagcagcattcagtgccctcgttgcactgccgtcgacgtttccgtctttcgttcccagcaccgctgaatgggagcacaacatgcatgcacggctgcaacggaactgcagcaatgagcttatatgcggggcaagggcgatcaaggtttacggcatccacgccgtgtgtccgtatgctttgaacactacctgtgtggaaagttcagcgggagctgtgaacccgcagagaggttgcaggcattgggccacaggaggggtatccaacgtttttggccatatttgaggacgtgtttaatccattctggatttcggacggtttgaagaagctgcggacgtcaagaaagggggaacgttgcacttctttgcagtgtgcgcctcgtcgcggaagtgtgtcgaagaagcaggaacta

SEQ ID NO: 813 - DNA, 1980 bp, Toxoplasma gondii
ccgttttcattccactcgccactgttgaggcctgctttgcagcaggtgccaatgtgcgactcaacaagaccagcgagttaccaaaaacggcactgcagggcggatgttcgcagataaccttcgcatcggcttcactcaggttgtgaacaacctcgcaaagcacacccaggaatcgcgcaacagcagcttctgcgacagcagcaggggcagtcctcacgcgcttgaaagcctgctgcgccgcctgacagaaggacgtcagcacgggcaaagcgttgcctgaatctgtcactggcgagcctgctgcgacatgcgcttcggtcactaaagcagtgcgcacaacagacaggacttgctgaagctgagaagaggcggccttggtgatatcaggggtggtggcgacgttcatgagtaccgcactggttaggaggttgataatggagggatctcgaatgactggcagccccccctcagaatcgccttcggcagatctcgactggagaattgaaaggacgacatctaaggagttagccagttcatccagataactgccaccccgagctgcgagggacgaggattgcagcgcatcactcagcgagacggagtcttctgctgcaagcggagtgtccgccggaggaccagccccgttatgagcctcctcggacccacagcctgcactcattgtggaagcgccagtaatccgccacgtcagaggggtcgaaatgattgaactgctcggtaactctcaaagccactacggcagagacgagaccggcggaaaaatcgacacacaggtggccaccgctcaggggggcgattggcttcttctgagatttcgtaggggctggttctaggcgcagtcggatgagacgctgactcgcatttgttgcgcgaatgaagaaaggggtaccagaacggcaagaggcctcgctcgagtccaggaagaacgtggctgaggggcgagccaagtagtgagccacaacaatgacagcgaacagcaacacaagaatcgtgttcggttagacagtccttgagaacagactacaataaaacaaaagtggcgacgaactgcaggtagcctgccaacgggcaaacgtacgtacacacgagcgcgtatcaaagtggacagtttttttcgcatgctaggacagcgttttccgtcggctgcggccaataacgtgtgacctaacactcataaacagttgtcgtaaacgatcccacgcatgcgtcctgatcttgtgctgctcaggtttgaaactttaccattcaaccttgcgctgtgactttgcgcgtgctggcagccgtaacacatttcgtctgtctggcgctcgcgtgtctgtctcaaatgacgttcatcactctctctttgcgtattccccttgtgtaccttgattctttgactgtgttgttccaacttaagcatctctcgcatacgaagtgcctctgtttctgctctgccatgtcttgagggtacatgcacggctcctatgagacttggtgcaaggcagtggtggaatgacacacggagccccccaaggcgcgcgttgtctcgtctgcgtgaactcattgcttgttctcggcaactgtagcccagcccgcttcgcttcttcagcaccagtgcacatccaattactgacatgcacgttatgtgaaaataccgtgcaacttttctaccagtagcatctgctccaccagttagcagatttccagcgtagcaagtagggcaggttatcatcaggtgaaggtagcgaggtcgatccctgcttctccttcagagtagctgtccgcagtctcgtcgcccccctctcgagcctcgtgcataatcctcgtcatatgtcgcctagacgggcaccagatcagtagcatccctttccaagcagtgccacagggaaaccccagccgtctgacggtgcctgaaccggatttccaggaactacatccagctgaagtctcttgtagagtcactcagttgcttttacagga

SEQ ID NO: 814 - DNA, 4960 bp, Toxoplasma gondii
gcagatcccagtggcctccagcttctttgtgtctctggaaagacaaggtgggcgccaggcggtttgcagcgccgccttcgcatcctctctctcccctctattccccgttgtgtttcctctctctgtctttgcgcagtacaacagacgcttgcaccttccccttccacgcacgcgccctgtcgccaagtacagagcctgttcgttccccctctgggagctctggagaggcaggcggagccagcacagaggtcttttccggcggcttccaagtttcgccaaagtcgtcgaccgtgttttccctggacgcggagattcgcagacttactttctttcttgccggacgtctcgctgccgtcgatgcctcctctcaagctctcgtcgctgcggtttcgcgcgacgtcttccgagccggcacggtcgctcacggcgtcgatggaagttcgcacaagaggcggagttggagaaacagaagctcgcgaaatgacccacttggggtgtgaagccgcagatccaggagcagcctgcagcgcaggcatggctgaagcggctcgatgagaacgcatgctgtcgtccgacgccttctgcgcatgcaggcgcggacctccccctacactcgcgctccgaggcgcagcgtagtgcactgctgaaaacggagacgaagccgcagcggagagatacggagagacgctctgcggcgctgaaaacaccaagggagaacggtgctcctccggagtcgacatggtgcgggagagaggaaaaaaaggaaaaacgaaaaaagaaaagaagagggaaaaacgaaaacgcgaacgaaaaggaaaagagaaaaaaaaggaaaaaaaggagaaagaagacaagcggggcaaagggagaggggaggaggagagaaaaaatgtgaggtgtgaagacgaacgcgaagcgaggcgtgtgtatgcaaagatgatggatctgtgaagagagaaaaaacgagaaaagaagcaaagacggcaagctgtgggggatacacctcgtgatggtgacaggcaaacgacaaagacacggagggaggacgacaaaaacaaagtgcgttttggcttggagaaagaagttccagcaactgaaggaagagccgcaggtcccaaagaacgcggcgaaagaaatgacgcaacgagagaaagaaagaggctcgtgctcttcaaacacagcgtcctcagctttctctctgttgtgactggaaatgcatccgaagaagactccgcaaggctcggcactctcgaaagaaggaaccttgtcactacgagtagtgatggtacagcggaagtccagatctgaggcctggaaaccaaattcccgaggccttcagtgtcgcatgaggacgtagaactcgacgctgtgggccaagttgagtcgttttcagatacgcagaggacagctggaggagagggcaagaaaaacggggagaacgacgttcaagagaacgaagaggaagtaaggaagtcgccgagtcacgagagcttcagctgcttcggagtcctgagcatgacattccgagcaacagctgcaacaaaaaggacggacagaactgattccggaagccaagtagcgggtcgttctgtgttgcagagtgttctcgtctcaacaaaggaaagaaaaaagagagtttcgagagcgaagagctgaaattgccgcgggcaaagaagccagccagtcgagtccagggaaaaagctcgcgcgcaagtagcggtcggatttttcaggtatgcataccctctcgagaaggcgtccagctttttcgcctccgacaaaatttcgtgtgtgtcaagaaaatagagttttccaccttttccgcgatgtacgctgcgctttgtttcgcgaaaataaaacgggggggaaaagaaagggtcgtcaccgcgccagacaacgcgcctgtcttgcaaggagaaaaccgctcgctgggcggggcactcagaaggcgcttttcgcgttctttgcctcagttctcagatgttttccggtgaaaaaaatcgacgctcgctccactcacgtatctcaggcttctgcaaaagcaaaggcctcggcaggctcgtctacgcaggcaaatgctagcttttaaggttcggaacacagacgtccacagactgcctatggagagccgcggcaagacacgacaccagctgttttctcgctggataaaagatctcgctgagaaagaaacgacgcactgctcctcagtcctcgcctacataaaagcgttcgtgccgttgaagttcgctgaaatggaaagaggctgattttcttctgggggacccagatgcagtgccggagtgacaggacgaagaccccagtacttggttttcctcgaaacgaaagagagagcgaaggcgttgtctctcactgcagttgaaagcgtacttcaatcgaaagtcgacacaaggacaagtgagaaggaggacgcaagtgaaagagcgtggaggaacgaattctccttgtcgttctgtctcgcggaagaacactacagcttcccgcgcgtcttccagaactctcggtgcatacgtttttcaattgcaacgatcgaaacataaacagagaacgtaaaaaaaccaaaaaggatacgcacataaaggtctacgtctgcatatttcgggcatatatgcattcatccaaacaaggcatatacatacataaatatatatatatatatagatatatatagatagatatagatatgggtgtggaagagacagcgtagtaagtttgacaggtgtgaaagagctgcacttttgagagtcgagaaaagaatgtacaagctgcatgctcgagtctgtctgagttgagagctatggcagtcggtttcctcgacgaggtgacaacaaagtcccggtcaagctgagggccgtgtgggtgcacaagagggaggaaagagtttctccgtcaattctctctgggtcgattggaaaaacgagggaatgcaggctgtgtctttcgtcttctctctctgtttgtcatcttttctctccttctctgttcctgattggcctgctctgtctgccactcggagatccccgtcagtctctgtgtctcttgttccctatttttctccctcgaagcgtttgccattcctgcagaggagagagaggcgattctctgtggagttcaaagtacgccattcaaaaaccggagtttcacagcggttgtctcctgccttcttgatctaggattgctgatttccgcatcaggtcctggcaacgctgcaaatttgaggctgcgaattcgccggtgcattccactccgaaccgtccaagacgagacaccaaaaaagtgaaatgttaggccagggtgaacgaggacttctcgtttccctctcgttgtcagatgtactcgggaaatcctttcttcagcgccaagcatgcaaaaatggtatccatccttcgcgacagatccgtcatctgagctctttagttgcagtgttttcatgagacgatgcggctttgataaacgggcaggcgtactttgaaaactacttcaaatcttgacagtcgtgtactccactgcgttgcttcggtgtgcgagacatgacaagtgactgttactctttggcgctaattgcccgttgcgcgaccgctctgctactccgcaagaaatcgcaaaaacgagccttgagaggactgtgatcttctgtaagaaggagacagcgcgacagaagaagcggctcatttctaccagttctttcctataaaaaaacgcagatttgaaaaaagtcaacttttctcttctagatggcgccgagcaaggcaagtgaggcgcatctaatcgtcggttttccagatctctctcgagaaaacgtttgaacagccaacatgaggacgcctcacttatgagtcttccctcacccaagaaaaggatgttttcgtttctcgttgtcctcgaagttccacacccactcccaaagcctgttcgcaccagagtgagggcgcccctccagcggcttatatacggtttttcctccgcttggagtcgtcgcgtttttcagtcctaaaggtgtaaaacatcaacggccgtctgcgttcagacgagagacagcaggaattcacttgcctccgacaaagaggggaacaacgatcgacactcaagagagagcaaagaacaggaaccagaaggagagagagagaacatgaggaagagaggggagagaagagaaaagagagaagagaaaagagagatggcacaggagaaggagaagaaagaaatgtgagaggagagaacagagagaaaagagagtgacaacagacgaggagtgagagaagggtgagaggagagagagagagaaggcgagagaggtaggaaagaaaggcagacgagaaagtagacggaggcgagggaggagcgtttctgtgctgcatgcgcgaaaaacctaaaacgaaaagttttcatcaccgcagaaagtcaagaagtcgagagaagaatcaacgattgatcggggcaccgctgaaagacgaaactgcagcggcaaacgcaagcaaatacgtcgacagaaaatacgcagagccagaggtcaggactcgcctgagttttcttgttttttgtgagagcaagaattctctcgcgagtgccagagaggcgatgcatgcaccggtttctccatcgagcagtcgagagcgatttacgcgagacagagaaaaccgctgaagccagtttttttcgctttttttattcgccgttgattctccatctctccttccgtctcgctggttcacctttgcggggaggacgatccttcgcgtcaaatctgcaagccacgagggagacttctctgttccgcgggtgtcagcttgtgtatgtacagctgaactcagttctggaggttgtcgcttgcccccggtcgttgctttcttctctgtcctcaacttgttttctttcgcgctagacttcgccttctccgctttgcctctcgtcctcgatctcttcacttcttctgttttcaaga

SEQ ID NO: 815 - DNA, 1459 bp, Toxoplasma gondii
ttttatgagacttctctctgtgctgccgcctcgatggaggaggacaacactttttttctccggcggaactgcggttcatccacgcagagacaccggctcttgggcggacgttgttttcgccgttttcgctggtttcccattcatttgtcgacaatgtgtttcgaccgcattcaccgataccatttgtgcatggagcaaagcgactaggcgcctccgcgtctccagagaaccttgtgtgtagtgatcgtgaacacagaggttcggtttccagctgtccgacatctgttgggtgactgacttcatgctgtgcaataatgcattcagcgacatagtgttggttcgctggtaacatctaagtccttcattgtggcggaaaatattcatatcgcgtcggcatgacacgtccagaacaaggtgcatacatgcagactgacacagaagaattttgcagatcgattccttgtcgacacacggcaggcactgcatacctcgagacgatggcactgagaagcgcctcttgggatcacggaaaagtcctagtggagatagaccgtctgcagactgtggtgttcccttcatgctacgcagacctgcgtcacaacgcttcaggaatactgttggcctgagtcgaagaccgtcactgtactggatatagagaggctgagcaaattatttgcgtgcataacagcctgacgatggtttattgcagtatatctgcggtcgctggtcagcccgacatttgtataggaaagtcctttatcaggctggaacgcttttcctgttttcgtcatccgtgaccggaccgggcagctgaacagggagtgaaagaattttatggcagattatccttcagatctacctaccttgtccacactgtcatgaaagccgacgtcgtcagcattttactagttcatatccgatcgcttggtagctgagggtttgaaatgtgtgcatttagactatacaacacagtttgccgtgttcgtccactctcaatactggaaacggatagtggtcggatttcatgtgtcattcgtacttgtaacacatcggaataaaatttagtcgattcatgctccaggacattatcggagctcttcaaaggggctggcccacacgctgcctcagccccacatgtggaagacgttcatttttcgagtatttcgttgaggcggaaagcgagtcccgcccacaccgcttgtcgaaaagaggcctgccggagttgtcatcgctatcgaggaactccgatatcgttgttatccgcccttattctcttcaccccactcaacacagctggagaggaggcaaaaatggaccttgcatcgaaagaaaaagcccttgaaaagcaaacgacacggcacgacgccattcgcgtagagaacattagaaaggagagacactatgcaaaggagtggctcaaacggtggggtttcctgactcaaggagagcagcgagagga

SEQ ID NO: 816 - DNA, 4235 bp, Toxoplasma gondii
agaagaaactgcctgtgctgcctctatagatacacgcgtagaagctcaagtgcgcaatgctgcgactctgcgtggaatttgctcagtcctgttcactcatgacatcatgtacgacatcggcgttctgttccatgaaaaacttcgtcgacacggtgtcaggactggcatttacattgcccctggtgagtttcgcagacccacagtgtccacgacttgaatcccatagacagagatttccaagagcaaaaccgtttgtcgaacttgtagtttctactgcccagcagaaaaagccaagcaaacatgagttcaggtaagatgttggagcccaacacattcaccccgtgatttgtggacaggcgcatgcaccatgcgcgttttcttcctctcgtttggactttggtgagcgtaaacgacagaagattgggtgcgggtcttctctcacggttcatgcgcgcgatatacagtaagccatacaaaatacgcgcagaacacaagggatgtagagaaatctttatggcgtagggtactgaagtcctccatgccaaaaacacaatcctaggtgcagccttttacgcagaattactgaccaagcggtcgataggccaccccattcgactgcttaagactagcttggcaggcctcccgtaagtgaaaattcacagatgtacattcccagctgtgccagttacactacagtcaagtcgagtatcgacccaacacaccgagtgtagagagcacaactgaccacgagtatttccagactatcaaacctaatactcattcaccgaattaaataaaataaacttgtattgttggttcgcttcagcgcccaagactgagagcactgcagtggaattgcttgtgtggccaagtcagtgttgactctcgggtatacatgcatcggaacagcagtcgcgtattgtgcggtgacattctcagtcaatgcaccgcacctagacacagtgaaactcaccctttcctcaacccaaaagtggttctttggcctgcattcacaagtccgatgctcgaaactgcaatgttgacacacagtcgtcctacttaagtggagacaagcaaaaactatctctcgaagtagtcgcactaacagcctggcaagaccggtgatgtgctcgaaacgatgtctacgtagagttgctgctgtacaagagggaagggcccgcatcgtttgagaaagcacatgagactcgtgtgaccaggatagagcgatgagggcaccgggcgaactttcaagtgctgagttgctgatttgccaggtcttttccgacaagaatttcttgtggagtgcgcctgcgccggtggcgtgcccaccctcgataggaaatcctcacacggaaggcctgcttcggagtattttagctcagaccgcgccagccagtaaacgcctgtagcactcctgcttcattcctttttcctattccgcgtttgatacatacgactctccagagctgttcctgaatgcgctgtctttaacaagcacacacactggctatcgcagacagtcatgcgtaccaccggcaagcattgacggaggagtgacgggtgttggggttcggtgtggaaggccgctacgtcggttgctttcgactgagaggggaccttacttgtgggggagggaattctaacctcttattgggtatttgggcttccgtcacgtcacattcaaatgcacaagtgcaaatagttcgttgttgtgtcgttttaattcaggtttccacggcttcttcggtagcgaccggtggagtcgttttggggtgccgtcggtagagtgggctgccgacaggatcatggacaattggtaaagtcgacggatgtgttctgtcgaaactcagtggcgcagactctacattttggccgatcttttgaaacgactttgaaaaacgttctcaaacgatagcttcagggaattcggtattcgcgcccccgaaacggcgtagcggtgtacttccaatgacttgtgcctttgcagccatcggagactttgagcacccccgcagacaggctttctatacagtgtgcaatcattcgtctgcactcatacatcattcaaggaggaaacctggcagaaagtactctagataagcgctaacagaacggtcttgcgctccggcgtgacgcatgagcctggcctctatctagtacgaaacacacgagtctgtttgataccagtacaccttggaatactttttatgtgtgaacgtaggaactgtttagcaactttcaacgtgattccacactatgagtcaaatttgaggcgaaatcgggaacgaataggcatcagtcgcactccacgacgggtatattctgattccgtagtgcggttgccaattcgagcgtgtttgtcgcccttgaatcagccggggacgtgctcctttcacggcaggtccctacacctcaatctcttcgaaaagagcctcctacgtacctgatgatggtgtttaaggaacctaagggttgcttgtgatggattgtcgcaccggatgccagctcgctgctcccaagaattccgtaaatcacacaacgatccatattactttctctgggaacgctttggatagctcgcagtgctcgaacagggtgctgtagcatgcaacatcctagctacccatcctgctgctacttctttgacctgatgcgggacgatggcagatgcagaagattcttctgaagcatgtgtaaacgctagagtagctcccgcaatgacttggagcacaaagagaactgcagcttggtgagtggaagcagccctaaagagattttcgtgtgcgtgctgcactgaacttgttcgcatctctgtttgcttccacgatgctcacttgtacgcacaagcagtcgagctttgatggcgaacacccgcgcataagagtgggaattggaactgttgcatctcctcaacaccactatctatctatcggtcgagtaagttaatagtgttttctggcgtgtgatgcacacgtgatcacgttttcgccccgaacaaccgaccaccggagtcggagattatcaccgtcgtcgaacacagcatcagcaaggaaactcgccttctgtgccttgaaaagccatgccctggaggatgtcctgcctctcgacgaaaaaaacgtgacgttgttactggtttttgccaaaccaatggaaggaaagaatttctgtggcatgtttgcgggtcgcctgcgcgtgcccgtcgattcgatcagggttgagccgtagtcgtgtgcaagctcgtgtcaacttttttgtgtgtcccggagcgaatgagtttccagcgcttgcttctcccgctactcgttctgcaaacgaactgggtgaatcatattgacaaggaggtttgtgtttcgaggggattccgcacccagtttagaaaaatgaaccgttttctggggagagtccggaacgggaggacccaggcaccgccccggccggtggtggattgtgcacgagagtcggtcactggtgtgtggctgcttcggaacggtcgtaaaggtccttcgacggcactcgacgggacggctctttctcccgaggtggagttcgagacgacgcaaaaaccgcccttccatgcacacaagagaagattctgtccactgtgtttccagcaacccgtgttaaggggcagcagtggagtctccagttcggtcgtgcccggactagctagttggccttcaagggacttcttcttgtcagcggacggccgcaaaagttaccctgttcttcaaatccttttcgagagagggttttgaggggcttagaatggagtgtgtggccgctcttcgggaagggaatcgacctcggtgaaaaggaggcggaggaaatagtgactcctcgttctttttccctggctcgcggcctctgactttttgcgtgcacgccaactggttttcaccttttcctcccgttcctctccacgttgagtctgcatcaccgggaaactgtctgtgtgccttcaagcgcgcatgcccgcgtccaaatgagaggcaactgcctggtttctttcgactacccgtgtgtttcttcgtgccacgcctctcagttgctgacccaccacaccctagcgagtccgttgttctgaatcacctcgtttctccctgccgccgcattgcccagatacaaagcggagaaccacacttctcgtttctttcagggagaagatctgaagggatctgacgctcaagtgactcaaacctgcgtttcccgcaaccctctttcggccgtgacaacca

SEQ ID NO: 817 - DNA, 2138 bp, Toxoplasma gondii
cacaagatatttcggaagtccataaactcgcacaaaactgtgtaggcccttggatagcagaaactcgacggccttgctttgccactgcatgcctagagaggctgaaatccgaaagatgtctgtcattctcgtggtgcggaggctgcttcgtggtggtgggttggctttgcgtctgtcttctttcgcgccctgccgaggttttttgaaagagggagttttgcggccaaattttcaacctagctagtgtttatctccagtcagatgttctttgtagttatcctgctggctgactgctctctggttcgatacttgtcacgttccgcagcctaatgtggcgaaagtgcatccatttgattattcatgcacagagggcaggacggcctcaaagaggtgtcccgtttccgcagtttgtctcgatgtttatgtgttgagggcgtcatttcctgattcactctctgtttacagcagtgttaggaagaccgaacgttcgatagaagacccgcagttggctctttcgctaggctatgggcgttttttgtcacacgcaacgtgaattcttatcgtggaaaccagcgtatttgaggattctgtgtaacatccgtcaggtatcgcactgctctcagagtgttgttgtccaatgaagcaaacgtttctcctgccaacatgagaaatctggttactcttgacactcttcggagcgcctggttttttcctacacaagacagtctgtcactgctgcgtcttacagtctctccggcttcatctcttgatgtggactctcccgtctgggccaaacaaagcatctcggaagaaaagcactgtctgactgctgcctgaagcagacttcgagtgtagttctaaccaacagcaacatgcaccatgaatgtcatagcagcaaaccggtgaggagggctgccaccggaactgctcatcatcccttgagctcccgagtgggataaaccgtggaaattcgcaagaccaccctataggcaacatctagaggaaaacctgacaacacgaactctgaggaggtacttttgtggagtgaaccctgcgtccgtcgaaaagccagcatgtcagctgcttccaagaccgttccagagttcccaacgggacactattcatggccaagttggtctcccgtcggcttccggaaacggggagaggcagatgcatttaaaagaccaaccacgagtttcagcggggcctcgaaagctaaattttaggcgtttgcacttggtggactgtaggcgagaagcaaaagggaaagagaaagaacgagagacccgcactcttgacggattaagattctggtattcgaagctcgagtctcagatagtaatcctagatcaattaggggtgacatgtgggcactcacctagtaattgagagacactcacagacccaaagctgtaacatggtgatctcaagcgtctggcatctcgcagcaagaggtaccgccgacagcagcggcgggctggcgtgtgacatgacggctgcattgttttttccttgggaattctttgcttccgccatcaaagcggtaaaagcgcttcgttgtaaatcactaccattcctcgtgacatcgtttctttccagcatttcagcttgctcgtgcgccacactttgcgctgactttccctcgtctcccatgtgtccacggcgttcgctggcgcaccgaacccccctgtgccgcctcgcggaatttcgtttcctttctcgtttggctctgctttctttttaccgtcttttttgaagtctcgattcaccttgtgttccggataggaagtgcgttggcaagaagttcggtttctcctgcttgtgcgacggagactccaggggtgccgcttttcgcctcctttctgtgtctcgcggggggcggcgccgcttcaatcgaaatttcgttttctgagaattctttcgcggccgcaaaccggcacgcgttttctgagagctggtggttcttggtgtctctgtctcgggactttctgtctttttctcgtctcctctgctcacggcgaggccctcggcatgtacatggcgccaccgcgagccccggggaaagtccacgcatctccagttggagagggagatttctgttcagttcgcgtttacacagtcctgcagaggaaccagga

SEQ ID NO: 818 - DNA, 2465 bp, Toxoplasma gondii
acattcatgcatctcttcaacacacacagttccacatacacatctgcgtacacatgtttcatgtatatatatatatatatatgtatatttatatatatatctatatgaatagaatagaggaaatacgtacatacatatttatacacgtacacgcatacgcatacagagagggaactctgtgtctatgttaagacgaggaacactccccccccctctggagataggttacgaaagaggcctcagtcgaaattcgtgtagatctggaagatgatattccacaagtttttccccgttctctctgtctcgtccgcttctgtctctccatgtcccgttcgtcttctctcctccacacccagacgcgttctttctcttctgctgtccctcctccgctgtctgtgtggtgcggtgtacatacacattccggcacatcaatgcacggggcgagtccggttcccttcgtttcgcgttttccagagagaggcgaagttcctgactgtttggaggagacggtggagtgccctttctgcctgagagaagcgttggcagctgtcgatgcactcgaaggcttcttcgcgcatgcagacgcagagcccgcgacagaccgcgccgcggcagacgccggaaaggtctcgttttgcggtcgacaagaggcgccgtccacagaggcctgagaggcggcgggaactccagaagaaggcgtcattttggaatcgacgacgaaaaaaggaggggggtatggggagaggacagggaagaggatggagcagaggacagggaagagagaaaatccttcagaggcgtgagggcagatctgacgtcgaatctttgttggggcacccccagcgaattcaggagagattcaagcgacggaagagacgagagcggggtgtacagacgcaggagacacaagggcgacggacaaaaggaaacaggaaggggtgttgcgctcttgagagagaagatgcagaggaaaggagacaagacaagcagaaaataaaggacgaaggaagcgcgaaagggaagaagagaagagaaaaggaaaacaacgaagaaagaagagagaacaccgcgctgacaaaggagggggagaagagaagagcttcgtcgccttctcccccccagagagaagagacgttcaggcggatgtctactcaggaggccgttttacggtacgaaattccttccgttcacaaccaagaaagtgacgagtcttgatcttcacacttttgaccgcaaggcagaagacgacggagcctaacgtcgtgttttcctccggagtcgactccgagaaactccgcattctggagacgccgcgcccgcctcaaagaaaaaacaaacgaaagagatcgtttcgtgaaactgtatgaaagttgctgatgtcttcctctctgcttctctctcccttctctcgcgtctgcccttgcatgcgttcacagccgttcgggagattgtgcctcctggacatctcggcgacagctttgagagacaaggtcggagaatgttctttgttgaaacgagttctttcggttgacgcgttttcttctcagagagagcaacgaaactgcggcgaaggaagatcttttttctgagtctcgccgcttggcctcgccttgtcgcttgcgccgtctcaaaagaacagcttcttagtctctgccggaagggccggtcgacacaccagtggggtgtccccgttctcctttcgggcgtgttgggctccaaaagggctcagcaagaagtcagagaaaaaggcttggtttccttacgaaaaccgtcctctccgacttctttttcctcgacttccggcaccagttcgtctccgctccgctgcgcgcagcgcccggcggcggtcgacccaggaaattgttccagatccctttctctcagccaacgctgaagcactcagtcctctccgctcttcactccacgcgctcgcatatatatatatatatccctatatctatatatttatgcatatatatatatacatatatacgtatgtatatttaattttatgcatcctgcgtctacgccgttacgtccccaagtattctgcgtgctggattttacgtccaacacgatctacacttacgcatatacacgtatgcatacttgcagagacgtgtatgtatacacagggtttgtatgtgaatctgcatcttcaatgatattgagaggcatgcagttgcttcagtgtgtctgtgtgtgtgtctcgcaagcgacttgcctgcgttgtctccctgtcaatttttgcgaagagctggacgaaaacgcgttctctgaagcattctcttgactcctatcctgatttttcggaggaaccttggacccccactctctttttttcaaggtcgctgggtccccaaattctctctccgtcttcaacagagtcgccgccttccacttgctgcacagacagctcgtttcaacgtttcctgcagccgtctccctctccttcactgagagaa

SEQ ID NO: 819 - DNA, 2810 bp, Toxoplasma gondii
tctcttggtctagccttccacctattacaaacatctcaagtatccgcagttcatttggacagcaggagctactgcagcttccccagtcccgcacagtattcagaacttttcaaatacgccgggacgagtagctgggcagtaggataagccaaccagcaaagaggaagctttcgattcaggcaccgcacgcaaaaaagacagactgactctacacggttttctctgtcttttgtcatcaggctgttcagcgtccacaggatatatgcataaagcattctgtccctgaagcatcccagcccagctatagaacaccgcggtggtcagttttctctgcgggtctagatacacgctgcaaacaaagaatgttcaaggagaagcaagtatcgctgcttttctgcgaaatataggagctaacagacgtatccgtattccgtgtatcacatccattagacacgacgtttccaaaatatagatgttgcttggccgccagaaaacatcttgcaaaagagaaaagacactacttttcagtcaaaaaacttcagaacggaaagggcgcagcgtttacaaatagcgtcattcaggatcgtatacaaaatgttggtggagaggccagtctgcatatccggtgaatctggtggacgcggccccgcgtttgctcgtggtgacaaccaggtaaacgattcacgatgtactggctggcatgattcgaccgcccaacagtggagtttgaagacgtgtcgaacaccttgtttgagaaaaaaggaagtaaaagatatcctacctccgcaatgcaagcacaaggtttccaaagttaacttgaaatcttcagccagagacaccgtagcctacctcgattgcggcgaaacgacacagtgtttaccagtggtcggcggcatcgctcgcctgccttcccccgcgtttctggaatccctgtactctgggtgaaaactagcgttcttctctacgagctactgccatcttcacatattcgtcccgcagaagaacgagcaagaacttggttcttctttccccgccatacccctccatcaccgtgtagcacatgggaggcccatgtactttttcccttctgccctcgacgaccacatgaactatttgagggtatctgcgtcttttaagacagctctctatgtagcataaatccttgctctttctcatttcacacttgagagagggatgtgtaaccgtttccgtatctggtgaattcgtgctgctcacgtgtgcctcgagtgtgccacgcgatctagttcgtagtgcctacggccaggttgatcgacgaataaaatatacccctgccttgctgccacctccctgcttatgaagataatgcaattttcagctaatgtctagtgattaatggccatttccttcttgctggagggatgagaagacacgctgacgactcaaaacgaggttctacatgctcttacatgctcatccagctcctcgtctacatgcaaattcttcttaccatgagatacagaggcttcaggaacgctgcatatgcacctgagctgagcgttagggttcaactgaagagcactcccgacagcccaaaccactggagattcctcttgcatttccgtgtgctgtcctctcaacctctgctgtttcacgatggcactcccgttttcacggatcggggctcgtgcccggtcccgcgtttgtctgtttataaccagccagcaagtgttaccgcgcccgctctggagtcagcccgttcccacgttccatccagctctttcacggctgtctgcttcctcagggtttggactttcctttcgcagcgacagctgctttcctgccgcccaatgtttccgcgacaatccgctcgtttcccggcgacgggcaacagcagtggcatgggaaaagatggccaaacccattcgagagccacctcttgtacgcggttgagtcctttttaccgcgaatggttgagtccctttgcccccttcccctttattctctacagcgcgaaacccctgctgttgtccgcaaagatatctaccgaattaatagtgcctcttgttcaccagagatgtccggccacacccacctgcttcgcaggtgtcttcttgagcgcgggaacagcttccctccacattgcatgcgatgggttgagttgtggcgtaggtctgcatctaggaatcgccgcgtcttctgcctttccagcgacttccaagtctgctgaacgtctctctttggtctccaggtttgtgtctgtgcatattttggtctgtttctgtcaacggacttgcgtctccgactgcgcagcaacggggtcggcgaaccttctgtaacgcgaagcacatctcgcggtggactttgtcgcttgaatccggtaagaaccccccagatttgaccatcgttcagtcgctcgtttcgttttcgtctctttattcgtttccgaagcgtatcatctcaattctccacataaggccttttcatttcgctagagcctagtcgacccagcagccgagttccgggacttccgccggcggcggggtcctttcctccccgcgatgggtttctgagtccaggcagttcccactaccgcgtcgcgccttttgtttgtgtcggcctgagtgccacgaatctcgcctgtgtctcgcgtcccgcgggagtcaagctctcccctgccaattcaccaagcgtcctctctgctctccgacgacgctccccgcaccaactcgccggcctcccgagacgcgaggcgccgcttcgaggctcatgccgcacagcgccatgtccctcttcttccttcccttctgttggactcaacagctgcacga

SEQ ID NO: 820 - DNA, 3102 bp, Toxoplasma gondii
ctctgcgagagggtcgaagttcagtctctcttctggaagagagaacgcgcgaagaagcgacggaagctcaccaacgctgaggcttgcagacgagagagtggagagtctctccggcacgcaggctgaggctttgcgggagacactcgcagccttcgtctgatcgggtgtgaaggcaaaagaggaggagactggacttcctgttgcaccttcttgcttctgttcccttcgcgcggatccaggagatccaagagaaaacgcggaaagagctcgcgcaacaaacgacgaggcgcgcgagggtgcaggagcagaggtgactctcctcattctgtcaacgaaggaagagcgagagagggcgccgaggccttcttccccgggcatcggagctcccgcagcgctgtcgtccatcttgagaaggtgagaaaaccttcagaacgtcgggtggtacttggatccggaaacgtgtctgtggagtgtcagaagatttttgaggggaccttcttggaggcttgcccgttctgtgactcgggagtctttcgtcgccttccgctttcgacggcaagcagcttttcggcgtctagacagcaaaaggtggacacaaacggagagtactgaagcgtggaaagaaagagttccctggagagcaggtcggaaacgaacacagtcacggcaaaaaacgggaggaagggggacgagcacacgtggaggaggcagacagacgaccagcgacaggggcgctgagagcctccgagggaaactgcgtggcaaactgcagaaaaatgctgatcttgtgtttccttgcttctctcctttctttctgccgggcaggagcaaggaaagaggaaactctgccttttgaaaaaacgacgctcttctctcgagtatactctctatcccttttcccggagggaacgaggttttcgctagcttctgcacgagttctcagaattcaagcgtttcatgcaggcaaagacgctgcactttttctttgtgagaaatatgctgaagtgatttttgaaaatccaagcactcgccagaaacttttgctttcagatccaccacgcgacgacttagcgctcgcgggacggcttgggctctcgttcgatcacagccacttctttgctcaaaagaaggagcgaaaacgctgtggttaaatatcaacaaggattgacagaacgcctgccattacagcgtcttctacctgcaactatcaatatgtaaatgtacgtatggccagacacatctccgttgagatgcaaaattcagaacggctgagcgtcgaaggcgtcaagcgcgacacgaaatctgacatttgtcttcttcaccagttgaattttaaactctcagtcgcgttgaaatcgttcgccgagtcgcttttcgtggttctcctcagtgcaaaagggagcatggacctccaggaagttatcgctcgacttggctgtcgccgctgtgccgccggcagaagacatactttacacgacgctggacatcaaagctcacgggtactgacacagcagctcgcaaatgcatctttgactgaatcgacgcaaagtcatataggcagcctgcaacaatcaaatagacatttcttcggccgcgactcgccacttgggaggaaacgacgaacgtgtcaaatgaggcaagccccaggagcaaagattgggcctttatgaaaagccacttcctcctcggatgtggacgtctctgcagaccatgaagaaacttagtgcagagactggatattcggtgagttgttgggtcggggcgctttctttggagaatctgtcgttttctgcgaagatcgaccgcaaacgctggcaaacgcgcgagcaccgtcacttccccgctctcgctgcccagcgctgtctcgaaactccttcgatcttcgctcttgatgagctgagcgtcgcagaccgtgacgtaccctgcaagacggaggccctgctttccgggtgctgttcttttgacggcttctgccttctcctgacagtactggaacggacatcctctaaggaatctgtttcggagaaaatgttaatcgcaagactcgctgcgccacggccgcaaattgccgtgtcgaaacccacgtgtcttgcagctatgccaattcgtgccacccggtggaccacatgcagctgaatccggaggcacagaaaactcgtttttcaaggcgagattccctcaattcacaattcgttgggttttatgtgctggtccgcgcgcttcactcgcgaaaaaccgcacgaacccgtcaaattgtcgactccacagtctacgatctagagatgcgcgtgcgtcaatcgcaagcaacaggtgagtgagctcgagagcgcagaggcaagttcgccgaaggaaaaaaagtcaggcatgttggagaagaaaagatctgagttttcccaggctttctggtccttccatgtcaaacccggcggccaccttcacgcagaacactacaacgcgttccgtgtcagtcgtgggggagcccgcttttgcctagagtgaggattctccgatatttgaccggagaagtcatcaagacacggacgaaaaggtccgacagcactcgttcatgtcgagagcgcctattcgaaaagtgtcacttcgttctgaacggcaataggacctcccactggttcgtcgctccaggtctttctgcctcgacttcgcgtctcgagcctggttcggttgtcttcccctctcgcttttccggtgcgcatatctctcgaatctgccgttcgctcgctcttacgttcggttcgtgatgaacctacctctctctcctcgtcagacaccactcgtggaggctgcttgtgcctcgtacctgtggtggccgttttcggccccgttgccgcggttagctacaattgatccgtgtctcagttcgttcccttcgctgttccgtgcatttcttcctctcttcgcatcttccttattcgaactcgcctccgattcgcctcgtggtggtgtggcttcctctgcatcgcgctttcagcttccctgtgccctcgcagatcgtcttctctgttggccgtcttgttcgatttcaaactatcgctgtggcaaagcaacctcgaactcaagtatccgcagtggtgacctgcaaga

SEQ ID NO: 821 - DNA, 2827 bp, Toxoplasma gondii
aaaaagagagctgccggcgttgtacggagagcacgggaacctcgttgcacgaatctatctcgatggttccaaagtcgttttccggggaacgagcgcgacctcccaactccgagtaccgtcatgttctctatcactaactcacagtgtctgtgttccgcaatttcggaagtggccttggtggacggtgtaccctccattcagcactagctcgatggaaagaaagataggccggctggactcgagctgtggaggagcaggcgggggcgagtgcgagaagcgaagaagcaagagttcacagaatcttcctcgttaaaagggagacgagtctctccacgcagttggacagcgagtaggcagagtcagtgctaaaagaagcagcaaggcaacgcgaggggggcatcgggggggaggggggaaagctggatacacattttagagacagaatcccagagagctctccccgctggttcggcaaaacgtcgcaacaagtcggtgtctctccacgttgatgccgtgcttcgttcctgattctttgcccgagaagtttgacttcctcgcgctcgaaaatccccttttcagtcggactcgactctggaactggcaagtttcgaagcagtgtcggaagcaactaaggcagagcactgccccagacagtttgagagtcccgtatttctccttcattcacaaagagagctaattcgacctttacttttcgctgtggcaaatcgagtgtccactcaagaaagaggcgcaggaggagctcctggagcaaggaacaactcagaccctcacgagaggcgtacagacagtcgagagggggggaagaacggatggaaaactggagggatttgaaggcgttcctaggaactcggaacgatggcgaatgtgcgagacagaggttctttgttcttgtctgaaggcgagtgcaaggatccgcggtcttcgggattcgacgcgaaatccagcttggcaacgaaaacaccatcttctacgacgattcgaagcggccagccactcgcactgcagttcttccagtttcagggcgcctcaagcatttcaacctcctgtccgagtaaaaacagcttttctaactatatacatatatatgtatatgcatatcaatccatagacacagatatgaatctatccgtctctcaatctctacacacacacatttatagatatacatatggatatgtagagatagagatatctataggtatagatatactgatcattcaaaaagggtgccacgcgtatagaagagatgtctcttgacgtttctgtcgccttctccaacctctgtttagatatatgcacacgtttacttgtacatctaagagtttgtgtgaggtgcagtgtctttttccattcttgcgtggaggcagcactgctttacgtggtgccggggagattcgtccctcgtttttttcatacagacgtacgcacctgtcggattctgagtcgcttgagatcttcgtcgactttttcctttcaaagtgtatttccagcttcgttccgtagttctactaagttcagttagtcgttttctctctcttgttctccagacaccggtcgacaccttcctgttctgccgtagctccgatattcggttcgcgttttctctgttctacgcatctctctgttctctgacacgcagcttcctcctgcttttccatacttgtctttcttttttttctgcggagaaggcgtcgcttccttcctcacctcttcctcttcaggagcctccgccgtcggtagactttctcttcttcactcctatacacgtcgcacccccgttgaggcggcgaaagtttttctcggagacttagaaacaactaatttccctcgttcgaattgtccgcaaatgcctgaaaaagattttcttcaagtgccttttttccgccgagaactgttctgccatcgacagctgttttccactcaaagcagaaaccgagaaggcagccttgccgggtgtcgctacaacacctgcagcaggctgcttcgcacgaaccgtcttctcggtgtctttgcgtttcttcctcaaaaaagtggatttcctctctcgccgagaagcaggctccgacacccactctccgtcttgggagtgcaactcgcttttcttctgaattcggcgctgcttcgagagttttcggtccaaatctcctttcctctcctcgctctgtcgcacgaaaaggtcgacgcaaggcgagagaaaacgaccagctttgagagaggacaacgtcgcgcagctcccaaagaaaagcgaagagttctcttcttccaggggtctctctaacggcatctttctcgaaaaaagacaaagtccgcgtttctccaggctcaatcgtcatccgcctgtctttctcacgtgtcttctttctcatccggccgttctccgcgtcgtccttttcttctggcttcttcttcaaaactctttttgtctcgacagattcctcttcctcctccctggtcctcctttctcactgccggatctcatcctctctccgtctattctccctcgtcgcccactgtgtgtcttctcttaacctctcagtctcctctcctcttattgtcctcctcttctttctcctattccctccctctcctatttttctcctcctctttttcctctccttctgctcccctttttcttcctctgcttcgtctccttctcttttcttcctcgtttcttccttttcccccctcttttcctctctttctcttctccttcctctcgcttcttcctcatctttctcttctccttcctctcgcttcttcctgatctttcttctccagagaggagtgtcctgagcgcgcggtacga

SEQ ID NO: 822 - DNA, 4190 bp, Toxoplasma gondii
tggaaacagcgtttatcttatgggcggcactttttatttaagtgacaccggcgcttacctcctcggcctccgaagctgagcagtatttttcgatcagtttactggttgatgtaaactagaactgtcgtgattggaaatgcttcatcagatgggcgaaacacatcgttccatactgtgttgaattgacgcctaaacgaggatcatgtatgtcatgaacgagtggtcaggggcatgcattctggattatcatcttctagcaaaaaacagcgacgtgacgactttcaacgaactttttttctacaggtgtgttttgcgtccccgatacgtgcgttagttgttccatgcagtacgcagttccatttcttcgcacttgacaaaaggcttcgctccccacgcggttttcacgagttattcaaccacagaaaacattgcatctggagaaggtgcgattgtgaggagtggcgaagtagttggcatctgtcacatcctgcgggattaactcccggcggcaattatatgtgtgttcgaccatttcttagcagtcaagtgtactaacggcagcaaggcttgcgaagcaaagcctgatacctggagagcatctaagggttgcttcccgagtcacgtcatgcagtgatcacttcgtagcggtagtaactttcgaagacgagttgcaatcatgtggagcgccaactcattgataccaatttgttcactgcaccacgtgggatcactacgcgactcacgtacaatgttgcgaacatggtgaagaaagcaccatttctcagtgtttggcccgagcaaatccaatttgcaagttgtctctatcgaaaactgtatagtaacagcggaggaatacctgaagcggagagagagcattcgacagccgtcgaacggtgctggtgaaaggacccaacctgtcctagtgtccagccgtcgagtgcctgtaagagtgattgagtttcacaagtccaggtgctaaatagttgggcgagcttacatcttcttctgcagcgtcatccatagctatgccaagcatacactcgcggcttccatcatcttcaaggaattcaaggacgtagtcgtccgggctcagtcgcacctctactacagaatcacctcctgttccgtttcctgtagatgttgccttctctgagtggcagcagaaacaccttaccatgctgcggattacccaggaactgcagaatctgggaaaagaccgttcagtttgtcattgtaaacaccaacaattctatgcgcggcattaccaaatcaggaagtctctttttgtcgtcgcaggaagaaactgagatgtcactgagctcattctccataacggtctgtatggtggggatttcaagctgaattcgaggatcatgatttggtgtgtgggacctactgcaggcgcgtatatgaggtaggtgccggtgtcaacaatcgactttttcccatctgcaggatcccaccagtgtcacaggtgaaagatgcatggtaacagtggatcaaccgacccgtttgagttactgcggtttgcccgttttctagctgtttcgtcacagtggcaagcgagctggtggatcggggttctttatgaacaccgataactttaactaacagcatcatttcgtgaacgaggggcctatgcatttcccgttaaggtttcgaacctgtccagtaactgtctgaagggtccacaggaatccaactatttgtatcaagacatggtcaaaaatcggtgttgggctgaaggcgctactttacgtgcctgaattcctccgtggggtattctttctttgacaagtcagcgccaccaaaagtcatggaaccgcctggaagaaaccagcgcattatcggttgtgtttacaaggaagttttaaagcacactttaccgtccgcgttgaggtagtaagcaaactggttctaaacaacaggcagaaatagattctgttgctctggtgaaaactggcagctgcgtaccccaagatgtttggattctagggccttcgtttggacgatatggtcaaggctacccaggaactgttaacactctggtcaatcgatttttggggaatcgaacgtacaacggaactactcccctactggagatctcgtggttcttgaatccaagaccaacgatgccatcctataccaagatgataggccagtcagtccggcgaccatgatgagacagtgtccatacccaggcaagatctctcagtagaggaatgtccaccagcgtctgtggcggtgaacggacagtgacgaactgcgcgccaagtttgtgactgatagttccttacgccgaacccaatgttcgtatgcggtacagaaatgccattgccgaggtgcaccgtgtcgtagcctacttatgcaactgaacagacgcggattctaacgacaggcaaattctgcttaccgtcgtagccttggagtgtgccactcaggtacacgacattcatgaggcttggcttgccgttttgattaaacctcggctgaaatgatgcgcttctcctatacttcgtgtgaccaatgcactgcatggacagactgattatgagtagttcaaaagatttatggctgggttacaaagttgcaagtacgctgaccaggtctcatctggcacccagaactcgcacgatccagtgtcgaacagaactttgaatgccctctcaggttcacttcctatacttatttctccatagtaagtggctggaaacgaggatcatctgactgttgtctttgtgtccatgattccgtcacggcgtacctagtttttttgacgcaataacttggtcgtgtaacggaatctccgacaccgacgatagcgggtgctgcctaagttgaaggaactcaggtatcgttttcattcgattagccatctttcgcagctggtgaagctgcttgacatgctctttctcatagatagtgtctattttggacaaaggtatagagacgttgctgtgttggatcttcgccgccgttgagtgcagcgctgtaccccacagcgacgcgagaactgtaagctgccagactttcataatggtagtcactttagcagcgattccacttttatccgggggacaaaaacttgagagcagaccatgctcccagctggccacgttcctccctttgttgctggcgtcattacaccgggggacggttgagttttccttgttggatgagtcaggagatacgggagcgactgacactctcaaaattggtttcgccgcacaagttgttctaaccgatgttgttgcctcctcacactgtgtgagtcacaatggccggccatggattgctcgtaaccgaccccttaacgatgcggtcctcagttgccgagctcgcttcactatttgcagtgctaattgcatgcctcgcatgcgacgatggatttttctcagtggaagaagacattgtctacgtccagcggttgccaacatagtgttctccagcactgcaactctccgacctcctttgtcaacgtcttctgaatttggcggtaatactggaggtgatcagtctgcttggcaagatgggagttgctgccgtgctagggagccgttcctgtttcgccagcttggttcttgtatcttgattcccactcgtagtggcggcagtgaaaaatatgtgttgaaaccagcgatgtagttgtgttgtgactgttgctagaattggttaacgcacacttttcaggttacaagcgtttttggacagcagattttgaccagttcaagactcgactgtgacttgtgttcgcaagacgatgttccccgtcgtccaggtggctttgtgcaccctagatgagcaagatttactgtcgttttgtctttccgctgtgttttatttaccacttcacaatgttttgagcgtgccttccacggagatggttagtttcgccgtttgcggggtgcgggcctggcaaagcgcgtgcagcgtgtatgctgatgaaaaagatttttcccacgttagcaagcgactgccatttttcttcacccattgtcgccagttcagttgaacctattttttcagtttgtgcaataccggtgagccactagcttatgcttgagggagaccgtcaagatttcatctagacaggttcttgcatccactgttgcgcgccgcgacaaggccatgcttcacaggtcgctggcagtgcctacgcattttcctcgtattcaacaaaacgcatacaa

SEQ ID NO: 823 - DNA, 2071 bp, Toxoplasma gondii
ggaggaattgtaagcagggttcccggtagacaactctttagtccaagggatatcggtaggaccgcgtgaaccagcaggcacatgcgagcgagctcacggttcaatgtttgccagttgtacgccttcttgtcaatagagtttgccgagctgaacagaaattgaacggtgaccgcccgccttatcgttcctcgaaaagccgttcggcccttctctgagtgttactacgtaccataagtatatcagtgtgcaacagattagattgttacctgtaattgtgcagctcagccattttgggaagacatgaattcaccaactcggccattagaactgcaagagacgcgcacaccgggggcgtcatcatcggcacagtaaaacagcatgcggaactcaatcagtggtagattgcaaactgatcctctttatgagtccaccgccaacgtccgcagtgctcaggaaatgaagcactgccggatagcaagctttgtcttccggtcgaaacctcaccaccatcagaaaagtcgcggctgatatttcgtttcggcctggagagaggaatagtatccacccagtgatacaactcagctaactcttcgtctcccggaagcggcggagccaaagggacgcaacctgacagggaagaaggaaattcgcatgggcaccctagggaaatctagttgtgcgttccggggcaatacaactcatatttcgtaatcgactgatccgtagtctccgtcgcctgttcgtcccacagaaaaccaagggcatgtgaaacctacgtgaaacacagttggtggaagtgttctgacgaagcggcactacggtcgttcagagcaaccggcactacgatatttctgactagctccttctaagaaaggctacctctcagcatacttttagatgctcccttgggaaaagaagcatggagcgaggcagagctcgccatgattggcctgtttgcccgaaaagattctgctgctacgctgaatctagaatgtacggactggcaacaaatgacgcccgacgcactcgtataaaaactgtggcgacgccttatcctccgaggtccgagaaggccgcacacgatcagctatgtatgttgtgtccttcggagtacccgaggataatatgcaaaacagaatgtaaatatttacgatcaagttgggtgggggggagggggggcgggagcgacgcaaaaactgtagttcaccacgagcaccgccgccgccgacccagaccacgtcaatgactacggccacagactcgctacctctgtcaggagaaatggtttcaaaaaaagcttggaagagaaaaccacatttctctgtgacagccttttggttgtgcaaattcagcgaacgatccagcatgcgccattagaacagtcgtgcgagcgctggcgtgctgttgtctcttttctcagatgcagccggttgtaactggcctgttcgggagaatccgagaaagggaccgggcagttacgaataatggggctcccccgtgcagttgctggtacaatgatgcaagcatagttttgaccgacattgactctggagcgtaatatccccatgttcgtgtttttagcggaagcgcagcgacgccgagaaacgtgctttctgttgccagccgcggccccaagctagtctgtcttgtgcatcaagacagcatagggaagagataccagcatggttgggacacgaactccgcagaggacaatgagttaatttcgtgtctgccttgaggtaccgtgtggctccctggaagcctgactcctttccatgtatttctactgcctcttgtggctctgcgtccgggttgcgatgctacgtatctttgttcccctgcagcccaacattcgttggctacactcgctagctggactttgcctctaacggagcattttggccggttcgtaccaactgactttttagtccgcaagcgtccatatcgaaaggaaataccacccgcaggcgtccctatcagcaggaggtcccaaggaaaactctccgcagttcacgctttcaagcacgccaaacctggcagaggtcactcaattcaggttatcgccgggaaa

SEQ ID NO: 824 - DNA, 2983 bp, Toxoplasma gondii
tttcttgcgcatcttcttcgtgtcacacactacgtctgtacaggtgcatgccgagtgcatactcatatatatatatatatatatatatatcaatatatatatatatatcattatgctctgtaggttccttgtaactttgctctgtatagacttagaggagatgagcactttttgtacgcagatatgcacttgtgtgtgtatttatgtctggggatctaagcagctgggagacagggagcagttgttggcaaacagtggcattcttctgtattatttctccctttcgtgacgcagctagtgcatgctatgtccagccttgtcacgtcctctcaaaaacgaagagaaagactttttaactccaggaacgtgctgtgctcgggtcgcaaaaagagacgtccttgctgcttgggtctcacattttctgctgttattctgacacgggtttccgtcagcttctctggcagaaaaaggggaagtgaggaagaagcgagatcgggacgtacagcaggaaagcagatgaagttgtcccggacagacctcttttgtctatgctcgatttcaacacccgcaaatccgcagggcggcaagtacgttggcgtggataggcatattgctcagcgtgaacctgggtcctcacgagttccgccacttaaattttcattttcttttcgaattcaggtacaaccagcattagatatacagcgcgacaatctttgtggtggaaaattattgctgttttcgcgttatgttgtgtctttcggggcggcttccttgccttcgccgtgctggtggaaagcctgcctgtcatcgctggcggcagaatcgagggttgtctcatcgccggagattagctgcccgtcccccggatgtcggtgtgtctgctgctgtctctttccaaatcttcgatcacctttccaaagtagatatttgtagcgctctctcttctcaacttcccggtgaacaaagtctgtccttgtgaatagtatgagcaaaaagagtcgagtagagcactgcgaagattttcgaagatgaagcccaacagcaaaaggtcgtgaatgtctatccttcgtgctgctcgtcagtacaggattttttaacggcgtcacagtttatctgggtgaagagtgacggtagaaagcaatgcaccatgtgggaagaggggatctgtcattgtttgcgtcaccgtcttggcttgcaaaaagtgtacgggaatcagaaccatttttcgccctcttgcagaagagaacttcgttggcaactagtgacgaacacaatcttgcacacgaatgccgcggctccaccgaccgctcggcttttttcctgccctcgttacaggcagcctgttgaatggaaataaactgctctcgtgaacaagaaatcgaaggccaacttcgacacaggaaggggtcagccaccatatacaacgtgttgtgttaaaatgttgagtatagaaaactagaggaggtgtgtgtctggtacatcagttcaggattgccttccaaaagggggagggggcaaaataaaagacagagaatcgctgtctaaaaatacgcagcagtaaccgtagctatggataaatgcttattctcgactttgtttcctacgacactacctaacatgtaaactctgcttccgtcaatgactgactgggttgacgacggggacttgaactgaatatcaatttcttagcctggaggttataagcagggaactagagagccagctgcagcgttctgaaatgtctgcttatttttagactgtcgttttaggcagaaaaaagataaggggagatttacttgaaaccagccgagggtgtacctttgagaaaaactgtaacgctgtcacaccgcgcccccaacgccgcttatgaccggagaactcttctcacgggggttcctcagttctttgggattatcgcttaactctgtggtcttgctgatacatgacgcgcgatttctgtgtgacagtaacccttgaagaaactcgtcaggtctactccagtagtcttttctcaaagacattttgttcactgcggcagcatttcacaccatccagagggcacccaatcaccgggtaggaaaaaagatcggtgaagggggacgagaaattatgttatttgcacgggtggagggcttcgtaaatgtgtgctttatcttcgtcctgaacactggacgccatcggtgggatgcttccttctgttaaacattcacgcgcttcgtccccaattagccgcagttattaggttctcgtgcaggaggtactcaaaccagagagtgaagacatcgctcaagagctgggaaactggttgcagcgtttcgacacgtcacaattcgagtaaggatcttggcataatttcgggcacaacgagagcagagggatatcatcggggacttcccgcttccagcgttctggggtgccagctgtcttgcctgataagaagcacctttgctgtgtagagactgtcgcagcaaactcgaggcagaacagtcgatgttttcagagattccgaacgcgatttctgtcttgggattaagcggcgtcaagtcgcaagcaggaattgaccgctagccgtttgcgggattggaagttgagcaggccttcgtggctgttgccgcacgcgctctgcgcgtgggtctcgccaacacttggcaagacattgcgacctgtcgggaaagtgtggacgtttggtttcgattcactgtcgacagaaaatcgctgctcttctgtttccggactcgagaaagtgtcttgctcgtttctgcctttgtcgcgcgatttctccgtccttttacggcaaacctaagcacgttcatgcaggccaggaagctctgcccctggcgtcctgagaactggcggctgtttctgtacggacttttcgtcgaactttctccttcgtcctgcgcgccttgccgcaaatcttttcggtaacgaggtttctccgcgtcttccaccctcggtccagaaaatccctttttccgcaaaa

SEQ ID NO: 825 - DNA, 2409 bp, Toxoplasma gondii
acggaaaatttcaaggacccactggtgttgttctgttcgtggactgtcttccggttggcgacggcaccaccgttgttgtttgtgtctaaagcacctggcgcacaacaccctttttgcgcatccttttccgggtgctgccaatctcgttgtcacagatgtcaaagcaaaagtatttggctcccgtgtgtttgtacacctagatttcgtccctcgggggtgggcagggaccctctggtggcgactgtgcttccagggtgtaggactcgaagtacgctctggtagcttccctgtttctgcaacggctttagtggtaacggtccttcagtttcccttagaagcttgctggaccacgcatgtgggcacaccacttctgtctgcatctgtacgagtggagaacccaatagcaccacgaggcagccacggtatcagacgtgcatagagtcctcacgatatacgcacgcgatcgtgtcgctaccatgctgacagtgccctggcagatgtgcaggaccatcttacacactgctcagtggggaaagagtgtagaggcgacaggcaaccgcaggtttccgttagaattgaatatcgtaaattgttgctggaagacaattcagctaaggtggagctagaattggctgtggtacgcagcaactagtgcgtcaagtagacgacggatgtccagacttggtagaacagcgagctttcccttcgtcacgacttaacggaatgggtcgactttggattggaggctctagcaatacatggaatccacaccagcacattgccggtggctctgaaagctacgagatgtaacggaacgttcttttaagggtctggacatggcatgccgcccacttgtccgcatcgggtcgtcgtcgctgagagctagccaccgttgcacttgtaccagaaagatgtaatcttctagtgactccccagtttagtaactgaacagcttcctttgtaacagcgtgactctactgtgtcaccgagtaacactggttcgcacggaaccgccacaactgaattcttcgactgtcacggtctcgcggtagcggacaggaacggaacgccaggcgaggcaagtctgtgctcattcccgactctgcttgtcttgaagacagccgcatagagagacaacacaactcagaacacacagctaactttaaagaaaatgtgaagccacctccaggagctgcgcccttcgcatccgggcgctagaggcggcttgcatgcatctaagcacggaagcccggtgcagcaacgaagtggacgacaacagggtagcttccttttggactatacaagtccatgggtacagacgcagatcagaagaaaccggtgttggcatttgccgtatcgtagcactggcacaagaaagacattcttttcctgcggagcttcctcaaggactcgatgtcacttgcatcgtgtaacgcgcagtgactagcagactcgttccacgccaactgcctctcaagacacattaccgtgtccacacgaagaccaattgatctagaatgctcgtcagtgctctacatttaagcatatgtctccgtccgacgaaattggaacagagtttcaaggcaagcgtccgtgtctcctctcggcgcggtcttctgttctgccctgcgacactttcatcgagttccgcgcaaactgtcggtcgcatgcactgcccgcttttggagacacgcctgctcgcgctcgcacgagaacggagaggttgtaggtctttttgggcgggatcgatgttcctcattttattttctcgagagcttgatactgagcactttacagaacgaacatggaggggacttgacagctctcacactgggcttcttcgtcgtagacccgcccagttccgggtgagtttgcactctcgtgtgtgcgtagcctggactccgaggctcgtgtttagcgaacgcagtgagtagaacgcgtgcttggggcggatttccgtgtagtatcgggctcttcgcctactcaagagcacgcttagatccgtctctgggtactatgtggaattgaggctgtccaacagctgcatgggacggggatcgcgggttccgccgttgcatgtcttttgatctgtatacgggcgcccgctctaatagggccccatgactctggcgcacttcgcctcgatcttgacagtgcgactccacgccagaatttctgtctcttcagcgtcactctgcaacgtatcgcaactccgactgagagtgtatgggtgcgtgcgaacgtgtgaccgcggcaaatcccctcccggtcgctgccgactttaacggcctactcgagcaccggattctctctggtttccagcgtgactgaatgtgtccatctgaaggttggaagactctgttcacgcgtcctccgcggaaaaaccctctcgtctaacctgaagtcgca

SEQ ID NO: 826 - DNA, 3588 bp, Toxoplasma gondii
aagagtcgcggcggacagaaaaatacacgagagcgtcttggacaaaccgctggcctgctgctcccataccggtgccatgtcgttcacggatatagcctgtcaactcgtgaatgtggggagctgcctcatgagaacgcggtatcacaaacgaagatccgggctccgcacgaaaaaaagccacctttcaagtctcaaggccgcacaagaagcgcttcctttttccttggagtttcctgaaactgagacgtaccgccgcgaaaacgaagacctcgttggaagccccgaaaagaaacaccgtttgatcttcgatgttggccgcaagaatctgttccagttgtttcttggcgagcttgcggaaggcccgcgcggcttgcttgtcactttccagcgccttttcaggagcagcctcgagggcggccacgcgctcatccgatcgctcgcgtgtgtgctcggctcctgcgaagaaacgcgcgcgaacgatcaaggcgcaaagctgcaaaggctcagtgacggggaaaagacgcgagaaacgcccacctcgaagaagaaccagtgtcatgaaggacgcagtgtcacagcacctgaagcacactcaggtttcaaagcctcgaagcctctgcgggctgtctggcccacgacagaaagcgaatgtttctgtcttccagagagtgcctacagtcgtccatacttctgaaacgcactttgtcctactttgcctccttcctcgctctctccagaagcagcctactgatttgcctactgacctaatgacttactttgttcggtgtcgtctttaaccgcagacatgaccttgagaacgtcatttccgaccaactccgggtgcacacagacctcgcttagctcggcagcagcggaccggacactggagtcggactcttccgcgctgccagtgccggcggcctcggcccggatggctcggattcgctccaaaatggcttcgcgactcttcaagtgcgctgcagaacatcaaaccgagaccgcgaagcccacagagcaagtgctagctgtgaggaagtgttgtgcaaacatcgaaaaatagacttgcccacggtaaataaaaaccatctagatctaaatacctccaggcaaagcatttgctcttgtgttctgcttccctcagtacacacagtcaacgagtggtggaaggaggtgtcggatggacgtcgtttcaacaccgcaaaacaagctggaaaaagccattcaggtacgacaaagagggacagctgtgatggtgaggagctgagagcgggcagtaagccgtacacgagcgagaggtataccagaaagcagaactcaacggaagggctgcgagggtgcgctttaagctgtcgatccggggcaaaatccctcctcatcacgaaagtgacattttgcggagacaggagagaaagtgagcaagctcaacatagtcctccttgaaagtgtcgggcgagtcagaaagaacagaaacatcaaaatggtggcaagaggtgtcattccgatttccaggtatgggatacaaacaaaggagtttgcgacgactgacgtactccaccaccccactggactgcttaagacaggtaagtagttcgatgtcaccctgtcagttgaagtgccctgcttactgaagaggatgttcatcttctgaatcgcagtagtcgccgcgacgagaaatgtgaaatcactcgacgaaagaatcagcgcgccgagggcgcacaccgaggcgcagaaccaaaggattgtgaagtccgccatactgtccagacgctttaactgatatgtccctgccgcagcctttgacagataggaaagtgactggagaagtcaagattatcatcgtcggtcaacacaaaatctgcgagtcttgcaagccaaccgagaagcgaatgaggcattgtttgccgcctgaaacgccggtagccgtcggttgcacgtaagtgtctgagagaaagcacgggcgagaaacgtagacttcagtcatccaggaaaggggaaggacgtggggaagaattccgcgtccgaaggtatcaacgcagtgaagctacacaaaccctgtgaaaaccgaagaaggatccgtgccatacctggcgggatgtagataggcgatgttcgctcctcgagttgcaaaaggaaaggaatgcgtgaaaggcagcccatccgcaactttactaaaagcgctggatcccagtgaacagcctggatgcgtagcaagaaaaagaagacccttccttctgactgaggacaagcagtcggcaagacacggtgtctgccgttcggtgggcgggaacctctctgctgtgcctagtgccgctttcccttacagctgctgctgtcttcgtcggaaagatgttttcctccgggagagcttcagatgtcgacggaagcttgcacagcttctgctgaggtaccccgcggtggcttcgacggctgttgagaggttttgtacgcgtgattaagaactggggtcaaacaagcaggccgacaaatcgaggaagcagcaacagagaaccgcggctgagacaccggctaaaccgacacacaaaaaattggctgccttcacaagttgagagatgaatccgacagccaaagtcgactagcggaaggccgcctcgccttcggtacaggcagagaacgaaacagaaagaatggggaattttaccccattacgaagggccactgagacaaacctccagtaagtttgcaagcaacagaacatccaataagttagagtccaacatcatagtggaaaacgaggtttagagggcttgacgcaccttgtgtgaccctggcgctcggaagaagctgccgcgagcatgcgtctctctcaggcctacaatcgaagtggagagaggccggcgcacaccgcatgagttcggaaaacgtctgtttctttagcttccgcgccacactggcaggaggctcgtctcaaaccccatcaaaaacgctgtggagtcagaactcgcgacttaggaggttttaaaacgcattcttccgcctttcctccaaaaaccgtctgcgcatgttccctaacaaacctgcagaggcctcttgtctgtttttattgccggagttgccgtgtctggggacttgtagccaacacatttttatttgcggtggacgcattgcgtcttacccgcggtcatatgtgagttattcagctgcagaacttcacgtactttggaaattccgagctctgtcgcccctgtgcgtactcagccgcagtcaagggtggcccgttgacttcgcttgcagtggcgccagtgaccgaaaatagttgagaatgctgcggtgatttccttcatgtttttcccacttcgtttcaaatcttttccctcgatacccatcctgctgaccggggctgaccgcgctgcagcgctggcgcatttcggccgtcgcgcctctccggcggacctttttctgcggcacaatgtgcttcttgagttttcaatattttcggtgtcagaggagttcgagcgaggctgtggaacagcactttgccttagatcgcagactcttttctcaggtagacggaaggggtccaagaagatcctaaacgggagcgaaaaagtcgctgcaaccacgtcagaa

SEQ ID NO: 827 - DNA, 2939 bp, Toxoplasma gondii
tgtctttactaaatatacacgtacatctatgcccatataagtttatagacgcacatggatacatatatatatatatatatatatatatatatatatatatatatatatatatatatataacgtgtatatatgtataaatgcatacatacatatatatatatatatatatatatgcatgtgtatacgtatgtacatatatgtgcatatgttcacatgtctgtatatgaatatgtgtttatatatctacatatatatctacatatatatctacatatatatatccatatatatctacatatatatatacatatatatctacatatatatatacatatatatctacatatatatatatatacatatacatacatatatatctacatatatataaatatatatatatatatatatgtatacctagacatttgtatatatatgcagatgtgcgtgaaatatcccagtgaaggagattagcttttggtggcaaggagcttcctggaaaagtttctcgattcgggcagtgtctttgaaaaaaagaaatggtcctggatgcggtttcgatttcagttttggcttcgtcgtcagctgaatccgcgtcgcagcgtcatccgcagttcacacattggcgcgtttcgggagtctttctctgaaaacgggaactcctgaagtccggtccttgccgtacactgtgtaacttgacttggtgcagaagtatctttgaaaacaaggcaaaaagagacgaaaacgaagttcactctggacggatcttcaggtgtgcgtgcacccccaaaaaaaaagaagccgtcgcgtatttcgagaagagcctctctgttttcggtgttctgcctgcgtcgggccgcctcgctttttcgtccagttcctcgatcacctaccgattcgtagaggatgtcgaccttcactgaattctgggctgtggctccgcttgcggatccgcaaaaaggcagggaaacggcaaggaaaaaagcaaaaaacgcctccgcacaagtccggatgtcagccatcgtgaagtgacggtgtcgccgggctcttgaaaagaagcagaagaatgtcaaggaggcgagagtcggcggcctgtgttcgcgcgttctggagctctcgcgagagtcgatacgaaacgcaaaaaactggagacacaaacgcgcaacttgcgtcaaaacaccctcgtcgtcgcgaaagagcgacgctcaacccccaaaagtcggaattgttcgcgctcaaaactagcgacggagtcgaggtctcatctcaactcgaactgcggactgttacacgaaggttcacaccgtacacaaaaaacagacggagcttgtcagcctgggtcaactcccgcgctttgtgtcgcgaagccgatcgtcagtccgcaggattgacacaaactttttccagctttctcttcacacggcgaaacggcgaagaaggactcgcgagtacagcgccgctggcgtcctctctgtcgaagcagcgttctcacgagcgtctgcaagtgtctttctttttttccagcctcgagcgaacgctggtccccctcccgcctcgggcagtcagctcttttcggcagaactttccccgctcccgtgtttcgcgagcgttttcgtgtaaaaaggagagtgtgtgcgacccctctgtcggatcgaacgcagctctccgcagtgtcaagcgccggtcgcgactcccaggaacgcctccgcgcccgtctgaaaagaaggttttcgaagaagccgacgagtctggcggataattgcgcagacgagaaggactgaaacgaatgccttttcactgcctcactcgagaaactcggagcagggacgcaaaccgccgagagcggggcgcagggacggaaatgtccgttcgagaggcctttttttcttctgtgaaacgccagggatggtacaaacgtcgcctggacatggtggccggggaattcgctccagccttcgatgcaggtgtgaggaagaaactctgcctcgacaccacgggagccggaaatcggcgctgtcgcggcgcaagcacaagttccagctcgtttcgtctcgcgaggcctgagagccatgcccgagggaagacacccagattgccttcaaaacgtcgcctcagttgctcggaaagaaaggaggccaaaagaaaaggcgcaccaagggtgtagattcgccgttaaagataatacgcgaacgacgcaaaagtggaggaaacagcaaattgacagagacggtgcccgtccagcgcgacgatccgcgcgaaagagaagcacagggaaacacgagaacggcgatggcatatgctctcgttctttcgagttttctcccttttacgcaaggcaaggacgcgaacctttctggaaaaacgtttcaaagcgttcgagaaagagtgtgccagcttcctctcctctcgatgctttttgcggaaggcgcctgcgctacatcgtccgctctttgtctctttgcgttccttttttccccttcatgtagtcaactactgttctccttttctccttctacaattgctctcttctctcttttcttttttcttctcctttttcttctcttttttcttctcctttttcttctcttttctcttccctcgtgtactcctttccttcgccgcgtcgtcctacgttcctcctctcgctgtcgctcgatttgcttcgttctttctcgtcctccacctcttttccttcgtctcttgctccacctttcctggaacaagtctctgcccctgtcaagcttctccgctgctctcgttgcctctgcttcactctgtgtttttcgccttcgatatcttccaaaagtctcagaacctcgtgattgtcgccttcgcgtagagagcgtggactgccgctctgcctctgctgaaagcgaggttctcgcgccttcgcgccggctcttcccccttctctttcctcccctcagttgctcctgtca

SEQ ID NO: 828 - DNA, 3001 bp, Toxoplasma gondii
aagaaagagcgagcacctcagaacagaagcgagtaacgagaaggacgccagaaggtgacgttggtatcacgagacaagagaaagaacagactccagagcgcgggtagaagacgcattgcagatcagacggcaacggcagtctctggcgagactctccaggttctcgttgacgctttggcctgcaggctcctcgctctcccttttgcttgttgtgcgtgtagagggatgagactcacatatgtacaaacgccctgagtctgaaaaaagaagtgggcagtcaagacgaaaaaacggaagaaaaaaagtgcagttcgcaccaacggcgaattcttcgagacataccaacatacaaacgtaggtaagtcttacaatgcagatatacgtaggttgcaatacgcacatgcagatatgaggaacatatgatcaatctaaagagactgacgtgtgcacgcacggttttgaagtgccacaaagagagaaatctttgtgcaacgacccttagatgaagaggggacgaaactcggtggaaactgtacctcttcaccaactccgccgtttggagcactgagactgtggagtcggttcccttcgttgtctttctaccaagcgccccctcaaacagaaactccaggtcacacggaactgcgcacctttgtttcgcgcaaaaagaggacaggggatcgtaggaacaggccggccttcaaccccactttcacacgagcggcgacccctgctacttcttgttttacttgtctttctctcattccttgctcgttttcgttttctgtcaactttaccttccacggcgacaatgtttccgagaacacaagggggaagaccaaaacgaaaaggctgttaacgcctagaagtgtttcagatcctgccggacgacagtggagacgtcggcgacagaggaacgacgtgcgtttgtgcgatacgactgcagacgcctcttcactggttcgccgtggacgaaagcagggcagcaacaccagcaatctgtttttcgtgggaggggtgttttctcgaagagcgttagaagcagaagcgtatctgtccggtgtgtttctgaggcacagggaccgggaatttgcgggtccggagcgtgaatcgtcaagggtagggcggacgagaaaaagcagcgtggagtgaagacgggaaacacacctacacactttcgagaataaagacaagaggcggcgtctgctctgcgtatcccgtttcccagcaaccaagcttgcacagcaagtagccgccgcagggaatgaggacctttcaagcccttggcttctagcccgtttattcgccgcaaagaggatctccttactcgaaagtgcgtgacagaatttcctcttcgccgggaacttcccctgcggctgaaatcaaggacgaacggaagggagcgccagcacagacacatgcacccgtccagagggaaccgtagctaggagacgaccgaaacccgcctcggcaaaaggagtgacgggcggtatttcgcccttggatcggtcaccttccagtttcgcaagtcttggcaaaagcgactgcatcaaggctcgctccaggaaacgtgtgtgccccgtcgaaaaagatcccgttacgggaacctcgcggccagaagcgacagagaagaacctcgcagcgcgagtctcggccgagttgcccgcgctctcggggaggcgcgcccccggcctttggaggctatctgcagggccctcgttggcgttttctcgggaaaacgcgggaagcctggacaagtggtgaagcttcgggtgaacttggcttttaattatctctcccaaagaacaaacgcgtggagagagccgaaacggagtgcctccatgtgtgccggcaagcccgctgctgtacagcctgttcgcgtgggcagacgagggaggccggcacgcgcgcacagggggcacacacaaacgcatccaaaaagagcgggacggtggcatatgcgcgcctgaaaaacggactctcttttctgcagccttccttgcttgatcctggtcggcttgatcaccctgcaaccacgctctctggcgttgaacttcccgtttcgcgctgtttcagaagtgtgagctgcactgggttgaccggacacgcccaaccgcccttcagggtgtacatacacgcggcgtcagcggctcactatgcagggactcaggcgctgtaattcggcaggcggggaaactgtggtgcattccatggaagaaaaggacgctggaacgcacgatctgcaccgaacctcgcccaggattcaggtcctgtcctcgcttcgaggttgtgagaacgtcggcgctgttcttccagcgggcccgcgcctcctgcactgaagacctcgagtgacacacgccacaggagtggtctctataccctgcccgctgggcggacacgctgaacaaaacgtcacctggaggcaccgcagacgtttttcttgagcgtctcgctctcgtatttcgctctctcctctttttttcggtgatcctggcctgtcctctttctgaggacttctgcccggcgacgcgcacactgccacgctttcgatttgcggcgaaaacagaggtcatcttcgcgcgcgctgtcttcacttccccagctcgtggtccgcaggggggctgcgaggcagatcacgttccccggcaggtctccgtcccttgcttcgcatgtgcattttgtctctttctttgtgggtcacgcgaggcttcgcgtttctgccctttctcctacttttcctcgtctctcgcctgcgcggtgtctgtcgctgttcgcagccgaagcacccctccgttttcctcggtttcgtccgcgatccgtttcacgcgtgcgcgtcgtggttttttgccggaacgtagacggttccgggccggacattcgagagtgcctgcacacccgtttccccaggcttttccacggttcagacgcatcgactgccaccagtctctgggacttctttccccggaaaaacccaaaatcaccccgtccccagtacgcaaaa

SEQ ID NO: 829 - DNA, 1881 bp, Toxoplasma gondii
gtgttcagcatgggaacagagcgtatctgcttggtttctctcaggaggaacgcgtgtagctttgtgtgtgttccttcacttttcttagcttctgtcgagcaactgcattccgcgatcggggcatatcacacgtagatggtggatgatgatttcgaaagtgtagcagaactcttgtctttcgcttcagtcagaccgcagcgaatccgtcgacaggtgtggatgggcacaaagcctctcacacgcagaggtccgaaatgtgaatggagactcaagcgtgagtgaacgtatgcacctgtgggtctatcctgcttgaatgcggccctgcacataggtaaagtcacagacttttgctgctctaatttgacagtgagacagcaagagggattttcctcgacagagccgttaatcaccgccccacccccacaaagtcgctcaacaacggaaggaatggagagtccgtgtggtcggtttcaactgaacatgctcgaggaaagtggggaagggtcacaagagcaaacaattcgtggagggaagcctcgatatcaggcaacacttccggagcacgtaccaggttggggcggctgtcgaaagctgctcaccatgacacaaagctgctgcagcagacgacttagcaaacgcaagatacacctgcatgtgcaaccatagaaatacgttttcgttcatgtgcaaacgacggggggccgttcaaggtacacgtcccccaccagctctagcgatggcgcggcacaggtgcttacatattcgtttacacaaatttgcatgcacaagtatgtatacatgtatatatgtatatatatgcatcgcttgccctgtacacatatcgatgtggcaagaacgatgtgcgcccaaaaattctttcagaacagcaacagagcgtcggccggtggcaccgtagaggaccagatgctctggtgtgctgagacgatctagatctactcaacaaaaagggggtttttctttcgtttgtagacgggcgtgagcgtcgaaaatatgcggaaatgcatcgaagttcgtctatgcattggtggagtttcagataattcgtgtgaaactgtcgtctctgggcgaacctcgaacggtgtctcccgtatgctttttagtgtacacactcttcttgtgtctgtgtagagcctgcacccttcagagagtcggtcgagtttcaaaagggaaggagagacacgaaaaacgccctaccgtttctctttccttttctaatcaccaatcttctcgacagacgcttctctttggttttggaaactctcttttgagtctctcgaaagtgtctgggacacgctgcatgctcgccgggcgagagggcgaccgagaacagactctccgaatacaagccgccagagccgggtctcgtcgtcggctgtgtggagcagacttgattgtttccacgttgaaacctaggtttgcttggatttgtcgttgacaaggaaggccaaaattcccctcgaatcaaggcggcatccatccttgaaacttcgctgttctgctatctgcatcgcggagctctttgcgtcgtttttttcgcagtctgcgcgagggaaaagtaccggagagaactagatccgctgcattttcgatcttcgctgtttcctcggtccatttctcttttccctagtcctcttttttttcgtcttcgggtgtctgtccgagtccgcgagtcggttgctgcgaagctcctcggcagaatcttcgtttctttggcgaagttcctctccgctttcctcgctcgacttcgtttctttcgcttcttttccaagtcattttcctgcctttccgcagaacgtcgctgccagcgctgtctcccccttccaccttcggttttctgtcgtcttcccctgtccgtcaaga

SEQ ID NO: 830 - DNA, 3708 bp, Toxoplasma gondii
gagtctctctgagaacccaaggtaagccatacgcggtcctcttcggcggaggcagaggcgcctgcgcctgtccccaggggagagtgacccccagcgagttcgaggtttcctgctccacttcttcccccgtctacgcttccttctgacgcgtttctttcctctacgtcctgcactccttccaagactctctcagagacgcaagcgcgaggagatgcgcggtctccagtggcgtcgaggcgcgggctgaagaaagagcagacagtggcgcccaacgcgcccgaaggagacagggccggcgcccccgctccgggaaggcgcgcagacagatgctgcatcccggcggacttgaaatgctccgcctatcgacggtgcatgcacatagtgtccagacggcgtttgctgactgtgccaccaggggcgcgttttttgaaaatttctctctcgcactttctagctcctaaagaaactcccgtttttgaagggacctcagtgaatcagtcagacaacatgcagcatctcctctctctcctcgaccttcggctcaaaagaaaactctgctgagagtctcggacgacccaacgcgcctcggtagccgtgtgtgccggacaagcatgcatgcagaggcaaaaaatacaggtaaatcggcagagagacgcgagtgagcacggatgcatgcggcaggttccgtgaatctacacaggagctgtcgacgcgtttacggcaaacgcgaagattaagaacggatagaacagcgaagtctgggcgagacggagaaaacgacgtacaagatggacccaggggagaaaggggagggaacaaggggaaagaaagcgaaaagagaggtgcagaggaaagggaacaggaacggagaaccaggcaagcaaagaagaccaaggaggaaggtcacgaacagagaaaaagaggcgacccttggtatttcgcgaggagacacccccggacatggcgtttctctgcttcccgaggcttttcatccacgcgacctgtgcgacagcgtgcagacgcttgaaagcaggctggaatacaaaagatttgaactgaggaaggaaaagaagtaaaaacaagcctcgcagacgacgagacagaaaaaggcttcgcatgcagtcaagccgatatatatgtgcgcatgcagcgaaccgctgtaccccgaggcgtttcgcttggtggcagccttggtgtgtgcttcgtttccttctctgcgttttctctctttcttttcgtagacttgcttgctattcaccgtgagttcgtctcagaactccctccccaacttttaaagaaagcgcatggtggctgctgacagatcaaacgcacagctgtgaactcggttcctacctttagacagtatctcactttcgactacccgagtcccccttcctctcttttattttcggtacttctgccgaccacaatcgacatcgttggtggcctggacttcttcgtctctcacccctcatctgtgcacatcttcacaagtcttgcagcttctgttttcttcactcttgctcgtctctctctgcatcgtttccttccctctccacgtttctctatgtttcacgagctgtctctgttccttgctccctctctctccgccgcgtattctctcgtcgtcttttttttgtgggaggctgtcatggtttgttgcagctgtcttggagatctggaaagtctgtttttttttgtcggaacccagttagactgcgtttttcacatgaggatgcaagctgtgaatagatgccacaataacatctgtggtagtctccttcctcaaaagcgcctccacattcgagacctcaccagtgctaagttcccgtcggaggcgcgggcgcatggagagaattacctctctgaagaagaaaagaatggacattacaaaacgggtgttggcgtggttctaggaagcaggagagtgcatcagaaatagacacgatgggcatagaagaatgtaagatcgacaccgtttttttcaggaattttggggaacttcagcactctcagtaaacgccaacttctcccgtttctgtgtcttttctgtttccgcggttccccctcttctcttttgcaggcacagcatcccttcgcgtcggctagagagagccgtgagatgcgacagcttcgatcagcgccgtcgtgctgggagtgggggcctcttagtcagacgtttcacggcgctttccggcgagggagcattgagctcacaagatgcgaaagaatttggcagataacacaagagttgtacataggggtgtgtagacaaccaagacaacaggactgtagagcaggatggctttacgttacacacagagacacacaccaactctcagactgtttctcggatgtaactcagagttgccaggcggagcgcgagcgttcagcacgggcgacaactttttttgtagattgctgaaggcagcaaaaagtagtggaaatgaatatcgtccgacagaaggttcctcgacactcgatctgctgtaaagttctggatttcgatacttgacgaaactaaggttctttcgcgtatgttccagatgcaatctatggatgcgatccagaactgcagaagtcaaatggactgaaccgagtcataaagcttcgcaaaaactgaaccgcagtccagttccccacttctttcacctccgaacacactctgcatttcttttcgctgcaaatcattgccaattctccgggacatctgctttccatacgaaagccgagcgggggtgacggctgcaaacaaccaacaccgtcgaggtgcggtcggtgaccggacattttcgttgagaaaccaaatcctaatttgcctcaggaggttcggtctctcttccgctgcaggtaagctgcagtctatcggtcagctcccatcctctcacgctgccgctgctctcggagtttatgtgggcgtgaagaaggctgtaaagcattggtatattaactgtggtagtctccttcctcattcaagtctgttcgaacgagtctgtctgcctatgcctatcaacgacgctggagaacctatgcagttgcggcgtcggttcggagagagttatgtcgcaaagggaactgctcgccagcacaccgatacagagactcccagttctctgaaacaacgccaccgcatagacgccgcgtctggatccccagtccttccttgataacacaaaaggcgtggaaacgcagaccgacaggaagcccagatgtctgcgtgcatctgcaaacgctgtgataaacgcatgaaacggcaggacaaaagatatgtttcctttccctcagcctcacggtccaggagaaccgattttcacactccattatactccacccgtcgccgcgagtaaaaataacggacagttgcgtgcaggtgtgtgtcacctgtcctatttgaggtgatgtgcaatcctgatgtggaggggcaccagccgcccgtggaagtctcagacagcaagaggagttcgatgagacacaaagagagacagaaagtacaagagagtaaggagaaaaagagaaagaaggagaaatagtcgaaacaagacgtttacaggacagccggaggagaaggtctgggcagggttagggcggaacgaagcagtagagagtggtgacgctgacgatacaggaaagagaataaaagataaaacgaggaacgaaagagagcgcgtttgttgagaggccagtacttcgaacacaagacgagaagaa

SEQ ID NO: 831 - DNA, 4281 bp, Toxoplasma gondii
acgccaaggcacgacggcaagtcacgagaagaactcctgaaacgagggacaaacgagaaaaacacaaatccggggacgagaagtgtctttccacttcccgttggacacggcgcaccgcttgcaggctctgcggagagcaaaaacggggctgcctttcacgtacgcatcgaagggagacaccgaaaaattcggacgcagcggaaaacgacggagaaaaagcaagtcaagcgcgagatggcagtcagcccagggggcgcgacagataagagagcgttctccgtgtttctgtctgagtttttctggttgtcagctgacgaagaagaaggagaaagaacaggattttctgtcttgcttagaaaagaagccatgccgttccttgttccgaagacactaggggacaggcgtgacgcttgggacgaacaacaacttggaaagcgtcttgggtgaaaattctcggggcgtggtgtctttgccgcgtaacgctgttgactctgacaagattcaagtgaattcctttcgagaaaaaggcggaggtgaagcaaacgaaaaatgccttttgttcgactcaaacaaacgacaagcaatccacgactgacaccgagagaagcgggcgaggcggaaaaagcggtacgagggcgccagtctgggaaaacgcgaagaagctgaaaaagacgggggacgcagaagaagaaactccaaacgccacggaaagcaggacagccaatggatcaacgggcaaagtgaaaacatatcggggaatggcgacaagacgagggcgcgtggcttcccctcttcttgaaacgacggcgcataggcgagtgggagagagcggtggaaaagacgaaagacccggtactttgagggactgatttcaagatgtgaatcgcaagggaaagacgaaaggttgtttctggaaaaaaacagagcgcagcttgcctttacgatcgagagcagcgcgggcggtcatgaggagacagagattcgttggggagtgaggacgacgacgggtgactgaaagacggggaaaagagaatctgaaacgacgcgagcgaaaagacggagaaaacgcacgtttctcgagaaaagaatagtcaactaggagaaagacaggtccagcagccgcctccctcgcgcgttcttttcggattcggccgctctcgttggggaggatttcgcagaaagggaaacacgtggaggggcgaagaagcgaaagacaccagtcgaagctcttgaagcttttgagatgtgaaaaaagtctcagagtcgacgcgttgagagcagagagtccgggagaaatggacggcgcgggcacagagtgcctgtagagatctcgacgaaaaggacgatacaacagcttgccgcgttcttcgtcttttctgagccaggcatcccgaggagccgagcgtggtggccgcacatgcgagtcacgagtttcgagcgtcttccttgatttccccagttccagaaaaatcgtcggcgcgatacgatcacagccctgtttgaggatgacagcagtgcctcgcgcaaactgtcacctcgccggtattcctgcgacgaggagcgcgcgtagaagagcgatccgcctgagggaggtctgagacgcgggacacatgtggtcaacctttcgcttttctcgcaaacgtctattccatacttttggtcgaacgcgtcttcggacctgcaattatgcgctttatgctttagagctcagacttgaacgccgcttaccagtcaagagacgatggacgacgggcggtggactgccgggcaacactctcgagagcactgcggagatggggaacctgaaacgcctggtgacgggaaacaccagaaagcggcaaagtggtccgcgatgtgagcgagacaagaagcagggcaaggaagcgggaaggcggaaatcttgcaaatgcgtaaagccgccaaagttcaactgtctcgctcgaattttgctcaaagccagtgtgaaaaagcacagagtcattagagagcggaataggcgagcgcgtgtgccgctgacccatgcacgctcaccgcgcccagtgtacgtacaccagaacacagtcttgagtctaagtcacttccacttcctgcgatgcttgcaggctttcttcttagactcgccatattggttcaaaaaccgtactctgctccatatgtttccacaacgcttcgaactggaagaccaacagcgacatgggtctgtttgaccacggaggcttaaccgactccatcggctgttcgtgagcacggaacacaaacgggaaagtgactgctgccctaaacagatgaggcctgcatcagtcttcgcgtgggtttcaactgatgtttctggagagaacttggcacctccttttttcgccttgtttcattcccaccggtaacacactcgtcacattcaaaccgacccacgacttaatgcgcggccttcctgtgcccaaaggcaattcattttctagaatccgctacgtgtttttttgctcaagaaggccacgtttatgtcgtcgccgaacgagctaccataaccatgtatgtatgtgtgtttttacatctatgcgagtgagtagtcacaggcaggcttacatgcacgtaaggacgcgagctgctcgaatggaccacagaagagtcactaccctttcttttggggtcatttcatattctctcgggcgcccgagtgttgctcggcagccctccactgcttgccactctcttgaaggaggtgagttgtctcagaggagagtaagcagacctgcccctgcatcgacagttcgcgtgcactgaccgaatcaaaaatgaccggaaacaagacatacctaagcattaatccatttatggatgtcaaggtaaccaaaccatgtttgatgctttttcatagacaggtaggtgtgggcgcagcagtaagtcgagagcgacatcgcgagccctgctctaaatttaccacgttgtgaacagagttcgtaaagctttcttcgcccactgccatccatattcgttaggtttgtcgcgagcttattcagtgagttgttcatcttctacatccactttactgaactcggcgcagaagatattaggacatcagatcagagcctcatcccgtgtgtcaaaaaagctgtctgcatgtgtcgcaaagcccttggcacaactgcctgatggttacgccgagtcaaattgtgcgcctccacggaaaaggctcaccttaatcatagtgaagatgctgtacgtgttagtaaaagagtattatacatatggaataggtgtaaagtatcaccacacatctgtaaacaaaggactccttaacttaaactgaggagtgcgtttgattgctgaacacctgcggtttcaggtgttttctaagtaaccgtatatatgcgagttctctcctcaacgtttctgccagcgttattcttgcttactcctctacgaaagggacccgccatcgttgatatcctctgtaaactaatcttgtgtagacgtggttccggacggatacaacttcgcgacaaacgctcagaattgctgtgtacatcagttcgagagcggagaacaacagtttgaacagcgagagaagacgaccatctggacactagtgtgatcagcaccatccacgtagaagtacctctctctgtgagacaggattatttgtcgaaaaattctgttatcacccatagtaagatcacgataaaacgacgacttagatgccagtatgatcagtaccatcgctctgggagtaattgtctctgagagaacgactgaatcacggaaccatggatacctagaacacgatcaaggggggggtgtatgcgcgagagctgccctgtctagaacaaaagttcccatgccgttctgcctatcctttttgaaagtcgttgtatcttgctcaggaacgaacgttcgttcacacaaccgtgtcagggcgctgcgtcactttttttgtgtggtgaataggtcactgagatgataaagagctgccgagaatatggaccgatcggaatttgcactcagtcagaactttgttccttgtttccgaaagctgtggaagacaggaaaacagatggtttgtcccgttttttccgcttcgcacctcacagtcgcaggtattctttgtttttcgtttcttgtcatagtgtctttttctttctcattctcttgagtgggttgtgccgtgccaaggggcgctcacacgacgcgcgctcggtcttccgcttgctctgtctgtatttgcgaacttttacagaagcaggtttcattttcaggtagaacttgtgaaaaagagaacacccacta

SEQ ID NO: 832 - DNA, 2235 bp, Toxoplasma gondii
aacaagtctataatgcgcaaactccacggaaggcgcaggatatatggaagggtgtttgtcctccgttggtataccgagtttcgaagaaaggggagaactccagtgtacgcaagggagcgttttcctcagcgcatgcagccgtgaatgggtacaaattttgcagtcgatccatttcggtctctattcaagtgcagagcagtgacacgaatcagcgcagcccgctgtagcgtgtatgtgactggaggaggcatacgtctgtgcctggaggaacgaagaatgtcctcatcactcgcgactttctcttgtgttgggttgtttgctctaggcggccgctgtggactacagagacgagagaccaagcactcaaagggagaagagagagagagaagacagagaaaaggagtcggaaagagagacgaagaaagccaagtagtccggggtgcggggagaacttgaaggcggagccagagaagccgagtttttttgtgcggtattttgcatgcacgcaatgtattcgcacgtgctggtcggtctccaggtttctgcgggatacacagagaaagaagtgaacaactgacagccatcttctacccttctcgtggcggaaatgcggtttttgcccatttgtaacggcactgacggacaagttgcaacttttttctttggggatatcagccgggaagcactgggttctttcgtagcaactctttccctgtgtcgttggacgtttcctcgacacgagctcttcaagcgactggactatatatgcggcatgcgcgattcgcacggggttttttgtacgtctactttctttctctagcctgcttcctcgcacgacgttgttgcgctcgctactccgttttcttgtgtttatccagggcgctctgccgccgtagttctctcgcaacgtctttttcggtatttgtgtcagctcctcgcaactcgcaggcctgatggttcgctaaatagtttctttctcccagtttttgtacggcaaacgagctgtcccgcagcactagaaacacggcattcctggacaccccatttcggcgtgctgctctgcctgtcgccggcggacatcagaacataccgatgtggaatcaccctaatgtctcagcttgcaaagctccggtccttccattctcgaagcttgaacagggctgtttgcaaagactctctctgtgaaaggagcttcttcaggagaagtaatgtcggctgcagacaacttcacgtcccttcactttgccagcctcccgtggcaattgctcctttgtagagcccggcacatagagaagcacggggcgttttctccgctttccaagatttattcaccgtctttctttcacacttgcccgttaaaaacaaaaactgcccgctgatgctccggctgccatcggtttctgtggtgcgtggcattctcatggttgggagcaaccgtgaagatcgagaatcgctgcacggttccagggaacgcgatgtatccagtttcgtcgggagttttccccggctttctactccgcccgcaaggcaaagaacaccttttctgtaaatgtagtcaacggggtcgtctagcctacacattttctgctttttcgttgactcggcccgtcttaaagggagcgccgttctccgcgccctgagagtgctctttccccctcggcggttcctaatcccttctctctgtatcgcgcctgttgttgctttcttttggcgtctgccgtcccgcttcgtcgccttttttcaggaattctccgggcatctctccgctgcttattcgtcaccgcaattcacaccattctaaagagccgtctcccgctgctgccttcacgggttaaggtttggggggtttagcgtttaccgcttcaacccgtaagggtgttcctgcgccgactctcagcgtttcccgaccgcgacgacgcggccttctcttgtgcgaccaatttcgcgccggattgaagcttggggtaaggtcgtggagggttgcctccgaggccgcgaatcagcgggggcgggtcgtttttgcagcggtggatttcgtagagaggaccagtggttttcgggggggggcggcgggtcgcatggctccccctgcagagcgcagctgctgccacaccattttcaagtttttttaacgttttcatttcgctgtttcgagctcgatccgccagacttttcgctgctgtgccgacattacttttttcttgatcgagcttgtccccacagttccagtgaaga

SEQ ID NO: 833 - DNA, 4124 bp, Toxoplasma gondii
catcctttctgtctcctcctctccgtcgttgcgccgttttctgtctcgttctctctgtgtctttccctttctgttttctcactggacgggtcgacactgggtgggaggtctgaccaccaagcaccggcttgccacgtggaactggcttctcgagtggtcttgttgactgcgtcgttgaggtcttttttgacgatgagttggacgagttcgagttcgacttcccgcgttcgcgcgacttcggcctcccgagcctggtcctccgttttgtcctctgcctctgcggcctcggcgccttcgccctcgacgcggcgacgctgcgcgtggtttcgcctgcactcgccggggcggcaagccggcacgaaggcagacaggaggaagggcagggtgacgaagaggggggcagtcaccatcggtcgcgtcatgctgctccgcggcgtcttcccggcggggaacggtcccctggaaagcagattcacgagcgcggctgtgccggggtacggctcgcctagacgcaggcgagcgtcctcgccatacacggcatctccatggcgcctgatgccgcccgaggaaaccaaaacatcctcgacctgcacaatgggggtgatgcggttcgacaaaccgtgcttccagcctctgaaggaaactttcggctgcgccaaggcgggcggtgctcgagagacttcggggtcagccgccggctgcgcgttgtcgacttcgccagcttcacgcgaggtgcctgtgttgctgcgcacagcagcgaaagcggggggcagagcgacaaagagaaggagcgaaaagaagaggagacagcgggcggaggcgaacgagttggagaaacgagggaaaaaagaaaacgagggtctgcggattcgcggacgcagtggcgcgctatttggcgccgatcccggggtcgccaggacggtccggatcagccggggctgcatctcggcgtctcgcgagggcttctcttcttttcgggatgcagaatgacagcttgctggaggaaaacgcatgcgacaagaagtgagcgccagaaaacacgggcttgcttcgaaaaaacgcgacgcacagaatgcttgcacaagcaacggcgacagcccccgcgcgcaagagtctggcacgtctctgccacggcagcgcggcgcgttgaggcgcgaccctcgcgacgtattcgagtgcctttgagtcggtccacaagaaatacaacgaaacagaatgtgaaaaactcgatatttgacgcaatgggtcgtgcacaaccaaaagattggggggggggggaaacccttatcggtgaccgtgtgcagccgccctctcaggtttcgcgttacgcgcggacagcggccgcgtacaggtttgacccgcagctacaaggctttttcctccacgactcggccgtgactcgagaaacaaaaccgtcttcacctcgaagaaagggcaaacgcaaactggatctgtcaaacaatccggcaccatccgcgagactcgcccatattcaccattcaagtagcctcgggattgccgaaatttcgggggctgcgaaacgcgctacgctgatcgatgccacagccacgcttaccgcgaggagcgtcggggggagtttaagtcatccagacacacacacacacacatacacacacaccaacgactcacacggaactggccttgctgagaacagttccccgaaaaaactcgaggacgcatattcggtgcctgtgtcgtcaagttgggaaaaagggcaaatgcctctggttctgttccagtcgcaggaagccggcgctcgttcgcctaccaagcaaaaccgggactcgtggcacacgggcacgaaaagcggaaacacatccgctttgactaggagacacgcacaatgcagatactatgacgagcatgattcgtccgctaaaagggccaaagagagtgtcctccatacgacgcagcgtcaggtgtatattttcagcgggcaaccccgatggctcaaagccatgagtttggtggtcatccaactttggaaacgaaaaccgtcggcatgctcctcgtcggtccggtgttcacacccttattgccaagcgtctattcacttgttcagtatttgtacggaggggggtgcgcagcgagggatgcgaaggtaagtgtgtgacacgtgtgcacggaactgcgtagaaaaatgtgtgtgaaacgtagaagcagacgtgcgtcgcccgtcagcggtgccgtaacggcgtattcatacgggaccgacgaggagcatgccgacggttttcgtttccaaagttgggtgaccaccaaactcatggctttgagccatcggggttgcccgctgaaaatatacacctgacgctgcgtcgtatggaggacactctctttggcccttttagcggacgaatcatgctcgtcatagtatctgcattgtgcgtgtctccgcgcacacttcccccattcacttctaaatgatgcatcttcccgttcacttccatgtcaatgccacttccacgaaacacaggattcccgagctgactcaacgaagttgtccaaagcgatctgcaactcgaatgtcccttttcatccctcagcatcttctacaaatacgtatggttctgcgcctcctcacagcctgtgaccttgcagaaaaatatgtttttcgtgggtgacgttcacgaagtatgcaccggtaaagctgcaaggtgacgacaaacagggacgcctgcaacccaggacgccctcgcctcgccgtttctgcctgttcagaccccgtttcatgtgtcggggttccttctcggcttctgtaaaactatctacatctacccatcgctgtatgtggcgtaccatgcaacttgttgggtctcaccagcgcgttttcttccaagataagccgaaacgttcgaacgcggcgctttgaggcgtatgagccgtctctgtgtcacgtggagagagcgatagcgagatccagtttgctatctccgcaggcacacacatctgtgtgttaattgttgcaaaataagaggttatgtccgatgtttataggcttttccgaaggaacgggaagctcttcttgagaaagagcgcctctttcaaggagttggggatgcgcgaccggcgacacagccgccccggcgcgtgtgtgtgttggtggtctaccggcaaagcacgctcccgctctgtcgcgtgcgaggattttcacttgtcagcgctcgaaggtctccgaagctcgttttttccctggcgaccggatttgtaactacagaaaatgcgagttttagtgacctgcgcgaactcttcccctccggacacaaggaagcgcacaaacagggggttctttagcgagaacggcgcctctgttttttcccccttttcctgagctgcgctccttttcctcgcgccccctcgcgctctttcgttcgccctgtgtgcttcttctcgctctcatcgcagggtctgactgaaccgctgcggtcttttcccgttttctttttttggcactgcaaactgctgggttcgcgagtcgctgcgcgccggagcgtttggagcgcgcgggttccccttgcattctcgacatttcgtagaactttggaaaaaacactctggatcgacggccagaaaccacttctctgcctcacactgccgtgcgcagcgcccaggaagaccgtacccaactgctagaaaacggggtgtagtgacgtctgcatgctccgatccgcggtttctcggcagaccgttacacacgcctgtctgcgtggacttgttcccctcatttgcgaatcttttgccgtactcttgcaagacctctcgtcctgcgttgtcagatccgtcgggagaccctgtgccctcgatatctctcctcactgttctgcgtctgcctcgcgacgcctctgttacgtagtctcgtttctcggatcgcagagagcttcttacgtctcctctcctcggcgtctccaaatttcccttcgaactgtaaaaacgtctctagaatcctcctggttcttccacgctcgcttttctctgtgttctctcgtaaccgttcagctggctcttccgatctatcgggattcatccgacgtcttccattctctgtcgttccagtctgacaatcgcctttctcattctcaaagctctttcctgggacccaagaa

SEQ ID NO: 834 - DNA, 4747 bp, Toxoplasma gondii
ttgttttctcacatcagacacagaagctcagaaaagctcgaagaaacggcgcgttaaggcaatcaaggcccagcagcaattggaaatggcagagaaagatgcggacgaacgtgcgaaagcttggcaaaaattcaacaaacgcgtaagtagtcggcgaaaggaagtcacctttcaatcttgcgtcttcagaggacgccgtgcagaatcaggcggtattacatcgttgtctgcagtgtcaagagcgttgtacagagttgtgcgtgatcccctttcttgtctttagcaacaccgcattgcaggcaaaattgtaatgctgcatttctcgaaaagaagcagaacagctcgaggatgccggtttctagcgctgtagaaactgcgacaccgccgtcatcgtgttttgtggtgtgatgcaaatgctggattattcgtacatagtcgaaacagtcatgtggggcgcagggtcgcaaacaggaatgacatgtcattgggcttttttcgtcggtggtgctcgattgaagcggtgttgctgcggaaccacgcggtacttgtcacgtctgtattttgtagccggctgcaaagcatctcaaattctgtttatgagttgctgtttaggctgggtgtacagacgtgtgctgtgtgatggttcgccgtgagtggcagcggttcatttgatagttctgtttttgcgtgtctgtgcaggccatcaacaaacgtatggcggggtacatgtctggacgtggccacgaatcaatgttttctggccacgaagtgaagaccacagttagcatcagtgtcctgagttcgcagcgaactacggtgaattcgtttgttccccgccgcaaacatgatgtagatgaagaactgattactgatgactgatgcgtgtgcgttaatttcctcgtaaggtactgtgcacaaactgtaaccctcaaggctttgaaatttcatcatctttgcgagcaagcgagtagatcctctagtaccgtctctcatgtgctagagttacgcgtacatagacctgcaggagaaaagcattaccgtcttctgcgcaagacgctcgtgacgtctcttaagcgtaggtagtggcgttcacttctgagcatcttactggtgcaagacagattgcggtaaattactaaacgtgggcaacccacaggcagcataaaaaagcctaaactcatacatcaccctgaacaagtgacaactaatgcactgcgtacaccacgatccggtgactccgcgactacggagcatcttcagcgtgtttgttgaaaccgtcgtacaaaaacacatcactattccggtattataagtttctgctctttgaatctgctcgtagaaacttatttcgattggtctcctgcatatgatatgggtgggccgacgtggccggtttcctctcatcaacggtacgtctgtgcgccttgtgtgcgaatcaggccacggccttcggcatatttaactgtaatggatcaaagtcgcgtgcaacccgcctcgcacaatcactggtttgagtatgtgctcgacaaaaaaggtccttgcccttcatgttatcacgaggcacacctctacgcaccacaacgatcatcacgcaacctccctcggtatctgtccgacgagcgattacaccaacacattttcttccaacgtgcaacacgctctgacaatgacgtctgccgtctgccacaagggatacagacgacacgtccaaccgtgcctgtatcgatcgatacatgctccgctacacgcactaaatcctcacgctgagacaacaaagagccgagcaacacagtgccccttactcttcctcggcaacttcttcctcttccgcggttgcagactccttgctctcttcttgaatcgcgcgtctcctcctccttctcaacaatcgcagtagtgacacaacggccaccacagctgcagcaagtcccactgcagtcctcactggatgtccagtcaccgctgctcttcccctttcgaataacgatcggtcttcactttgtccgtgttgttgtacctgttgttgttcacccccccaagcaccttcggagtcatccccgcctgaccctgtgtcacgcgttgaaccggcaacgcccacaaaaattaaagccagcacgttcacgatcattaccgccacaacgacgcgttttacagacgccattttgttacttcacgaaaatcgcaataaaaaacagtgaaccatacacacagttagagtgaacacacgcgcgatgatatctgcaaaaaccaaaataaaattgactgacggtaggatcgagtgccgatcgacgtcaaccgtcagtgcgtctctgcacaaaccaaaccgacacggaacagcccacacgtctgattccacaacctggcaggacctttatccaaacgtgtctcgttgccaccccgtcccgcgctctggcacgcgtcgcgcgccgagggatctgaggtttctccgctaaccacctgagggagtcatgcgtcccaaatcctgtctcgatgattgctgcatggcgtactgtatcatcatttcggcacctttcttgccggaacaagcggatggtggcagcctgatcctgcttagttgtagtggcggcttaaggaaactggttccatcttgaagtactggctggataccttgtctcgtgttacatgtaacgtcgtttggtggcagggctgagagacagaaattccccttctatatagcagcatcagtttctcacagcttggaatttgttagcaacttgtacagttttttcaccagtccgtgaacagggaggcaaggccaggatttttcatgtaacatgtttgagtgcgtcccaaaacctggtgggggtgggaaagggggggttgcattgtttttttcatatgcgatgttgcggcagtcagcacgaatgccgcggtacatgcgcccaagactccgccacatagagttacaggctgtaaaattactggtgttcatcagacatagattgcatcactgaagtatgaagagtatgtaggggggcactttgcagcaactggcatttagttactttgaaacgtactttttattgcaacgtgtagagaaccagaaatttcggttagtgcggaaacggatggggttggcatgaacttctagagttctgtgtggtagattccggttcccaccagacgacgaaagcccgttggaggcatttgccgtcttttgcgatgtttcggacaccaggacgtggagttgagaccggtgtcgtgtggtacacagcgggaacaacaaatgccgtttggtggaagcctgtaatgtcgtgactacgtgcttccggcacgtcaggtggtggtgcacacaggaatgagatgaagggaacgtatcaacagagctctgaagcgaaagaacgaacgatctgtgtagctgatggcaacccgccgtttggggttgcactacagtggacagcagtgatgtctcatatagtcacttcgaagtaaggaaagagtaatgtgagtttttcctcaaagccgttgtatatgcttgcaccagtacacgataaggtcgaggaacatgaaaaatcgttgggtagtcggtcgaggcattctttcggagcaccggcgacgcgcaagagtatcagtgtggtacaagcgatagaggcaaaaacgtcacctcgaaaaagagaccgtttctgctgcacttgagcatggccccctggaagcgtttgttgccatgatgtcaactcaacgcttacgccgtctgtacacaggagctggcaccgttggcgccgcggctgctgaacaagagtttgaattcgatgtgttgcggatttactcacccacaaagtacaacgcctcagtacatttcgcggagaaccagctagatcaaagttcgacaagcatttcacaacttatctgatttcttccttgctatggcggaaacgatcgagctccatgatgatgcggcttttgcgccaacgcgcccggacatggaatgcgcattgcatgagtgtatgggcagatggggcaacctgaaaattatgttcgagttggagtgtcttctccaagagatggaaaaaagaatccaggaaatacaggcagaaaaggcgatggaggaacggtgggaaatagtccgaacacgtaggcgtttattgctacgtgattttttgcctgcgaagctacccacgctatgcagacctgtcgaagctgcaacacgagataactgaggtcgagcagaaaagagcagacgtctctctcaaaactctacaacttgacgaaaaagctttggagaaggaacaccaggttaaatgtgcttttcggcagttgaacctggggttaaaagagtgatacagtgtgtgtggcgcacataacgcgtatgggctaacatatggtgtgtgcggcaggcaagctcttttacgggaaagactacgatcagtacgtggttgacgtgctttttgaaccgatcgctgttgatgtaccttttaactctacgagtgcaggtgaagaacgttgcttctggcggaagaggccagccttcgcaagtgcatgtgaggcggaccgcttctctcactcaaatggataacgctatggctacaacaaggctaacggtgatagtataagcattctcatctccgcgagagtaatcgaggaagcagaacaacgcgaaaattttgcggtatgacgtccacttcagttctgtcttgtctagcgagcaacactagttcggcttgcgctttcaacccacagctccacagtgatgcaactgaactaacgtcgagtaacgctgctggccgta

SEQ ID NO: 835 - DNA, 4496 bp, Toxoplasma gondii
cacaggtctaacgagggtcgctcaggcaagtaccggccgtgtagcaaggggctctggaaatgtgcagttgtgcgaagccagaacaacgctgctgagaacgcgacgttcgatagtatgactgaatggcatgcgctgtgcaggccagccactcaaaaatcgaaaaaaggcttgcaagtgtctgacgactgctgctatgtaacaccatgaatagtaacttctatttcaatagacccaggtacatgagctaggtttcccttcccagcaggtccctccttgataacaccacagagcgaggaaagccatcagaggaaacaaaaggattcaggctttgtcgaatttcaatctggatggcacgcgagtaccacaatggaccaatggtatctctggagaaaagcgatgctacgtatttaagcacggtaaagcccacaggccaatgacaaatacagtgctcttgtgtccatttgggaacggcggatttgaattcactagcaaattccggtgtcgagtgccgaagtaccgtctccagaaatccagggcgcaggtcagagcttctaacagaaagctgctcactcgtccaagcaagtgaccagcaccctatctgcagtgcaaaagtcccctgcccgctacagccatgcgtaggaggaagcccttgtcaatcgcagggacacttctagcatagtcaacgcagttccagtggtgttcgctagttttctattcctttcctcccagcccctttagtgggctgggcttacatcccgtgcagctgttctcgtaacgtggagtggcggtccttagaattcctggaaccaacgcgcgatcagacatacaatttcatccggaacatgacacgataaaaagcataatctgagatatttcacctggtggttgaattttctgaggaaagtcgctctttgcggtgagacagttgtttgctaggctccaaacagggtctagcaactcgggctggccagtcctgggcttctgacaaggttgctcggtgtcggaagaatgggcaagagaattgcatcacgactcaatgtaagaggaacagaaaacctcaagtactgcaacgttgaatcggcaaaattttatttatcaacgaacacagaaaacacatttcaagagcgccccgagtcgcggtacgagcaaactcattagaccacgatcagggcttgaagaacgggtctgaagctgcgaaccgtatcatttcttcacgttcgtgcccgctgacaaaaatcgccgtttgaccttactgcacagtggatgctacatttttgtgttcttgaaagcccgtgtctggggtcgttcaccgatcgaactgcttggtacttcttttatccaaaggcttttgggaaggcgtggcgttcaaaggagcttcgctcgtatgtgagtagctttgtctgtcattgtcacgatgaaggccgcaagctctctctgcctgggattggttttccttctacagctgagtacggctcaagcaagttcagctgaaacttcctctggtacgttctttggaacacaaaattatcctacgcaactcggttcttccagtgcacgcgagcaggcgcctgttctaatctcgactttccagccgaccacagatcgcttgaacacgcgcatggttttcacgcaagttctcaacgatgcatacaatggaggcacagatggaatacacaaagcaactttgttctcacaagagctcagcaacagcgtagaatacactgctgaggcgatggagaagtttgtggacatggttcaaccagttcaaggagttgcttccatctgttacccaacaacggcgacagaaataccggagaaatgcagtaaagcgtatgagtatggcgatactgtctacattcctattacccgctccagcgtcgccccaaccacaaatgaggcgtactcgggcggcttgtggagggaacccagcgaaaaactcgacaaggtatgagcctaatcagaggatgaaagttaagtatcacccctgaatgggacaagatgctgcagtgtcaagcctctactgtgtagatgaatctctgcagagcaatacacgagagaaatcagccggcatttactatcatttgtacaggtctcagtgagtagagtctcaatggacaagcagtgcaccttatgtacgtttcgtgtgcccaggaatggtacgaggcgatacgccttctgaagaaacaggttcccaagctcaagacctttgcactgtacactggtcctcctgacgacaagcttcttcattacctactaggcgaacacaggctgatttttgatggcctcttgatcgactgggaatttggtcgcggagcatgttggtcagaggtacgacgcggacaacagtatttctcacgaacaggggcagggtgtgtgcgtagagtttgtgggtgttctttcacatgtggtgacggtgctctactttctggatacaggtgcagaaatcaccgcccaataacaactggatgtggttcgtaaaaagcaaaacaagatacatgatggccaatcaggatccctcaagctgtgtcaacgctgatggaagccgggccgacaaggacgtgtttcttaatgctggagaccgcagtaagcagttctttctcgtaccagcggctgcccttccgagaaaggcaccagcagcctttttcgtgggggtcagaaaccccgacgcactttttagcgtggttagaagtgacagacaaaaaatgcagtatcatttatcaacaaatatttgtatagaattaaattctgtgtgtgaccttcaagctctcttcaaacatttccaccgacgatttgatggacctcacgtgtatttcgactgtgaaaaaagttaggcctgtctcggtacagacaatactaagtttgttttcttgtttctgcaaaattacctggttaggcctgcaaatacaagactatctccttcccgtctttccctgctacaacggcagcgagtggcgatgtcacagcgctattaaagagaggccttctctggcgtgtgacgaccagagacaaaggtaagtgaggaatactaggaatgcttctttgttgtaggacaccaacgcaagtagctttggaaggtcgacccggtcaggggtgtgctgcgcaccgtctgttcaatacaatgacagcgaacactctgatgtctgaacttgtacatatggggtcacgacgttcaggtacgcttttgcgttgtttgagatcaattcatctgcaacgctcaagttcttcttgaaaacgtgcaagaacgtattgggcaaaactccggcgtacgatcttgtacaagtgctctgaggatcccaaagacggacacagaaaggatccagtgtacacctgttcgtcattccctcgcagttaaggggactagcatcgtcgaagtcgcggctaggacagtctctccagcagcaaccaatccaccgagccccaattcttctctgttgcatcacggggcaacgtaaatgtctatacatcgcattcacttgattttctggtcactatcttgtaaaccttcaccaagaaacatgtctgacagcgcagctgcatatatttagtgcaagtgcgtgaacttagttctgcgtcccgactctatccataacgaagtccattgtacttcgtcttgtcgactcgctttcgtacaacaatgaaaaaggaaacacctctggtgtgcctgtactttggttccgagtagctttccggtaacgtctgtcaaaatgtcaactgcgtcgctccagagactgttgcgcacacctcaaaacgctgcttcacagtgtgcctcgcagccatcagccttcacagcaacgcaagtctatcagaagtatgtcaacctcaggtcaacactggtcacctttcgtccgaacgtcggaacgccaacgataaccattgcacgctactatcgggtgtcggacttcggcaagggttagaaacaaacctcgcattctcggatactcattcctccaaccttggccgccacggtggcagcgtagagcggttgaaaatggtagcgcttttgctcctcgccacgagcagggtttgttctacggagagaggcccagacaatttttcttcaaattgtggttgttggtccgcagcgtagctcagtgcattatgataaatagaacaaaaagcaggtggcgatgccccgtacgacgtcgccatcaacaaagtagcagtgtggccgcactacgaataacgacttctgacccttttttgtacgtttttccttgttttgtgggatgtccttgaagtgttgctgatttggtcaactagtcgcgacataccgcgcatgcacatgcacacccgtgtgagacggggtttctgaccaccggcggcgaacagtgccacgagtggtgcccacgtggtgacccgcgtcctgaaatctttctttgtagcttcccgattgggtgcctttctctgtgtagagtcactattgttttcggagacatagatttaatgtcagctagggccttgcgaataattcagacggcgctccccgacactaacga

SEQ ID NO: 836 - DNA, 2579 bp, Toxoplasma gondii
catcttgagggagagctttaatctagttgcttacacccttcagctgcgagggaaaacgactggtagatggagccctctccagcctcttcagtgaaccattctgggtggtttggtttctatagtgtggaaaccgaacatctagatcagtttttaagggacacatcatgtcgtcacttcccgttcgttgactttgcagcatgcagggcgaaaagtggtgggcttggcgttacgtggactggctgcgtgtcgcgtgcactgcatgtgagcttcaagggggtttccaaggtgtcctcaaggagcataaagccttgtttgaagtagatattgtctcagatactttgcgtgggtacaaaagtttcccaccgtcgtgacgtggacttacgacaaaactcgagcctcgcctttttcgccggctacccgtgacgtttgagaaatcgtgggatctgcacaaaggctccgaagtaaaattcaattataacttgctgttcggatcatctcagaagtaacacaaacggctctggcttctagtgaaagtctggacactcgagacgactatgcaggtcagtacattacccacggtggcaccttcagccgccgcccgatgaggcgaatatcgacgacgctcacggtgtcagattttgtggagccttgtgagcaggcaatgaccagcagtgcacttctcggtctttgcttactgctacaagaaaacatttgagggccgtgaaaccgcgcaccttttgccacactgagtctggtgtccatttgacacacggacgggatgacgttaggcgttcccccatctcacgtttaccactggtagttacactacacctgcggaaacaaaggaatgtgtcatgtgccaaactgacacgagatcaaacgcagacactctttgacgccaagagtggtggtagctcctgcactgtgagacagggccggagtgcaggtctcaagagtccgaaaggaacgtttcggttccaccaaactggaggcgcgcgacagaagacgctccatacaaccagattcggctagcgatttatacgctccaccgtccgcaactcaggttcctcttctgtgagtggcattcaccactggactttgcccaacggttttgtctggatttggagatcggtgtgcgcgtctcaaattctcgatagtggagccagacactctaagtctctacagaaaaaaagtgcgcgtcctgcaaaaccttgcgatatttaagaaatgtggaacttcactcctcagttcagcaaccggtttctgacggctacctgcagagcaggtccctaaatgcttctccctaccttgagtatatgcgtcaacccggaaaccgcagctcgactgctgtcgaggaacaggtcctgctgatgaaccgagtgtgaaaagtcctggtttgaggcgaatttatgcctttgaaaaccgttggggcaaacggagaactccagtgcatttagcgtggaagaagaaatccggaaaacgcgctcgctgtcttgccaaacaggggtggcgtcttccccacctcttcttccgacaagctgccatcgcgagacggggctagcgggtggcggcggaggagggtagaaacggatcgtctccttttgagagattcgcacatggtacagctttaactcctcttctgtggagctgcggtaaacgaagactctgtgtatttacggggaaaataacagagggaaacacgcttctaccgatggccactcgaccagagggggtgctgcgctaacaagtttcagcgcagtcgatgacaatcggaccaccacgaccatgaacacgtccgccaccctccagaaatctttttccctttgctctgttgtgtaaacgctgttttcaggaaaagagacctttctcgctggagcatgtgtctgtcgcgttttcggtgtctgcgacctcgttgcggtctgcggatgtcacatcgaaaatcccttatcctgagcttctttttcctccacaccgaaggcgtttcctctccttttcttgcggaggccctaccctccacggcaaacagaagcaatagctggtcgtctattcccttgctctttcgtttgtgccgtatcgcagcctcctctgcttctgaccagaaaatgaccgtggaaccgattgtctcacgcgacgatcctttctctctttgaccctctggggagatgtctctgcctggatttcgccgacttgcacattttgtttcgaactctccgagtctacacgaacaccgttgtttcccccttccttgtcgatgtttccttcccatctaccttttgtctccgcttctgccttcttgtgaaacttgtcaacgctgacctttgcgcgcctcttgtctgtgactccagcgggagagtggacagttttttttccttgggacggagaggccaccgcgtccccttcgttgcctgctccggagcaggcgagaatttttgcagctggaccctgaatcgtcccgcagagaaggagcctcagttgtatacgggaggtaaatcgccaagcctgctcggctgtcggctctcttcatgtgcagcaaagcgcgttggaggccgaagggtctgcgttcccagaggcctgcaaaa

SEQ ID NO: 837 - DNA, 4848 bp, Toxoplasma gondii
tagaagaggcacatgagaagcaggcaagccgcctgaagacacgatccggttcggagtagagcggatgtgaaaaaataaatgaacgggctgtgattctcgcctcgcggagtctcgtcaaagttagccgggggacgcaggttttcattgatggatcgggtcagctgcttcgtcagctgctctccgaagtcaaaagaaccacttccttgcggtcccgtactgttctgccctgtaggggctctgttgtagccctccatgctggccgaagagacaaacgcctgctggaccggcagagtttcgtccccttcgacgcctagagaatacattttgtggcgagaaaactggaaggaaatcagttttggaacagagggctatggcaaaaagggaggataccgagaagctgagtcttcttaagagtgctggagtccctgagctcccagaacaaatgccgagagccgagaagagacgaacagaacggttcctgcaagcagacagaagcggaaacacggaatcatgtatgaggagagctgacggcggactcatttgcactgccactacatccaaacacaaaatatgcgttcttctcaaaaactcttggagctagtgtgtgtgaaagagtaatagcattcacagtgtggacagaaggtgcagaaggccctctcagtcaacatgtggggtaaggctagcggaaggcatggaagcaaatttctctatagcaggattgctccagaatcacactggaaacaactgagggaagacacgcaacatccgagagctacgagaaaattatctaaccgaataccaaaggctccagcgaaaacgtcagaaagaaagtctggctctcaagcagtgtgaacaaccaaagaactgaacagccgcggcaggccttgagttattttccgtctgaggtctcttgagacgtgtgtagacaaaggtatcagagccagtaggcacacacacttggaggccacaggcgtgcagacatgtggctatcagccttcccgacgcttcatcatacatcccacgagtacgtagacgctttttatcgaaggagagcactcctgccatcggtttggctagtctgtatcgacgtttgggtggacccttcggcggttgttccttttgtcatgccagagtgcatattagacatagccacacaatggcataacttcatcttttcacttcccaatgctccggcatttgtcggcggccgctttccacagggcagtgtcttatcaatcgacacctaatcgcagtgaatccacgcgaatccggaatcacagtgcacataccgaaaagtcaaacacgaccttgcaacttgatttgatgagattgcagccccacaaaaacgtttctttttctatccttctcccgagagagtgcttgaaaagccctgtaacaaacggcctgtaaagacatctgagtatcctgctgggtcttgctcgacgaaccaagcaccgtccggtcgtggtgctgtgtaacacggatgcggcttaaccaaacatctcaggctagaaaaccgcccatttgaacgcatgtctcacgtgcatgagtcccgaatgccaccggagttgcagcaacacagtggcgcagcgaagaaagcggaaaggaagagaatccctttcgctgctcaccgtgaaagcgtagcgcgtcaacggcgtcgagctttttcttcgagcagacgacgtgatgctaagacttgaaggtttgagagagccacacggtacccccgacgaaacaaattgagaaacgcgtcttttctgcgttttaaagtccttcatgatccaggcacatgccagcttttcttccagaaatttccagttcttgcaaccacaggcacgtggtagcagagaaacagggcatcgggcaagcgattgctaggactacatcatcgaacctcgtcctcgagacccggtgttccgcagctgcatgtgcgcggctggacagtcctctcctgagcactgtcaaattttcccaattgtgcatagttttccgatcagtcaagtggtagaagggagacgcgacttcccgttgatgggcaacggtgtcgaaagacactgcacgtgcttcggaatgtggcatgcgcgtgcgacagcaagtgcaagttttaaggcgaagtggattcgctgcctggccttccggcactgcaactccgagtaactgaaaaacgtcccgaggtctaataaccgcatgcccatcctaagttaaaagagaagcgacgtctactattttcctcccatagagtgtgatttcgcgtcgaacagggatgcacgcagtatattttggggaacaactgattcgagggcggcaggcagtctttcaggatttcgacgggtttgctcgggacctctactacccttaacaaccgtatccaccaactcaattattgtactgacaacaaggatcagagttggcaactcgcgggtggcctgttacaagacagaagcgcatattcggatgcagagtgcgctcagcagttcatgagattttcgacgcactacaaaaacaactttggactactcgtttagacattcatgttattcctttaccggatcgaagttctattgacattcaactcagtaaatccgatccgccgaactgaccgaaagcgccagctaagccgacattggaaggagagagcgacgcgacgtcaccgtgtttttgctgcgcttaacactcactcggggtcactccgctaggcctccagtatcttcagctctggagatgtcagtattccgtgttttccggcattgctgacttatgagataatgcacacaaatgtgtccctcctccaggatgcgactcaagaactaccgtatagctgctatgccatgcacaaacacattgtttgtagtcacacagggcgtcctgctaatcggtgcactaccaagtttaatatgggatattgccaagaacagtcactgtgtccgtgtccgctctacgcgtttcccctgaaatcctggtcacgttacaatgccaacatacacaggtactagccacaggggtagagccttactaccagtgacgctttttcagacccccacttaaagaagtaccggaatttaacgattgcgtttcgccaaccaactgacgagagtgcttcctgcgtgaatgctttgtcgttgctctcgccacacaatcgttgcgcctttaccgtgacgaactaataagtggatttcttcagtgctttgggcaacaaagagctgatgcacgctgttgtcggcgaggcccctgcgcttggaagccgcatcgcaggtagaccttttgttttctctgagcgaataatttggacgggcatgtatcttattttgtcaagactgggtgtgctcacaagcaatcgcttccacgatacgggtccaacccgagtaacgacgtatacaagatgcctctgtgcactgactacaattctggatgggtggaaaatcaaaaggaagaacatattcccagagatggacaactggaagccttcatccaaccaatcagatgaaggtgcattaacttcgaaaaggctatacgctcctaggaaagcacgtacgattcggaatgcctgaccatagaaagtctaccgtacccaagtcacgtagtttgctacggggcattatctatagttcaagtgaaatccgtttacattgccttttcgtcttttgcgctttcgggtagttctcagatgcaagtttcgcgcactgtggaaactgcgttacgaacagccttaccctttgctgcggttagttgtagtggaagtcgaaagtcatcccgccgcatcgagctatgcagacacttgcgcacgagggagttcttgtctgggtcccccctcccctacctcaacagaggaaatctgacgcctggtggcagacaaatgatacctttcgaatttggcctagactccgaagctgatgctacgttggcctggacatcgatatttcattgactttttcgcacgtgttgttcatgacatggctccacagcgtgcaagccatctgcattgtggctttcttgtcactctgatttagcatgaggcaacggttttttgtgaattcataacgtgtgcaaaacctgccgcaaggactcaccgagtgatggcttctttcccggcacgcctatttttgtcttgggggttggtgtgccgcatgtgcatgcgttcggccgggcctgaacagaaccggtgaaactttccgttattgtctcagctgcttgtctttcatatcctgttgaggacagcgacttcctacacactctgttcagcctttaaaaaggtatgcgcgttttaaattttcagctgttcggagacgggcttccccggtcgcctaccgtcggcctccgctccgacagaaagaagcacacttccaggaggttcaacggcaaacgcgcttgcatctgtatgtttcgtgtttcatttataacgcgtgcccacgagactttttccagtgaacagtcatgcgtccgtaaccgacggaatgcacaagacagcacgagcatgcgatgaatgtgttcatgtcgcaggtcgaccgggtgtcgcgttcatcttgtcactttcacacattggctttcccttgctttctcttcgaccaaagtccgttgtgttttctcgccctctttctctttctcgcgaaccaggtgcgaatttcgctttcgtactcctcggtgcgccgccgtcttttgaggtctgtctccattctgtcgctctctcattcacctttcgaaatcgtttctgtcattagtaagcgatcctgccgtgtcacgagctcgcttcgctctcccttgttccccacaattttcagcgcaagtgtgagtcacccgcggcacacacagcagtaaaccaaggacagccttccaaaacgttgcggggcaaaa

SEQ ID NO: 838 - DNA, 1512 bp, Toxoplasma gondii
cagaagacgcagaagatttgcatgcgttcgcggacggagaagagagagaagtaggaatcagataatcgcaggaagaagctcgagtctcggaggacgcctggttttttggagcttcatcacgcctgtgcttcaactcaccgggcataatgtcaacttggaacggaaaaaagagcacactcggtctcgttcactctcccttgtctcgtcctccgaggcgtagaagactcttgcgacagagccgagagagtcacggcccagaaaagtaaggcaaagaccgtatcgagacatgttttggcggacacgacgggccaggaaattggcatgaaatgtggaaaacgatcaacgacaagcaggcggaaacaaatctgtatatacattagaggatacggaagttcagctcgccgcgtctatctcgacttttacttccagagcagctccctttccaagtcgcacatcatcgtagtgtcgctggaccttttttctgttggtgcctctttctcattcgcaagttttcctcttccactcctactgcctttcccccctttcgccgacgatgggagaagcctccacacacgctcgtccacggggctcggtgtcgtgtcgaggcaggacggaaaacaggcaaatttgcaccgtcccgcttggaaaaatgggaaggccggacagaaactggggataagacacaactgcaaaagcaggagttcgcgaccggggaaaagcaagagacatgggggcaacgaaggcacaaccgacggtgctggggcagacgggaggggagcggcagcttttccggcagagaaaaggcaaggaagtcgaacggctgctttttgatttccagatgctttttctcgttcccgtgtgcggtctcagatgcgcactggggcttcttgttttcgaccggcaaagcgcgcaagaagctagaccgcatgcgtgtcacagcacacagacagccagcagagaccgggggtaaaaagcggcgggtctttggcgcttcttttatttcatctcgaaaggctgttcacacttttcagcagaacgtaggcctcaaaagacacgcacaaatcttggacagctagaggctcaggcagccgtgcatgcacaaactccagcatctacctctctgtgaagtccagttggaaaagatcgaagccgccttcgagttcgagaaaagatttccttctcattgctcgcaggggtttttcccgtagctgcgcatgcgcagagaggatctcccttcccgggttccggtttttcaggtggcggcttatattcggaaactcaggctgccgcgctctctaagggaggggcctgcgtgtcgcgcggcctttggtttccagtgtgggtgccaaggcgaaagaaagaagtgacgggggggcatcgtttttgcagcacgcgcagagagatctgggtcgtttttcttcggggcggggcgtgtgtctgtcggagagttgttcctttctttccgtttctttctggatattcgtctgctctctcgcgacctcttcgacgcga

SEQ ID NO: 839 - DNA, 4993 bp, Toxoplasma gondii
cctcctccgagagcagcgaggccgcgttgttgtcagttttctcaactcctctgaaacgctgatccgcgtctgcactcgcgttttgaggaccagagagcccgtcgatgatgtcttggacttcgtcgcagagaagaacagtgtctcttttcccctgggcggcgtcgaccccgtcagcgcctgacaacttgtctgtctctggggccgagttctcgcgggcgtcaaagcgccccaacgcgttgtcgaagaggctggagaggcctgtctctgtctcgtcccggagagacattgataaaaaggttttccagtctaccctggatggcgagaaagctcctccgcgtcgtgctcgcggtagagaggcctcgcgcgggcgcgccacggggagtctgactgaggcctgcgagccgaagaacccagggacggactgtctcctgcctcggatggtggacccgtcagagacatcctcgctgctcgacgtttgattcccgtacaaaagattgtacgcttgccgtacgaggctttggtggtgactctcctccccctgtgccaaggtcacgtctgactccagcaactcggtttcttcgagtgtctcaacgcgcagctctgcatctgcctccgccaagagctgcgaaaacgggccatctttcacgttgtctccactcccttcctggcttgtcgtgtcttgtctgttccgcgccaaaaaggcggtaatctcggccttctgggcgaggacgattgtccccgcggtcgctgcggcgtctgaagccgcacccgggagcggctgaaggaggctgccctcgcaggaggcgaggcgcgaggtctgcgccagcttttcgcctggagtccttcggtcctggccgtatctacacgaagagtgtcttcccgaggcggctgagtcttctctttcgccgccctccctctgcaagtgactcaggaagaccgcggcggtgtcggagacgtcagagacagacgagagtgactggcgaactgggtctttgaaaacaggagacgggtctagtttgcctgaggagacggaagtcagagaactgcgagacgcgccggtccgcgccgccccagctgagaacgaggagacaagagaaccccgctgagaagtggggacagagtcgggtccacgagaaagcgaggtgccttcttcgtgtcttgaagcgccggcgggagtgtagatatcaaagtactcgggagaaggcccggtcccccctgcagcgtcgcagggagccgaaggcgccgcgacagagatcagcgagtgtacgtccgagtcgcgatcgcatgcagggtcttgaagaggctcagaagcgcgaggaagcgaaccagagggagaagcgatactggcgtcgagcgcagacacccggctgctggcgagatggggcgttctctcgcgtgcctctgcggagtctactcgaaacggtggtggtgagagttgagcctctgattcaaaagacgcgcccccctgacaggagtgagcagagggtgaagcgaacgcggagcgtcgcggggaactggaggggctttctgcaggcgaagcaaacgcagcggagctttggcttccaatctgaatcgcttctgacccaggggacatctcttgagctcgaacagaggcagacgaagggtccggcaaagcgtcctgagggtctgcaagttgggacgccgcaaactcgacagctgcggaagcagactctgaggcggcggcgctgtccaacagcgtctcgccggggcaatactcgtggtcggcagtcggtgctccgttgtggtctggaacgacacaagttgccgcggcagcctggaacgaaggctgctcttcatgtgtgttcgactcccagttcttctccacagtgtcgcctgagttgcttcgaataaccccagacggggacggactcgccggctcttgcgaagtggactccgcccctccagcgctgtcgagcgcagcgcccgatcctgagcgctcgttcagcattccagaaaaagaagttaacgcggaggcagaaaacaaccgagaaagaagcgaaagacggtggagagcaggagacctgcctcggagaaagagggtcagctaactcggagttaggcgcaggcgactgggaggagttggagggccgagagacgggtcgaagaagaaactcaacgcagtttgctctcgagaagaggctcgggggctcgtggaaagaatgtgtgtcaacccagaaaagtcactggcgcggatctcgtgccttctttggtgttcccttctgccccccctcccaggtgacggtagtgacccaaaaaagagatgcgcatggaagaccgacactgtcaagcatgctgcaaagggcgggttcatcgtccgggactcggaaacgaaggcgcgcgcggttgagtccaggggtagatgggatgggtctgaaaaaaaatcagcaggggaactctcagagagtcggttgacgcaaagacagtacgctcgtggattctgcgcccgcgtgttttttgactagacaacgcgagagaggtagccacccgggccggtgcacaaacgaaaccctgggaggcgcggtgacgcattcgcagaaaacaggctttctgtcctgcagcatgaacgaaaactgggcaggtggaattgtatgtgaaaagttcctttagcacgtgagcgcggacataaagaaaaagattgcgccgcgcgcgctaggctcacctcccttgattggcgcccaccctccacacgtgcgcggcaacagttaccctcctacgagcgaagacacgcgacagccagaaattttgcgcaggctgcaagacaaaagacaggctggaaaaaaggggtttgggggcgaaggtgctgatgagcgggagcgaacagaggcgagtaagagataaggccaatgcgttgaaaagttgcctcgaaagcagttcctctggaaaccatgtggcatatctgcctacaaccgcgcttctctgcgcactgcaacaagccacctttcgaatggctcacaggttttacacgggtttaccacaagacgaacagcggaaggggaactcaaatgcgctttcttgaagaaataccaacacgaggcgtccacgactctccaaatagccaaaataagcagcatcgggaaactcggaaaatggcgtatcagtctatgacgccattacgaagaaacgattagctgtagggacacctcaccactccgcagcaggcctggcagcgaatcttcgcagggaatgccaaacggaaggattgcagggacgaaaagcagagttgtcttgtccgatgtttatcgagtgtaccttactcgcacgaaaggcagctcgcactctcattgtccgaatgcagggtcccaagtttcacaagtagcacactaagtgtttgggtgcgagaccaagtttcgttattttccgcacagtcgaatatattctggaaatgcaagatagcgggcggtacgggcgtcgaggaataaaacgactactatctgaggagtagcgtagctgtccttagtcacaatccgacaagaggtacctgtttagaagcgatgagtagtgctgggctcctgttgaccagctggttctgtgaaccgtccagcacactgtatctgaatgtatgattatgacgcagacttgtaattcatcttcggacagtgtcgaattcccacctgaatggtggactcctcgtgttagaggcggacggctggtgcaatttgtcggagctttctgcgttgagggaagtttcccggttccaaacgggtaactgatgaagcgggtggctgcttcgacgaccttcgaatccaatacagtctttgtgcgcttggacctacagtacgttgttcaggtgcattcgctgtaatgggaccaagcactgcatccagttccttcttatgtgctgcagcgaactgccatcagaacatccctttctcgcagtcctctctacttcctaaaatctctgtcataccacctctacagcaaagggtattagagttctcatgtgcacaaatattaggctctggaaacacttgtccggtgaattgacgagcgggacgccttcgcgtcacaccgtgttgttgacacattgcttacccagtcacctcttgcgttgcagcgggagcgcacaccattcaagcaagtagataaatagtgtccacgagaaagcatgttagtgtgcggatgtctcagtttttggaaccatgccattttagctactgctttgtgttgcaagtgacaaatcggtggattgccagcaacacacagcgtgattgcatacccatacagatataagttgtcttttagtgtctataaatgtcagcgtgtcgtgcgcaggtgcctcgtttttgttgacaatggcgcacgcacatgcctgttatgcggccagcattaacctcttttcttttagtggtctaaccgacgtgtgcctataaaacatcagcgtgctggttggtagacagtcgtaattctatatgttctttgtgagatgttttacgatgaacgagcatcgcccacgggatctcactatcccttggctctgatacgccaccagctacaagttcacggtggaaaagaagccacaaatttctgttccaccgtccaaaacaccgagtggctctcgaggctgtcctccgtgagaaaaacaatctctctacccgctcaagatttcctcggaaaggtggtgcaaaatggagtggagagtggggcagtcagcaggccgtaaagacgcagcttgtacagattgacgccatatcgacctagaattgtcaatcagaggatgcaggtcgcctcgtaaaatttacctgcttgtgccatcgggaaagagagattattgagaagcgagggactgataaaagcctgcgaaactgttgattgagcgagtgctgtgttgagtttttagcggaagagtcatagtcggcagtctctagaatgagctctcacactcgcaagctatggtttgactctcagctgccaataaaaacgtcaacgagtgggtatctgtttccttgccagttgtacgcaggcatcaccgaga

SEQ ID NO: 840 - DNA, 4289 bp, Toxoplasma gondii
gcgaagaagcctcttaacgccagtaacgctcttcgtctcgccatcgacgcaccacaggtggtagcccactaagtagagaacgaagttgaagtcggtccttccgaggcaggcgaacagggacgaaacgagaagcaccatgatgcaggtgacgatgcccccgcggagtgtacgtacacctggtaagtcttcagacgaggcgtcagcgaggcgactgccgagccagcctgcgcggaacgaatgtgggagcgcaggcagcagagtcggaggctgggcttgacgaactgtcgaaatcggtgccgaagacataaaaaagctgcctccgggcatggcactctgggccgggtacgagaaactgccggtcgtcgaaggcgcgagaccagtggacggcaaaccctgagccatgacgtacaccgtgcccggcgcagctgaggcgggacacgcgacatagctcgaaggcattggggcgccggcggaaggcatcaccacagacggacccgttggcggaccgttgctaacaagaacagctggacgcgtaggttcgttcgccgccgaagagacgggagcataatgcgccgcatacggatcggagagttgcgtcgccatggtcaacagagggagagagacgaccttcggggagtcgacggctgtgtctagaggaaagaataagcctaacgtgaacgcactgtcggctcaatcggaaaacatactttcgtgctgcaccggaagctatgcgcctgcgaaacgcgaccgcaagaaaaaggcttagcggaggcttgggagcaagacagatgacagtgccttgaagtacgaggaaagagaagtgactgctgtgcagaggaagcagctttcgagagaggactgaatacagagttaccggggacgaacgacactcagagtatttttgggagggcggctgggcccctacagcccttccaagaggtgcggctgaaaaccatgtgcggagacaaaaccgccctgaagaagttgcgattttgctgtaaggcagaagggatgagtcacggtcgaccaacggcctggaaaggaacagaagaaagtggaaacggccgtcggcggagagtggttgtaaaaagagagcgcgaaaaagcaggggtaacggatccagtttgcttcagtcactgagtcgagtctaacgaagaatcagtgagaaaagcagaggtgggaaaggacgcagtcagtgtcttccgaccgccactcgcgcgcacggcttgaggggttgagtttcccggagaaagcgcttggaacggctgatctacctcgagatatcggtggttttttccaaattccgtccaggaggcagaagcggcaacccagttggggaaaatctgtgcaaatacaagggagaatttcgggcttcgaaccgaggaagcacattgggatacgcgccacctcgccagaacagctaccgtagcaggtgggaggcagagcgggtcgccaccgagctgtgcaagtcactgcaagacaagcgtgagagcaccacaaaaaatcaagtcctgtgctttctggtcacgcattcccagcattcttccgcagcagaaatctacagcggtgggtggaacctcgtataagtgtaagttggctgcataataaccaagggaggagatgaggtcgcaacacatgttgttcccggtgcggcaagacatgccgtggcggacacagcctggcggctctgctcttttcaccactggaggagctggaaacagacgatccgggctctgagttgcctttttttatcggtggcctcgacaaactttgcgaagtccgagaacgctgccgaagggaccttctgtgcagttccgcatggaagcgacaccatttcgtgtcttgcgggagtctaccaagcagtttacccttgcaactgaacaggtgggggtcaccagctgcaatggcgcgaaggtcacctttctccctgagtgaaagagagagctggttcttcagtgttgaatttacaaagcgggggacagctacactgactcaggtgacggctctgagcgccttcaagttggaggttttttgctccgacatctgcagttgttggtgcctccgcttccgatgaaaccacctcgtgtcgctgcaacccttctccgctatgtgttactaaatgctgagcatcatagcagaaaaccattgctgcttagctcagtgaacctcatgtcaagagcgatagcctgacgctgacgtccttcggcaagaagtccggcggtgatctgtagagactcttccaggtgcttaccttacggtttattgcctggcaccgcgccggtagtagtctgtggacttctgcgtaccctgccgtggtacacgaatagtcagtctttttctcaaacctttgataccccttatggggtgttcagcgccaatcaagaacagtgcattagtatcatccaccctgggggtgtccccgactcaaggcccttacggtctgttgtgaaggacctcgggttcgtgccgttgttagcagggttgctggaaccatttaaatgtaagcagaaaatatgtgggactatggcggttgaattcggacagcccaaaggaagttaactatcaaatgtattcagtgtatccttgaaacctgatgcagcttagtcttctatgttgctatcttagtcaactaagcttcaaggggaaagaacttgtcgagagcagtcgtcgtggtaaaagctggtccgactttttgcatggtacttgcctggcgcattttttacgtactttgccagaagaaaaggcttatgtggtagaatcattgtgatggcacctgctgtgtgcatctgacccctcagcttttaccagaagacacgaacggggaacggggtccctgagttcgttatcctgggtgtatgtgtgagactccgggttgcctcgatctcttcgactagagtcccgtcggctgagtttggtcaggtgcagcatcgggggctacgcgaacggcacctagacacgatggaggaggtaactgttcctcgtttcggcccttacaatttcatcggtatagaagagaagttccttttcacgctctctggcatttgcccttccgggtgacacgtcgacaatttgtgggtcgtcgatttctctcatccgtagggaatgtctttcattttttgaggacatgttaccgaggggctaaatgttccgagagatagtctgtcctgtttatccaaacacaaagtttgccaattgcagcaccactggaggcggtcaccgcctttcccgagggaaatcgtgagatatgtatactttcttaacgcgtgcgactgattgtacacgggtttgcttcttgcctccaaatagcactaaagaagcagtctctgtggcgaaaccctgtccaggcatcttgttaaaacagatggcagggacagggccccctccagagatggctagtctcgatcgagcacatactttcgtgctcgtcggagactatataacggagaccgatcacagaagcaaaacggcgtgtgttttgttcatttccagctaggtaccgctgaaacgccccgtgtttttaccgtaacaggacttgccgaccccaatacagctaatatcaacagtcgtaattagtcgggcctgcgaaaattatggtcccagcaccgactggcaaaatgcgcacaatgtgcatgcagcaagaggcaaagctaggttctcgcgtcgagaagttagtattctctcgatgcccagcgtccacactttgttacgcacatttcactggaacgagagacagtggcaccaaaacatacggtgcatcgcgcactgacgagcacgtgcggtttctacagggatgtaaaaagctgccgcgacaatgtaaggaggagttggagatctcttcgagcattgcatttcactgctgatcaaggcgggaccacggggtttcgagcacccggttccccctgtctcggaagatgccactctatgggccgcaaacccttcttacgatcctggctttatttcctgctcctgtttgtgtctctcatccaagagaggtacagtatcaagcctcattaaagtatgaacaggcgaagcaatcgatcacatagattgagggcgtggtattccataggcaagaacaacttttttctcttgaggcgacaaacgcacccgagacgcgctagcgccccctcgtccgcgtaaaggcgtgtttacatgcgcgtagcactgcgcgggtacaggcagttgggggcaccagtttccacaggggttctttcaccagcgtcgctgaatatggttctgtattgagacttatttgcctgcaagatgctaagtttcacccgaaagaaata

SEQ ID NO: 841 - DNA, 1455 bp, Toxoplasma gondii
ctcctcctccaaatggacgtggtggagaacaggcaatccatggccttcagcggcctcgcgaactgcgaaagctgggtaccgggcggcgagatctgtcggaaggttggagacgagaaagacgtccaagccactgcatttctccactttcaagtgatgcgactgtttgcccacaaaacctggcgccgccgtcaaggtcgaagccgcgagacttcgaggcacctggacggcatgcccgggagagcgaggagagaaaggagagggaggagaagagagagaagaaagccgatcaggaagcgagggggcaggagaggaaagacgtccatttatgtgggcatagtttgccttgaaagccgactcaagagcctgtagcacatcgcttccaccgggaggtggtggagcctccagagggccatttggaagatggtgctcaggcaatggagacgaagagagagaagaaggagaagagagagaagaaggagaagagagagaagaaggagagagagaagaaggagaagagatagaaggaacgggatgtgggacaggagaagaagaaacggcggagcacgacagtagagtcaagagacagatggagagccagcagaagatcgcaggcaagcttcgagacaactgacgagcgtttttcaacgggagagacaaagaccgacggcagagagacgacctcgagcgagactgggacgatgacggaagagacgacaaagggaggagcaagtcaacctcggagggtccagactcgcgagagcgaggccgcgtgacacgcagatgcgagagattcttcccccctgcctccatcttcggtagccgtcgaggagagagggagagaggccaagaaaaggaaaaacatgcgttcgagacaagtcggctggacaaagagacctcccggacctctcgcgctcacgcaagaacggcggagcgcctcgaaagcactcttgaaggaaatttgagcggaaactgaacaggagcgagagtcctggaaagcactggtgacaaagactaaggcctagaccaaggcgagggggggagaagacacaggcgaagaaagagaagcagggaaaagaaaagagcgacgcggacagcgaagaagactcgggggcgattgccggcgacgctctctcgaagtcgcatgcctttttgttcgtggaaaaacaaacgagtcttgaaaccacctatatctgttcgcgcgaaggtcgcaaggaacgtccgggtatctaaaaccttctggactagaaaaaagaaaggagacgaaaaggagaagagacaaagaaaaacaaaagcgtcagcttcaccatcctccccccttggcgagtgacctcgagagtaatcaccttgcagcgtttcggatttcgcgagcccttgtcaagtcgaggcgacaagaaagcagtctaacgaagcgaacaaagagtccgttgttcgtcaaaactgtggcgcgcagccaaa

SEQ ID NO: 842 - DNA, 4217 bp, Toxoplasma gondii
gggtttaaactgccttcagattgttttactcgtaggctgtcaacattgttcgttccgttactgccacctcgacttgttacctgcttgcactctttgaggaatgacttccgagtgactgggttcgtggcgcttgctcaaaaacctttccccaagcgctcaccgagcttgagcgcggacgtttcagcggttgatttgttgttcttgtgtcgtgcactgaggaacgaccataatttgccagtgagaaagcctgagtcatttggcatgtcacacgtggtggcagcacacctgggactttactagtgtgggtgacagcagaggtttcatgcgacttgcttagtgagcaaggtggaagaaacatacacacaaagtgtcttttcactcatgaattgaaggattgacggcctctgaagtactacggggttatacccaagaaaatgagagagctgagtaatattacaggatactgtagcactatggcgttcttaggcgacatgcgaaagacgcagaaagcgcatgatacttgtagttgttgttacaccggcaatcgaaacatgtgtgtcttcgatatcacgaggaactcgatgcgcttggcgcatcagtggatgcacctttgaaagacgatcacgaagtgtaagtcatccgttgggcgcaggagtcttggagtttacgcgcagtcatgtgttgatcaacgtgcatttggttccgtcgagacccggaaacttacgactgtagctgaagatcctagcgtctggtttcgtcctatctttatgagaataggaatgtatccgtatgcgtagtggtgatgattctgtaggcttgtggtcgtcatcttcttctctgttactgtcctagataagaaactaagtttagttatggtgggagattatttcgtacatttggatcacacgcttcccgagaggttctgaggacttcagtgctgtctcgaatcttccgctactcagacaggcggagtaacatggatgcactgttgctgtgtgcgcaagaggcactgtcgtgcgtgcaacaggacttgcaatgacacaaatacctaaagaatctagaacaaacctactctacgtgtccaaggttacaagcctaataacagcggcattcgcatgggcacgagacaatacagaagtgaaagttgcctgacatataagtgccagtgtaatgcgagctttctagttccctgcttccgacagatacgcaagcaaacacttgcgcgtgatccgcgtatctaagcatgctccaaagtatcgcttgatttcggcctcgaattttgatgagggaaaccggtggtcccttcccttgaaccgtgtgcccggtcgacgagatttacgtggtcatcgtacgtgggagcgctccacgaacaggacagatcttcgctcgatgtccccatcgcctttgtttcacatgcgtttgcctaggtttgccggacctctggtgtctctcacgctgaagaatctgttctcgtgactaagatacatcaaagaacgcagcgctgaatgcaaggacgctgcggactttgcgaccatattttttcaacctctggtccctatccagcagcgggtttctttagtcccgacgtgcaacagcgaggcgtgtgctgtgtggggcttcatggaaatgtcaaccgcccggtgtcaaaaatcaactgcggaagcgatctgatatgtggtgcgtcgctttcacgaaaaatttaggccttaagaaacaggagggttaagggggtctggtggtttgaaacgaatagttcagctcgtctggaaacaactcggtaatagcttccggtctaggttcttgtacctgtgttccggctcgttgctacacacgaacagtcctccataaaccgataacaaacaacgggttttacatgagcatcttcttcagttcgtcatagaagaccaacacgagggcaccgccagcgccacgcaacacgttcgcccacgcgcccttgaagaagcccttgaatccttcctgctgatagaccttcttccagcagtctgcagtgcccgtgtactggatttcctgctcacccttcttgcggccagccatcatcatcattcttcttcgaacagtgtcgaaggggtaggacgcaacaccggcggcagcagtgacggtctgagcaactgcccacttgtagaagaggtttgcatcgttgttgggaccgaagagcatcgccttcgcggtatcgaacagaccgaagtaggcaccgcggtacacgatgatgccctgaacagagactccgaagccttggtagagggagaagaacccggtgcgacggaagattttgccgaggcagtcgaccagtcctgtaaattcacgttcgttgcccttgccgacgtcagaggccagacgagttcgagcaaagtcaagaggatatacaataaccaacgaggaagcaccggccagaccgccagaggcgacgttcgtgcaaaaaaacttccagaattcttttttctggtcatatctggggaacatgcgcttgaaagtgtccttgaaggcaaagttgaacgcctgagtagggaaatatctgattacatttgccatgttcccacgccacagagacgcaacgccctgctcagcagacacacgacggaagcagtcgacgataccagtgtatcgtggaatcttcccctccttgatttcggggatggagtcctgcgtctgaatcagcatcttcacacgctcgattggagccacaattgtctttgatacacccgcggaaattcctcctgcgaggaaatccttcgcggtattcatgagctgactatccgcatttcccttcttctccttcccccccgcagagaccgtcggcgccgccattgttcctggttcgcgaaaatgaaaatgcacagcaaaggggaacccgctttcctacggaaagatcgctgctttaacacggacagaacgcctgccttgctgtacacagggacgaagagacaggcgacaacacacaggaaggcggcccttctctcttcgaacgacttgcgtatagacacttccggagtttttgatcgaaggcgaaaaaacaggaagaagacgcagtgacgcagcgacagacgaaccgtcgcagtggacgcctttagaaacgcgaggaagcaagagtagggaaacacggtaatgacgccgccctcaaccccttgcggaggaacgacgggaccaacatggggaacttcctacggtggtgtggacgattttcgggcaaaatgtctccagtacccggtctctagtgcggtgacgacgccgcgcgcttatgtaagccggggggaggggttgctcacgaacgcccattctgtgggtttctacctacaaagcggaagaacacaccaccctgtacagatcaggcaccactgcggtctacagttgtgtgtttgcctcgcccgtccctgcccgaaaattagccgcatctctctgggtgtgcggcgcagcacctctgctcgcatgcacgtcctgtcttctctggcgttaccccacaattttctgtcttgccgcgtcagcgttttcgctcttcaagactctacgatcaggagaacggacctctgatagtttgactccaaaacaagtagctcctctaactttcgtaggggtacaattggaggattgtcttcgaaggaagtgccgaacactgcacgcgctaatggaaatatgtgactctcggcttttccaaacgtctgcacaccgtcgcgcagatgtccagctccgatggacgtaccagccagggcagttcccgagcgtaagcggcaagcggttctctctgcggaccgccaggacattgacgcttccgaatatccttatcaaaccttgttttccctgtgaaaaagggcagaacccggggttaactcgcggttcttgccacgaaactaccgatcgaccttcagtggaacgatgacgcgtcctttaactccgtacatcttgtgtccacgccttgtcagtgcaggcctcgctggaagtcgcctgccacggagctgtcttccttggctcttcggcagctttcccagcgaccgtggtacaaccacgtaggcggaaatcaagtgcatctcgagcgactccgtcattctttcgaacgcctacaaagccggctgccacacccatccggagttgccgccgtagatagcggtacttcgaagtgagaaatgtggaacagcgggcaaaggtggtaagcccaacgaccaagctcttcacctgaggtgcaggttcaacgtctttcctcagca

SEQ ID NO: 843 - DNA, 2594 bp, Toxoplasma gondii
actccgttagtaaggagcatcctgtatacgccaccagacaggcaacagcgtaggagggcgcactggaacgtcgagtttaccgtcgagtttaccgtcgagtttacggactccaccctccggcgttcttttgactcactccgttgatgttcggacctgtcgcgaaagacgccagcctgtcggggactgagtcctccagaggctcttcctgcttttgctccacagcttgtcgcaggtgcgccgtcgcgattgccttcatcgacacctgcggatgaggcacagagtcgaggaagtatttggactcctggcgtctggggaaactcttgtatctggagtctaggcgctcgggggctcctcgagcattgtcgggactcagtgggtcctctgtcgacgacgacgcactgttctgcacttcgggagctccttcgacgcagcgacccgaaggggcagagaacagggaggacggagactcggaggcagcagagacagagagagacggcgaagacgacagaagtccttgctccggcgaagcctccagcgcggagacagggccgacgagtggggactcggcttccgccatctggtcctcgcaagcccgtgagaccagcaaccgcgaagctgggtgagaaggaggcggctggagggcgcgcctcggccgtgtctacctacggaggcagacgcggcaggggaggcagcgagagcgcaggcgaggaacgaagctggggcaacttccgcggcaacgcgaggctcaggaacggcgaagaggcgcgcgtgcttagcgagcaaaggtgcaaagtaaccttaatgtggtaaacaaactgtgggagatctaaaccgggaggtgaactcgtgactctctgagagaggaggcgacaccgtgggcgacgggttgcttaagactcgtagagtcttgaatacgggcagcagagtctcctgtaagtaccaccgatttgaaggtgtttctacgagaccacgaagaactactgcgaaacgacagagaaacatgccgcagaaacgagaaacacggcagggaaaaagcccaccgagaatggggaaccgaacgcacaattcgaagcaggggagacgacgatacagcagggtcaccaaagtatccagtgaagcattgcaagaattcggatacctggagagaggcttaccgaagaaacacgcagccaaaaagagtggtgcccgcgagcgctgttggcgtgaagataccgcggtaagcgaggcgccaaatgggctcagcaccgggcaaggaatggatcacgcaataaagacgctgaagaggactgaagataccggagaaaagaggagcaacggcggttacagggaggctgcagagtagacgcaggcagagcccaggaaatttttgcacagagtctgctgcgagcaatgcggaaacaagacgctgagactacagtcgctggcgccgaagagcgacagctgcagacttcgcggcagaggattcgctcgccgcatctgaatgccggcgcctacgttagcgaggttacaagaagcgtcgacagcaattccagtgtacagaagtctcttgtttctgtccggaatttgtgtcgggcaacagtcggggcctgtgagcagtcgccaacactgtgtgagcgttatgctttgaggcagctcaagattccacactagttcccgctgtagctaagagaaggccactgttgattatcattgcgtgcgcgagctgggagtgtttccctgtcgcgttcgtgagctccgtctgtcgcatctaagtgggcaacgaccgcggcgagtagatcgcagcaacagacccggctacgaggagccgccggcacacttgaagaagtgtctatccgtgaaaagcccagagacgcccttctttcgaccgaggcacgagaaaaaaagaccttgcgtgagatgttgcccgcgggaaaattccacgcaactcccgcgtatttcgacatgtgaacggattctgatccccgagagtcgagtattatccatacataccaggcgtaaaaagcgttcatccagttactcaacaggtgccaggccaacaagaatccggttagtgcagaaactttcgagacggtaactgcgttcgacacgaccgtgcggaaacgctgacaatgcctggagaggcgaaaacacgaagcgactcggaaagccgaaaaacttgtgcagtccaattttgcaatgacctgtcgcccagctcaccgagctgctcattgtccggcgattgttgaccaattctcgcggcgttcgatggtactgcccgtgcctgcatgcgcctgcaagtgcgaaggaaaagggaagagtccgcaactttcagcgagtgattttgcttcgtgtatagctccagaaccaattcgggcagcgctctcgaaaacctgccttctctttgaggttcaggaggattccctcacagttgcatacgaggtcgtcctgagttgtggctagcctttccgcggagccccctcagacaatagtgtgctgctaagccgccaacaagagtgaggcccaaaacttgccgcgtacaagacatccaattgctatcgagacggagcagccttgttcctctgcacaaagtggagacaaaactttggaaagggaca

SEQ ID NO: 844 - DNA, 1665 bp, Toxoplasma gondii
agtattttgaccacgctgcaccatcgtactaaataagatgtcaatgtcgcggaaacgcctgcaccggccggaatgcaccgcaccgcaacaaatggtgcaaactccactttactacttcggaaacctgtatccactggcgcagaatttcttgagcagacgcgtttttaaacattagcgtttctgtgacagcaggtgcatagaaattttctgaccgagcgaaagacgttgactgcaaacagacttctgggttggtcagtatcgtctgaggcgaactgacagggcgcgctcaacaaatccgttttgtttttcggcacttggacaaatcaagaaatgaatttctgctcttccgtgcgtcgaaacgagttcctgtcaagttcagcatacaccacacgcaacttagaaggcagcgggaactcgcatcaccatgcagtagatatggccgaattccgccacgccttgaggtgacggaactaccaaatgcagactgctagcactgcccctttcttcttcaaaaagtgttgaataggtagttcatgccttgatgacaaggagcgagagtcacttttttctttatgatgctactacctgcataagtttttgtccattaaagctttagttgtcccgagtaacggacggtctctccgaggcgtctactgtccagcactcccagcggcggccgacgaccttgcgaagtgctgtctttacagtggtgggagcaaagtccagaaactgtccgtagcatgaacaaacttaatccgtgagggcatgtcgtgacgcatgtgtgcatcagcaggagaaccatagatcagtaactcgttagctggtatatcccagcacacagtatctacaaagattgagaggcacatgcagcaaaccggttttcttcgacgaaagaataacccactttcctcgacaattccactagtttcccccccagaatctgtaacaatgcgactggcacgcgattatggagttgctgtgtgccctataaacacgtggttgtgcgaagtcgcagcggggaaggacttccccgactactgtgttcatcagtggcacagagaaaacctggtgcaagtatggcagaaaaaaatggacccaacgcactatgttggtcgttgcagatttaaaaaggcacacaaacactgcagaggatcacgtgaacgtgccaggttgacacagttggcgtccaggaaactgtgactgcatgcagatctcgcatgcaccgaactccctcgattactttttcctataaaaagggagtcatgcgagacacgttccagtaagcccagcactgagcttccctgttctcacgaccaccataaacgtgtcgtataattaaactatgcggtgtcgccaaaagctgaaccgcccttgtcgagaactttcgctttcgtagtgtgtttcacctcgtttgtcgatcctgtaaccgtggcatgcacaccgtctatcattttcacttttcggtctagctccagcgtctcgatgtgcgtatcactttggacaccgacaggagatacatcgaatatctttaagttcgtctgcgtccctgctctcctggaatagacaggaacgcgactgtaggtaactggcccatgctccaggggtcgtttgttgaaccagcagtttctctgtgttacttcagcgcagctgtttgagtcctcaaaa

SEQ ID NO: 845 - DNA, 3990 bp, Toxoplasma gondii
tttgtacactgtgcacaactgtacgaccatgtagtgtaaaacgaaaccggaaacgttctctccaaagaggaactgcgtgcggttgatgttacgcgcttcaccgctttaagcgtgtcacaaattaatgtgcatgttaatgactctaatgaaccttccctgagtatcttcgtgatacaccttccatatcaaatgcctatagcggcactgatactcagttttgtgcctgaggtcgcggcaacaacgtgatctcttgcaatcgacagtggccccaaggtgttcagcgagtcaactatgttacggagaaactctaaaggcagttgccggatgaaccccccttgctggacctacgaagtagttccttccgaaactgaagcgtgtgtctagcaattatcgaggcacatcgtgaccctcgctttaaatgtggaacgtcggcctcattctgcccaccactcaccacagaaaacgtttatgcccagtagagcagatgttcagtctgtttcctttccctggacaaataagttgagaaagggtcgtccttggcctcggggttggcccgggtctacgggaaggggaggtcgaggagacgacaaggggagagctcgaccgagatgagaaaggacgagtggaggcgatgaaagggatatttcgtgtgggggtatcagctgcttcatctcttctgtcgttgcttgcatggtctccagcgcggcccttgggtagcgctgctccaagtgagcaggaacgacgaaacgttggggtttcgggttattgggaggttgtgatctgtatcagagcacacaaaatcacagaagctggcggcagctcatgaagcgaatagtcgagagtagaagtgtggaagagcttcaattaccggtccaggattttgatcaagtagaaaaactggcacggtgcatatggctaaggtctaaccactcgccacgaagccagcagcagtgcagtgcagtgccgtgaaaacgaactctagtcactgaagctgcagcgtggaccggtactgaaacgatgttttgtcttgagcgtcaaagcatatcagctctgtaaacgtcggcattggtttaatgagcacagttgtggctcggagctacaaattaaatgtaaggctagaaccgtcgcgtgaccgtttgcttcgcgtcaagggaatccgaagtggatctgacaagcaaggcggcgtgcttggggcgcgtaacataatatcagaacactggtatcaggtcttctcgagacgcacgtggaaactgatagtaggtggatgagtctggtggtcgaaaagctgggttggcatgaaatataacatgcaagacttggggggtattcatcggcggcaagcggcctttctcttcctcagcaggcccttccttatttgaccctagaaaattctctaccatgagcgccgcgggttcgtattcaagaggaccacgactacgagaggaacacgaagacgagccggcctcgtccacatcaccatgatctctactcctgggaggtggagcacggggacggcttgttagcgggatggcttccggcttttcactttcttggccattccctcgtccaaaacggggacgtgcgcaagaggctagcgtaggcgaaacaccataacagaagatttcgtattacaccaccactcaacatagaagtgctgaaaaggcagatgcccctattctcatgttgtcgattttaatgtcctcctgtgttaaaaaagaatcacttgtcagaaaagatgaaacgaatccagcttttttgcaaatacgtaggtcagcccgtgtccgttcctgcaggaacaagacaagactcaatgtggcgagagacacgttgccagctctcagcactaccgccctgggcacacggtccgtcagcagacacgcgatcacatcggatcatcattgaagtgaatctaactgatcgtagcttgagggtcatatggctgatgtttttcgacgacagcgggcccgcattcttgtgaagaatgataggcatctgggcgtgctgactggctggttgagtcgcagcatcctgacaccagatttcaccataaaggcgtgctgcaaacagcaggaagccgttctgtggtggtttcccaagacctacgaattttgaaactcgtcacaagctctaatgtatacgcccgttgtgcattagtagttcggccacaaaccctctgacctttcttgtatccctatccgctaattcgttcgaggactacatcgtggcgcaggtagccgttccaactatgggctctggataaagcattagtcatgttgtactcgtcgaaaacagccttagaggtacgtcaagtgttgtccggagggagcggaagctcacacgtggtacacgtacctctttggccaccgtcaagtgaatctgatcactataggcagaggtatgacgcatcttttcgtcgtatgtagacacggaggcagcgtatctcccagtgtcaggctccgcttgagctgctggcaacgcgtgcggtaatctctagaggtggatagtcaatgttcgttctctgcaggcgtaacgtcttcaggcgagccacccaactttctgtttgatagaattcttagaatggtaatgacgatgggcaaaaacaccgtatcaatttccaggtcgcctgctattttggcgcgtcgatcacaaggagtctcgttgttagtagacatgaaccacccttcgcgaaatgagcaaccatggggtttccagatggtgcgacaaccgtgagacaacaccaggaagcctcttccctgcattcttcagtttgtctcggttgtcatcacgcgtgtgtgttcgccgcaagcagggaactggcattgggatcggacgctatcaatagctaaacaaccaggtaaagtaaagcctttgtacgtttttctatgacacgtgtactttgtattgcagtgcttgtgatacagggttcaaggcgaatctggtgtgagcttggggcggttgaagtagacgatgggaagagcagcaatattttcagtcattcatttgtgtttgtcagtgccttattttcggttggacgtattatatgaaaacctcgagaagacgatttgcagggtatcaaagccaatgttagacgcgtattctactcggaacacgcactcctacggggggaggaagtggtcaaacacacttgtggacacagacacaaaagcagtaggtcgcctgacatatcgatgaccaatattaagtttgtggttacccgctttataagcaaacatgtgagacactccccacctccctaatccaatgatggaaactaacgcccttgcggggggcaactgtttgccaaacacactatataaaagtaactctttctgtgcatggaatacctcatttccgacggtgtcgtcaacacaacaacagttgtcttttaatgagctctagcaatgcactgggaaccagagtaatgggcagaggacaactagaccctctctttctgtcgccggaagtgtgcctgcaattgttgttgtcgccacggcgcagtccttcagcacagatttcaagtggtttgccgacaacggatgctgccgtaagtgatgaaatagtcactgttgacatgacagtgacacgccaatatttgaaagagcagaacgagttacgatagaggactcggaacgaattacatcggctcccatgccgtactccactggccatccggtacggcgcttccggttgcctaatgcgtgtaggctgaaacagaggacaactcgtagcaagctgttcggtatcgatggaagatacctttcacttgaacgtctccgcgtgtgacacggttggagaccgctgaaaaaattagcgcatgcgtttctgtcgtattaggagtacgtacagtccgcaaacaatctgataaaatgaagtgaatgcccggcgccggagagtaattaagctgagttacctgacagacgaaacgcctatatgttgaagagataatctactgggaaagaaattcggttcttcactacttaccaaatataa

SEQ ID NO: 846 - DNA, 1501 bp, Toxoplasma gondii
tacggtgttaaatgacacactttgaagcaagcttgcgctaccaagatcctttcagtgacaatgattcgccatatggtacccctggaaagatacgtgcaatccatgggcacacatggagcactccgtgacggcatggaagttgtgcaacctctcgaagcagtcgtgtacgaaaagaaactgtgatcatacacattttcaattacacgctgtccttcctgtcgcatgccggattgactctttaagctcacgcaaggggctgaaccccccgccagaagatagtcaggttccatcaccgggaacaggcgcattctggcctagtcacagtccctaccaccgcgttaacacttgtactctcctctccgtttctagtaggactttttctgttcataccttttctgttctagaggatgacacatcagaaactgagaaagtagtcgcatcttttcgttacgagagtgccgcctacaagctggcaggttcgacgggtggcttcggtcacaagtcacgacactctacaccaccacgttggatttcatcgcttgatgaacttcatctctgccacgacttgtgtgagattctgttggcacaatcctgcacaaaaggtagtataaatatctccacagctttgtaacagtggccaagcatcctaggcattgtcgttcctctcgagttcatctatgcaatggagctagctcggacaataacaaaaatgtatgtacctcgaaaatggcgcacacagttgggcgtgcactcattcattgagcattcggtcgtgagaatacaaataccagactgaccatctacacttctggcagtattttcagcacttgacgttcagttgcatgtaccccggcgccgtggcagaaacagaaacgatttaccaacactccagctcacctgagtgaaacacgcactttacaaccaaacaattcgttgagaaaaacgactgagcaatattcgaggactcaaacgaatggcattccccggctgaagtctccgcaagactctaggaccgctgcacaccgagtggtgaccttgccactgcatgcgtttttgtcaccgatgttcgacatcgaccccgctgaaatcgatcgaaaggctctttcctgtttggtattatttgacagcttgtgcgacccttgttgtaatcgacggtacaaggtaggaagcataaattcttgtcaattgctcgagttacgatcttgtttctgaacagcactgctgggtggaggcagtgactgttcgaaagccgatcgttttcatgtctacgtgatgcgactaagtagccattgtactgaagaatgaaaaggaaatcgacagttctggggctagtatgtggatggatctaaatggactgcgtccttcggagggcgggtagtaagcatatttcccccgaggcgcgaatgccgacgtacacacgcgttcgctgccttttgaatgccatcactcttttcccgaagcagacgtgtgcagagtaatgtctaacttcgagtaacgatta

SEQ ID NO: 847 - DNA, 2249 bp, Toxoplasma gondii
taatcttgaatattcacccgctcttcgcgcaagactgggagtagtgctagctggttgcccccccacccgccgaatgccttcgtagacatcatggcccgcgacctcacagcaaggaggacgggttccactacgtttggagaagaacttttgagagcggcaagaggttacgctcaagacgatgtttctgcgacatatgtggcagagcgggacattcgtcgccgaagacggcgacgggttactgtcagacggcagcgaacatgttgctccaattctggaaatacttgttccacgttgtgtgatgctgcagtggaataagctttggcttattcgcacaggaagctggtctattctgctgcagcgacatgtcagcaaaggctgagctcgctggatcaacagctccatgagaacgaacaggttctcctcattagaatttgagaacagacgtgctcgctggagttactgaatccaaggttgttcgatcgcaaatgaggagatgcacgaaggtatcacaacaaaaagcgaggtcagcaccggcaacggaattccgactgtgaaaaccccccacaggttccagacggcagcgttgacttctcatacaacgtagtcgcacctttgaaaaactgggagaaaggaatcggagcaaagaatacaggctagtcctgtcggcaaatgctcacgatcgggaggcaaactgctccctgcggtcgtatttggagcagcgtcgttgaatcgtccttggtaagcgtcgatgctaccggcacagcaccactgacgaagtatcaagcgtccctcagtgattagctccgtcacaaattccactgttgagaggattcatacaggaagaactgttgaacagagttgctgtgcaaaaagtgagtagtcgtcgtacacaatggggaagacgaagaaagacaaaccacaccgaggggacagggattagaaggcatcgacactgcgactagtctgcacaactacacgacagtcagcccggtcaataaaaagatgaatcggcatctcatgagcataatcacacaagaaaactcatggttattaagtctcgaaggagcatatggcgactcacatgtcttgaagtcaggaagaccaactgagcctgcatgcacgggaaatgtggcatgctgacgacgtccgtgaatgactccgttggggttctcgtaggctttccgcttcttgtgtggacactgcaattgcgtataggcagttgttcaccacgggatcatttgtagctgaaccgttccatagtctacactgggaatttgtgtgatagatttttagaactccttgcctgctgcggcccactgtcaaatagctcgccctgttgaggagaacccacgccagcccgccacactgtgacgtcttgtgctggaatgtgtgtggtgtgatagaccttcactgtctcggaaagacctcgttgagagtgtgcgtgcggttacttgtcaccgcaaaaagatgtgcctcagtcaagtagtgagaatcactgcggctatgtctttcgaggcagttaggcttttatgttcccgtagccccgggatatcgtcgacgggttcgaaccaaggtcgcctcgatgagcgacctaccattctcacgtgtagatgtggcgacagtcgcaagtaaatcgcttacatttctggtaaagttcatcagtctttcctggcattcaggtcactatttgaggtgattgcttcccgggttgcatgcggccgtaattcggagggatccaggcttggcacaccggcaggggatgacggctgctggcgcagcagaagacggtgaccactgcggccgccggagcccccgtttgtgtttcgcttatgcaaagtcgccatttctggctaatgcgaaggccaaatcaatatattttcaggtgtatttccaacacaaacgaagacgtgattatagcacggtgtgtgcaacaagtgaagccgtattcacggttctgtgtcgctttgcgccacaagcttcggcaaatcttagtactcacgttccgccacacacagttccttgcgtcactgaaactgtggccgacctccaatgtgtctttgtgttcattccaaagtaactagacacatctctacctttttcctgagcagcttgggcatgtccatatctgtcggctttcctgaaatctgcagccagtgtgtgtgtgtgtggtccgcgaaactccgaggctggtgccatacaactctcgctccagtgccgccacaccgaggaatcctgtaggacacgtcgaa

SEQ ID NO: 848 - DNA, 2715 bp, Toxoplasma gondii
agcaaggaatataggatacgattccagcgtattctgcagaacatagaacataggtgaaagcaaaccagagattcagctgcacaaggcggggaaaatcaagtgtcaccgtgtttctaacctcgtatttgcgcttaccagatgggcccgctgatagcaattgaacacttcacactcctgatcggacaacctcagaagcatgacgtcagcatcgccggagaaccgtgtacggcctgttattcctgcaagaagttatcgcagcatcattagtcccgttttcaacagttgcgacatcgtataagcagagtatttacaacggcaacaaatgcagcattcttacctttgatggcgtagacgtcggggcactctatgccgaagcgccgccgagcccgtgtcacgttgatagtgaggtacgcttgtaaagctagagccaaaatcacgtcagctacaacccagccgtacactgcaaagcacaacatcgcgcaaaccagataaggtggagatcgcaggaccgtccagaaacgagaatttctattcgaaacctatataagaataatctgtaccgacgcacttgcggtacgcactgttcgatggcttactggctccgggtccggcattctcgctcgccaagcaatcaaatatgcgacgcgaacctggggaattcgggcatgcacggcaacagcagttttgctccccagtggctgcagcaccgaggcaatgttcttctctctcaatgcaacacactggttcatggtagtagtcctttgaatgtatgccctcacttcagtatcgttatcgagctacgtcacaaatttgcacgtagagtggggaggtatattcggagagtggtgcctcaaaacgtgggacatcatacttacccattctctcatcccactgtgaagaggcggtagtgtgtgcgcgccgtaaacagagccccacgaatccagctgagcatgaacacggtcctcacaaacggtacggtggagaggacgtcaagccacattcgtacgacgggagggttgcactggcgggtctcgctttcgtcttgcaacggtggtcaatttggcggaaacgtttacgctatttgtttgcatcaacgacacagccggcccgagctaataagctgttgtagacgggcgtaagctcggaactcctgttgtttctccggaagactgtggtacgtcactgtgctgtaggctgccggcgatccgatttcccacttattgtcacctcaccggcgcttgtcgcggttgaggcctgaaaccgacaccagcaggcattcccgccagctgcttcgaaagagccgcctttgattatgaagtcgcaactcacgccagcacgatcagcgcgtggcttgctaatgtctcaaacaggcctactatggcgcctgcaatcagagataccttatccaagaaccagcaagacattttctcctgaatcactaaccctcgtttcggctgatgaggagaagcgatgcaagtgttcctgcaagcgacagccgtattcccaagtcgcccgcgcaaagttgagctttatgcgtggcatgaaaaattaggctgtcggtggcggtaaccactcgcaggacacggaagctacttccggatttttcttgcggcagtgcttggtggacacagaagaaaatgtttctttatgcaagacaactgcagagaagagatcatgaagaatgccttttagtgagacagcagtgcttcttgcctgcatgggttgcctgtcccaccgacagtggacgacgccgtggtatcgattctcacagaacctacggcagctggctggcttttcaatgaccacgtgcaagcctagccgtgccgcacacgagaaactgactccacctgcgaggaaacctttgctggcaactacttaccgtttcctttgcatttttgtgcaagcaactgtgcagaaacgggttttgttctgttgaagtggccgagtcactggacgggggcgatgtttggttgacgtcgactgttcgggtgttagccaaccgcgttggcgagggatcgcgactccgtcgttgttgattccaacgaaaagactgaatccgggatttatcaagaaggcaccgccgtgaaccgttgcactgtgccgtccaataaggtgtgaatgcagttttttatggaaacatgcgcatcatctgtgtggcgcgcctatatcgccgaggggcggtgccgtgcgcacgcagacatccttttgtttgatgatgctcgacgttgtgttagagaaccaggtcgtcacggcgactgatgcccgctaagctcccatattgtcctttccgacttatctgtaatccatagttagttcaggctccgcgacactgcaacgggggctgcctatcgtcttcggaatgcatcagcgtgtcccatcgtcccctaatgtccggcggaagcttcaatcagggaattcccaaccttttcaatctgaatcttgtcaacagagggaagcaaaccgttcatatcatttcgctggcattttcctcaccggctgtttcgtcaggtcactccatcgaccacactatgcaagagaagtagtaccgagcggaagcacagcgcgtttatgaattgtgcagtaactgttttgtaaagtgtttttccatcgaacgtgtagtccgcgaccgaaactagcacgtgcatatgctgttgacggcagtggacgcccgacgttgcactccttagtctgcgcatcaagccttcgacagcccaa

SEQ ID NO: 849 - DNA, 2806 bp, Toxoplasma gondii
aaagaccttccgtgcaagctccggatagtgggcgtctttcggcgagactcgcgggaaaaagggcaagcaaacgggctgcttgcagagctccacgaggacctcgtgcatccaacagacccagggcgaggggacccacgactgctctttcaagctcccgcgcttggacgcctcctgcgagacaggcgaagagtgagacgcagagtgagaggaactgtctgccggcgcactcgcagaagacgggcccacagaggcagcggtggcggagcgcgaagaacgctgaggacggcccgaagcactcaactcagtcggttcgagcttcagacccgcactctcgagaaggccagacagcgcgctaaatccgcgccgagacgacgtcccggcgcccttgcgagaccgcttcccgcctccctggccacgcgcagcttcggcagcaatcggctggagacgccactgcggccgagaggcttttccaccgtcgatttcagaagctttcttcgcccactctgcgatgaactgctcctcgatcgcccgcgcctccgcctcagtgagaaacagctcgcctcgcgtgcagtcgaacccatggacagcgccatccagacggacggcagtggatgaccgagcagctaacgcaggcagcgaggaacgaggaagggcaggcgccacggacgagtcaggcgctgtttgagaatccccagtgcaactcgcagccgaggaagtagcttccggagaaaaagtgccggcaaccgccggcgcggaaaaagaactgggtacagttgaagcgtcctccgggctcgcaagcgccgttgacccctctgtatgtacactggaaccagccgcgggggcgctcgccgacgaagtagcttctgcccctgacgacggggccgactcagtcggcaaagggattggttgctccattctatcggaacgacaagcgtgcagctcacaacatcaactagttgtgtgtagagacgtaaatctgcatacggtggagaaaaggtggaaaccctctgagtatcggtcgtgagaacgcctccacccctggtgaaatcacatgcagcggggtctcaagcgcaaaaagaacgacagaagcaacgatgaagtcaccggcgcctctcttgcggagggccttatcttgactaacaaatgcgtactgtcctaggtaaatagagagtccatcccttatttgcctccgttttgcctcgcgaagccactttgtttgccgacggttgagctgcagagaagagacgaggcagctgttttgagaaacaacgctcgaaacacacaaatgcagtctcggaaaactctgaaatgcgagctacggtacgaggctccgaatgtgatgaagccagaagcttgattctgaaactcgcatgagagctatgtcatggaaaataggtagccggcgtgtcacttcttcggttgtcgtcgagatacttcatatcctacgccgcatcacgccctctttcccctgcaaacaaagtatgacaaattttggaagggattgtccgcactttcccccgacgaacattcgcgccctgaattacgcgctgtcctgctccagtttccgccgggaagtgaggtgtatggttcagaaaaacagagcgtccatccacagaaaggaaccgtcccttcatcacgtacgcagtgaaaagagcacttcatccgccaaaagggccaccacttttcttgttgggtctcgcgaaaaagtttacgattgcgaattcagaagatcgaatctctgccttctgagtatgatgtgcatgcgaagaatccccactctgctggtcctcggcagcctacgctgggcaacggaacgcgcactctacctctgactccctccgtgctgtagcttgcggctaacaggaaggtggccagtttgaaaaaagaatggaaatgccagaaggaaccccagtgtgaagtaagcggttttaaaccagttggggatgcagaatattgacgcaaaggggaaaatggtccatatctttcagtacacgtagaccggtagtgcaactcgaggaaaagagtgttataactccagagttaatgacgaatgtcacgcctaatggacatggctacatacatacacatttcctctctttttttagtattcaaacatgtgtgtacagcctacttctataaatgtttacctaagcaacacatctgtccacttacgcgactacaatacaacattgcagactcgatattgggtttagatggtccagcacacctcgtgcagggattttaaaagtaacagaagatatgttttccccaaagagacaagcgaatacttctttctcttggcttgtaatgcatcccgtacgaatgggtatcaggccgggaaggatacttgcggcctttggtgggcagatgacatcgactaccgtgcctcgcgagttcatcaacccacgttgcagagcgtgtcaagacaaagcgaggcactgttcgtgagagagaaagcagcacttacgattgtattgtaaaggagtgtttccagtgtataaccaaagaaaagagcatcacgagttcctgcagaaaggagcgggtcaccgctatgctcaacctcacccgaacttcccaggtagcagggtgccagccaggggctgtcgcgtctcacgcgcgtttatcgtcacgagacgaatacgcgaaatgttggctgcaggcacatctgctctcggcatcgcgctgtatactctgtctccgacatataaatgtctagaaccgtttttttgaccctttggcgtccgtgtttgtatcccttcgcagttggttttccagagctggtgtccccggtgttccttttgactca

SEQ ID NO: 850 - DNA, 2077 bp, Toxoplasma gondii
ggaccttgaacatttcgtcctcagtcatggcctttaccttgggcagaggcacttgccatttgcccgccttctctttgcgtttttgcttgaccatgttgctgaggactttggtgcgtttgaccgcctcacgatcgaggagatacgcggggacggcgccgtctggggcctgctccggctccgcgctctttgcgtctttctcctcaaagtgcttcaaagtcttcttcatcgtcgccttctccacgtagcgtttcttgttgaacagtttggacttgatgccgcggaggcgacgcgcctgcttggacagcttgtgcggctcgcgcgccgccttcttgcgtctggaaagcagaaaaatcggaaggtggacacagaggaaaaaactctaacgcacaagaggcgagcaacaagaacaacgaaggcaaagaacagagcacgaggagagagaaggcggagaaaaaacaagtgaaggcgcggagggaagaggatggtcggcaggataaagaaggagagcaaatgggtcaagcaacgcctggagcgacaccaaaaggaaaaaacagacaccgaggcagaacatacaaagagaaaaaagtgagagagcaacgcggaagggaagaagaaacagcctgcaggtcggaaaaaagacagaagaagatagagagccgcatacgacagagaaaagaaagaaaggacaagaagaaaagaggacgaagccgaagaagacgagaagaagaagatagaggagaagaagaagttataggaggggaagaagttgcctgaagaggagttgaccgagaagaagcgtttacggagaagaaagaggacaaggaggagaagacggagaggaaaaagagtcagaaggagagcaagcctgcctactgcctctcatggtgatcgagacgtcgtccaaagcgcttttggtgaagctcaatgtactcgttctgcggcatgctggcaaagaggtaaatttcagagatccggagagagcgcggagaagcgtcggcggacggattcagaagaaggacgagagacagcgccctgcagctctcgcagtcggccggagagatcggcaagtcgcctttcctgcagagcgtcggttttggcctttctttgaggaaagattctctaaaaactttgggaagtcgagactcaaatcgacatgttcaagactttgcatgcccagctgggcaccatcccacagagcgcaaaacggcgatttttcgcgggtgagagataagcagaaaacctggatttcctggctcgagttggactcctctagcgacaaagatcgaaggttgagcaaggtgtcgactctcttgaaatttcagaaaacgccgaagagccgcgaaactccgccttctcgcgtccgctcgtctcccccctgcgcccgggggttccagtgtacgtacagctgcgccgcgaaaaagaagtctcttttctcaggtctggaccgcggtgctcgcacagcggcgccttcgctttttccgggtgtgcatctgctaaggcgccgcggcgaacgaaggtttccagaaaaagaggaaaagccgagagagtataagaatgaagagaactgtcgcgcctttgccggagaggtgatggaggttctggcgatctgaaggaggcctcagtctctcgccttttcgttccgctcctgcggctgctctcgcacttgcgtccggagaggtccctcccccctttgcgtgtcttctccctgaggagggcgatacgttcccccgcttcgatttacagagaattggcatggatgcgcgtatcttgtgatctctagttgcaggcaactgtcttcgctttctctccgcccactgcctcgcgtcgtcgttccccgcttgtgcatgacctcctcgtttcgcagagctccgtcgatgcgcgccgggagctcctcgccagcctagtcggtctctgcgcgcctgttgaactccaggttctcaagcgaatccagttgaaagaaccgcactgagagtcctccagccttctccttgttcgccttctccttgttcaccttctctttcctcgtcgtctttcttgtcttgcgcgcggcaagaaagactcgttgagctgtccgcaa

SEQ ID NO: 851 - DNA, 4990 bp, Toxoplasma gondii
ataaaggacggttctttacgtgaatgtggaacagaaaagaaaaacgccgtgcacagactcggtctaaaggcagtttccctttgatggcgctgtttactcgccagcgcaaccggtcactccggtacgtacacagcacccatcatagcctccagccacttttgttcgtaacctgttcagattttccgcgttgcagtctctcttggtcacatctcatcaaaacccgtggctttctctccccttctttcgggcaaccacatatgcgcgcgtcgctcgccatctcttagcgcaccgtctgctcgactagacttggcatgttcctcccttcgaggcacaacggctgaaaatccgcgtgctgctcacctgagaaacagcgaactgtccacggagcttctggcccccgagggagtttccagagccatcgagcgttcctccgagaacaccttcgagtttcgggcgcctcgcctcctgatttccgaatccagctcgaatggtcctcgagtccatcgttctattttgggagccattcccggaaattccgccaacgggaagagggccgggagtgtttggaccgacggggagggagttttcggcgcgaaaatgcgagttcgcctcccgtctcccttcgctgtccaaccgcgggttgccgtactgcgtggcagtgacagaaactgggtttgattcgcctttacctgaagacccggagagggccggagctgcaggtgaaagagcgccgacagaagccgaggtagcggggagaagacttggtcgagctggcggaggtgggacgcctggcgtcgacgtgtcgttgtagaagtcgtccatgctgtcagtcggatccagcattgtgcgtgcagggaaaggggcaaagtgcttgaaaacctcgcaagtcaaggctatgagggtgaaggaaatgttcaggaagtgtagtaagaggtcttcagacaaagaacgggaaatgcacgttgagaaaaacgcgtcggaaacgcaagacagaacagccggaactggcgggagcgaaaacctccaggttcatgcagtggaggtagcggaacggcggctccagagaaaacgcatctacggggggaaaactcagaaaagaggtggatgtcttgcgaaggaaacgcgaaaacaacgggtggaaaaagccgaaaaaccgtgtctttcggggattcaaacttctcgcaggaaaccgcgacacggaaccgcataaaaggcacaccgggggatgtggcgcttgtctgccccgaggagggctgctaaaaagtctaacgaaaaggaaaacgcatgggagaagatggcgaaacaagacaacggagctctgcactcgacgctagcttgagcagagttttcacgcgttctttttgttgagaaaagtgggtgactcgcgggggtttcggggttcgctcgctagtccaagtttccttcttgctcaaaagacaaaggcgtccaccataatgcgttttcaccatgtttctttaacaaaagatcgccaagttttcattggtgggtaggtgacaggaactcaagaaacgtttccgtgctgcaagtgtggcggtcacactttctcgctagaacgaagagcgtggctaaccgcgggagaaccggagtcgacaggcgccctcaccgacgtccgtgcgccttccttttctagacgaaagtgctaagtgtttaccagagttctcaggttgtctgcgtggcagagatgcaacagcagcgtgattgacgatcgcagcaaatgtacaagtggaatcatatcgcacgaagacgattagttacttgcatctgctccgcccgctgcgtcctgacgaccagacaaagagagttcactaatggtactagcacagtagagatcgccttagttctcgggaaactacttccaaaccaccaatagaagaaattggtactacgaagttactctatccgctgcacaaagccggcattacgaacatggcgaaaagcgtgacccttctcttagtcaatcaattcggggacaagcgtttcatgaacaagagcgcaaacgtcgctttgtcttctattcttttgctgtgttgcctttcaaaatctctctgaggggtttcaacccctccatcctctctttgttttcacgcttggcgcgatgacgtccgcactcgcactcctgttataaggtctatttaatgtttagcctgaaacttgcaggtttgatgctaatccacactcatccgagaaatacttgtttgttgaaggttctgtatgatttctcgtcacactatgtagatcacatggcatctgaggttgagatcgtaggttgcgggggaagggaagtgctataaacttccgtaagttgtgtgataccacccttcaatggtactgatcctacttagtgacggcgagcgcagtggcaggccatggacgccagaatatacctacatatatacatatatatgtacatatatgtatatacatatgattacatttacatacaattctacatgattttctctctaccgtagcaaaaagatctatggactcgcaagcttatccggttccagtacaatgccagacatgtatcagtaaagaaaagtcctgctgctttttgttttagttatttcttgacttggaaaaagctgaactatcgcatcgaagcgaggtacatcgtggacacctcgcctgccggtgcggctgatgactcgagtaggtacataccgtacaaggaacgattctctgcttcccagcacgtatttgttagtcctcgtaattagagtttcgcgctaaggtcccgttccttttagacaatacagctttcgtttgctcagcctctttggtagagtcatttccttgtttacacggaatactcactctgcctcctttaacgacagtgcttgtggtgtgttcagccagcgtgcatttgaaaatcacatctagatttcgaggttcaaaggcacttgcttgcctgtttaggcgtgagacaaagaaggcatcacgtaccaacgcttttagctgagcgatcaaagggcgactaaagcccagcgtaaacattgcgaaaaaggacggctttacgtttttcatcaaaacaagcagtgaagttgaaccgtctgaacaggacagagtcaaacggttctaccgtgttgtctaactctgtttactgagccggcacttccacatgcttgccacagatccgagcagcgcagatcattttcacgaggagagcggccgtgcaacagcatgcgagcgaccaaacaactgcggaaacttgcgcgtggaaacgtatggcctcttttacgaaggtaggatggctctctcagattttgacctggacgcctcggatgtggccaaaacacgagttcgaggggctggaaccctagtcagcgcacaaagagtcatagaattctgcgttgacatgcaaatctgatagaagcagatctgattcacccgttaagataggtagagtacatactagcgcaaaagctgtaaaggttaccccgttccaccaggggggctcgtccagcgtctacttgaggctcgtggcgccagatccagacaaagccgctttcgagaacagagaaaagcgtttcaccgtccacggtaaagcgttgtggcgcttggtgacgtttgcactcccgatagtccgcgaggactgctgaaaaatatcgtattcacaaacaggttcatgccaggctaccaagccgcacacggtagactggcgtggcagcggggcgggtggcaatggcgtcgtcgtggtcactagaagacaaggtgtgtttcgagctcgagtgtcgccaccggaaacccctcccactcgaatcgttccagaacaaatgcacaagtcgcactgtttcagcctcacatcttcagccacttttctttctcgtgacgacgtcgaaacctagcgagaggaggcatcgaccctgtctttcgcgagtcggcgcaggtgcaagacaacgctccccggtctccgccgttgcccgttgaggcgtttggtgcacgttcttgcagcaaataaagagagtaaggagtcgagattcctcagcttcaccggacaatctcgtttttgagcctttgccacgccgaagaacaaagaacgtcgcacttttcagcggacaaatcgtacgggagcccgaaggagctcagcgcttcgttacttagtagctcgcgggcggaagcactctctcgcctttcctagcactctgtagtgtctctgagaagagaggcgttgttcacgacttgcgtcgttgcagggcgttcgagaaaagcgcaacaagctcgcaaaagtgacgaaggactgtcaaaaacgttgcatcttttcgacctgagcgagagagtgacacgcgggaggagtcggcctgcgtaggtgctaggatcttgtgcaggccagttgggggtcgaaccgacgtcgttgtgtaatcaagaatctctgttttctctcgcctttcatctctgtctcgaacccggttgtggtggcggcaaaaaggacaaaataacgggagtcgcagggcgttttcgctgctcccttggcctcgcgacacttcgctctctttgaaaacgagctttcctgcgtgtgcttacgctggggcgcaacttgccaacgccgaaaagacgtgctctcttttgtcccgctctccgtttttcgctgctttctcggtcggcacgcacaccttctctccgtttcagctcaccaggggaagaatttcgcgttgaacgcctcgtttccccgttcacacagaggcacttcccggcgcgaccccggcggtcgaaaccgccttctctaaattaattcgcggttcaaatgctgtaccccgccgcggtcttgactccctctgggtgagctggaagtgcgggagttccacatcgctcgacgctagagccactgcacatcgggagcgttgttctagacgtacaccgaaaaggactctcatcatacaacgcctgtgttcaccaaagaacacgcatagtcagatgtaagtgtgatcaatcccctcgtccttggagcaaccagaaggtcttccgagga

SEQ ID NO: 852 - DNA, 2367 bp, Toxoplasma gondii
tcgtcgagatggccgagtgtcatctcaagagctctctgccggtgtgtgcgactttccccatccttcagcagaagaaagagaggctgccttgcagctgtctcaagccatccctcctcgttccaggcggcctttataaaaggcccgtctctatcaggacggcagtccgccgtgcaagaatctagaggcgccgaagccggagaggggctggcgcccgtggcgatatgtgcgcgcgccattgcacgaactctttcgtccgcttaagacctacgagttacgcggtcggaagagtagaaacttcgcaaattgagggtccgagactccctttgcgcatgctgcggagacacgagttctccaacgaaaaagtggatcacctttgagttgtatgacgtcaccagaggcaactcagaagagaactgccttccagttgcctcaaggacgaccgaggaagctcagtgagacccgcgagcccgccggcatccacaaaagcagcggacgcctttccctgcttaaaaaagaactccggtagtccactcggcgtgggaagggggcagacctggaaaagcaggtatatctgctttgcatcaaaacagcttgcaaaatgaacgagaaaaaaaggggggaaacgaccaggtgacgtacaaaagggtgatcggacagggccaggaacgcacaccagcagatgagggtcaatgtcccggaactgtttctacgcgatggatggcacagaggttccaataaagcggcacacgaaaggaagacagggaaagagcgcgtatcgcctcgtggcgctggcacagatgatggttacatgcagacgaacatcacggggcagttgagttcaacagagagagacggcttggcggcccacgacgcaaaacgctgccgagcggaaaaggccttgcttctccaacagcaagtggaaataccgcagacagtggagattagattgtcttcttgtacctttccgtagtcgtggaattgtcgctaaattttgagtcccgccccacagagaatttttcgctgcccggcttttgctgtcgacggatggggcatgcagttttcgcttgattcgtcagtagggaagaagcatgcatgcccgtcacgcgcagtcgaactctgctgaggagaacgagaaactctccctggcgacgaaaagtgagacaggaaaaacatcgaagacaagcattaagacagaactgtgagggctgtctcgcaggttgattcaaaaccttgatggtttacccaaatgcctacggcaaacaccatattacgtgtcgttggccaggcgacccccagctaaagcgggggttcgcacctctactgtggagctgggaacagtcgggacggttgcacattaccggtaggacggctgagactgaggcagcagcgtagtagtcccgggctgtggcacgcgacgttcgcagcgactgcccggctagaagaggccagagaagaacacagctggcgacaggcggtgttgctgttttgcagagaaacggaaactgttgacctcgggccctgcgagagctgtacgcgtcgtaatgctgtgcgtgagggtagttcaggaaaaggcacggatcttagaccgaaatccgaagttagtgtacccagatattgtcggcagctggtgcggtggtgtacatacaccccaaaaagccagagcttttttgtgtgtgccgtcggatatcaggacatcgtggattcttcacattctctgaatccatgtgcagtttccgcctagtttcctcatgtgccttcagcagcttaccactttctttccgtgtactggtcgtctgcttttctgctgactgtgttatctgcggtcgtcttcctcggatctcctcttgtcttcacctcagcgtgtacgatgctcagggacccccgtctctatcacgccaggcagaagtgttaatctctggatctgaatgctcgtttcgaaggaggcattttcgaaatgtgctagttgacgtcctgtactgtttttagtatcgtggtgtgctgttgttttcaccagtagccgtcaggttcaagccgtatctgagtgacaatcgaggaggctgaagtcttaaaaccgggtcttccatttcgtctgacccatagaatccagaggtctccctctttgtttttcccccattcagttgtttcccccgtttttgggatgttgttgatatgcatagttcctctttacgcgtcgcttccgtctgtttctcgatattggcgttttgttgccgctgttacaccccgtccgtaagtagagtaatttggactcctcgtggaactcttccaacaagcaagcacccttccagcttgatatatcgtcaccagtattttcggtggcccttcactgactttcgccagacagaaaca

SEQ ID NO: 853 - DNA, 2795 bp, Toxoplasma gondii
catgcccttagcctttcattcagtcctactgtggtgttatcgttcaggcgaaggcctcgtaattaggaacacggcttcgaaaaaccacgatcttgattcactggaccgcgttagttattttggagacgatgtgtcatcacctgtttggcccagctggcgctgttggaggtcccatcgcttgagggcttcttcatactcttcgagttgttcgtagtacatgtctgatgcaacgtcacaaacaagaacatctcacacagtcaggacgaccccacagcacgctgacgaggaggcaccacatagctttgagagagtaatatgcacttgttgacttcagagggcagaaatgtttttatggtcgctcaggacatggtttcaaacgagctcgctcacctgtgacttgggcgagcacacagattcagtctcgagtcacgaactgcgtgcatgccctttatgagggttcagatggctgagtagacatcatgttcctgccctaaggataacttccagtgaaactgcaaaggaatagacataccgaaaatgcatcgtttgcagccagatccgcagctgcaacacaacagagagcagagaatgcccaatcagccttcccagaggctgttttctgaacaaaaccgaaagggggggtagaggtggaaatgatctaatatgggagcactcataccagccatgagacacgaagacatatctccctccgataaaaacaagtcactcaatacagtgacggttcacacgcgcgaaacgccctcctacttcaaaaactgcgttcttgaatagctggacggtatctcgaataaagccgtccacgacttcaccttggtttagtgtgtggaaggccatccgcaagcgtgcgattactgatgggtgcgcaccggatgaagccacttcatactctatttttgttttcttgtgctgaaagcgatttagcgttatttccactcgggcactggtttcttccacagcggacgccacctgcgcatgctaaaacgctggcccatcaggtagcaacgctggcgctacacttttggacattaccagagcagtagagttcatcgaatgctaatgattcacagtaatccttggcgtcataccagtcttccggttctggtttccatggcggcacaggctttttcagcagacgaatgcttccctgttgccgattcatttcggattcacgtgctggatcggaggtcttagtctttaccgcaggacctgcagatgtcatcgtttcttctccaggtgtacttgaaggaggcgtcgtgtgagaagaaacgcttgagaaattgccggcggcacaagacgcctcgcccggcagaccgagaggagtgacattcgcagtagcgttattcatgacccccctctttctggacttcagtccactcatatgtgcaaaacgcacattgcggcaaatagtaacaagcgacagaggaacattcggtctacaatgcgacacaaacatggaggttcgtcggcttttcccccaacgtgtcagaagatcaccactgccgatgccgggggacggtaaaaatgacagtccaggaaaaaggggcgacactctgtcaaaacgaaggagtcatgcacaaaagcacacgtgaagcgaacagctgtgatatgccgggaatattgagacccctttgtagcgctggggcagtcaccgaagcgttgatggtgagtcgtggtgacccggcagccggcacgatgtcttcgcgctttggacggagagtaccatcagccaacgactcacttgctgcagcgttgcagagagaaaaaacgaaatacatgtggtaatagtggcgccacacaacaaaacaatacaaatcaaaaagcctgtcgtgtacggttgggcttcactttattcacgaaatatgcgtgccgaaaccctagggcctggacaacggcaaaacagcagagcagctcattggcatgctcgaacagctcgcatttcgtgggaacgacggtagattctttctcccaaggaattaaacagataggcggtgtcgtttgccgttgtcacatgctgtttctccacagtctgatatataatgttcttccatgaccgggggatctttgccgattacctaacgcttttcccctagcttcctgccgtcgccttgtgacccgcctcttcgcatgcgagaaaaatcgaagccgacagggaacagcagacttgcaagcgagcttggccgacatacatgctggagttaaaagtaatagacctatttaaaaagcagttgactcaatatcatttagtgtttcttgcctccctgcacactaagtggctgttcgtttcttatacggcggacacagatgaggagatcactttttttttgcagctgtattgtggtggcatcggcgtggcgcgaagccgggtgcttgctattttgcctttgcctaacacatgctttttgccaccggatccgttgtcttacaactgccacccataatgaacaaacacgttgcccgtaccatagcgtcaggggtgcaaatgaacgagacgacctccactacaacgcaagaattgggtggtcgccagcatgtaccttgcgagtttctttcaccttcatgttctcctgtgagggtaatcaaagtcatttcttcattttcttcccccctcgcgctctccttggaatactggtgaggctgtcgggcggattgagagcgtaactggcttcgttggagtcagacagtgtagcgactgcatcaaccagcagctcgtgagccacgtgtatcttttgccagcggagggttcgtgccaatccagacctggacagtaaacaaca

SEQ ID NO: 854 - DNA, 1232 bp, Toxoplasma gondii
caggagaagcagagacgatcaaaaatgaagagaagatacgagaagtgagataagagaaaaaaggtaggggaagacaaggcgataggaggaagaagagaaaagagaaaagaaagcaagaaaagacaataagtcggattgtttacctgacagaattgataaaatttgcctctgagcaaggcagaggagcggccggagctgctggcgcttcctccgggacctctctgtttctctcgctgctgaaggagactgaaaatctcgtctttcaaagcctccactctgctgatgtctcttccccacaagtccatcttaaggagaagaaagccacaaaaaaagaaaaagagaaagacgcaggacggaaagaaacagcctggaagaggcagagaagaagagaagagaaagagaggagaaggaggaggcgaaaaggcgaagagaaagagaagaaaatgagagtcgaggaggaagacgcaaatcggcagtcaaaggcaaagcagagaagagacagaagcgaggaagacgaacagatgagaagacagggagaggggagagagatgcgtaaaggttggaaacggaaggcaggggaggacgcggagaaaagaattggagaagaagaacggaaacggttgtgcaggtgagcggacggagaaaacggagtgaagatcgaaacacagaatgcgctacgaaacgatgttttccggtaaggaaagaagaggacgaaaaccgagaagaagcaggacgcagaaaggagcgcgaggagtcgcggagccgagcgacaagcctccgaacttgaagtgaaacgcagaaagacaaggtaggtcttcccctccgagtttccagcggagaaagcgcaacaagacaaagtcaccgccctccccttttccccccggcgaacggcggtggtagggcaagaagtcgagaccgcggcggcgcttcaggttgaagtaaaacaactaccgcgggaccggcgacttggcttttggacttgcttgtgtttcgttttatcgtttttcgcgtcggaagttcacactgtgttttttccggactcgcgccgcccaccgcatgcgaccgagaagacaaagcaaaagacgacagagatctctcggggagtgagcgcagcagcgaggagacacacagagtcgccgtggaaacgttttctctcatcccaagggtgcttcgcgatgatggctggtctttttccagtctcgtctcctgcgaattgagagacgcagtttgaa

SEQ ID NO: 855 - DNA, 1839 bp, Toxoplasma gondii
aagcctctgtagggaaggaaattcggcggaacagggacgagcatggcgtctgcggcgagaacgtttccttcctgtttctcttgccccggcctgcctgcgctttcctcttctgccctgcgctgtagcgcttcgcggtcggagccggagagaaggtctccgtggacgacgttgatttctccgaatccagggagctcgatttgctgcaagaggcccccgtactgcggtccttcggccgaaagaaggagaggcgcagcgtccgccgcctcgtcgcctcgagagagaccgagttctcgctctagcgcccgcgcagcctctccggccgtcgccgtgtcaggctggtgtgaaagcggaaagaagaagtcccgcttgatccattcctctgcagaccgcactagcacactcggctcgggtgtctgtgcagctgcctgctcggcgaaggccgcggctttcgcggctgcggcggacgcaggcgagcttggagaaggcgacggaggcagcgggaacggcgagggcgtcggcggccgctcgagctggcgcagatactcgatgtgacctcgagaggcgcgctcctggtgcaggcgcagcttccgcgagaggtgagaggaggagaagttgcgcgagcccagcggactggcgagagcagaggccgcagaggaggcgagagagaagggtgaggacagggaactcgagcagacgaaacttgaagagaggacagcggaaggggagactggaccgtttgttcgagagaaggtcgaggggcgggcagggacaaaaacgaaagagcgcgagtgaggaacagagaaagacgcttctgagaacggagacatggaagaagacgagaagcgcgagacggagcccgagagaggtccagaggagagagacacgggggcgacagctgaaggaggagacgcgacgggagaggagaccgaggaaagcgagaaggaagcaagtagggaagaagagcaacaacgagggcgcgcgttgcgacgtttggactggcgagagatgagcgggaggtgaggcgagtggagcagagactctgcagccaccctcctggcccttctgcctagcggtgcggttcccgagttgagcattctgtcaagggtgccgattcactgaaaaatcatctctgcgcgttcactgcgaaaaagaaacgtgagctcctctggaaactgacagagagagcggtccagatgaaaaggcgagcgcctgcctcgaaagtgtgagacagacagaaaagcaggtgaaggggaggcaaggagaagcggaagaaagaaggaaacttgaacttgtgcgaaaggacttgcaaaaagagacaaagggtgacacactgcgtcggacgctgtctcgtttgacagcccccttcgacatgtttccgctcaaagcgttttcgaggacggaaaacaagaaggtggagagaacctttcaacgcgatgaatgcgaaatggaggcgcggcaaagagagtctggtcacgcggcgagagtcgctccgcgcaaaatatcacatctctccacagaacatgcgcgattttcatgcgatcaagcccgccagcgcgaggcaggagggcacaaagactcgcgggtgttgtgtgcgtccaccgcgaaaatgtatgtggaaacgatccctctcgacaactttcgacgttcctgaagtttccggcggctgcgtttctgcagtttgtcttccagtgtgccagctgtgtcgttgtcaagctctctgctttttcctcgcggccgctcgtgccgcaaaagcgagcggaaacacttgtcttttcccgcgcgtgcatctggcgcctaccctctctccgtccataagccgacgccctccctctctgccaa

SEQ ID NO: 856 - DNA, 3562 bp, Toxoplasma gondii
catgatctcttgttccggagtggtatctgatgaaaagacacagcggtacacctgccgcttttctgtagtcctgtgtctgatgatacagtccggcagcgcatgcgttctaataccccacgagttccagcgagagatgcagctactgtggcacgctgctgacactcactgatcctttcaagcctctcaggtaccctctactttgtgacactgtccattcggggaatggcggcaaccatgcgactgcagaactcctgggcttcctggatgtatggggagacacatgcgcacacgggagctgcgcacatcttcttgacgaacgaaaagccaaaggcaatccagacaacacagaaaacgaggaagcacatggagaaaaacgacgagacgtacccgacagcccacgttagtacgcagcacttggccgtgtacatggcatccttccacaacaacacatctcgcactgactccaggacgcagttaacgttctcgtagcagcggccaaccattccgctgagtgtacttcgactcacgatttcaacggggccttcgccaaacgagggcgcaaggtcgaggacgcgaaacaggaatcccgcagcaaacggcaccatcaggaagtagcaactaacggagagaagtgatttacccagaacaaatacaaagaagtaaagcaaattgattcccagaaagagcgatcccgccgtggttgggttttcccacgacagtaatcgagccactgcacactcgtattcccttgtaggggaactcgaaccagcgctaattttcgacatggtgtgtggtggaagacggaaggcggcaatgcgaaacgggggaatcccagaatcgaaagtgcttgaaacgtgcttgcacaataaaggaccgcgttgaaagactgacgcctgcgactgaagtcccgttcgtccctcgagcgcagcgttcaaaaaaacgctgtccaatgaagacacgtaaactacccctacctagaaaactctcacaaacacggtttgcatatccctttatacagtaaacgcgaagagaatagacgggcgcacagaggatggaagtgttgcttgcaagcagtctggtcggagaactcgcaagtgctacgccaaaagtgagcaacctcccaaaaaagcgcttaccacagtcggaagcatgtgtgtgcggaagattccagagacacggaacggggaatcctcgacaggagcagcgctcttctaagacagagccaaagcactctgcacacgtaccacacaacaaaagtctttcggaccacttctcttcccgcagaagtgacctgctcactagcgctgaaagccggggaacaacaggtgagggagaacgattttgcacgataccgccacgctgaacctcttgctgctgttcgtctctttttcacgaccgaccacacacttcgattaacgctgaaagtgcctcgacgactgtgggtagcgccgccagcgatccacgcccgctttgctggcaccccgtaaagtctcatgcaggtcacttcctcacacacgtaccaggaaaatacgaaactgaaggttccattggttttgtgcgcaacattaaaaactgtgcaaccaaaaagatatggaggaaaacccacagaagcaatgtgtgctaacaccgtgtgtctctcgacgccctcggtccccttccacgtactagccctgaaatcgagctacaacgccactaggtcgtcgccttaaacttcagaaaagttcaagggtgccagaatgtattccttaacggtggactttccatgtaccagttcactgtgacatgccgtgcagaagcggttgaggcgtcgttgtgtaggtaggtgcgtagtgacgaatagttcaatagttcgcgccacgactgtatcgccttcccccggaccgatgaagtgagacgcgtgcgtaagacacattttgaggagcctgacagccgatggcttcgctcaaatctagcgattgtggggtagcatgaaatcggggatcttcatgagataccaaggattatctagtcttaccacagctgcgttcagcaaatgtccacaaagaaattcagcaatgtggaaccgccacgtcgtatttgccgccgctaacgtgttggtacatacagtctctttccacagccagcatcgacgatagaaactattgttacgtgaaatggtactccactaactgttggtggaaactcgcttcaggttccttataggcgacctcaggaagaaactccggcgattccggcaaacagccgctcgcatacagtgacggtgtatcgatgaagctagtcataatcgtctgcccagatactcgaagaagccagttttttcgttccagtgggcatggaaagtgttggccatcaagtgtccacttatgatctttgcctcgtaagagtaaatcgataatggaggacagtccaatggcatacagaggggggacgcagggtgcgcgacgcttttataactgcatggaatgtcggcggaagcgaacctacgaccgcaaaatcgacgtcagatactcttctggcacagtcaaaatactggaacgtttctgcgtggtgacggttttttaacggccgatggtgtcttcgaacccgagggcgaggcgcatctgtacccgtgtttagcgcccagtgtaaaaccccgaactcttctcagaataccgtacatgtccccccgcgctcgtttgaaacaaatgctccgggagacacacacactcccaacgatggtttaggacttcggtctaagctatggtgacagaaatcgtaagaaaaggactattgctcatctccgtaattggctgacggtgttgcgcatcaggcggaggaacggacacggcacatactacacgccgccgtcgtcgtgtgtttggcgtcccacccagagcaggtgcgtttagtgggtcgccagctgttcctgatagctactttcagttcacaagcagttcctgtttgcttacgttttctgtctaatccacgtcaactaatccggaggcaccgcacactacgatcggaggaacccagcgctgcggtgtgctgcggacggttactaacgctagtgaacctgcaatgtacccagtatggatatcacggtgcaatatccacagtgtttcactcgtgtttttgcgcattgttgcaattcacccgaggttatggaaatccttaccatttttcatttatccaggggtccgccgttcgggagtttcacaagggatcgggctaatcaagcgtgagtcaagcgcgcctgcgtcacacgatgccagttttcccagaattttcggcgccgcgtagttgccttcggaatttcatttgattctcaattaacatctgaaaacactgttccatgcttgaccgtttatttgtacccgggcatctgcctgtaccatctacaatcgaagtgtcaagtggtcgcactggccagtcatcttgtcgccacgaagaacccactggtctctagcctgttgcgtccagcttttcctcttgctcggtggtacattgcactgaaggtattggccgtcacatgtttgtgtgtggcgagcataggaaggatcaccttttagcatcggggcaagga

SEQ ID NO: 857 - DNA, 4428 bp, Toxoplasma gondii
ccttggctgctgatcctttcggcgctaagaagagtgctgagcatcctctcggacgggaggctcttgagttctgccagactcgtctgatcaagctcttcgctcatgaatgtcaaggagattacacgccagtgggatgaaggaagactagggtcggagccagaggagtggtctcgcttcagagcctcctcgacgtcgggaaggttgagagagctttgagcgaagagcgcgaggaaagggagagacgtatggttcaagcttgtggacgattcgtacgacagcaagtcgttcgaatagtgccaaatctgcatttcaatttcacgccgattcgcctcgccttgaaaggtgtgttcagagggggagtgaaagaagatgtgttgagcagtgtacatctccgtcgtgtctgtgctaaatagtgctccgagaggcgtcatttggtcctctggaacgcggacctgaaacaccttcgacgtcttgtacacttcgactttcgtgaactggtgagggtaggtgtagaagaaatccccgcgcttccaaggcttaagcgttcgagatggttgcgtcccggcgaacgcgttcatataaacatttgtcagattacggtactccggctcctgtagcccctcaatgtgtaaatcgactggcgactgctgcatgcctgtagcgcacatgccgccccaatccttgccatgttgcttgtagtcccattccgactctggcaacgcggagaagtgagggatggagccaaccgccgtactggagttttctcgctcctcagccacatcctgaagcaaggaatgggggcggccgctattctttccgggagttttctggaacgcagccctacgttgggcacggaccagcgtctcgtgagcaccgatggcactcagatattgcgcttgtgtcgggaggtcgtcacgagttgctgtcccttgcagagaccctcgatgaaaggctagcgttggattcgacgtgactgagacagccaggatgaccaaaaaagcgacatgcgaccgggagatccgcccactcgatccccggatcgccgcgaaaggacagtctgtcatcgctttccgacaaagttacggtttacgttagtttgtggagcgagagaaatcggacatcaagattcacaagtccgagagcgacagtggacaattgacacacactcctgaagcatcagaccggcgcgttgcgtccagtcccgtccccagtttcggcgacgaaattcgactgctagccactctgcctgcagccgatcttttgggaatcccgttgcgtcgcaagccggaggaaatgcagagagacagaggtcaagaaaagaaacgccggttcactgtttttgcgttgaaagacaacgcgtgagctccacgacgtctgttacgcgcgttggctaatttctagcgctcgctacgccttcgagacaaggcccctcatcatcgcagaggagaaaatcgtggcagcgagcaccaacatcagaaaccatcacacgggctttctccgaaatttaccgtgcacgctgccaagaagaggggagctgaaaaagacgcctaagaaaactcagcaagatcccgtgtgcctccgggattaaaagacaaagattcgcagctcattgcgcgagggcgtcttccttgcgtttggcgtcaaccgctggtggacaagacacgccctagcgtgacagcaaccacgtggccgcaaacgaccagatgactagaaagattccgaaagctcaaaaaactacacgttttcgccgtcctcggcgccaaaagtaactacaggctcttgaggagggttgccggcacgggacgccgttttcgcagataaacgagggaccaaatgagacactacctaccaagatagccacaaccatggcggctgccaccgcagagtggttccaataccaccgattaggacagccgaaatatcccgctagggaaccagttatgctgtcgatatatctgaatgaaacaccggtaagactgccaccgatatgggaccgactatgcatttcagacttgatggcgcccttgtagaacatgttttgccacctgaaacaccctaacagtgtcctttagctagtgccgcggctgctgtgtgaatgtctcgtggcgctgaaaatcagggtgcgtctccaccattcataaaaagcagacaccgtatacagccagcttgaaacggaagggactatcgcacaataaaaaaggtagaggatgcagctgccagtcaagcaggccgcaagagtatttgttgggtttacgctgcagctagctattttccgtcggtgaaaaaaaagcttcacaacacttcatcactctgaggacaagcgaagtggcacttctgtggactgcaaaactggttgcgggtgtcagcctgcatcgagacacaagatttcgctattaagtgatgaggacgcgaacacctgcgaactgcagatcgaactgtaccctaatgaccaactttggaggatgtagaatcgtgtgggtccgcttgctctacctgtcttacaatagcaggtcgcctcttgccgttcgaacatatcactattatggactgtggtacgtgagtcgttaccgaattggcaattgtcagttctggggaacaaagcaggccaagtgctgggaatgccatccatgtcaccgttgactgtggcggcccgtctccacaaagaccaagtgactaggcgtcctggcaacctttcactaaccatccagagatttatcagccttgagggagtgccaggataatgcctattccctatttgccttccctttccccacggctcacaactttctaagcacagccacagccaagtctttagcttaaactggattgtgttcccgctgttgccgatgtctcctgcttcatatttcaccatgtttcagatgtaggtcgggaaatctttcactgatatggaaatcgcagagcggtgatctgcagccgagttcccgtttactaaaactccatctgagtggatccgatggacaatgtaacagagtcaaaacttgtgagtcgaccctgcgttgcaatttttgggttagcatttgaaatcctattaatccacttgagtgcgctacacattgagcatccgtatatgccaaaggcggaaaacagccactcgatgccatgttgtgaagaagacaagttggtttgagcacctctgttcatttgttctatgggacaagatgcgctgcttcaggttgaggcaaaaacatgtgcagcaaacgagtattccttgatacaggtatacagaagtagaatccagctttatcacgccgagaaggcaatccaggccatgaatgaaccaaaatcaatgatgttcttgtcacacatttcgccgccgtgtacaacaggtatgcgctacagcaggtatccaccatttgccctgtcaacgctgatcgtgtgtagtaaaccgtcaatcgcctcaactcttagaaccatcaaatcagcacttgatgaggggtacggtgccccatctggaccaataatggataaagagttgataccttgaataactaccacaaagtctaccggcactacacaaaaacatagcgtgtggtctcggcgcgcaagaccaaatggtacaaaacgattctaacatcgtcattacagaagtaggtattaacaatatacaagccatagctgaccgtgtaacggaattttcacaatagaagcggttgctgtcttttagcaaacgactgtaaacgaaggacaccttcactttcactgactactcgacactccgcgggccattcattgactatttgccgtgggaaagtaaaagcgagtaccgcgatatcaaggatgtttgtgtcgtttcgtagattcacaatggcaaacgcccctgtaatatcccgaagcgcgacaggtacatgtaattcattcagtatagaggtgaatgcaacaaaaaggccaattttgccacatgcgcctgttctagggtaatcagttgaaaaaacacggcatactcgaaatgggctagtcttatctgactgccaccaaatcaagctaacaaccaaatttggaatcgctaaaacaatcgcgatcttgtttgcgcggtcctgtacgtggcagcaatggtgctgcaagactctcgatcagtactcagtgtatgagtcgcgaaccgacacagagctattcaaggtaagttttttttctaaatacacaggcgcgcagcttgctagacatgtttgggtcctcttttctcttttgacgcaaacttgacacgaagcagccctgtggtgtgcgcttgatcctgactgtgacgacacacagttgcatgccctgttccgcatgcgacgtagatgaacaagcaacaaatgaaataggatgccacgaccccattgtacaagattgcccatccacattaacaaatgccatatttttgtcagttgtaatctctcgcggacgttattctacaattgtcgagtgcca

SEQ ID NO: 858 - DNA, 1240 bp, Toxoplasma gondii
aaacattcgtcagtagacgtgcgtaactagattccataaataagcatgtaccatgggaaccaagcacagtattgtatatcagcatggaggacagggggaatacgatacggcacgcacgagagagagcgggcttctcggttctttgagcggtcgctcatagaatatcctggaagaaaggtactctcgttgatgcgtgtaatgaactagtgaacgtgaagacatttcactgaaatgacactgttcgtcgtttctttcgggggctgtctgtggccctttccgattcatgcactgactggcagtttgattcttgtagtaaacagctggggaagagtgggctcgagagcatatgcattcttccatgaggctctgccacagggcagatgtgcctgactcactgacacaggcgtctatccccgccagtgatacagcagtgctgctacagagagctgctcgcatatttcactagtagggtgagctcaactgaataaagagattgtccagggataagacgagtcaccgggcaaaccggtaccttcgtacaatccaacagattattcccaaaaattgagttactatcgttgccaccgttcgctcttctggacatgaaattgaattgaatctacgtcagtcactaactaaatctatgcttcctcaccaagaacggcatctttgtggcacgctggttgcaagcttcgaaactaatcctagggtgcagatccatgaagtcgatagaaagcctgtttcgcacacttcgatccctgtcgatcgatatcgttttcgtttgaatgatcactacacatcgttgaggacgagaagcggggagaataagagttaattgtggacgtttgaatctcagtggtaacagcaaatgtatgcctgtcaggcggaaaccggcaaactacgatggaacccctacggagggaagcaagtggtacggtgggagaggcgatcgcagctgctactcgcatttcacagccccgctatttgttctctcccattcctgagtctcccgttcctgacacgagcgaagtccttagcggcagaaggaatgacaagttgacagaggactgtccgaacagtcaaaaatgtttcttcccattctgtcgtctttatctgaaatacccccccctcccgggcggctgttcttctctactcaagttcgtggcgctgcacagtgcaaaagaaaactggcaacctcattcataataattccaggtcagtcctcctcttacaattccga

SEQ ID NO: 859 - DNA, 1871 bp, Toxoplasma gondii
caagacatctcggtacagaggaaagcaaggctgcagcttctgaagcatcgggaaatgtcgctcctcgcagactcgcgcccactgcggctttccactcgcctgccaattctccgcaaacgccgccgctcgcgactccgaaggccccggccgcagacgcgccgccgccgccttcgcagccgccagcgccagccgcggcctgcaaatcgcagacatctcgaaagagaaagggagaagaaaaggagacaggaaaaggaaagaagagagaggggggaagagggagaagaggaagacaagagagacagagacacgaaaagagaaagagctggagaagcagagggagacgaagaaagagaggaagaagaaagaagaagaagaagaagaagaagaagaagaagaagaagaagaagaagaagaagaagaagaagaagaagaagaagaagaagaagaagaagaagggtaatggcgaaaggcagcggcgaaggagatgaagcaagcctaagagagagaaaagtggaaaggcggaggaaggaaggagaaaacgaacgggcagaaaaaaagactttcgggaaggactgagagaaggcgaagcatgagtcaaaggagaatgaagggacaacagaaggaacgggaggaagaagaacgcgaactatagagggaaacggaaagggaaggagaacgagaacaagaagagcgacaaaacggaggaggagaacagggagatgataaaagaaagagaagagagaatgtaaaggcgtaaccagtagaacaaaggggaggaagaagagaagcaactaggcaggttgacaggtgcaaacgaggagaatctcccgcgaacaacagagacccgacgtacagccaaagacgaggagaaagatgaagaacataagtcgaggtgaacgacaccattcacgcatgcggtgaaacttcctcgtacgtgtgacgcgctgagagcagagagacaagaaaataaaggtttctccagtgttctgtctccgataacgagcagcacaaaaaaggagcgagaactcaagaaaccagtgcacaacaggcgttgttgatacgcatgtttcggtcttttttcgcgtttcctccgcgcagaatgccagtctcataagttgtgtctatgtcttccttttcctttctttttcttgtctttgaattacacggttcctcgcagttctgcatgcgcatgtgaatcgttcgcttgttgtcgcgaggaaatgaagcctcgcacagagacgaacgagcgattaaatgaggagcgcggagagatttctcttgcaaccagatcctctcactttcttcttctcttctttctctccgccctcccgctgttcgtgtagttgcttcttctcaactcgtctcggtctccccgcctcgctcggtcatcagcagaagaaaacggtgcaaaatcgggtgtttttcacgagagagctgcatccccaaagatacgcctccctctcaatttttttcaaacgcctcaattcttattcgccttcgtgtttcttcttcggcagcggagagtccattcctgtacctgctttccacctgcacaccgacatcacgctctgagttctcgtctcagctgacagaagctggccgctgtgcttcctctctgcttctgtcgaattctgctagcgatagacagtcctttcatgccatcgcaagccggacaatttcctggaggtgaaggacccgcgggtcgtctctctccgtcgagtttgtctcccgtcctcgagagacagagcgcgctccgtctgcggcgttcgctctctgtctctccctctcttttcgtctctcgctgtctccctgcctcttcttgcaccttctccgctccggcgcgaggcggcatctcccaggctgaagcacaa

SEQ ID NO: 860 - DNA, 2112 bp, Toxoplasma gondii
gagaagtccaagaagaggatgcagaagacgaggacagcgacgaagaatacggcggcgtaggagaacaaggagacgaaggaatcgagagagaagaaggaggccgcagcgcgggagatgccggtggcgaggagactctgatcagggatgcggtacgggctacatcgcagcagcagcagtggagacagcaggagcagcaggagacagcagaaacttgatgacggagaaagaagggaaatccaaagacctgcaggagaggaggctcgaaggcttgtcgaagatgcaaaagtttcttcagcaggagagaaagacgcagcccgccaacatcgaccggcggcaaaaaaggcgacttatgttctcctggggcttccggactgacacctgcgaggggcagagtgagagggagagaagagcaggaagcaggtgacagatcagacgagggagaagacgcagaaacgaggtcttgcggaggcgtaggggcttgactgcgcgaagagctgcaacactctggcgtttgagtcgcctccatttcggcacgaaaatcgcaggcaaagcaacgacctccatctgtctgtacactcggcctcccttggccgccctctcacacgagggctgcttgctgtcagcgcctcctgcgagtcctcatggatagaagaccttccgttcctcctttctcttctctctttcaatagactcgtgacagccgcggagagagacagacggtgggagacagacgctgagagactgaaagaggaagagtgacagttggagacgaagggataaaactctgcttccggcactcaacgactttcgcacgaaaccgggacggtcaagcccgcatcccaggaaattcgactggaagcagaagccttgcatgtgcttctcaaataaagaggaaggaagcctccaaagactgacgaacaaagacgactctcttctggacgagtcaagaaaggattaagcgctgcgctctgaggcagcgtagcgtggatagccacacagagtatgcgtacaataagaatcagagataccttcttgggctggagtgagtctagtgtgtcaatatatacctgcacaagtccagagagatagctgcacttgtaacagaaaacaaatgtgcgcagaaagacgaaggcccgattttgccgccgatttttctcgtactgttcgcttctacaggacccgccagacgttccgaacccgctgcgattcgcactattctttgactacgcctgtcaaaacgcatgcagacacgaaaaatagtggattcatttccagcgtgtgtttcttcgagggtcataagcgcgaaaacccagaagatttcctctcaaaagcggagctccgaggcgcgcggctgcatgcgtcgaaaaggatttccaagagaggccgttcgctgtctgagcgatgcgtttgtccacatctttgtgtcggtttcgcctttctctattctttaaggcttggtcttccgtgccgcttctcaatctcctttctctcgtctccaagttccctttcctctcaatagatgtgtgtctctggtgagtcttgtcctcgcgagtggcatgaccgggcgctaggactctttttcggcggatgccttcgcctgcttctctgttttcctcagatgccaaatgccaagccggcctttgtgggcttgcctttaccctttgccatccttttcgggggtgtctgtgcggaacctactgggagatcggttttcgcagttttctttgtgagtttccaagaacgcagtgcgcgccttgcgtcggccgcgcgcctcgagcgtcccttcttccgcttgactcccaagaaactcgtggaagaaaagataattcaaggtgtttctccgtccgtggagaccaacagaattttcttcacggagtcaccagacgtcgtcagttcacccagttccctttcctgcgttccaaacagcgcctgaggcggtcttcgtcacccggagagagcctctcagtcccgacgcctcgaaacgaacatctcctcgcatgcatttcacccctgtccgcctttctgtaatctattttctctgaaggggcgcctagggccgtctttgcaggttatgtggtcgaaaacgagtttcttactctgcgcagagatgca

SEQ ID NO: 861 - DNA, 2863 bp, Toxoplasma gondii
gaaacagagaaacttcgggagaagggtgaaaaaggtgagggaaaggggggatgcagagcagctcgtcgattttttttcaagaaacggggctgtcgctttcttgattgggtctgtggaagagacatgagtttcgcaagtgcagatgtagaggggagaaagtctgcaagtaagaaatgaagtttcaattcgccaaatgcccaccgagtttcctgtaggggtgcgtcgtgcaaatttttcttgttcacgacgacagaacgcgattgccgccaggtatttaacttttttaaagtcgaaacttgctctcgtaaccccgcagtcgaaagcggaacggctattttcgacaacgaaggtccttccgatttctgatatttaagcacctggaatccggactcggattccagctatgataaacagacacggatattttgacgaattctgcaatttagcatctaggacactgaataggacgccatttatgcgatgccaacaaccaaggtcttcatgactgctgtacaccattccccactgaagagtgcctagggcaaaccccccctggactctttctcggtgtagccacatggtccctagaagggcgtggagagccagaggagaaagttctgcttcatttcagagaggaggtcggtgtgtgcgacccgacgactcgcagtggcaggagaaagtggaaagtcgtgggcaaacgacacatggaaaagtttcctcgcgtctctctgagcgaggcatgccccaagcatcagcgttacgccacgtctggtgttcagtgaaactaggccggtgggaattcgttgagaggcttttccatcgcctttgaagtttttcgcggcttgtgggctctcccgctccgctctgtctctcttcgtgtttctacccactgtaggtttaggaaactggggagacgcccctgaaggaacgtcctgaaaccacactcggaaaggttcctcgcagtccagcgacttcactcgactttcagagcgaagtcgttttcctcaccgtcttccgcggtctgaaagactgcttcttcctccagtgtgtgtgtttttgtgggtgcgtgcgggttttctgtgttttatgcacagacgctacggggacgcagtttccttttgtgactttcagcgccggctccgcgctgtcaggtttttcggatttcttcaggcgacaccgtggcagcttgccacctcccgctctagtcttttcggcagttcctgtgcattcacgttccagcgagtgttcctttggcacgccggaaaccctcgttgtcgagaccgagcggcgtgggcccggctgccctttctgatttctcgcgaagcaaccgcgtgttcggcgtttctctccgagaagcaacctggtttcgtttccgttgaggaggcccttgttgtaaggcagccttgccttcctcggaacgcagaaagccgagagtcgagctgggtccacgcgacactgcctcaagtgttcccacgcgttcgtctcgatattttgtaggcgcggatttcgaggttctgtctggtttcgggttccgcgggtgttagaagacgacagtctcgtgcacagagcgagctgggagatccttctgcgtccgttcctgctgcaaaatcgagcgcgactctagatggcctggtgaatttctaaccgagttccaatcaacagaggcaaatgatacaaggttggcctgtgaggttcagtgcccaggaattcgcactgtggacgcttgcagagcggttggcagaccgaatgtcaacgtagtacgaatgtggctgtagcaaccttttgcttgaggatgcgagacccgaggatttgtgcgcttcctctgggattccccacgtgaactgcggaaatatacaccatcctgcttcagatctatatggacccagtgtgctttgtcctaggctagtttccgtctgtaggcggcaaaggttttttacgccgcgcatgcagtggtggaaaaatgcgagaggggggcgggctcgctttcaccacagccgcgaaaaatatgcggaaatgcaagccgaaatttgcacacgcaggcatctctttgtgttacgcccagcgagaaactgcagttttctcggacactcgaatctgggtgcccgcccatcgagatacctttgtcttaacgcggtgtctcgcggacccctctctcaattgcgactttgaatgcgtttcgcgagacgaaaaggagttctttgtggaacctcggtgcctttgcccttttccccggtcctttctctgcatgctgcgtttccttgtgcatatcctgcccactttgtgtacgcgcaagcgctgagttgaaagatcttgctccgcctcttttccgctttttttcccgaggtagaagttagcaagcagaaagagccgtacgtttcttgtctggtattttcggtcggctttctgttgctttctttgtggcgttttccctttcgtccccctctgttttccgcgttttctggcgcgtaacggcagcacgcgtttctcagcctcttcgaacggcacccgctcctttccagatatttctttccacacgttctctgtcggaaatctccatttttttatctctccggcgttcggccatctttggatttccgcgcagcttctcgaacggcggacacaggccgtcgcgctgctctgccgagcaccagaccgggggcacttcgggtgtatgtacacctcgcttctcctgtttcccctgtcagcgagtgagacgccgaaccccgacgatatgcccggagattaagcgctttcgtctcttcaagcattcactcctcttgaatcgtgtcttccgttgtctaccgagtttagtcactcttgctagttcccttgactttttcgctgcctcacagtgtcgcaaaaa

SEQ ID NO: 862 - DNA, 2370 bp, Toxoplasma gondii
gggagcaacccaatgaaaacaaaagcaggaacaagaagtcaaatgagaagtggaagatgcgccttaccgcaaccgctcgcgtggttgcacatgatgatggttcgacgggggtggtaattcctgggcgggcggttgaggaatttgactctccagaaaggcagacagaacatggctgtgaaaagcagacaccacagattccggcaacaaacacggaacgcagatgatgcgacctccgaccggcgtccacccaagaaaaacttgcttgaattcgaagaagaacgtccagtcgataaagtcttggatgccgaaaccttgtggaaagaccaggacgacagcggcaaatggcagacaggcactggaaggttgactggggaactcaagtcagacacagggaagaaaagcagttcacaactcgcgcagactgcagctgttccgcgctgtattcttgtaagatcagttgtcacacaaaattcggagcggcactgcggcggcgcgacggcgacgccttggcgcaaatgttccttagacgcgaccgattgctcttctcgtctttggtggtgattccccggcgcaactgtctcggtctgcgtcttcacaggggaaggctcttgccacaagcgaggatcgagcaacagcgaccgcgttcatacagacgcgtccggaggaagaccaagaaaagtcttcggccgagaacaaagagaatgcagagacagagaaggaaaaaagctgaaccttgaacagaggagactcacccatttccatgtacgcctggaatgtgaagctcaaaacgcggcggcggaggcctttgatcgtcaacatcaagggcaggagaacgacgagctcggccaattcagtgaggaaggccagcagaaagaaaacggagacgaccaggtagaagtaaatggtcatcaagactcgcagcggcgtggacgccatcttgccaccgtgagaggacaccggggcaaagcggaggctagtcaaacttgtcagaagcctcttttcggcttcccagagaaccggcagctctcggtgaactgaggcgagaggacagtctgtccaagaatgcaggaatttgcgtcaggggcggcaaaatccgacggaaaaaaccaagagacccgcgaagcgagtggtggcgcagcgaccgtcaaagggagcggtgactaaaccagacggagcgtcgaagcagcaaaggacgaacggtgcggaaggttttcttgccaaactctgcgtcacgagctggcaggaattgccaaccctcaaactggcgagacgggaagaacctctgcgagacgacgggtgacctcgtcgattccgcctcagaaaacgcgaaaccgatagtggtgaggacggagtgtaagaagaccgcttccagacaaacgactcaaaggcgaaaaagatttccaagaggcaactggacagacggggggaagcgacttaaaaacctaaaaaaactcgccggcaaaaaccgatccgctgcctgcgatggatataataggcggtttatccgaacgccgtcgctgccagaggagatttgagaggtctgcagaacagctagaggactttgcgaaggggcgcgtatgtgtacttgaggaaaaaggcaggtgtgtgtcacggttttaccgcaaaaggggagaattttccattcgaggcgccggatacaatcgcttggcatcgtcggctttgccggtgcaacctgcgcgcgagcggcgcagcgcagtttcagagcttgctcggacatgtttcctctcgctggcgcagctgcttcgtcctgagtgcatgcagcggtcttggaaacattccaagatcggcgctgtcttcactttggtttttcccaggaccgtggcttaccagaactgcgtttcgcagctccacgcctcgaagtacacaaggtctcaggtcgcaaaactctcgccggcccagcggactgtcctcgcttgtctcacccgccgcggtctcttcttgtggaggcttctgccggcgagttttcttgaaaaagccaagcgactgcggactctgcaagactccgcgcaagtcccggcgcccatctacctttctggacggctggctgcacaccgcaagactccgtgacggagcgacgtcgggcgtttcgcggtctgcgcttgtcggcaaaaccttcacgatccacgtctggggacagtggcgaaacggttgtttttccgtctgtctgaggcttgtactccccactcgcgaccttttgtcggaaactcgcttgcgactttcgcagctggaagctgtgtgtgtgaaccattccgtcgcgttttctgcgcaggcccctcgaacctggggaccccggcagactccgccgaaaaaccatcgcacggccgtccttgccctcctcgcccggcagaa

SEQ ID NO: 863 - DNA, 2219 bp, Toxoplasma gondii
tctctcctccatatttctcacagatctctctctatctgcatttcgatgtctacgaatggatgtcttgtctcgctctctctctccctgcatctcttctcgccccttcgcccaatctcctccctcgctgcctcggcttcgcggtgcacctggaactcgtggacgaagtcgccgcggcagatcggttccgccatcgtcaggaggagctcggtggcttgtctgttggcggcggagaaagtctcgaggagaattgtgccgtcgggacagacccagagagggcggtgtgcgtggtcgacttttagcgccagtttcgagccgaagtctctgaagcctccgactccgagactcaagctgtcagcggttagaggcagactgccgtacactccgccttgtgcagtctcgctcggccgcgcatcctttgtcttgcccgcgctcttctccgccatcccctcttctcgcactctcagagcaactgggggggcgactcggggaacctgagccgccggccaagtccgcgacgcgcgactctcccgatcggcctgcgaggcttcatagaggcaggtgtcaggatcccagtcttcgtcgtcaggttctgaacgccgaaacctcttcgcggcaggcggactcgacgcgcggaacggggagcgcgcctctgaagaaaaggtccccgaacaaggaaacgcgccaggctccatcgttccgtcgcaacgggagcagaaaccgttctctcaggcaagagtccctgcttccaacgcggatacttctctccaccgactcctcgtctccatctccgctttgttctctttttctcctccgtctccacctctctctggtcttttctctccttcttccctccttctcttctgctgctcttcttttctcctccccttcttctcttcgagttcttctgctctgccgtttttctctcctggcaaaagagaggctccgaagatagcagcgaggcacagagaacaagaagaagtcgcttctcagaagattcgtaagtgaaaaagatggacagttgctgttcgtcagcgacgaggcgcaagtttcggcggaaaagacacctagcacgcagaaagactctccggagaaacggaaagcgccaagacgctggagatcggaagctgcagaagaagaaagaggggaagcaacgacagacgacgcccgaagccgagacaggaagagacagaacagaagaagttgaagtgagggtgtgaaatgaggataggcgcgcgcgttctcgagattccagataatgtgcgaaaaaggagagagagaagcaaatcaaaaacttgggagaaagagacgagtgacggatacgaaaatacgaaagaagagaggaaagtcgacggtctccgaagatatcgttcttcgatcgtttcggcgcgggggaggagaagagaggacggcgaaaccaaagaatgagagtttttcttcgaaaaaagagcgaacgcgcgtttctctgtatcgccgattgtcttctttatcaaagtgaaggactctctctccctctctgctctcttcggagggaacgctctttttccagtgactcttttttcagttcgctgcatgcgacgctttttccaggtttgctcggcgctgctgcactggtcggcgcgcttttctcgccgtcgaagaaaaactttttcttctccctccccagaggaggggaccttctttgtctctctctcctctcgctcggttctcgtcgccctccccgcgttgctcgcaaccgtcgactccgtgcgctcgtccgcgtcgtgtcttctcagtgtgcaccctggcgaaccactggcaaaagagagcagagacagccgcgcaagcaagaagagagagaaagaatcgaaaagagcggaacgagagaagagagcaggagcgtcgaaggaagactcgcgaatgaagacgagaaaaaaagaccaagaggaagacaagacagagaagaggagcagattgagaggaagagaagaggaggttgagaggaagaaaagaggagaaggttgagaggaagaaaagaggagaagattgagaggaagaaaagaggagaagattgagaggaagaaaagaggagaagattgagaggaagaaacgaggagaagattgagaggaggagaagaggagaagattgagaggaagaaaagaggagaaggttgagaggaagaaaagaggagaagatagagaggaagaaaagagattggcacaagcttgcatctctgtgcaga

SEQ ID NO: 864 - DNA, 1591 bp, Toxoplasma gondii
gatttctgcgcgaacgacatgtccgtcgttgtagccgagaagaaacgcgaagtgtttcctgacgaggaaccgcgttttctcttctgtcgcctcgcctgtttcctcttgcgggtctctgcgctcctgccgggccttcaccccgaaggcttcgtggactgcgagctcgtcgacgtacatttccatgaagaagttctgttcgatcagttctcgccaggaagccatgcgctctctgttcaaggccatcacgcagagcttccgcggcgtctcctcagcgacgccgtaggcgatgtcgaaccgactcttcatcaggcggtcgccgcgcagaacctgccccagagtcatgggtgcgtactcgaccgtctcgggtgtgcagacgcctagcttgtcgtagaagttgtacgtctccagcggattgaacagaggccaagccttgctcacgcagacggagacggcggatccagcagcatgcgcagtggcgtcggagaggtacgaggaggagcgcgagagcagagacgaggtcgcgagcttgtagaagagaagaagaaaaaacaacagcgcgagcgcaggcagcacgcaagagccgggcgtctctcggcgctctttctcgcgcgcagacatccgtgaattccgcctgccttcaccgccgagggaagacaactcgatgccgtccttcatcgtggagaccgagaagaagacgcggtcgacgtccgagtcggcgacgaggagcacagcgagagacgaaaacagaccgagagacagcagacagagaagcagggacttgggcgcgtctgccacacacaggcacggggcgatacagcatacgcgacggtggagaaaaaggagaagacagacagcagagagcagagcgaagacggaggagagagaaggggggaggaagagaaagaaggaggagaagcgggagaagaagcggagaagaaggagaaaacgaacgaggagacaaagagagagagagaaagagaaagaagaaaagagagagagaaagggagaaagagcgagagaaagagcgagagagagagaaagaccgagaagacaaggagagagacaggtgtagaagaagaggagaggtcgagagatcgaagacgcaggaagaggtctgggaaggtgcagcaagacggattcgggatgaggtcactctctcattttctgaagtttcgccgtctattcccttgtctgtcttgtcttcttttggaggcaggaccggcggatgtgcagagagtcgtgagtgaccgcggcatgcacaacaaaagagaagctgcatgcagttttctgtcggtttctctgccgctccgcacaggcggatcgaagacttttcctctccactcttctcgcaccttgtctcaggcgcatctgacagtttcttgtgtcgaaaaaagacagaacgaccgcggggctcttcttctccgccgagactcgccttactagctacgcgcaacgcgtctgacagtgaacagggcgcttgacgccgcgtcacgagaaggtctcttggtccgtttctctctttttcttttcttctttttcttctcgttttctcatgttttcgtctcctcacaggccggtcctcaaaactgaa

SEQ ID NO: 865 - DNA, 1429 bp, Toxoplasma gondii
acaaagaggaaccaagagccacaggactcaggaagcttctgggagaggctgaagaagagacggagaccggtggttctacgtcgacatgccgacggggagacaccgacaagccaggcagtggcctaggcgaaagaaaccgatcttctctggggtcctacgccccctaagaagacatccaatgccggactcgactgtccaccggatttgtttgtttcattgctggatttttgctctgttttttctcaactttctccccttgtgtcgttgggtcgaagctctccggaaagcacaggggaagccaaaacagttgaaagaaaaactgcaaacggctttggaaagaaaaccgataaacatttagacaaaacgacgtttcctagctttctctaaagaggtgcgtgtgtccagtctacgtcgacgtctccaaaagcaaagattgcttcgagttggagatgtcgacttccggcagactttcgcttcccccacgaccagggacagacgagaaaaagacatcgccaatcgaagctggtctccgtagagacactccacaagatactccttgtgttgaccacagggggactaaaacaggagatcgagttttttgcctggacgttttcgagttgcgacagaacaggcgcttagaggggaggccatcaaagcgagtttcgcgggagagcagcacagtttccatgcagaagcaggttgttctatgctacgctggatgaggcaaaaagccttgttcgtgacgaaagtctggcgttgcagcgaactgtctcctttgatcgtctactccccatcacagcaaatggcttctgcgttcttcagacaggtccttttctgaaacctagacacctcgacttttgcagtgtgacatgcgttgagctccagttgtcttgtgactcgaaaaagccttgttctccaaaaacgcttccacgattcgttgacttccttgcacattcaacagactcatagagagcgggagctccacacagacctgcctgcatacccctacagctgcgtacacagttgctgagatgtaagtccatgctgaagtctcttgcgaaatcaatctctgttaacgagtactcagatccaaatgtgtgcgtagtttttgggatgcaaaggcagatttcgtctacctttgagacataaatgtatgctaatgcatattgagatccaaatgcatatttatgcgtattgaggtagaatttggagagagtggcgagctcggctctcgtgcagatgcgtgtttccaagctaacgcgaggtaccctcatgcacacatgtaacttttcatgcgagaagacgaagagcggatgcgcgaactacgagcagaccgaaggagttttcactaatggttcgtggaagcaggaaacatgattcggaacatgattcggacggctggctgggctcttgaggtctgcgttcaaga

SEQ ID NO: 866 - DNA, 1365 bp, Toxoplasma gondii
tcagacggaataaattgtagcttcttctagaaatcacttgacgctgcgggcgttcgaaactcctcggctattacacagacgatgtgttaccaggataagtgagctaagcggatgtagaactaaggtctgcaacgcccctaaaaatgtaacgtggacagacagggataatctcaaaaaaacagaatgcgggctacgcgtgtggcaggacaaaaaggcaaaaaagggtgcattggaaaaaagacgcgtcgcgtttcactttgcgggctctagccacgttgtcagaggatcaattctgcaaaagaaagtgtctacgcacgccgcgcatatcaaatgcttgctccccgctgtgcgggacaaactttgctaacaagacaaagctgagatccactttcttctgctgtctacatgtcagcctatgttcaattccaacttaaggtatatgacctccgtcattcacgtaactctccaccagcatcgtctcaaatggtagtccatagcgtatcatggtcggccactgtgatgcccataatcattgatgttctagtttagttgatatcgcgagcatggcactttcttcggcaaattgacattagcgaaaaagattcctttttgaagactgtgtgtactcattttcgtggccaaacgtgacaggcgtcagacgacaaaaaacaccggctggagtgtgatatgacagtttctgtgaacttgcttgagtatcggaccggcggcggtgtgttggaagctacagagttttcagcgaaccaggtttgctctgatgaacctaatttccaccgcatttccgctgcaaattggtgtttcaagttttctagtgagcgctttcagatgttctgctgacgggcatggagttagcatcgcatgcaggtcggcacacgtacggcggcaacagagtatacggtgtctttaaacaaagcgaatgttggtagcaggatatccgttcagtggaacaatcttacgccttttgtacattccattcaggcgcgtgaaaccattcaccaatctcgtgttgaagcctgatgtgcagtttatcgcatttctcttttttaagaggcatgcaacggcgaatctttttttgcatgcgagtagactgcccggttcttcgtttcttccgctgctggctttccctccgattttcttgttcttgcttcaccattaccactgccaagcctctgtgaaggctccattcttcgcagtcttttctggggcgggtttcccttctgtggcgcggactgtctgtcgactgagtacccagctgcttgagtctccgaccggccgactcagagcacatacatcggtgcaccaaacacgcgagttttctggaaaggaagggtgtccttggaagagaaa

SEQ ID NO: 867 - DNA, 4444 bp, Toxoplasma gondii
gatctttttcttaaagttcatcatcctggcgacagatcggagaaatcaccagaacgtcctgaaggaaacacgcaagacacagccacgcgtcaatgcagaaaaggatccggacaccaggtgcttgcacatccagatgaagaaaacgtccatcgaccacagcgtcgaaaccctgaaaatttggcaaactttctgcgtgcaattctcatcaaaccgacacttgaacatccacaggggcactacatgcacgtacacccagtcgtcaactctggttgtagcaggcgacaaaaaacgcccgaagaaaaacttctggtgcctgccagccttcccccaaactgaacagagtcttcacgcacgcaaatacacccatgcacaaggttgtacatcatacaagccacatattcgcgccgacccgcgacagctgcacagagagaacagcggtgtcaagtacgtgggtgggcgaatcgagaatgagagatggctgcgcctttcgccactggaagaaaacgcattttgaagaaaaaccatcgagatgcaggaggaaaaacgtgagtgtggctgctcgcgtggagttccggtgcgcgtagagccaccacacgaacgttaagaaacaggggaacacagcggggattggccagcctgcccctcccggcaaagagccagcgattcggagagacacagtcgagagactttcattggaaaaaaaagaatctttgcggattgcccaaaggaggacatggggaactgcgccgtcgattcgtcacagccggcacccccattccctggcaggctcaacgctcgcgccagacgcccgcactcgatgtagacaggcgctccccggcgtatcccatacgcagaaatacagatattcaggagcaaaatcatagggaaaaggatatgcgcaaataaatggtgggttctgtgggcgttccagcatacatacagatgcacgcgtaaatgcggccgtttcagcggcgctgcgcctctacggcatacccgaagcgacaggaaaaggcgtggaaaacgtgtcaacgacctttgcaaagcagaaacggattgcagagaaaagccagagacacgagacccgtcggagttggccgaaacgcgaagaaaactgaaacgtggcctgctgtggggtggctctgaaatggcgccctctctcgcagtcgccaccgcgggaaaaaggaccgggagacagcgaataacatacgagagacgaaggcagaggcacagctttttttccgtcctcgactggggtgaaattgcccttacctcgtctttagagcagccgaatattcatgtttttgctccagcacagcacaaaggggcgaaaaggctaccccatcgtccccatactaccagttcttcgctggtctacacagtgagggaaatattttcgcatgcatttgcctcaccacgtggggacggaaaaagaaaccatcatatttttgcaaagcacgcgtccgtatatagaacctaggcgcgacaccgcagatcggcttatatacggagacttgccaaaaacgatcgtagggagttcgttagacgtgtttccctgaactaacaaatgtgacaaatgtgcgaccagacaagacgcttccaaatatcaacacacattcgcttcttcattttaaagtcggtttttgtgagaagaaggaagataaaaacatgacgtaaggacattgtgagactccgaaaatgaaagactggcaaccaggcgttggacgcatcgcccggtacctcgatcggcttagttcgcgatgctacccactccacacaaaatgtagtaacatagccccgcaatagacgtactacgtatatttttaaaatatctgcacactggaattgcatcaaccgttttttacggctgctgtccccctatttctcagggccgacaggatggaaccaggaggtactggttttagaaaacgatcgtacagcctcgcacaagctcgcttacaagaatttgagcctcgttgccggccttgggaacacacaaaaagtgagaaagatattgtgctgagcttctcgtgtgaatgacggcacaaggcgaatgccacactccactctttttctctcatctgtcttttgaggcagggccctcgactgaaagggggtgaagttagaatatggacagaaagatacattacgaggacacatttttttcatgttatgcatacagcatccccactctctcggcggtgtgcaatcttttttgagagatgtaggatctccaaatgctagacagttttaagagctgtacgacggtttgagtagccctgacacggtgtgtcctcacatggtcaatgggaagccagttgttccgactcctgcgtccacgttaaatacgcagatgttaccagagccattcgaatggattttggtgatggagtttcacctcaacaaacacagattctgtttaatttctgttacgacaaatagtacgtaaatggctatgcgactgaccagcagaggtgtacctatgaggcgacgaacgaacgctcactaaattgaaaaaacttcactcatgaactgcctgccatgtggtctttcatctgcatgttggcgacaccttccagaaacagcagcttttgttcatgtgtgtagaataacacacacaggagcattctgtttccagggagtcgcatacagctcaaactcatgacagctgtccgcttcttttcctcagatgcagttagggaaatgactgaagctgttgttgttgccacctgtgtgcacgttaggagattcagcttcttctcaacagtgctgtagacaaattgaacagaatctgcgtcaggggtgaagaaacagcatcacacgtaccgtagaagctttcagaatgtccaggtgtctctatgcacagtgtccggcaaatgtattccactggaagagcacggcggtcgagcgttttccggctgcaagcaacggcacgacctccactcgcggaagcacatcgcattttccttagcatggaagaagctgtcaacggcttcaacgagtaataacgcacctgggtctgctcgtaagtatctagtgagcgtgcttgacgcattgatgtgttgccgtggtcggagtctcatgttgagtctaaacccgccactgtggtagcccggaacactctccccagctcgtgttggaattcctttaaagctttaaagccacttctttgaaggagcatagatgagacctgttgttgactctcatgtttgacttgggacaaagaagacgtgcacaagtttgctggactcggtcccagtggcctccccccggacatcaattgggacaacagcgaaaatgccacttcagaatacactcgcgttgtgtgtggatagttaggagcaaggctgtctctactggttcactctagccgagacgagctttagtactgctttaatgaaagctagtgtcgacacggtacgggtcgattgctcataaggccggcggtgtatgaactcaacgcccacagaacaaacatctgactaaaacaggctcacgttacaatcctaaccgcctccaatcccgttaaccgtagccgtgacacacctgtttagcgttcgaattaaagcccacgtttcttttctgaactcccgactctttttccgtctccaccagattgtggcatcgcagcagcaatggggagttgaccgatgtggaacaacgtttttcagtcatatagaggcatttgcagttgcatggttcccggtacggtattactgtagcgacactgtaagtagcttgcaccttttttactgtttttgctgtgccggccgttttgatttcccatcctggcgttggctttctttacactgaacaaagagaagtccgaaatggacccgaaaccaagcttccagtcgacacggaggcatactccttttcctcttgctttcagtctttcctcactgaacagaaaatcctccggccctcacgtggtgctcgctccagtcaaagcacctggcgtttctgaacagaaacctgacgcattttccggtgtgcctcacacagtcgacagagccgcgactttttcccgcgatgctctcagggggcgactcggcgaaacccacttcagtataaacgacaagacacttccctccgttggccatgagatactgtgtctaacctccagaagacacgaaagaccgtcgagcggcggtacgagcggcggtacgaggcgctgctgtgtggcgtaacacacctggggggtggcgacaagacaggagcccgaaaatccaccgcctaccgggggttaggcgagtaggagttgccccgctctttcacaggacacgaaggctgttgaggttctcgtacagaagtcctctcgtctactgagacatgcctctgctttcactttatttatttccataagactttctagaatcacaccgctttcgacagcgcccttcactagagaactttgtctgtcccctttctcacgtttcaggcaaca

SEQ ID NO: 868 - DNA, 1714 bp, Toxoplasma gondii
ctcggacagcaggcagtaggcgagacatttgagggtgcgacgctcacgccattcctgtcctgagaggagtgattctcttccgactctggggagtctcgagaagagcctgttgatggcaagggcaagagagcgagagacgccatgcttccccgctttttctctcctcgctctcttcagtgcgaagtctaacccgcagctggctacgaacatacgccgggggaaaaagcgaagaaaagcgaatctccagtcgacagtgagacacttgcgtgccgctacagagaagaaacatgtgagttaaaaaaatgatgaatctcgaggatccgtcatatatatatatatatatatatatatatatacatatatatatatatatatatacataagtatgtatgtatatgaataaatgtgtacagatatgtaaatgtatgtatgttcacggttactggcacggcgcgaagcgtatcgacttgcgtaggtacagctgaagattaaaggccatgcgagaaaactgtcagtttcccagtttcttgggtgtttttgacacgcacaacaagcgagtcgagacgtgtatgcgtttgaggcattgtttggattcgtatgaggaagagtgagctttccactgagaaaaatacttggaaggcgttaattcgctgtgcttcgtccttcattgagacgaagcttccgccgagggggtcgacggcggggaagccgagcgagacaagcagagacacaggaaatgtctgtggctcttttccaacctcgcgtcgcctgggtacaaaggccagagaaacgcgagacgcgcgcgtggacggacatcacacatgacaagagttgcttcagcgaaaggttgaagcccttctcgggagcgaggcggaggcgtctggtctctcgcgaggacctcgaatgcggagctctccctggcgaagtctgggggctctactgtccgatcgagcgagctcgtattcagcgtcgctctctgtgcagactgatgcgcggacggctggaagcagcagccagagagaggccgcgacgcgtacgagacaagcgcgagtcgccaccgaggcaaggaagaaggcaagagaagagcgaaggctgttgttgagggacgcacatgccgccctcgcagcgaagcaaggcggcttccgtgagccgcgaccttctgtcggccttgttgaagaagaagatcggtctgaggagagactggatgtcgcaaaatctctcgcggaaagagctgctgaaccattgggttatatctctctgtctgcatgcacaagaaggagcgcgcgccttcgcgcattttcacggcgcgtctctcacggcgttgttccgcgtcctttttgcggctttcctcttgtctctgtagagcgcgggagctctcgcgaggtcgatgaggcgttgccagtcggggacagagagcagcgcagagagaacggtggggttgcagtgtgtttctcctcatcgtggggccaggagagggtgcgggagagcaactgcgccacggagaggaggtagggaatgaggggaaacaggtgaaggggacgagtggtgcatccgtcagttgcagttcctcttccagtttgcggagtcgcggcgcagatcgcactcttttcttttcgcttcagaaaactcttcaaagataagtctgtctgtggcgtcggttcacgacagatctctcaaccttgtcgactttcaactctcctcgctcgagacaaga

SEQ ID NO: 869 - DNA, 1681 bp, Toxoplasma gondii
gtcatctgcgcagttgacgcgccgaaactcgaacgcgtaaagaaaaaaaggaaagtctgaaccttactcttcccacccaaatttcttcagaatggaggctccgaaggaagagtggaacgggcgagactgtacaccgctgcccttgaggaggcgatcgtagaatttcttcgacatttttcgttcttctacgcactgtgcagtgcaaagtctgggcaaggagacggccgagaggcgactgcgaactcccgaaaggagacgaaggaaaaactcggggagacggcgaggcgcgaagaagagaaattcggaaagaagacgcaggagtgtaagtgcctccagactgcagagccaccgaaacgttcttcacgggtgctcaagaagagagtcgaagagactcgaggaaaggccgaaggcgcgactccgcagatgaacatacaacgacgacaagcggggaagcgcgcgggaaggaggacgaggagacctggtgagtcaggcgacaagctcgaagtgaactgcgagtccgactcaaacgagaagaaataacagctgctggtgacatgtaactttcagaagagaagcagccagagaggaaggaacaaacaagacggcgagagtggggataactctcgccgaacgcgccgtggccgcaacctgagtcaggccggtgagagagagaagaggagagagaaggtggactttgaggaaaaaattcaaaaatgacgtttcgcgaccagaaaatcgagagctaagaacatgcatgcaatgttatctttgttcagcgagagaggtcaaaaccgtctccccacattgacagatttcgtcgagaaaagcgaggagagagaacgcgagattcgatcgcagaacgagcagaaaagacccaacgtccctgtgtaatctcccgcctctttctccccttcctcactttttctttttcgctgcatgtagggagaggccggcaaagcgcagggagagaagagggccaaggccggaccggcgcgacagctgacagaaagagaagagagaagaggggggagaagactgctcagagactagtgtgtaacgcaaaggagcgtagagttcgtcgtgacttctcagcttctgtcttcttcagagagagcttgtccgttttgtttctcgattttcagagagacgcgggcaatttccgaggaacgaatacgatgccaaggttgtagatatacacacgaaaaacacacacacaatttaaagaggcaggcagcgacgacaaagaaccaacccatttcggagctgtgttttccttgtctcttgttgcgttttattgtctttgtctcctctctctgaagtgaaagaaagcgctcgctttctcgtacctttgtgtcaaaatcctctttttttctctcgctgcacctcctccgtccaaggttcgccgcaacttctcggtttcgtctctctgtgtctctttttattccatcgcgctccatttctcccctttctgcttctttcttgtgcgtcggattccttctcctccatcggcagaactcctgccttcctcggacttctcttcgtcgctgcaccgccagtgctgcgagcttcgccaagggtgtaccgtgtcttcctcctcctctgttttcaccccttttttccgtccgtttcccctgcttttccccccgtttcctgtcttttttcctttttcttttcgccagca

SEQ ID NO: 870 - DNA, 2764 bp, Toxoplasma gondii
atgtcgcatttgtagtgcacagcgcgcccgtcggagaggagtgtttgacggcgtctgctctgtctactgtgtttcatgtttatttctgacaagcgagcgggagagggggggggcagtgagggcgttggacacagtttcgtttttctgtgctagacgatgccgctttctttgtttcaagcgtttttctttcatcaatcgcgcaccgacgccttccctgggtcttgccggttcgctgcctctgcgtactagttgatttgttgttcgcgatcaagagacttgcccgaaacggtcttggggactggagcaggcacccgtcgaggtggacgttgggtttgcctcttgaatgcctagtttctttttctctagaagacttcagtggagaaggcgaacttcagaagctggaaaaagggcatgcagccgtctcttcagttccctgggtgctgtcactgctccccaccagacgacagagataccgcacgttgccgcatgcgcgatatcagccactctctcttgccggcgacattccctcaacgatgaaaaaacacaggaacgcagagggtagcggggaagttcgcgtctgaaacatgtacagctctgtgtcaacttagatgcaccgaacgcgccgaaccagatgcgctggagaagcaagttttcgaatatctgtcgagtctcaggggtgggctctctcgcagtacatctccaggcagggaaggctagaggaaggagacacagactcgacgcagacatcttccttgagacagttaaagacccacacgtgcagcaagaaccgcagatctcccgaaacttttttttcgaaacttcacaggagaatcgacagtttctgcgaaggaggcccgagaccgagtccccaggaacgaagcgcttggttgccctgccgcaccacaaacagcgaaagacatgtttcaatgttccccagtccgaggtgctctccacgtcacattttatcttgtgcttcataggttggacgatagccgcttcacatgtcttctacgtttagtggaatgagtcgagcggcgctggggtatggtcgacaactcgaaacaccctgccgaagaggccttttcgccgcagagataatgacggatggtggtcgacaagtgagatggaagtgggcgacagcggccgcgcgatgcagaatgctgaaaagcacaagcaagtaaaaaatactaagaatcgacgctttattcatatatatctatatctatctatatatatatatatatatatatatatatttagatatttatgtttgcttgtgtgcagacgtagagatgacactgtagagaagtcgagggcagcagcagctcggcaactccttggtacatactcatagagtgagattttctctttcctgtcacgatcttcgctgggggggcggcttgactgtgaaatcggtttacgaagggatctcgttcagcgggcgagaccggattgtcgttctgcaggtagatgccttcctctccttcgatttgatgtgaaaacgacatggcaatctttcaggaacagcggccgagggaaggactcctcagtcgctgttatgtgagagtaaaccggtgaccccatatcgcgcacaaacttggaaaggcgttaggcatctcgtctacagactcggaaaaatacacaccgagtcataggctgctttcctgtctgcagaacgagcgaggaaatcttcaccccacgacgttcgacggaagaggtccctgaggtgtaactctgttcagtgaaaatcaaagaagttttgtgctctgtgtagtgccgggcgagtctctcaatgaagaacggagtttttgacaaaggcccatcggctgcgatgatcgcgagaagaccccgcgattttccagcgttggttccagtgagtctctctagcaaacggatttttttctctgctttttaagtttgtgtgtcttgctagcctgtcttggatgggtatggtggcgcggtgcctccagggagagaggaaacgtggaaggggactgaccatccgcccggagaggaagtcgaaaagacggggggaacttggacgaaaacgccaaaaggagagtcttatgctgtggtaaaagtagcagaaagggagagtttttcctctagagaaaatttggagcaactgagcatgaaaaatcacgaaaaagtctctggaaacaacgcttcagcgtgctcacggggtgaccctgtgttgcgcccttgtcctcgcttgcagctcttgtgttttctctccgtttgtcgttttttctccattttcttttcgatccgaattcaacggtcttttcaatccttcatgccctagcgagtgtgtcgcgccctcaactgtttgactgtctccgtcacaagccgtctcgccgtcacgttctttcttgcagccttcttccactgcgcgtctgggaacagcctcccttcttcctctcttctcaccgcttctgcgtcttcattttctcttctcaccgcttcagtcgttcctgtggagggtcctctccgtcagcttcggctccagtttcctccgcccccctcacctggcgagcacactgtctttttcgtctcgtctttcctttcgcttgctctgactgttccccttcgctatcaccttttctttgcatcgtggcgcgcgattcctttgcgcggccgcctttttcgcgtctgtcctgccgccttgtgcgtgagccgcgctgcctcgctgttcctgctgcgccctgcgcctgttaacgccggctggtgcttgctatctcccgtctctccctcttctccacca

SEQ ID NO: 871 - DNA, 4455 bp, Toxoplasma gondii
tgatgcacgcggacgcatacccgtgtactgaaatcgatgaaaacgcacacaacatatttgtattcacggacgcatacacgcgcgcagatatgaaaaagtagacgccccacgacgctgccttctggctcaggagtcccggcaacaatgcgactggaagaaactcctgtttgtggttcggcgttgaggaattcgcaagcacatgtcagctccgttcacaaagagctggacgcgtgagccgacgcgagggtttgtcttcaaagcgagggtccttttgtcgcagcgacaacgaatccagaagctccacaagcgcatgcaaccaagagatgacgcgcaggggcagcgacccaggacaggctgaccaagatcaaagagcttcgtgcacacgacttctcttcaagcagaaagtgtacatcgttcccacccaagcgtggcggatgttggcaggtccgcggtaccaggcaaagcgggacggaggcatgcgaagagagacagggatcacacactccaagtcagttcacatgagacaagactggaataagacagagcctttgtcccgagatctctctgggtcaccttgccacggcgatccatctccgtcacacgcggctcgagtcctgtcttttccgacagcgacgcatacacatacagacaagtggcgcttagacacaggcacgcatctctaggtgtggagattcactttggtcaacttccagtcttggtttctccgcggagtccgacaccctgccgcgaagtcgcgttctccgacacgactctcacacacaggtgcatccctctccgcagttcaccgaatgcacactcaaggacgtatacatttaaatcatttcgggcatttccaaactgagcagaactgggaaacggacaaaatcctgctggagacacggcgtccccccggtcgcgatttcgaaacgcatgccacaaccgcagacgggggactcttgtctgtaagctcgcgggggattcgtacgatatgttcttgcattcctttccgccaaagaattctccgacccgtcagcagattgagtcgcctcaattttccttgttcgtttcaggaaccaccccttgcacgcggagccagcccctggggagatacgcggtcacacagcgcgacaaatcgctcgcaaaattgtcccgcagacaagtggccgggacgttcggagcagaaaagtgggaataggacagcaattcactcgcgcaaaaagaagatgaaaccggcaaaattcgcccggcgactcactcgcacagtctaccccccgcttctggggagacgagaggaacaagggtcggtaactcgcgaacccaagtacagttgacgaacacgcgcggcggcgtccaaccttccgtgtctctcgcaacgacggtccaggttctttttatatctcacaccgacgtgggacgatgtgtcacacgattcctgcacccaaacagagaaacgaatgcgctgaggacgagtggatcgaggacggaggaagcacgcagcgagcatcaggcacactgcccgatcgaaaggcgggaaaaaggcgtcgccgcccgacgaaaagagtactttgcgttgaagtggcaccacatgtgaaagcgacaggaaaaaaagagcacaaaaacagggttttcaaacagaacctcgtagcatgccccgcacgcgtatgccacggcaagcaccccgatgtcacctcatcccccccgcacatttcgaaatgctgagtcgactcacgctgtgaattacggagcagatgtgagagaaaagagcggctgacacacacgcgttttggcttacttgtatgtaagcaagtctcattgacaatgagtaccgaacaaatcgtcacttggatggcagcttatctgtcagatcacgtgtatgtgcaccaaggcgggtggctacacgctatgtttcttcgcatagtcaatcgagctctgggggagagacgcgggaaactgccacgccttgctcgcttgcaatttccggagtgcccgaagctcggggaaagtattcgacagaagtgtgcacagaacataccaaaacgccttctgttgtggcgtttcaacacaagggaaatcctatccagcagtccagcgcactcacgatgtttagcgcgcgtgtctaccgcggtgcctctgcaacgatagcatgaggcactctgtcgatggcgcgaggtggaaggcaaaacccaactgcgcgacgttgagagcacgcgtacctaggctgtggttccctctggtcccgcagtcgactttgaagacaatcgggacgacaaaaccgttgtcaggcagttcgcaatcaaacgtcaagggaattatctgcacacaaaaatcaagcacgcggggaatcgaatacgtcgaccgacgcacgaattaacgcaatttgtagtatcgctgtattgaccagtcctgcagaggaatcagagtacgtctagttgaactggtagacacaaatggacaggcagatatgtccggtgtttgcgcttcatcagggcaacaaacagggggtttcctgtgttaaacgagcaaaggctgcggggggggggaggcgaaaatgatgtctgctggttttttccggtgtttctcccgtctaagcaataacttctcggcacaaggctggtaagttcccgtcgacggtggacagacaacttcaagggagcgactaaaactcgcgtcccttagcggctctcgccgccttactgaagcaaaagctacatcaataggtggcagaggagatggctttcgttcatgagaagcattctcagcgaagaatctataaagtggccgctttcagtgcccccgaactcagacctggcgatcctggcgtctcctcgttgccccttttagcctgtgtttgcaccgaatatgtttcttggtgaaccacccggcactgcactccttccagaagctttcttcagctcgttttctgcctcctgcgtttgagtaaaggggaggtaccaattgaagaagggagatacgtccgcgtccgttctgtccaccgactattttttacacaactgttaccttgaaacaggcagttccggcggacacagattaatcacacaatagcgccgcgtactccctccttgaagcccgctcaggcgccttcccgcttggaggagagagaagacgtaggggatcctgaggcagaaagacggggacaccattcaggacaaagctccttatttggaaagctcctcgttttgctttgtcgaaataagacacccgacagggacacgcgcaacagacatgtcgacgactgcatacagaagagcggctgacatgtatgtgttcttatcagcagaggttcaagaagagtctgggatttctgggggccctcgaaaccaggagcaaatacgaattcggagtcgccgatgcgctgtgcgtcagctgtctctgacctacggcatatttccgtagaccagctcagatttctgtacctacaagagaactggcacctgtatgcgcgaatgtaaggttcggcgtgtatacgtgggggaacgctgtctggccattccgggagggaaaaagaaagcgagagaaaaggaagagagtctgtggttcgcgggaaaacccaggcggcgaggccggaaagcgcacttgaaaagaggacaagggaagaaaaagcgacacccatgagagcacaggatgcaaagcaagaaggattattgtgttgatggctgggaagccacggcgaacggcgctcttcgtgactgccaggttcgctgggccaggaaaacccacgcagcgaaggcgctgacagccgctcccctctcgtaggtcggaccttcgccccacgcgtccaccgtccaccctgatttctcgacaccttcgaactgctggaagtttctgattgtctaatgcacctggtaaggcagctgaaggaccgaaaacggcagcaggcgttcgcagggcggcttctcatgtaattccgttccacaaataacgcgtgtctggtcgagattgttttgtacactggacctctacccttgacatcgacagtccttgtccagcgtgtccccccccccccaatcgtaaacacgctagacgccctcacgtggaaaagggcacaccattcctgcatgtttaacctgtattcaatgcgtgtcatgccctcgacgttgcggctggtccttcgattttctgccagtcacgccgccacagaacacgcgcctgcggaattcttaggatgatgccctagcagtttcttcttgggggggtacaagagcaactatcgaaaacaacaggggcgaccccactcagctcaagacgcttccagccagcacaggagtccacgctagctgaattttctcagctgctaacgactttctctcccagagcgccttcagcctcaatcaaaagccgttcgtctgcgaccaccaacggctcgcgagccccgaccctccatctacccttctacgtattcgagaaacaacttactactcgagacgtttgcaacaa

SEQ ID NO: 872 - DNA, 4225 bp, Toxoplasma gondii
acacatgtatttatgcatgtacatgcatacatgtacagatacatatatagctgtagatccctatgaaaatctctccaaatgatacagatagaggaacaggatgcaaggttaagcgaagaagcgcgagaggaggaacgctgggaaaaagaaatctattctgagaagcctggtcaggtgcagaagcggtgcaggatcagaggtcggggagaaaaagaagaagcaaaaccttgaccgttgtcaagacagcatgttctgtcttgtgcgcctccatcgcaaatggacatcgagagagagagcgagagggagaggtcgcattcactccccaagagacttgacgattctgaagatgtcacctcttggtagtcgtatgttcgcgcatgcatctgttggacgttctcccatttttttatgcacacaagacgcaaagggccgtctcttttctctcgtcctttcctgtcagtatacgtatttttgaggtgtctggacacgtagaaaaaaacgtttctcctcacatttttcccgtcggctgtccagagcgcctgttccacgccttcgaacgtcgccactggctttcggatgtcctccagcggccggccgtgttcgtagcggtaaagttcagctgcatctttcgtgagcgcgagaaactcgatcggcagcaacttttccttgtctttcttgtcctcttgcgtcgcttctgccgggccgaagccgtcgtctcccatcgttcctttctgtgaagacgaggcgcgtgctctagtctcttggtctctcgcgattcgcgtcgactcttgcccttcgcgccgtgtgccagcgctgccgtttcgtttctcccggagcgactccaggccgagtcgcaagggtgtccgcagaaacggcttccctctgccccgagataacaggaagagcgggagacaagcgaaaacgtaagaaaaacgtcaggaaagcggggaccgggcaggcgggagaaagcgcagaaaagaagcgaaaacgcggagagggtcggagaaacgacctacggggaaggcgggggcaggtggacagaaagaagacacgacaacggagaaaagagaacgggaaaagaggacgaaaacgagaaaaaagtggataagacgagaaaaagaagactcagaagacggaaaacgcagtctgccttcgcgcaaaaacacagactgcatgtggcgacgaagggtgtatagtagaacagttgaacagcagacgaagagacactgtcacgcattccacacaccattttgaagcgtgttttcatcacttgctggagtcgtcgacgcaggaagacgaacgaggggtataatgccgagcgtgcgacgcaaccgactgaaaattccgcagattatgggagaagaacagcgtcaggttctgctcccgcgttccggggggaagcccaggcaggcaggctctcgtgactctctcgattgcaagaagttttctcgggagaaggaacgggaaaaacagtaagaaaaacaacatttcccacaagaatgtcgaggcaggcagagctgggactaaataggggctgcagagccggagatcgcagcaccctgcagtttcctcacgtttcgcagacttcatagaaacctcaccgaagtacgaggcatttttccacggggtagcggcgctgcgtttacgctttcactggatattcgtttcagtgttaactatcaataaagtaaagaccacgggagcgacggcaataaagtacgtaactccggagaggctgaagaaagtttctcctctatacagtggcgaacatctctgtaagatggaaaatccggaaacgctgccgagcacgaggctccgtctggtgtccaaacgccagctcacttgtggggcgttcaaaagtcccctgtacagctcctttagactgcggaaacacaaaggctgggctgcactatggacagcgtggaagccctgttgatttccatgaagcaagcagtgaaacgaatctagtgaaggcggaaacgtagtgcatattgatcgtttgttgtcacgctaataaaagaagttccatcgtcagtgattttcttgcttcttcctgccccaggagaccgtcgcggctaacgcgtcgggtgcacgagctccgctgttgttcactcgttgcttccttcaattatttgctctgtttcgagcccagacactcgcctttctctgcctgtgtgagctcccagactgtgacacggaaaaggttgtcccttcgagttgaccggctttttccgttttctttccaggtgctgcttcgccgctggttttctccggcactctcagagggagcagctagcaaactatacagagctttgctccgccagtccgcggcacatatctgcaccaccgggctgatgattcaaactgagccacgaaaaacgaaatgcagagataatctcagaactcgtcggtgacccgtttgagtttcagctatagggaaaagactctgcgatcacggacgacacggaaacgccatagcgaggataggagcacagttctgtttcatattgaactccacacctcctttcctcgtgaaagtccacgcaaacctttgaacgagaaggacgccaccatcacacacgtcttcaggcgatttctgctttcaatcaagactggagctctccggtcttgaaaactcacaaatcgcacttcttcgtgagataactgtttccgggttggttttgggatctccttggagagcgctggtacttcgttcgccagttctcgtttctcggacgtctccaccacggctctgaaacaagggatgtctccaacgtttgcgattcacggacagaaactcaagcatgaggtgccacatgcccacggcgatccagaggacagcagccctccaaacgaggtagagcctgttggttgctgctttttgccttggaatagttgtggtagtccgtgcaacttctcaaggtagaaagctgcggtaaactgcggcaagtcgcagagaatgctctggaagcaaaacgaggccggtagagtagtgttctagagttcgcgatggcgccagcatcgtcccttcagtggtgtgcaattggcctttaaacacgcattgaaacaacaaagtgaaggcgacctgaagtgagtcacttgccgctggatggtgaacatcgtcgttttggcataaagcatcccgcaggacactgacaaagagcccgtccgtggcgtaacaggctaccctactgtaagccgcttctgtcagaaagaatgcctcaaacggactgaaatgaaaatcgcggcgtttttgctcaatttcccttcagaagcattcatgttccctacagtaccaatgcggttactacactataaaaagtaaatcctgagggtttctgtccaccgacacaacgaacaccatacatgtaagctgcttgcttcttcttttctagctgcttccgtttatatttcatcagaagtcagacactgacaactttccgtaccgccgtctggctccgcgacaactgtgtcgtcaacagcgctggaccgtgacagcagtctccaggttgcggaaagagacaaagtctgttgaatacagatatttcatttggtttcagatgtcactggacaccatgtgagagcagcaaaggccgggacactacgtgtttgctttgaagtctacaatgaaaagtcttgtccccttcagtttcttagatactcgaagacttctggaaggagcctgccgacaattcgctgcctgagaaatcccgaacgcatgagggaggtcacttccttctaagaaaaataagaaaaagtaagcaaaagagtgatgctcgttccattctccggataccttcccgtcgcttgaagcctctacttatcgtgtgctcctcgccgaagcgccagccttccccgaaaatcgtgtctgcaccgtgcacgtattgcgaacgtgctttcccgtagtcctgcagaaaagaggtgtgcttcaaatagaacgcgagttggagacaaagtatgggaaaagaaatacaagcatctttgttgtttgcctgtctcggctagacagagacagccctaccttttttcgcttgcactgcatgtgaccttccgctcagctacctggcagttccgctcacggatgctcgcaagcctccaaatgggtcctgctttagctggtttgtggatcatagtgaagaaggtgtcgttttctgggaaagtgcgttcactggcgagtagtgattcctcctttattccctgtcaacttatcccttggcttccccga

SEQ ID NO: 873 - DNA, 1675 bp, Toxoplasma gondii
atttcttccagagaactggacttctcaacctgcagcagctcgtagtagcagacggcttcgccaacgcgcccgcctccggccatcttttcgcgcatgcatctgcgacccgcactgccggcagagtgctcgtcagggacctttcgaaaactcagaaaaacgcgagtcaggaatcgacggagtctctgacagcaggacgacagcgcctcggcgacgacagtgcctcggcgactctgaagaagtcagacgagttgtggaaggctggaagcctgtcctgcgtaagtctttgtgagcggccggaaagcgagagagcaccgtgatgttcagagagtttcgaaggaaaaatgggcgctttgaaccgcgctgcgagacgcagcctgagggggctgtcgccggagagcagagaggagagtcagcttgaaaactgcagagagagagagcagcaaaacggcgaagacttgcaaagcagaaaagaaaagaagaaacagagacaaaagagagaaaggcagcggcggtgaaaaagatgaagaaaacgagagaaaaaggagagacgcggaggagcgagacgacagcgagaacgcgagacacacagagattgaggaagaggaagagatggacaagagaaaaatccaggaagcgaaagagaagaaggagagcgagatctacgaagaagacacgagaggccgagacagaaggaggaagacaatccagagagactgaacaagcaggttagactgaggaagaactaaaaggtacgcgggaagaaagagatgaagaaagaaaaaagtcgaagaggccgagatggcggcgaggacggatgagagagtgcaacgacgaagaagagaggcaagagaggacggacgaacgaggtacagcgagagatagggaaagacgaaagacggtaaagaagcgaataataaggatgtaggagagacagggaagcacggagacacggcgtttgcagagagaacttttctagagagaaaagataaaaatgccagtttcgttcgactgcgttgcgtgtatcgtctcggagttcgaggagaaataggaggcgagcggtggggcggggagaacaggcctctctccctccttcctcgttctctcgctcgtcttcttctcttctccttcctctctttcgctcgtagaatgccgtaccttcccctctctccctgcgaaggcaacacaaacctgccgcaggcgaagaacgccgtattatagggcagaagcgggagagaagaagagacagaagagaaagaagagaaagaaagaaggcatcttgaggtggacgcatgaagcgtttccgagagaaaagaggaacaaagcggagcaagaaaggaagacggaggggagaaacgctccctcccctcccctgaagaaattcttctgttgctcggcgcatctgtgcccagctgcgcgactttttccggcgcaactcgcgtcgcgaactcacgaaaagacgcctttcttcttcctcgccaacctttctttcactcgtttttctcttttcagtctctcagttgagagacaggtccgacttctggcttttcccctccgttagttctcctcttttccccgcgttttcctcttcttttctccttcgccggcttgacagccttctctgctggctgcacacacggcttgcgccaggtcactgcgtcgctcgaaggacgtcaaa

SEQ ID NO: 874 - DNA, 2984 bp, Toxoplasma gondii
gacaagatgcgtctcgggatgaactttcgctatggatgccttgaatgttatccgaacaatccgttttcccctcgccccgcatcggattcgaatcctgtcgagctggcaggcgctgcgttcccccgaatttctctccaccgttctctcgagggcggtgagggtgcctagaacggcaggtttttgcagtagcgcgtttctcagcgctcgaatcaagtccaccgcctccgtggtcgggacgccatcctgccgagagccagaggcgagaaatggcgtggagagaaagggcgagctcttttgcgggcaaagagtggatgcgtcgagggtctttggctaagatggtcggcagccgcaagagccagtctcccggcggtaacgacgacgctgcgtacaagtgaaggattgagaagaagacgtggggtgagtgctcaaggtggaaaaccagggagcgccggagacactctgaaacattttgagacgccaggcgaggagaaccgagaggcgtgcaaactgtcgtacccgcagcgaagaagcgcttcggacccccacggccgtgggaacgatatgagggcgagacactcagactcttcagcagtctaagtagctcgttttcgctcataggctgcagtgagttcttgccgccgacaggactcattgacggagcggaggacacatacgcaggagcagcagacgaggcgaagcggcacgctgaagctacagcagagagcgcaaacaagtcccgggatcgggggtgtgcgagtgccaaggacgaagggtcgccttcgacagaaggcagccacgtcggcaagtcggcggtggactcgcataggaaacggagccgaatcttccgggcatcacagcgccttcgacgtgatttttccgacgatggcgagggagagcgtggctctacaccggtagttccgcgccgtccgttcgaggaacgtatgcagtcgcggcttcctttcgtgaggtagacccccctgacacgacgcagttgtcggcgacccgccaggaaagacagacaggggaaagaccgcacgccgggttcaggaggcagtatcggccattcgaaatgatcgcggatcagcacatcgactgagttcatgcaaccgagggactgcctccggacgacccccccgtgggagaggacactggccgtccacgagccattgctggcgagtggcacatcgccggccacaccagcaaggcgataactgatggaaggcatccatggcatctcagcggaatcaagattctgctggaaaactcttgactgctgagtcaaccggactcagagagcagcgctggtatgcttgaccgtctcccctgccggaggaaagggtcgggtacccgacttcaaacgagcctgcaaagaggagcagtccagaggtgagcagagactacaataaagatgtctagaagtaaagggtatccgttaccatctagatgcacatccagcaaacccgtttgcgtaaagttggtctgcgagatgtccgcaagcagctgcgaaacgcgccaagtcttcatgcctttcctgtcgcttccccgagaggcagacgagtcaaatgctttgcactatccctgtgttgcacgggaatgtctttgcgtcgtttcacatactcattgacttacttgtgccattaacgaggactacaagattgaatttcgtaccgattccgcttgcttcttgccgcacaatgctttcgtgttgacacgtgtagcgctatgcctcgagcgccgcgcggtgtatagacaccaagggctggtaaggaacagagagcttgccgtgtgccccggcagtggataccggaacagaaacggcgccttcgcttagtgtgcgtctacaaattacgcgccgaaaattgcgtgttcatctttggcgttcgttaggggtctttctagtctctatcgaatggtaagcctctccggagagacacttttttagcggaaatcgaggcagccgcaagactcatagtccgtggtgtgttgcgtggaaggttgcacgcgcgctccagctgagtccccaggcaagttgataccaaccctggacagagtaagacggtgcatctgggagacgctgccacagcatgcggctccaaaattgtgctggcagcaccgcatctcccgggtgcgcgtaccatcgtgttaacgggacaccggagagagaggttgcttcacctggtacatgcaatctgtgcaggggtctgggcgtttgtgcatcaggactcagcttttttcatttctgcaaccgcgtccttccgcgttgcatgtgacgcgatgacccattgcgacctcttcctccggcgaacggccttcgcaggggctgcgtgccaaccgaaaaattttccgaaacaagaagctgtccagatcgacgcgtgcctccctcgagaaaatccctgagcctccgttgtccccttcttgggtgctgtctcggcatcccggctgccgacggttccggcgtccgctttgccccccgttttcccgtgtttcgtaaatattcgctctgggcactgcgctgtcgcttttttgcactgtggggtcggtttcccccgtaaattgcaccggaccgtcgctcctctctttttcgcgtgctcgttttctgcgccggtaggttggtgcggcagagcgactcggggggctccagagagttggcagctcggcatcgttctgtaatatccgtcgcgacttctgtacgtattaccgcatcgttagttgtccacgcattgtcgcaccgtcttgttcacacgaagctcctcatgaagtgaggacgtagtgatgcagcttcagctcactccctcaagtcctgccatctgctcggctgattgcctatttgcggtggccgtgtggctggaggcggggaagtcatccatttggcagcacgcgactgggtgagaatccagttttgagaggcttcggcaacaccgtgtcaattttacagtcaactggctaagcatcattggaagactcactcgaaagtcccatcaaga

SEQ ID NO: 875 - DNA, 2217 bp, Toxoplasma gondii
acagtcttcgttctacgagttcctcccatgcgaccatgtacgaagcgagtgtggaggtgcactgtggcattcgcagagacctgagacgggggtgtctatgtcggtctcgaggagggaggcagaggcgaaacgaggccatatccttgtacagaaatcggagagttacggataaacaacctgcgactcgcgattccgaacaggatctcgaaggccagcaccgagactgtggagtgtccagggtccagagagttccagaattcggttaagagatgcagagactcaagtttttcgtgagcgctgtcacaccacagccttcagggactgctgaagagagcttcgagagtattgaattgcgcatgcacacagtcggcgctacctttctagacacacacacttgagacgcgcgggagacacgagcatggagagccagttgcgcgcgcgctggacgcgttgggcgtcgacaggagcttacatgaacggcgcccttccccattgtcggacttctcgactgtctgtttcggaaccacgggaggcgactgctctccaggaatcgacgagaaaggagatccagaggcgcgtctttcagacagtcctccttcgtcgtcgaggacaggggcaagaccgcgcggactcggagacgtcgcgaggtgtacgtacacccgaggtgcgcgcctcagccgagcgcgccaagacagaatacgcacatgcgacgcagctctccctgtcgctgcttgctcggcttctccctcgctcgtttgtgaggcaaaggaagagccttcaatcctctattctgctcgacgtactggctccgctccgctcgctgtctgctacctccgcccaagagaaggaagtgcgactgtggatctatcacgctgcgttccttcgtctcctctaactctcagctttgtctcctttgttctcttcttcccgagctacaaggaagcaggtggagagggcggaggaagtcgagggcgcgtcgcgaaccagccgaagcaggatggagaggccggcgatttccgcgaggaaagtggaggacagaagagaagcaagaaggaaaagtgaagaaagggaggagaaaaacgcaaggaagaaggcaaactcgagaaaggagatcgggaggaggccggggaagaaagatgcagggtcgtcactgcgagagaggcgctttcgctgaagagaggacagaagaacaggaacgagacgtggatgtcggaaaagactttcaagcggtagaaaggcaggcgaatggaagaacgagaaacacagagaggcaagtgcaagcagagatgaaaacacaataggaattaacttgttccctgtgctttcctcgcgcaaagaaggcgcccttcagccaccggtgtgtctcgcagcgttctcgcgctgtgcgtggtggttagttgctcgttcgaggagtctcgcggaggaaaaagttctccaaatgcagcaaaggcagcgaaagagaaactcatcaaactcgacctctgaaacgcgtatgttgtcgtctttctgggtcacaactgtccatctgtttccaccgaaaagcgaagagcctctctcccccctacgagagggcgcgctcgcatgctgccctccgacgacgcggtcgcgaaattttctcgccccgcaaaaccgacgctgcatgcgcgagtgtgcttcgtaaggtcgagcgactttctgagcaatttgaatctccttttttcctgtgtttccgacctcgcttctcttcttcgcttcgcgatcaactccagtgtccgtacacccgagagcgtcgaagagctctacttatccggcgtctgcttccccgtcacttggctcccgccttcgcgtcgttcgcagttgccagattttttctgcagagaacgacagccgaccgcgagatttcaccctcttccgcttgctcctctcgagtctcctgaggcatctctgcggcatctgtacgccgaacttgccgctcgcagtccctgcttttctgccgcttccttctccccaaataaacgctcctcgctgctctcaacaagaatcagacgctcttcttgctccttcggactctctttgtttctcgcttctccattccacctgcgttcctggtcctctcccgactcggtgtcgcaagcctgcccccgcgagaccgctcggcgccgttttccacccgtcgtcgagtctctctgttcgttgtagcttttcatctccgtctttccctttcctcctttttcccca

SEQ ID NO: 876 - DNA, 2139 bp, Toxoplasma gondii
tgtacttggaagtgagcagctcttccagttcggtccagtcatattgccacgccctagccaccgtttcaccagcgtccgatgcaggctcacctagccgatacctgtgaccgttcatatatgagttgctattacatctgtcggccgtaacgacacaaggagatgcagctggaggcaacgggtttgtgagcaccattttgactctgtcacggagtaaaaaacatttattcgaactttgtacgagcgcagtcagtagaagtcaaccacgcgtatcaactacgctgcaattacagaggacagggacagggaaaaaaagtcgaagaggttgccggtgttaggagatgacgagacgtttaaacggccgctggctattgttcgggcatcgttgagccacaagcgatcaaggtgaaaacaaagttaaatagttatgctggagcgattgccctgctgaatcttcagatcggacgaacagtcattctggcccactgtacttgatgtgttcgatgtaaatcacactcagtcgcgtgctcggtagcaatcaagttgctcttttctctcctttctagacacggtaagaacgcttatgaacacgcatagtttttgctagaatgcagcgaccagatgtcgcaaggtcgtctcccccatcgactggagaatcaagaaaaacctgcgttgatcccaaacgtactctgtggttggtgcaaccagaagtttcatactgatcaaaagccagtgaacagctgggggacattgcaggtctggtgcttcaagaagcgctgaagaagaaagtggcgaaaccctcggcagttgccttggaagaggcgccgtgcatgtaacttctgaagtgcgtagtacctggctcctaatgctgttttgtgtttcgctgtctgggcagcagtagaatgctgtgccagaattagccactattttagacatttatttacacattttttttctgatgaacttggcttattcattttttcaagtcttgccactgggtggtggcatgagactcgcttagatgtatgtgggtgttgcaatcacgctggatgctcggcttatttctgagttttttctggttttgacaatgggaacgatttcagagctactatttcacgtggtacggctatgagccactaaaaaaacgaagaaaaacgctgtttgcagaaacaatagcaaactgtttttcgtcatagtaactcagcgcccccttgcccccccccagcagtgagatgcaagacaatcctctctaccacagcttttgttgcgtctgtttcaaattttcagcgctcgcgaaaggcatcacgaacaacattatgagaggaagcaggtttgtggggctggcgggtgcaggaatgtgttcctgcgaaaaaggcctctgctgagaaggtcgtggcgtttgaaaaatatccgaggtagcaaagacttgtttcagtgctccccttttgaagacctgcggcggcagtgcactgaagagtaactccaaatcaccgcggtgagacttggttttttccgttatccttcagaagagtgtgttttcgtttaattcgtcacagaccacgaaaaacgaaccatcgaagacgatcactgcgtccgcgtgcatctggatggatgacccacatctgttgcagccgtcgcagacatgcatgtcccgcgttcgtgaaattctctgcatcagcggagtgatcaggaatcatcgtctcagcgggatgacgttgcggagcaggccggctcgcggtgggcagtcagatgccgaaggcgtgactcaggacggcttgcgctcatcgcagaacaggggtggtgcctgcattgggtgcggttggtgatcctggttggaccggtggagatgcgcgcgcacgaaggggatgtgtcagaaacattttgtttgttctctgtgaacttttagatgtgttaaaggcggcgaatattagcagagggtcctccttgttggattctctcttgaatttcgccctttccttctctttgcgagtctcgtagagaacaagcactcgttcgccgtccctgacgacgcaacccgcgcagaagacatccaccaaacggtgttacacaatcaccttgtgtgaagttcttgcggaaaactactcgttggcattttttcttgaattccctttttcgacaaaa

SEQ ID NO: 877 - DNA, 4673 bp, Toxoplasma gondii
ccagtcgtcgattcggcttgccacctattggcctcttcacttcctcatgcccctcttcatcagcgtgcagagctcccccttgccccttatcgtcgtctagggtatgcctactagttctcttcgccaactggggttttgattccgccttcgctcgttttccagcttcggtgtcgacctcattcacttgtttatctgcatccggtctccggttgtctcccgtttcccgaccactccttccttccgagtgctcattcatatcttccttctctgcgagggagaacatgcgatcccactgaagaacttctgccatatgcttgagttgttgttgttggaggcgaaattcattgtcgctatgcgcctgttcctcttgggcagcgagtgcctccgctttcgcctttttcgcttgagccacacttttcaactccttggcgaccttctttgccagagtggctctctggaaaacctctgcaggttcaggactcgactcttgcaagcgaggaaggtctgcgtttctctcagaattgacattcgcccgcatatctctgttcatgcagtcaacactacagtagtcactatacttccccgtccatgatagccaggcatccttcttacacatcttgcaatacggccgagctattgatggattgtattccgccccagccggagttacatcctccagtatatagtcgaagaacgtttgcatcgttgctacctctactaaaatgaacaaagtggcaaacgccgcggagccagctcaatccaccagataaccacataaacacttcctgaggatcaagcactgcacagtggttttttctgtgacaacgcaaagagatagcttgacgatcgcttcattcggcggcatgggcagaccctcacattaccacttgcgcgcacctttatcatgtaaggacgatgggcagcttcaatcttgtcgtggataacaccgcactatgatgcttttttcccaggacttccagtctgcagagtgactgctttcaaatgggccatctgctagcatctcacgttgtttgaaggaggaaccgatatccgcctgcaagagtactgcgggaagccactaccggacaagtgtcctttggcatgtttttcgtccgagcaaacagcttaaacgtgtggaaaaaacgcgggcgcctcgtcgtcacgcattgcaccttctgggtgtcgcttgtgacacagttgtctttgttgcgacggacggagatgttcacttccatacgggcaaagcccccatcaaacgacaacgtgccagggagttgctttcttctggtgccttgaacagtcaaaacgagtttctgctgcgaggtcaatgggccgtagccgccttataggtccaccggaacgatggatctctccgccagcggatcactcgcgacgagcgggagtgccagctgctagacatctaacctctaacctcgggatggtccggtcattgtgaaaaaaggcacctcaacacaacactatcttcttcccgctacagcatgctcgtgaaacagatttgttttatagaataagtttaacaccgcagatatcaccacgagagaatcgtgcgactttcgtggttgataacagctgacctgtgcgatgtcacgagctaggttcgcactcgcgtcgaccggtccacgtccacgtccctcctggaccaccggtcaccaggatgcttgtctcgataataagactgttgtcgtgaaaccatgatcgggctgacaaacttccctgtcgcctttctctgaaacgacgttaacatgggccaagaatgcgaatacggtgcccgtgcgtgtgctaaatcttcagccttatggtaaagcgatcgccactactgcaattttgggtgtcccgtcaccccatcggtatgtataatggtgtgttcctgtatgagaattaatctggtgcccaaattcgccccatcactgcggttgctggcatgagtcacaagaactcctttggtaaaatgccgacaatctgtcgtgtgtcggtgtgacagcatgataacatcaggcaaaagccgcccttataagctaaactatgttctatgacactttttcacgagaagcttccaccacagcaccgtcgctaaagttttggaaaacgcctcgtgcatatagagtccgaagcactgcgcaatccatgttgtttagtcgacaaaatgtatcatgaatgctgagatcacgtaagacgaacgacatccagcggcgaagacgccgctcgtttcaacaaggcgcacatctaccagtcagtgcactactgctaagtgacggcatatccctccgatgttttcctctgtatcttactcgttttgcatcttctgctgcaaatctatcagctcacatgtccatgatcaattccacttatcaaaattttcacattgttataatatgccagttggattcctcctcttctacgtgtggttacgatgattgctgccaccagcacaaaacgaccgtgcgtgggagctgaaagaaacttcaggaaatccttgactcttgaggattgtttctccatccaacggtcaggacattgtctcggccttccagtcagtaaatttgctacatgctgctcgctgaaaacgggccgacttctcctcaagctgttgtttaatacatgctgatattggtggtaaggctggttcctgggaggttggatcctgtagaaaggaattacccggacccaataaagtgtgtcggatgacgcctcagacagtaatgttgtatattcaaggaaactgccaacagcgtactactgaccgcccatctcggacacctgacagcataccataccgtgggcgtgccctgagcgctgtcacactcgtgcgtggcaggatgctcctcaccgtctcataatccccacaaaatattccttgaaacacctaaaactgcaaaagcggtgtcgtacctgcagcattgagcgcagctcaaagtagtactttgcgtatgttgacggcttgacgacgacctcaaaatggagcaatgaaagaaacgctgcctccattttgttcacttcttcaacggtaaaaaacggatacagatacgcgaacgacgcgttcgttagcacttggtcgtcccacactttctgcacacacaaaaactcgcgcctgcaacatgtccaacttctaaccagcagtttcatcgctacacgtggcttcttcgcttagccgctgaattaaaaatgacgcacctgagcgactattaaagctgtaaagacgagcggcctccagttcgaagcgcgaagaggcattccggagaaagcgatcagacggtttatgaagaggagggcaaggacattgcattctggagagtattccgccgcctcgtacagcacgccaatgaagtctcgaatctcctcaacagttggacaaggttcgccctgatgcttcgcaatggaggccctcatctctgtctcgccggagttgcctgaaggtaaatatgccaaacctcaggaacgcggctgccactcaggacaaacgctcactcaccatctaacgaaatgagtcacatactgtgaattgttccgttccgactgacaagatatacaggcaagccttcagcgggtttttacatagctgagagcagatgaggaatcatcgcaacgattcacatgcgtgctgacgttctacaactgagtttcaacacattttcatgcctattcggaagggccgacggactccatgatcttactgtcgcagtacgcgtcttcatcgaaaactctccattcgggtttctcctcaacggcacgcttctccatatcgaccgaaatctgatcttgaagtatggccgcgactgcagtgatcatcttctgaacgtttggctgagaaactgtagaggtcagcatccagttactgttatcggtcatactaagtctgtccccgctggcagggagtgggggaacgctatcctcagccataccgtgtaacggaaaatgtcactatcagtggtggtcccgggtctcggtaagtgggtaaaactcaaaaaatgtagcaaagaagccgcctccagccacaggcgtcaacgagggcggaacaacccccttgagaaagattattccaaaaagcgacagtgtgaatgagggacctgccgtccctaccaacaatctattgtacttccccggagctgatggccctcccatttaccagtgaggttcagtctacaagcaacacagcgtcatccttatattgccaaaaacaacagcaagatattagttttgctctaactgcttacaccccgactacttcagcaaataacgcacatttccggtgctgcgatggctcccaactgcatgtctgtcttttcttttgctgtccatacttggccgtgccacgagggtggggggcggaaaagggagcaagtgagctgtgtgttctgctggcgtatcagagacgccaagctacgctgcctcacctgtggtcacatcatggcgaatagagtctgcttctaatggccattgacagagctgtttgtctttttcagccttccaatgaaatgtggctcgaagcgaagttgaaccccgcacggtccagccagtgtctgtacagcgtgtggtacccgcggcacgggagctgtgcaatctggaatcgtacccaagcctactaacactttcgaatgaggaaggccatttaaactgcagtacccttttcaaacctccaaccctgtcagcgacca

SEQ ID NO: 878 - DNA, 1511 bp, Toxoplasma gondii
ctcgtccgacatgcttccactttccgcgtagctttggacaaagtcggaggttcgacagacgtcggcggaagcggcgtgaaggcgacagttaaggcgaactccgacggcgagatgttaaacaacgaagcaaacgagaaggggaatgcggtcgtttccaacatagaacaacctgcgaagacagctccgtggccagacgaatgggcctgtgggtgtcctgtgggctttggaactacctcctgcaagcatggatgactggcgcgttacaggacacatgctggccatgcttctacgcacaaagagctgaagaaagcatgtgtacggggaggaggaatgcttgcaaatcttgccttgtgtgtctcaggaattcgggtggagtcttaatcggcaaatatgttcggtaaatcgtttgagagttctcctaagacatatttatgtgtgactgccttattgggtggcgacataggatcccgattgatgctaaagatccgtgtaggatgctgtcacaccgcgcaggtctgcttccgcctcttgcagatacgcttcgatattcggaatttcttttaggggattcgcacatacgttcgaaatagaggccggagcgaatgtgcacggatcaacgggccgcctgtcgtgacgaaaaccgctcttagtttcgctggacgacgacgctgatgagacgcagacgccgagaggggggctggaaccaaaccctttagccgcggaatgaggagctccacttttcctttccaaaagcggtgaatgtgcagcccttaggctctggatgactttcacgagtagaggacggtgagccgaaaaaagtctttccccagtaaccactgtcagcgctttgggattctgacggatgggaccggtgggctccagtcagcagccaatgaggcttcctacgtcttcgagggagcgcgaagttcgatagtgtgtggatcgacgcaaatttatcggagaaagaagcacgtccgccaaagagaagttcggtgtcttgcgcgcttgccgaagcaacggttttccccaaggtcaacgagccacgaatccctggtggtgcagaagaaaataccgccgagaaggcagacggccgatgctttgcccaacgggaaaagcgagcgactctgtgacaaccacaaatgaggaagcgaagcggttctttagtgacacccgacactcatgatgtccgttagtcgacacggtcctacacgcgacgaaacgtgcactgaagggcaagcgccgccgaatacagaaactgtatcgcaatgcagagaactaagaagccatacattcgaacgggtttctacctcgaggaatgcacggcaatctagatctgtggagaatttgcctaacaactctgacgtcagccgcggagacgcgacaggatgtcttcacgcatgcaaccgactgttcacacgaaaaaaaacgacagcgttaaacgcgccgagtgcttagcttccgctttcttccacagactccttctctacccatttgcagtgccttttactgta

SEQ ID NO: 879 - DNA, 2200 bp, Toxoplasma gondii
cagcaaattataggtcactgacgagagcctcatagcggtaagatgacagctgatgctggtctgcgtcgacatgtaacaggagcagtgagtaaattggtcagcggattcacggaatattctcgtatcggattttttcggtgtggcacttgcttagtaactcgaacacgggctgtgccaggcatgtatcagtaatgctcgacgtcctctatagtttgaccactacaatcggaaatgttggacgacagaagggcgatggaacttcttttaatcccgcaaaacgggactgcaaatacccgtcggggacggtgtggagtggcagcaaaaagagccatttgaccggatctcttttcgacagcagcttcactcccgtttccaatggcaccgtacggaaaatgaatcaaacaacaactgagattacagttcctggatacagcgtgaaaaggggttcctgggctcgaagaattaaagaccttcttgtgccgcggtataaaagtcgagagttggactacgggttaagtctttcagagtctttgattgttccaacttcctcgccttccttgtcgaacatcagtgtgacgttgaaggaggaacaaagtcggatctttgcatgttttttatactatgagttcgactcttcgtatagatcttgaaggtgggtgtctgatcgaagtggctatacatgttcggtgtttttgtgatgaggggcgaaaggactgcgttgtcccgtagatgttggagcttgggatggccctacagttgcagatttcgctgttcagaggaaaaagttccgtcgcttgtcctgcatcttatgccagagaaagatactatcacggctctgttccagtacgaagagcgtcgcaacattgtgatgatgacgtcgacaaacattcacgagttagaaagcaacccttcgtcttcccggaggagtgcagtggaatacctaggcgaacgcagtgacaaaacaggagacgcttccgggtggaaaagcatggatcagcgtgaggcagatctgtcttgtcgatcgtccggaagtcaactgtgcttttagtgccttcatcagtcgggtgctcacagaacggctaggccgtccattagtgtctcttttttgttgcaggctccttcagctgcatgtccttctcagacacaagtctcttctctccgtgacaaaacagaatctcctccgtacacttcatagagccactgccctttcgcgccaacaaccgcttcgggttagttcactgtcggttctcggtgtggcgttcttccacgaccccgtgacttgtttctcgaagcagtctgggagatccaaattcgcatttttcgcagtgcctgtcgaatttcggaatcgctagacgggcgtgctgcgtctctgaatcccgaccctcttcgtctctggatcttatctcggtgcacatctcggctgctctctcgtctctctactctccagcgccgctgtttgcatgcgcgaggtaacgtcgcttttgtagtgccgccgatgcgttcctgcagaacgtatcgcgtccgctttccctttctccggaaaaactgcgtggcagccgcctctctgtctgcatttgtcgcgagcaaggaaaaaagactagaagatccagctttctcttcagagagaagggccgtgtgccggcacaggtaccgctgcctctctcgtctctagttgggtgtcgatgtcgctcggtagaaaggcaaatgttcgcagcggagttcctcagtagatgctgggattttctcgagcgtcatttcattgttatctcgtgcttttcatctgagtaaagcccccgggtttcgcgtcgtctcacccagaaaacggctgtcgagcgcatttacgaccaccgcctgcggtgctcgcgataatggagaaggtccttttgcgtccgtaacgcgattaaacgcaagggtattccagggaagactcatgagaagctttcgaacgttgtcgtgcctcctttcgcctctggtttcccggagagacggccttcgtcagcggggctcctcgtcatggttctgctgagttcccttgtcgctctcgggcttcctgcgtctttctcggagcatgacccgacggcgtaaggcggaaatttgctctcagttccagttctcttgtgtgtttcatggtcaccatgttaagtccgatcgtttagtggcatccagcgtagctccgttcccgtctgtcctaagtccaaca

SEQ ID NO: 880 - DNA, 3643 bp, Toxoplasma gondii
ctgttttgtagaattcgagaattcgttcagagcgattcagagagttactggcggtcgtgtcagacacgcgcggccattctcagccgtaccaactcgacgactcacctcagggacgacgacaatctttcatggagtgtgcgtttcaccgcggaagaggtgtgtgcttctggatacaacctgccgtttcttcccgcggagtttcgtctgctgtgggtggatatgcaggaagatgcgagaaagagggagaaacagagaaactcgcctttttcgcgtcttctcgtgggaagcagagggaacagagtgttttttcttccagagaggagagactccgcagggagaactcatttttctcggatagtgaggcagaggaagatctccagttgatgccgtaatggaggcttttcccggaactggttccgtcctttttttctcgagaaaaaccatgctttcggtcggtaccggaattcagaaatcgacttttggcctgggaccgcctcaaggtcacaagccggcaatgggggggtttctctccgtccacacaagcacatttgggattttctcgcgttgcaactgacaaatcgttatccccgacaaatgagttgcaaggatccagtgctttcgttttcgctgctattttcagctgaaaccgaccccagttgtacgcggcacgagcgtcttgacatgagaaaaaagttttctctcgctgttaatacgagtgattaccctaattcatatattatgcctagaacataaccgatatggagtaacctcagtgtcgtaggatgctgaaatccaacagttcgcgccaccccgaatagtgtcttgcagcgagcacattatgttttttacttgagagtatagagtccacgagttggactgccggcttaggtcgtgaaggtttttcgttaccgaatgcaacttcctttgtgtcagcatggtgtcaagaactttccggttaccatcgagacgtacaggagccgactgccgggactccggagggtgtacctgcggaaagctttgcttacgatgatcacgtggttgagccttgacaccacaatggaggtactgccagacaatgacagtcacaatccggagaagggttacgtagtcccgatactgatcaacaccaagttgacttccaggtttaactgtgtaaatattacattgagagcatcggaagcagaggcacacaggctcaccagggccgggccggggaactgtcgctacaggataaaccagagattccggagtaagcgttttgggctcgtatctgcaaagcagctgtgttttccgacgtagaacggctactttcgccctcaagagagacccgtatcacggtagcgactgaatacctatttcatcttggtgtttcagggccgtcaatcgtcagacatacagcaactgtcttgcattttccagatcgtgaaggcctgcacggcactcctcattttgttattcccggatccggaacgggttgtgttacctaggacactctctgtgtcggcatcgaccgcgcgcgaggcgaggcatttttcgctttggctgagtattacgcgacgcagacccaaaacgggaacgaccgactgaagaggccgcctgtgccccggcggccgacatacacatcgagaacggacacacttgcagcatgtggcaaaaacacgtcggaaagcaggattcgttgcgcaagttcacgcgataaacaagttctcggttttctcctccttttacccacgccactttcttcgagtggatcatgcgggagatccccactttttcgtgaaaggatcagcaggtgacctcgccggcgtcgtcgcaccctttttgtgggttcataaaccgattttctgaatctgtctctggatcttgtcgtgtctgtgtgtttgctggggaaacgaccaggaaacgagctgggaaccccgtggctgtctgccgttattacctttcagcggaaaccactgccacacacacacgcggccgacgccgactgctgctcgacaggcacggtatctccgatctgtccacagtgtgtggtcagtgcccccccccctccgtttgaggaactgcttttccagccgttggctgcaggcgtttgctcccccacgactagtggaaaaagttaggtttccctagactcaccttggtcactcgctcttcatcaggactggcatatcgtcgttctccggaccgttttcttgcgtgtctcctcgtttcctgaaacagtccgagagaaaacgacctgggaaggtacacagaaaaacgggggggctgcgatcgcgggctccacacctgtatttctgcgttgcctggtgcactgccacgacgttcgtccaacggcatcgaacacctggttttccacgcggaaaagcaaggacggatcgctcccggtgtcgacgattgcgcctgagcaaaagtttttccgtgtttctgccgaaagccggaaggaaagagcggaagcaaacgcacccgacagagacgacacacagcgcccgccgcgcaacagcagacgggtgcggcgaggacgatcctagtgtctcccaggaaggcgttgaacgtctctggagcgtcccacgggagtcgccagtgggttttccaagatttcttgcctttgtggaggcttcccagggaaaggatctgcgttccactcccgggatccgagccacaaccagacgctatggtgtggaagcgacacgattgacgcgacaggcgaaaacgtggacgcgcgtgcgtgcaggcgacccccggctgcctcgagttgtgtctgtgtgtcttctcggagagaatccgcggctctggaggcatccgaatccacacaatggcgagaccccagttctaggaagcaccgcaaaccgtccgcgagacaacttccccgcggcctgcaggcgccaggacgcagattgccgcccacgcccgaactcgaccgagagaggcgtgagaagctggatagaagggtcctgggaaaaaaggaatctcgtccgccgctctggggacaaaccccgttcggattcgggaatgtgtgtctagatcgaagcgcggaccgcctcccgcccagactgcgcgtggcgggttggggacccgctgttccgaaatcagagttaccggccacactcacagaatcaaatgagaggaatctgaaggactcgcacgacggcccaggtccctgggagactcctgtcgaagcccgtcggctgggagcctcgtcgatctggtgagaaaaaagctggaacggtcgggaaactcgaagcggaactgcgaagtcgcagggaatgcacgacggaagaaaagacccgcgggagtggctgacccatcgtctttctgccaccgagaactgtctgactggcgaagtctgattctccgttccaccactgaagggaagtcatttttttatcttctacggcgacgcaccgttgcacagcggtcttagtacagcgtttctctactccacgtcaaacctattggactctagagcgccgtgaaggtgctccgagaacgagggattccctgcgctctttgcagacttttctgcggccctctcatggccaaagccttctcccgcagcagcccctgactttgtccgcaggaactcagcgagttcgagtccggtggtagaactgaacgtctgcacgagtcgtctgaaacgccgaaa

SEQ ID NO: 881 - DNA, 2139 bp, Toxoplasma gondii
ggaagaagacagtgaagcgctggacagattgcctctttgaggcgacgggggcaggctttcggggagaagccggaggagaggagagcggaagccacagacgagacaccctgcccggcagcaggggaggcgacgaaacggagaagagacagagagaggccgtcaagacggtcggaggaagagatgaggaaggagatggaaaagaaaggacggaagggaggagaagtcagccagggtgaaaggaagagcagtcgagccaagaggccagtcaaaaaaagatagaacatggagatgtttatacggattggactgtgtacatcctagcgtcgggatggagggacgaaacagtctcaacgatctacgcacgaagacgctgcgttcatttttcgggtgtatggacacctgaacacgcatgcttttctgcccgtttttttatccgttcgtttattcaccattttcacatgatgcacaccactttgcgcgcagcggaagaaattcgcagagaaacgcggcttcgctgcctgcgggctgtggtctgtttcgcgtattcacgttccgctgtgtttttcgaggatacgtctgtgtatgttcctgagtacgcgaaggaacgcaggcaaagcgcgtcgtctcttccggctcctgatccgtcacaagacggggagcagatgcggcggggagggacactgacaagcggagagcgacagtggagatggcaaagaagaccttcagagaacggaccgaagaaaaggagttcgtgtgtgacagcgagctgaagcgttcaggcgccagtttccaactggcgtgaatgcatcccctcaaaaattccaaaaaggagggaagctgggtcgtgctttccgaggattttcggctcttctgcagacaagggtcgagagacaagtcaggatggaaagcgacttggggagttgacaagtcgttgcgtgtgtcgtaccccagcaacgcgatagctggcgcctcagaggagttcacgagacaccgttttcggaatcgcgtgaaattcctggaaaagtggagagaaaccctacccccgaaaacgcgcaaagacggggaagcgcgtggaactcccgcaacagggaaaagcgatccggaaacgcgagaaacgcagctgcatgtttgcatgaggcggcgcaaatcctaaacgctaaaccatctcggtagtacatccacctgaggcctgtcggaccgcgacgcttgtccgtgcacaccggaaaacaatactctttcgcctcatcaaaagtccgttcttcgcgagttcttcgcggagtctccactggagagagtccggaagagggacgaaaccagcaggttcgccagacgcggagctaaccgtgaaaaaggcccccgattcccaagaagaagcgcgatttcgcgcaagagaaactgcacagcgcgttcttggaatcgacgggcgaacgttctgacggcaaacggaaggcaaatgaggcactttttctcgaacaatctcatcttcttcttcaactcgggacgaaaaactccctcgtggagagaccctgtaaaagttcgttttctctgagggcagacagcaaggcggagagttacggagagacggagacatatctgcgcgccgccgactgatacccagcgcgtctgttctacatgtgaaccacgaaaacatctttttcttgatgaaggatgcttttttttctttttgtggaggtcttgtccttcgtgtacgcgctctggagtcggcgaaatctccatcttccaagagtgaggaacacagaggccatgtccgcttgaatgcacgaccagagacggcaaaggcgtgagagtttaacgagccttgattctctcagtttccttccctcagcttttctttcgttctctcttcttgtgcctcttttcgcgctgcctcgccatcgcactccagaaaacatgagatgtcctccctgtctccagaggggaacaacacaacgcatgcgcgaagagttacacgaggccctgcacaagagtccaggctccagagaagccattcattcacttatacatgtttgtatattcgtatctgagcaggcgcagttttgtattcgtatatggatatttggatatctgcatgcggctccgaatcctgatgaaatgtgtgtttcggtgcatgcgaggtga

SEQ ID NO: 882 - DNA, 4195 bp, Toxoplasma gondii
gtcttgagcggtgacaagcatggcttcgtagcaccgagcgagaagcatccaggtggcggggtcctcttcgttcgcttccgcggccttcttcagctcctgccgcgcgcgctggtaaagccttaagcacgccgcaagacctgcgccccctgcgtcccctttcccgccgtctccccccttgcctgtctccttcccccgctcgacctcttcgacccacaggccactttgctcggcctcggcgagcagtgcgaagcccatgaggcggtgaacttcgaagttctgcggcagcatgcgcaacaaactctcgagaagggcctgtgcctctttgatgcggtccacgccgccaagcaaaaggagacactgcgcaagtcgaaagaccgtcgccggatgctgcggccgcagctgttgcgcgcgctgtagctccgctacggctcgccaggtctggccctgaagctggagcagccagccgttgaggtagcgctgttcggcgaggaggtcgagggagaatggcgggggttgggcggcgcgaaggaggccctcagcctggcgcaggtctccgccaaggagagagcgtgcggcgagctggaggagaacggaggcgtcactgggcgagcagcggtgtgcggccagaagcagctgctgctgatcctcgtgctgggacccgcccgcgggaagaagcagcgccaggccacacagtgctccttggtgggtagggtcgattgaggccgctcgctggaaggcccggcgagcttcagcgtgtcgagacaaacgcagaaaacacatgcctgccgcgaagcggagatctgccccgtatcgtcggggacagaagcccgcggtaccctttccggagtgggctgcctccgctgtaggggaatcagatgctccggaagacgcgaggattttcgccatgatggggtccgaaacacaagcagcctcaaccggaggcactggcgagtacgcgatcaagcgacagtagtacacaagtgcatcttcccaccggcgctcgtagactgcgcagctcgcaagcccgagaagcggcgctgcatgcagcggcgtgtggacagccgcgaggcgaaagagctcctcggcacctcgcacctccgctgcactctgtcgctggagcattccctgctcctgctgcaacccagcataggccacctgaggcccccgggtgccgtccttcgccccagatccggacggcgtcggagtccccaaccttcttgtagatcccagagatccgggcactcctcgagaagcctcacccgagcctggggcgggggtcaagcctgccgggttgccagagggtgggtttgcggcgttaacgttgagaaggagggccttcgcgatcttcaggaacgccccgctgttgaccgagagaaggttcgggtctttacgcatgaggagcgggacgtcgacgccccctcccttcttgcgcgaggcctcaggcagccccgcagccgcctcggatttctgtctccactcttcactcttgaggagttcctcgtggcgggtgacttggtcgcgcgccctcagcgctgcatgcgtgtggtgggccgccatggccgcgtccacgaggacgcgccagtctccgtcccatgctgcgcggtcgccttcaggctcccggacttcgtctttcgcgtctgtgccctcgccggaggactggagggagccacgatgaagccgcgaggcgggacttggtgcgggtggcagctccgtcagcggctggttcgatatgtcgttgttcgagtacagtacggtgttggcgcagtagtcggcatcttggagaatcgagaggaaggaagaggcgttatggttcgcatggaagtgaagcgcgcagtccagccagtggtgcagcacacagacttcacgcttgagcatctcgccgatcaaccgacactccgactcgtcttcaaacacagagggccccggagcaccaggttcgcgtgagccggccgcctgcccagcctgccgagatggagacaccgccagatccgcgggcggagctgctggaagaatcacatgcgtgttggtgtctttgatgggcagatagagcagctcgccggcactggaagatctgccctggcgatggcgcaccatggaaaaagcggcttcttccatcttggcgtctagctcctgggagcgccgagagatgccgaggcggtagaaacggagaggcgatgtacaaaaatgtagggtaatcgtgaacagaaagaacctggagcggctgcacgcagccgacagcttactcgtccatatcggaaacctcactccatcttctccgctgcccactctcggttcggcggccccgctttacgtgaaacggggctttccctacaacgtttctcaaaggtgtttgaggtaaccgacgccttggtggggacaacaaatacgggggagacaatgcctgactcaggaaactgcaacgcgttttgtccttttcgtcgcggtctcaatctgatttacgagtgaaaaagaaaaacactgtgggaggaataagcacatgagttagccacaactccgaagacgaaagtgtgtagtgtcttcggaagagtcagtgaagcgggatacaggaggagaaagtcataaatctgtggagagaggaagacgatgaccggccaccacgcacacttctggggggcgacggtgttagaaaggcagatcgaaacaacggaggcatttgcggctcagcagaagccgttgtaaattgcaaacaagggaacgtattcggcgcgaatcgaatgaatccggaaaaactcagtgatggaggatacagtggtttgggaaaggcctctgcccccctgtagcaacatgtggagacgctgcgcaaatccagccccagctgaacagaagcggaaggcgacacgcatatcctatgacgcacaacgttctcaactcaaaaaaaaagtattggcaaaggtgaagaaaacagacataattccacagaaatccgcaaacggggcgccccgtcactgccgttctctggtctaccgctctggcgatgccagtgcggagcgtccccacgaacaactagattaagcgaacaaaacacggaacggtcttgacgaacagtttccagatcaagaagaataaaagcgaagaccagtaaacaacgcgcaggtgtaacattctcgattgcctcgcaagttcgcagcgcctctccccctcccagacgctgtgacctgctgtgctgcttctttgcgaagagagtcagcctagtatccgtgttaaggcccatcatattgcgtggactcgtcgatgcgaattcaatgagaaatgcgttatgttctcgaatgttttctattgaaaagcttacaggttgcagccgaagagtcttcgccgatgcatcgcacatgtcgtaaaagacatccaatacgcttacccgtcattgtaagcacattttccgcattggattggctgcgacgggttccatgtctcttctattaatgatacgctctcagcgtgaagggccgaggagcgacactccagctcgttgtggccagacatcgacggacgcacggacctcgctacagagattgttgaatgcgttcaagtgtgtataggtgtatagggttttgcttacatactgtatgcgttcacgcatgcgtggttgttctcaaccccgaagcaagcgaacatcgagagaagcgcggtgcgtcttggcgggacctgcactgataagaggaagacagcggtctttcctatcaaacagtcgctggccgctgacgtccgaactcgaaacaggtctgatttcagttgtgctgaaggctctggtagcaaatcgagggcttatttgacagcggggcactttcagtgacgcagactgccctccatcgattcttcgctatacatctcccactctctcccgcgttcttccttctggaaactgcagttcagtccaagctgcgattcccttctctctcaacaacttgtatgctgcgagtcaactgatgtttcgagagagaaccttgtgtaagcctatcacagcggtaaatcacacacgtccgcgtttccactaaaagccaggaaatattaagcaccgctttttgttgcagatgacgtctcattgtccttcttgctgcatctcagaattgcggtattccctggaacgacccggactcgctgaacaccacccgcttgcccgattattgccgccggtctttagctgaattgcgtccaaagagtccgagcgtgaccaaga

SEQ ID NO: 883 - DNA, 1213 bp, Toxoplasma gondii
caagggtgtgtagcctccagacgagtacttgtagctgtgcaaattttttagccccagagggggaatgtagtgtccaaacaccatctcggcggttcggtgaaggactgaacacgaaggacaggcgcgcggaggcagcggaaacgaaacagaggacgatctggggggacgcagcaacggtcacatccacccctcgtttctccccgcggcgcctctacaggcagtagggcgtcttcttcgatgaagagtcaacaacagggccgcttcttctcagcaccgaaggcagtgcacgcagaggcttgaaatctagacaggtgaacgtttgccggagtggaggggaggacagggactggacttgtcgctattcacgaaaccccgcgaaggagtgcgctgttcgtcgactggcacaagcgacaccggttcgacttcccgtttgtcggtacagcagagttcactcaacggcgaacgcctgctcagcaacaagggggaggaaattgtccaggaaggccccgcccctttgacgccgtgctccacggtttcttaacacaaggcagatgggactacacgacgacccaacgcagagcgataggagaaatcatacatgtggccaggtcacgaagaaagagatgaggcaggctcacagtccgactgggggtctgcgagctatcgagcctcttcaacttagcagagagaagtcaaaggaattcacagagtctcctacagtagcatgcttgcatcgggcaggaaacaattgacactggaaaagatcgaacaggacacccccgtcagagaaaaactgtcagaaccacccggagaatgtcgaacccatgccgcacacaaaaagtgacctagaatttcgcagaagggaagaaccaccgcgacaaacagagggccgcatatttatgatggacgaataccgagacgataaaaacaaaagaaacacgcggtctccccgagaccacggaaatggggaaagagaagggcggcaattcacgggacgagttcggcgaccgcacatgcactcgaagcgtgagtttctgaaagaaagaaaagcgcagcgcttctcaccctgaaacaaattctacttcggaaaatggtgtggaagaaagccgggatgccaggaagcttgtggcacacacgaccctatgcagcgcgtgaagcaaaaaagtcttgtcctgctgcagaaagtacagagagcgacgcagaaaaaaacaca

SEQ ID NO: 884 - DNA, 2923 bp, Toxoplasma gondii
aaaaaggagattctgcgtttccacaatggaattcctggtctccatcacactttggggacacggaacacaattcccaagaaacatctgccgtgacaagaccatttgcttacactgcagaaaatctgatattttctcgccggggctgccttgcagtttgtgcacgaagtggaatgcaccaggcccgcctgggacagtttttccgtgaggttgtcactcgccgggctgagcgccgtcgcctctcgcgatgttttcccgccagtcgcctcagaaaactctcgctgtccgacgacgccgaaacccagcgactgcatccagaaagaggcccttcttgccgaagaaaagattccgccttcagagtcagcaccgtactcccccaggagtggcagcgtagcacggatggaaagccaactgcagcgactgcggcaagaagcacccgcggtgcagttcagatgtgttctccgtcggcagtttgtcgttcttgtttccgcgtcggtcttcgctacgctgcccgtggcaagatcagggaggcaaccgctaaatcgaagccctccccgccgtggccagccgcttaccaagctctgtgcgtgtgaactcatagatgcggcgcagctagcgctttcgctaagaaaggacacattccgtgtcgactcagaatcgacggcagaacgcctgcacaaaaacaaaagaaccccgaatcagtcagtggtaaacccccagtcactccattgacgcacatttgggcatgcgtggacatggttaaagtgcacacactataaaggcgcgcctttcaaacagacccccggcgaatgacggagacaaaactcaggatgttataaagcacaatgttgcttccagtgacttgcaacgctcgggtttatcgctgagagttctgcgccactttggaaccgaaaacaagtggcagggcaagaaagatcgagcagaggtcactcggagccagcagcaccccgtgatccctctacggcttatagacacccgagacagagtcctgtttgccagtctgacaccatgtctcggctcagacttggtccgctgaccccatgcaaaaccaccgatgcccattacgccgcagccacacacaatccatgagaaaactgaaggacgacaaggcgtcgcgacacagtatatattccccaggtcgtgcaagaggttcctaagaattccgtctgcccccaggaccaacgaccactgcatcgtcctgcgtcggcccgggttcgaacacttacaatgttcggaggctgcacgctcgatggcctccacgagtgctacggtgcgcaccaacgatcgcttccggcgcttgtgaaggtagagaacggttttcgccgttgggtttagagcgtcgttgagtgcggaaagagacacagggagcagctgttccagcagcacaacacggaaccggatgccccatcggccgtaaaattgcacccgctaggcactgctttagtagtacatcactacgtagagaagatgaggaagccataatgaaaccgggaaacgacatcagccggagaggagggtgtggtaaatcagcggaccacctctgcgtcgccaggaacagtaaaaactgtgtgacagccggtcaagaacactgcacctctaggttgaccaacagtatctcgaagtcgaatgaagcaacaccggatttacgttctttcgcagacatcgaccgcttctactccgacgctgaggccgctaactgctcaagcggccggtgttggtacacgtggagaggtgcccagctctccttgtaggccactgcctgccgacaaaattggattcggcgagtacagtgctggtatcgtatgttgttaaacagagacgaaacggaaaagtagcagattcctgagctaccacactcgacagtcccctggggaccacgcgcatgctcgatgacccgtggccgcgctgtcgcacagggtacgctgtgtagaacacgtaacatcgtttttcttcagacaaacggcagcatccattaccgcaaaaacaagagagacaaaatgtggcaaagctccactggaaagactagcgcgatggcgcaactgcgctataagaccccacaagaacctcctttacgaggaaccgcggagactccctggcacacgcagcagcgtcctcaactacagactcgaatatccctttcaagcgaaacttgatcgtccttcctggactcttctgcgacacaagaaacagcgtctgttccaaacaaagcgtaccacaggcattcccttctttccggcaatgcaagtgtcctgccggtatggcgccggagacgcgccgcctagccaaagcgcacgcacaagcatcgaacacgaagtagcgaggcccgtttgacagcatgccaaagggcggaattcgctcaggctgtaaaagaaggatgtgtataataatggactgcgtacaacagtggttctgacagcttcggcaggtttatctgttgaccagtggcgtacccggcgtcgcgggtcttgctgtgtcaaaaaattactgcgaggaacgagcaattcagcgttcagtgatgataacgcgtctcctggttgatgatgcggcagataacctttgtgcacataaaacagctctgcgagtgactagtcttaacaaaaagaaccaccgaatcttactgatgtggaagaatgaaaagaagacgcagggaaaagaagaaaatagcggtgtgcaaatgtatgggtcaacactctacgcaccagcggcaaaggggctttggacattgttgcgacccgcggtcaagcgacagctcgtctggcacgttctttgaatctgttcccctgcgtggctcttgtctccccagccgccacatgcgatgatggcatttttgcattgatgttcttttttggaccagaaatgcagacgatctgcggtttgtggcattgggggtaagggaagataacca

SEQ ID NO: 885 - DNA, 2532 bp, Toxoplasma gondii
agaaactcgctcctcataatacatcgtttcgcttgcgtgttctattcatttaatctcggtcgtttcagtacagaactggggtgcgggagacagagtgaaaaatctgtacaaacgtttgctctcaagcacaccacggcaccgttgggtggttttccgctgctggtggggaagagacctcaaaaatcccgtccttctggagatacggatgaacgcagaaggaaaatgtggcacccagcagcacactgaatgagtggccgcggcttcgcttcgataaatacgaaccggataccgaccggtctgtttgtactttgctcctcgttacccaatgtacgaactcatcggacggttgcggtcggacgagtgggaaagcggtaaacataaaaccactgccggaacacaaggaaataaccgaatatatatatatatatatgtatatatatatatatatgtatatatatgtatatatatatatatatatatatagcaggtgcccgctcgaaaagcgcttcatcaaagtgtcaggtcttagaaaattaacgactgggagaccgaatgaggaaattttgtggtatctatcggtttacacagacgtgtatacactcgcactgtgcctgacttgaatgctgtagacgttggtgtctaacaaggtagaacgcgtggtttcggtggaaaggtcatgttctaagctaaatgttggccatatgtatggatagcccatgtggatcgttctgctctgcgggtcttcaattcagtatctcatgtcttttcggtctttccttggaaagcagtgtatactcagtgtgaccagggtgaatcaccgggggaaaaaacctaaaatgagtttgttttcttgctgacgatcggaatcatgtggagctgggtcgagacagctgtccctcgtgctatcggcctgcgccctccccccgcccgacacgcatctctatctcttttgtgtgttcagtaggcgacgtggtgagtagtctgcagcggaacccgagtttgtcgttctttcttctgaagaaaaaagtcagctttgtgttcgcatttccttcccgctagaagacacacttggtgtaaaaccaagactgtgccggggtagctgcagcacaacggtgccttttgaacaatcttttttgacctattctacccgcgatgggtgaaagcggaagtgtctgttttgccttccagcttcctctctacaacctctggatgctgtgtagacaggacggggtctgaacagcgatttgtgccactctctcgaacgcaagcgtttggatacgaagcaaagtatgggatccaatttgctgacaaccgttccctcctcgagagatgtgtcgccgaactgcagatgttgttccccgtccctattaaatagtatctattgacaattgttccaagaagaggaaagaactgcaaaagatgtcttcaccttgaggcaaaaggcaacacgttttagaagcccggaagtgaaacgcacacctccagtgcgatgctccagctgctccgccgaaaacaaggcgcagccaaactgcagcacaggcttggtttactgtcagatcgatggcgctctagaagatcttcatactattttttttctgacgttgttgtgtcgtagaacgggccttgttcctgtttaggattccaggtctgtttagggacgcatacacgcattgcttaaagtgttctgaaacactctcgcctgcggcccgtcttgttttcagcactctctgctgtgccccagagcaacaataactgtacggccatggtttttgtctcgaacagtggagttcccgcggtctccactagagcgatttggcctttgagaggaagtgggcgcctccgccgtcggtttccactttctgcggtggaattgtggcactatatgagaggatagcttgttttcgggcgtttttcgactctgccggttttctcgtttcgcttttggtttgcacatcttgttctgcagaccgtccctgttgaggattccggtccatggctttcgatctaaatgcgttttttgttcaaaaacagattttttgcagtctgtttgaagatcgctgagaatccccttttcgactgttcgtttttacctgtgtgtagacgctagactacgcgtttcctgcgactcaacaactatatactttgcatccgccggacgacgcaaattcatggcttggtatatcccgtagcgtctcgaaccgtgcgagtttttcctaagatttcgacttatgcttgcctgcttcccaacaaggagactggatcgcttccagaccggaaaccaatgctctgtaggtcacgaagacccgatcgttcatgagacagtttctcctttctccgtcttcgtccgctcgccatgtcagtgtttctcttccccgttctgcgactcggtggagaaagttcttcctcgtcaaagagaaaagaggagagaaacctcgtcccgcgggctctcctgcgcttgccgtcgaccctgccgtatctgtcgaagcacctcaagcaatttttgtctcgaaacaatgcgcccgtccacacaaa

SEQ ID NO: 886 - DNA, 5014 bp, Toxoplasma gondii
tttcacttataatttctacagagcagtactgctccaaaacagactcgccgatcttcgcagcatgcgagaaaatggcacaggatgctggctcctcttcagaagcatatcccttcggcggatgcaggtaagagccgaagcaaaggcaccgttggcagaagcaaagaacgtgtagcgtggcacaggacttgcgtgtcgcagtagtgatctacgcggagatgaagcagtctttccatcctacgtacagtgcaaggtgccggattcggtggggtagccgcagcgcgtgtttactattcgggccgtgcagaattccagaaaacatgcgtactagaaaggaatcaccaaccagaaccttgcttatcgtgagtaagcatctttctgtggtggcgtggcttaacacccctgtccgctctctgccttgcgctctcgtcaagaaattcgtttctgtataggcaaaactcgaacgatatatgatgtgaaacacactagcagaaccccagttgtccagaaggtgtgcagattcctttgggtcacaaggtcaacgcaatattctctataggggcctccaggggtgcgcgaaggttgtatacactgttcctgttgatttattgtatatttacgtctacaggagctttaatgaagagactggcagtccaggaaccgctacactgtacgcggctggcaacagggtcaatccctctctatcgctcagtttaaccggcgcattagtgattggtagtttttgggcagcgactgcgtaataatccactagaaatttgaaataaacattaactagatttgggggatgccgtgaagtagctaaaccgtcgtgtctcgtaaaacgcaccgtaagctgtctcaacagtgtcggcactcaaagcctgcttttcctggcttcgatgtgtatcacatatattaccattttcaacgttttgctttggtaacaaacaaacctggatgttaaaaacagaggaaatagtgaaaatatttttcactaagtgaattgggaaatttggaggacaccactgctagtggaatccctgaaacctgcactttctgtattcttgaacagtgtcaatcccgttttttgagactcgactccgctggtctatagagcaaaaacgcagaatcattttatatctaaagattttttactacaggctcttagtcgttgaatggatctcgggcgcgggaagggctccacgcgctccaggctcctgccgcctgcatagaattgttgatttcctgatatgtctcccgcaccataccggaattccctctcgattgggagccgtgaaattcagtactgggtcctaaggagaagggagagaatgcaggagaagggaaacgttttggtgagagggtaccttctccaggggtaacagagaatccgccgttcacaatccctgctcccgggctgccgtttgtcacggtgtgctggtagtctgtagttgggaaaaaactgtttggcaaagaaacaccaatccctgctggtccaccaaactgcatactcggcactccgcgtgccatactcggcgacgataagtcacctgagttgcccacgtttccgttcagcggatgggggccgccgtcgtctggaaaaacacctgcaattgcgcctgtgtaggacaggcccatgccatcgagactcccggctgacgcggcagttcgaagagtcggcgaatagactcccccaagtggagtgttgtccaccatagacaccgacggcgtacggtctgcgttgcctgccatcggaatgggtccagctgcagcggcaaagttggggctgtagagcgatccgacattagtattggcgaagcctgccgcaggatcaatactcatgcctcctggaaatactcctggatacggagagcccgtgtacgggctacgtgatggaagcacaggtggcagatacgtgccactcacgtcgcgcatcatgctcggtgacatcattccgaatccttcaatcggagagtacagcggagacaggctttcgaaagtggagaacgctgccatcgccggagagtttatgaagtcctgcaaactccacacacttcatcctactttgactgcatactggaacgatacaactcgattcacactgcccaaattactcagggactgcccccctggttaaatccgtccacacgtgatggtagtgattttattgtgaactttttcttttctggatctgctcccaccagctcaaagcacacatggacgaccgtcggcgtgcatcagctcgtgacgaacataaggatgttctgttcgtatccttgattcgcacagcagtgaatccagtgttagttgggagaaaaagagatatgcggacacacgatggtagaattccgaggtctgataagcgacttacagaacacaagactaatccatcccgcggactcaacacgagaagtgcctaccatatgaacttgcgaatgatatttcccagaagacaatacgtctggagctccccaaatgaagttctgggggctggcctgaacgtctttagctgcaggactgtcagcgtctggcagcatggtcgtcgctgggttctctgtcggcttcttgcttggaacgtcctcctgatgtgttagaaggggtccatttttttcatttatgttctcctgctcctcctcgaaagttccctcagttctcgagcgtgttccgtccgccagtgtaggtgagtcaagagtagaagccgctgcactgttacggtatccttcgccctccatactgtctgctgcgatagcattctggtcaagaagtgccggccccgccgcttgcttttcgtctttgccagcaacctcgtcttgcctttggacggtatcgtcggaatctgtaacagcggcagataacgagtaataaccactttgcgttgactcaaagcgtgttaaaagcagacgacgaactttcaccgacatcatccggtaggacttctttataccccccggtctgcgtgttatgtagactcccttgtgtctggccgtacactgtgtcgtgtcgactctgagaacgagttgtttctgcactaccagtagaggaggaaaggggttatgctgtcgatgtagcaaccagttcatccatttggttttcggctgctgcggcgaatctgcaacgatgagttcatgttcttcagtttttcttcgtgagacactctcgacgttccctctacgcgaatcttaccgctgttactcccgacgacattgaggtgatttttctgtttttctgcatcgccgagtgcagcgtgttgagaaactgagtttgcttcgtctttttctgtagtggcttcggttgatggatcactgttatcttcaacactttctgccgatgcaagcatggaaacgaggttcctcccgtcactctcccactcactgtcaaccggatctgggcccagctcggggttcatattaccggtctcttccatcccggagttcgtagctgcattaacaagacagtttccacctccatcgcgacttgtttcgcccccgtgtttcagccggcaagattcccgtactgattctgacgggaccgcttgtagtgatatgcccatattcaggtgtgtggactcgacaatggcattgacagaggtacagaacgttgctagcaacaaaagtgctagaactaacgacgactggtcgtggccaccgagaagcatcatgaaagtgtctaacaacgcgatgtaggttggtcaaaaccaccgggtcgtgagcggctcacttgccacttcactgacagtaaaaacaaacctgaagattacaatcatagagaggccgcgagggtcacaattttctttttggcacaaagaacgcgtcgttttacatccacctgcacagtttagccaaaactcggtatcaaaatgcagccgcttcggagacgaaagaagggcatattctttctcaccagtacacatgaggtgtttcaagttgtatctgcttgttatgtgcaaacttccctgctgaaaactctcagaggtgtcgcggtgctctgttcattctcaaaaggttgacttgccaaggggatcagcagcgctactgacaaagcgcactgcggatttttcatgggaattgcgttgggagcctcagagccgttgcaggttttacgtgccacgtaccgtccctatactcttctaaaagggctttcgtgatgtcgagatcggtctacggtcgcacccagggtccagccgagtcactaacagttttgccttttcgtgacttcgttgcactactcagaagtgtaaaatactcaccctgttcgaaagctgttcgattctcaactgacgcattcagcagtgaaagcaccgtgcagctgcaaaaaatcgcatccgtcaaaagccattggcaccgaaggttctctcctctgaagcgctacatgccttaacaatgaggcgcacatggctacagtgacacagatgctttgtgtggccggcaattgtacacccccttgtcaactcgtacagcaatgaaatcgttgcgcagaagtacacaggagagaaaggctggactagaaagctcttgaactaatcattactgttagatgcctgtttgcagaggttggctggtctcgcgctcggctgaagtaaaaccaacagtcggggcacgtcaccggctcgtgaagaggtttcggttcatcgcttgcgaataaatcaactcgatactaagtgttagacagtgggttgactcacatgtgcttaaatggtgctgcagatttgcagaagtggtctgaaaacagccgagcaaagtcgagatcatgccgtcgcacgaggtgaaaatgttcaaccactgtcaactgttttcgtattctttacccactgtttgctatgcgacttcgggaagcttctttcgcatttctggattctcaccggaaaccgcttgcgagacaaaatgccacgtagtggaggcggccgaagccgactaaagtatattccgtaaaacacctgcatttcaagaggctacccaagggattgcaagttgttctcgttgttctcggtgcttttcccgcctgaacccttcacacatca

SEQ ID NO: 887 - DNA, 4007 bp, Toxoplasma gondii
aaaggtcactgagttcaaactctcgttgccaaatcgagaaagtttctctcgccctcaggagagacgcgcctccgcgggaggcgtccaccattttctcagagactgtgtgctctcagtgaaacctcatggacacagaatgcatcgaaactcgagaaagagcgacttcctcagcaggctggtggagactcggggtcgtggttttacgccaacatcgacggctccacctacgcagttgaaagcagagtgaagtgatcaaactcgtgagttaggtatcctttgcaaaccttcttgaaaatagtttatttaattcgcggatcaggaatttttttcgagccatcgagaagctccgacacaggttattcctctcagtgctggtcgaggcctgtgtctgtgaccctcttgatcaaaggactctctctgaacgttccctaatgagcaccgagtgactttcgagaatctgcgaaacttctcactttactgcagtgttctcgcagctcaaaaaaggagcagtctctgctgcacttcaaagaaaatagtctgagcttccggcggtagcctcctagagaaaacagagtcctttggggttcggaagttctaaaccacctgagttgacggcaacaacttttcgacttgcactgtcggatagaaacgcctgttcggtgcagtggcagtaggtaagagtttttcgcatctacagaaatgtttgatgccttcttcatagagaagcgcgttcgcaattccaatgcaagtccagggtcgtccccaccgttctgcacaagcatgcgggggtgtctgattattacgtcggcttcgcggtccgcgacacaacgcaaaaagagtcaggaagtcacatctccagagaagtcaattgaatgggaagatccgcgttttcaggctcgaactgtgaacagttctatagagaggaacgcaacaaatccgactggaggaaaataagtatctgtggtggccaaaatagacttggagaagcaagcacacgcgcgaggtttttaaaagtcgtaggcaactgaaggcgctcggtcgtgaatgatatcacttgcggtttttctgctcgagcggaataaaatggggaaaagagcaatttagcaggagtgttcgtttgccagacacagtgagaaagcatccaactgcgcgtttgtttccatctgaaaagaaaggagatccgtatttttctcgaaccgtctcagctgagcgaactttccctgttctacgaagacgaaagagaaagagcgtgtatggaaagagacagtgaatgctttcttccagcttcgcacaaatacccacaacgatctagaaagcgaaagaacgaaggcaaccctgtcgctgacattgcctcgctcgatcagaccgttgccacacaaagatcccgcagctttcaacgcctaatttccctcacgaagcgaagcacatattccttcctccaatgaatgtctgaatacaagaggaaacaactgtgtgtgcagcgggaagttgcctcgctcaagttctcgacctgaagagaactcgatgtttcattacaccttttcgaggtgagaatgtgacgcgttcgccggaaggaagggagcatagtggataaactgctttccttccctcttcttgtcgatggggaaacctgagactagagcgcaattgcgagttatgttgcctatgtactcttttcgtcagattaggagttcgctgcgtctctacacacatcaaccgtaaaccagcgctttcttccttttcactgagtctacaaaaggccgaatctctgactgcttcttcttctgtgctcgatgcaagctcccctggagagtttttctccgttacgagtcgagccagcgagaaaaaaaactgccagaggttcccagtgtgtcgctagcgaattcgaaagaaatcgcttccacctgcggcgggaacaacaggctgtccaaacagtatcggatctactggagaagtcttagacttctttgtccaccccagggctgtagagtgtctttcgaggagcgctcgaggccacaatcaccgttttaaattggttgtcaagccttccatttctgccatgaccttttatccaggttcttccccgcctcagcagaatgccgaggctttaacatttatcaacagacatgtctccgtcacttttcttcgcgtgcttcagaaagaaacgaaaaaatgacaccaatggtccaaggaggcacactttcagctcttgacaatcgaatacgctaaccacacatttcagcatttaatgcatagtatatctatacatatatatatgtatatgtgcctgtatgcgtagtaatagatatgtaatttgacatatatttttttattttcatttcattttttaatatatttttgtgtacgcgtagccttctgccctgtgcgcctgtgtgccggctactcttgtttttctaacgtcgtatcgcctttatttcgagattgtgctgcgcgctctcttgcggaacaggttgaagcgtcaggttcactctcttttgactttgttcgccaattcgcagagaaagatcacagcgaaaccaaaagcttcagctctctgttggtttctacagagcagctgtctcgccacagcgaatccgagagagtgtgcagttgagttgatgccgcgggcgcggagagtttttgcgggactctctcgccagcgaagcggttcttcatttcctgaggagttaccattgtctttgaaactcccttgctgctcagcttttcttctttggattcctagcttttttgtctcgcgcggaagtccggatttttttgtttcctgtcggatcacctcaccgtgacagcctcggccctggccccccgtgcgcgaccctgggggcgcatctgacggagtctctgagtagatgcgaattcttcagcaagctgcgccatttgtttaccggcgttttctctgctttctcttcttcctgccttcgtagtcgctgggatgctgtcatcccctccgttgaaaagcatttttcgcggtcgaacgaggctgtccttccccgtcagcctgcgcctaaccgccagcggcaaaggcagaaaagcctagagagcagctcgccatttgaggcgttcccctgatgagctttgttgaagtctcgactttgtccggacagcgagaggacgcgcgcgaaatgcgcgaggcgctctgtctcgtttcgtctctttcaacgcctgaacaacgcgccgagagggagagacctcgggggaaggaaaaggcgacaggctaaaggacagaaaagagacaagacacagccgcggatgtgcttcgcgacttcaagacaacactcgaggcgaggagagaaacgagaggcttgcgggtggggagacaagacagagcagaacgaggaacgaaaaagtgacagacgaaaaagaggaaacgcgttcgtagaaagaaggcgaaaaaggacccccgacaaagtgtgagaaggcacaacggagggagggagactgcgaaagagccaagtgaagttctgtctcaggacttgcaggctgggggaaacgccgaaactcgcaacgcatttccagctgtacgtatatttttgcagggaaggaagagacactaaaaaatcagagaaagtcgcgcggtttctgccgaggttcatatttccactctcaacgggaacagagtttagacaaaaaacgaggatcgccagcttcgcctatacgcggatgccttctctctctctctctctcgacctccacatgcatcaccaatctctctgtctatctgtgaatctatccgtctcaatgagtctgttttcctctaaatctgtatctgtatttctctaccaacggttctctgtgtccttctctctctgtacctttgcgctaaagactgctccgccaagcatctccctctcctcacccggtgatgctctgtctcttcctgcaagtccctgtctctccgactggcacttgcttctcagacgttcgagcaggaagccttgaacctgcctttccttaaccgaatgccaggagaaataaaaactccgaaaaga

SEQ ID NO: 888 - DNA, 2725 bp, Toxoplasma gondii
actgtcatgtctgcgcatcttgcgcgagtcttcgagtggcgaagaaagcggcctgagcacgcctccttcctcgacgtccctgcgttctccgccgagaaaagagataaccggagatgacgccggagagagagaagagtgagagatgagcgttcgacttcctcccacttcgcgtcccttcgccggtgtccccctgtctcttctgcgacatccactcgaagagaaattgaagaaaggaacaaagcaaggagatgcgaaaacgtgaaaggaggacacgggaaagaatggagcgacgaggcagtcactgtgagacgccgctggggaaacgaccggagatatcacagttgaagaggagagcggagagacacccgatggggcaggcaggcagagagtgtggcgcttgcggtctctgagaacaaagtccgttccttgaactacctgtcgtcctacaggctgcactctcgtcgtcagggaggattgctgtcccatgaaggttccgtgcaacacctggcgagtcgccgctctgcccgcctgagaggagagagacaactcaactaaacacggacaaaggttccgccacattttgtccaccgtggcggcaatgcgcaggaggcaggcgttggaatagggagaaacttcggagagcaagagcggcgataaagaagagctgccagagccaaagggtgagtgaacgtgacgaggagaaaaaagaagggcaggggtaagttaacgggtttaaggcagttagaggaaagcgtgagcagcacgccggcgtaggggtttcatcggggacggactcgccagcgaaacgctgaaacgactgcggtccctccgaggaaaagagggaagcgtgaggaggcgcgggcatatgctttgaagaaagacgctacgggcaagcacaagggcgagacatacacggccagaacgactaaggttgtttgagggaaaaaataacgtcaacacgttggcacggccctatttagctccacagatcaacagagcgacacccaaacaccgcaattacatgcaagctggtgactctctgaaggctgatcaggagatgcatctctcgatacacaaacatgcaagtatttcccgatgaaaaacgaaagtggagaactgcgctgcagtcattcacgtgttttagaaaaaaggagcgagcgcccgatgtgctgtgcgccagtcgctcgacacgccaggggtctgtaatacgccagacaatttgattgaacgctctgcggaaagagaaaattctcggggactaggacaaaacttcgcagcaatagttcattacataggccaacagcatccgaaaaaagagtcaaaccacttctcagtggacaaaatgctccaaaaaaccctgcagcaccagccagccgctattttcgatacaaggcgcttgttgcgctgctccgccacgagtgaggcactttcatccgtcgcgaaggcaaaaattgaacacagcagacactcgaaaatgacaaagggtctttccgaatctttgatgaaacaaatcagacctcgttacgtcgaaacggtaaacatgcgactgcactgggtgtggcgaatacagggtgtacagacgctgggtgtcggatcgatgcgggcacactctgtgcgacagcggaaacacagatgcaatggactgtgagtcttttatgtggcatttgtgtgcatttccagtctaaccagaagtcttgaagttgcctttcactctctgccacccctgttttgctcaaaatgtcagttaactgtcacgtctggtcccaagaacgacattgcgaggctcttccccgaccccatgtcgataaacctgttagctgtcgaaatgcattttgatgtcaaatgtcctcttgcagaaaagacagaggcgactcctgcgtagtctcccgctgcaggtcgcatagtcggaatatcttggcatttcgcagagaacaagcgccacgaaatggcattcgcgtcttgtgcatctacacgtgttttgacgatttgcgcaagcgcttcgcatccgggtgtgcttgtcttggaggacgctggctttccgcacatgctgtgtctcgtgcgttttgctcgtccacagtcgtccagaaaacatgatgaaacgcgtctcaacacagatgacagaaaggaagacttgaaagcccgatggatcctctgattatgtcttcctccattcaccagtggatcagaaacgaccattcgcggttagcctcgagtatttccgtctctgcgttggccccacttttcaccggcggatcgttgctgcgcgcccagagacctgctgcagttcaatctgcggcgcatccgaaaaagtcgcacggaagagatgtttccagctctgtttcgttcctttcagacattcttttctcgtttgctgaggaacagcatcttgcgcgcgagtgattgtcttcaggaacaacgggacttctgcccgcgcatcccatcccgcatccgtgaaaaagaaaaaggaatttcattttcgcggacccgattccactctacagccaaatatgagctgcgcgctgcctcgaatgaaggaagcgagaggtgaaggacaacctgactcgacgagcgatagggggaagttcatcggttgctctaacaacaagacagcagctgtctgctttctgatgacgctggtgcaagaagaccacggcatcttcatatctcttgtgccaaattgaactgactttcactggcggtgaatgtagctcaaaagccgctgtca

SEQ ID NO: 889 - DNA, 3090 bp, Toxoplasma gondii
ctttgacgatcagcgagccttgcgccaccaggtcctcgagaattctttcgacatccggtttttttattgatttttttaggttatcaaaaacctgttaaacggtctgacatctcttcagacacaggcattgtcacacgtcttacgatctgggcgttgtatggacgattttgttctttcatgtagcaaaggatgcgttcagacggtgggaatgagttattcacgttatcgttcttgtcggtcttctgacacttaacgccagctcgactacctttgtgcgtcttttttgcagcgattgtgctaattatatccccccctccgttcttctccaactcagggggacgcttgatcgacagttgttcttgtgtaggagtgtctatttcagaaacggtatcgtttcctgttccacggctttcgtctgaagacgttctcgtcaagccaattgaagtctcttcattggaagggtcatatacatctgaatgtagacgatgactgtcaactcctgacacggttggaagagattccacacaaaattgtattcctgcctttgaagacgattcgttctgtgatggtaatgtgcaaatgaagggaactttttgattcagcaggttctccttttcatggtgagtatctgttgttgcataatcttcaccatggagtggtccatgagtgttagtgcttgccgatgcggacccagtaaagcagttttgtttctcagcacgagcaccagatatctcatttggcaatccttgcttctttgttgaccccttggtcctgcctcttggtttcgctggtttatggggcttatcagccaccatttcagtaaggtctttccggatgtctgctgtgggcttccccatagatgaacaaccgttgccggtcgtagaggcagaatttttgtgttcgacttcagcgctttggggattggctgaggacagtggcaactcgagtatgtggtcggatgcggcttcaagcgtcacgtgatcggcgtcggctttgtccgtcgggctgtttttcttcgaaccccttacaacatgttgattcacctcgtcgccatcaggatcagtactttttcttatgtctttgcttgccccacctttctcctcggccacaactggattatttcctttaacgggttgatttgctgtttgcttccctgaaatcatttgctctggctccaatggcgccacggtgttccgttggcgtggacttgtatccttcctgctgtaactgctcgtgccgccagtactacaatccacgccttttttcttggacttcttaactttgtcttgtttgtctccgctcttggtgtaggtccttttcctgccgttgctgttgaactccctgccaccgggaatggtgctgttctggggcggagctccagtggtcttctgtgttcccattttcgtcgttaaagaagaaatgtagaggaggcgtcgtgaagttcactgcaggggacggtgttctggatcacagaatgtcgcaggtacgaatgtgtaagtgaagccgatgtcatgagttcgtaaaaatatgacagagaactcaccaacaatacccggaagagtagccgctggtctggagatgagactacaaaactaagagaagctgtgcttccaataatcaccgtgatacgcgtctgcttgtacagccgaaacctcgatgtccactgatgcaagggatgccaatgcttctggagttctgcttgtcggagtgtacgtactgcaagattcggagggaaggcaacctgacgccacaggtactgacatactaatatcggtgctgccccctttaccgcatggtgaggaaatacatatgtatcagcgcattacaaaggtaacgtcctcatccgggcttcttcctcgccacgatgtagtcgggattgccggcatgcagctgctgaccgtacgacgtaatcaagcgaacaaaagacagtggtttactgctggtccgcaaacacaaccactcataaaacattaaatatatagccacaaacatttatgctagcactacatgccaaacaaaaaggctattattatggggtattgcgctgacagttggttctcgaacaaagctgattttcgagcctctcttccattcgaacaaacggaagaatggctggcgattctttaatatggtgcacgtagcgacttcatcgcaccgagtgtgtagtgagcttcatggcagtaattgataaaggcaatagagtaacttcgaaagatatccattaaggggagggcgaaaagcggctactagctagatcattctgtttatagtcgtgttctatttatggcggacgcgaggtgattcaggagcagccagtgaattaatgctgtccagctcgtatcccaacatttaatttgagtctttaaggtggtacagttggttgacataatatctagatgtagccgcattacgcaaaaagtagaaacttctttttagaaggggaagagtataaaaggtttccgccgccgggacttgaacccgggtcgcgcgggtgagagccgcgtatcctaaccacctagactacagcggatgcaaggtcccaatctgtgggacgtatgaagaagtgaaacgtgaacaaagcgccgcggtatgcaaattttttttctttgcgtatgtccacaccagtgtagcctgctggttttctacaccgtccggttgcgtttctgtgttcttttatgctaaggtgtcgtgacatgtcgatccgccccaagtcgatttgccccaagtgctctgcatgcgcatgcgaagctcggtaacaaagcccgtcggatactgcggcaccgttcatattggaagtactctccgtactctcgcctctgcccattattttgttaagtagaagtgggacctttgttgcttcccggtgttatgactgacgcggtgagagagaggagtgggagaagctccagcaagatacgtgtggcagcagcagactctgcgacacagcaacaacagtcgacggcaggaaaatttggtaaagcgagtgctttctgctgctttactccagtcggatcgtagactcggtgacggccagcgacacgtgaaacgttgtcgcgtgaaagcttgaggaaaactgaggcaacgctatca

SEQ ID NO: 890 - DNA, 2147 bp, Toxoplasma gondii
actttgttttgcgaaacttctttcacgacgatactcggttcgtaggccatggagccgccagctgcaaggcccgcgaagccggagaacgccgcccccgggaagagagagcctgcagccggcgcttgggctccagaggtaggagcgaacgtgtctctgtcgaagcggctggccttctgactctcgcttttcgagagaagggaagagaagtagtcgctctttccagtcgaagactgcccgctcagacctgcagtctcctccctggccgcaccgcggccgtcctgtgcttcggtcgcgcgtcccaagtgagtcgggtccgctagttgggctccacgaccgcggtcggaagaaccagagacagcggcgtgagcggcgacgccagatccgagtgaggagtgagcgaaggacggatccgaactgctcgcttgagagtcgaactcccgctgagttgagccatgcccgggcacaggttgtgagaagaaactgtccatttcgacagaaaaggaggagaaaagaaagagaaaagaaagacgaaaaccagggacagcctcttcctgttagcccgctagtgaggacgcgaggcaacgcgagctctcgcctcttcctccccgcctccaagaggctgcaaaggtcagccaagccccgaaagcggacacaagacggggccccgctggggtgtacatacacctgagaagagagcgccacgaagaagcgggagcagcaggcgagagagtggagacaaaggaggaagcgaatcttcgaggtcctcgtcactggccaatcgatagtgatttcagagacaaagaggacaagcaacagacaaaagaaaggcggagagttgaggtgaaggacgacagaacagagatgagtcgacggcggtgaaacaaggagataaacgacaagaggacaaggcgacaagaggtgagagagacggcagaacagagagggaagaggggaaggtctgaacgagtacaagaagaacgacggtagagggcgacttcttcgtgtgctgcgacagagagtgaactctggagtttccagagtggagcttttccgacgtgagtgtcaactcgaagaggattgtcagacagagaagagaacgcaagttagagacgaagtcccgaaaacggacagaaagctcaagatgctcgcgcgttcttcctctagaggccgttccgttccatgaaattcgagagaggaaacgcgtgaggactcctccgcgcagacgtccgtctacaccgcagaccgtttcattcgctcttctgttttccagtcttcgtttggctttgtgtctctcaacgcactgagaaaaactcggattcctcgcccgccgcccccccctctccccgcctggaaaagagactgccggcgattcagcgctgaactcgaaaaatcgcgggcatgcagttttttccgcgcctagagtttcgaggctcgcggcctcctctctcttcttcctccgtgtctgcggaggcgtcctcgccgcagattccttctcttttctttgtccacgctcgtcgactttctccaggaagaagcgattcgtctcggtccacgttcagcttcttgcagccgagaggcgcgccagccgcttgtccgccaaactcgaagtttttcgggtgtacgtacacccggtgttgcgccgcgagttatacgagagcgcacaggcctcttttccgcttgtgcgcaaacgtaggagggaactcggctgcgcgttctctcttgacttctctgcaccttcttcgcaagcgccgttctgcgactctgagcgtccccgaacgctcctcgtttccaggctcgtccgggcgcctgtcttcacacgcgcgaaacagtgtgtgtgtgctgtcgacgcagaccggccttttttcctgcttttcgctcttttttctcgaggttccttcgctttcctccgtcctcgccttctcgtgtggcgccttagtctcctgagctgtcagaacaacggaaactcgcggctctcgtccccgcgcgcgcagccctttccgctagcgactccgctctgcgcgttaaagaaccttctactgtcgttcttctctcccgagagtcctttcttgttctccccgtggtctctctcgtattctctttcctgttctctgtcgcgtattctcttgttctgtctcgattctccacca

SEQ ID NO: 891 - DNA, 4375 bp, Toxoplasma gondii
agtattcggcaatgtttttgagaggacacaggccctgtgcgtctgtccgaccttgctcaagttatgctgagctgctattcgcggtttctcaacagctgcatccagaatactcacactggcgtttgccgtgggaaatgctgcattagggacgtatgtggtgatgcttgtcccgaacactctcgggattcgagaagccctagctatcgaggtctgttcgttctctgcagtagcatggccgaaatgcattcaagaagctgccgcatcgggactgggatggacgggagtcgtttttttaggttgaggtcaacgtgacaccccaggctgcaaagcgaacatcacatcgatttttgtagctggggaagtgaggcgaagattttgtttcttgctgtgttgcatgagttgcatcgtccacaggcagagagaagggtcacgtgttggagaattgccctctcgcccaatccagcgccacagggtcttctgccgcggagaatgtcgcgaagcaaagtgacgccaaagcgggaccgctcatgagcggcatttgcttcaactgtggagcgacagatcacacgctaaagaattgcaagaaaaaacggaaaccagtaggttcagcaggattttctaatgctttgtgccgtacaaattataaaaaatggaccggagatgttttttgtggagctcgggtcagcctcaggtggaacaggtacaatgccatgaaaccaacacctctatttcatagccaggtcagacaggcagcgtgacgtctgacgcgagatgacggaaaggagagctgtggccgaaacacgtgcttgtgcagcatgcgacattcctttacgtttgttgttttggttgtcaacagcacggagcgctaccgttcgcattgtgcttcatctgtggcgaaaaaggacacttgtcttctggttgtcctaaatcgaaaacaggtaagggatggaaaaattggttattttaaagttactgcatggtattgcaaagaaggggcgttgcgtgtcactcaaaagatgtgtcgccgatgtcttctgctgatagagcatcagtgaggcggaagaacgtatccggctacgagttttcagagacatgcacatagaaagactggcggaagcgaaacaggaccagtgcattgatccgttgacttcattgaaaatgagttaacggtgatgatcaattattctgaacggtcatcgataattttttgtgtgacatatgccagccaatccatttcgagtttatcgcgtggtggacccagtccggatcccacagtgccaaatcattttgatgtgcattccagtgcagttgtcaacagatccaagcaatgcacatttccgctttttccctcttgttgctccaggcaaataccctcaaggggggtcgtgccacacttgtgggtcgatttaccatcttcaaatagagtgccccgaattccagcgccagcagaaggagcgatcaaaccaggaaaaacagagtcgggcgaagggcaattcacgaggtcgaactgaaaacaggaacgagaacaaacaaaagatgcaaacaacggaacgaggaagtgcaactggagggaaggttcacagaaaaatccaagagcctgatccagacgagttctggatgggacagagcgcctagcttttcgactgtttgacagcagcctcctttttttgccataagaagttccccgactttgtaacggggtgagacaatttttcgggacactgttgttcgacccgtctctcttctgaaccggtctcttgctccgtacaaccgtggacttatctggagggaagtgaacggggaaagcttatgctgtgaccaaaaagagacacctgaggcttcgaacaggtcgaatattcaacgtttttattttttcacggctgcgtgggttaattgttggagcacgaatacagtttttccgccagaagccgttcatgtagaaaatgggggcttaacatcgcaacacagcaacagacccgacgcctcgttcgttgtctttggagcttgctttctggttgactgcagggcaacagcttagaccttagagaaaggctacctagagttgaatcactttgtcggcctggctagagccgccgtgttgattccccaagagcaaatggaatggccaggcaacacaaactgaccagcgccttcgtcacatgctaagtggccatgcggtactccggaaaacgaactgggggtaacgtactgttaagagcttgaccgcggcgtttattcaatggcaagttactttgtcggcatgcgggtactgaaccaggaggctttggacagcctatctaacgaggttcagtgccctgtgtttaagaacgtgtctcgtaaccctctctggatttgacagctctgcacgagaaatacatgtaggcagatgaggcacgtcgaaagatgtggaaagaaaccctgtttttttacagccgtgacgaccgctcgacgagcgtcggcttcttcgacctttcatgtctgagaggcctcgcactctcgaacgagcacaaacgcctcagctttacgccaaagagttgggttgccatgttagcagaacagccaaaacgaagcatggacgaggccatggataagaaaaaactgtgagaaatgtggctctttcgtcgctccagttttttgatagcgagtctctagcggtcactaatttgagaacccagtccaaatcctttgttatcgtttcgaggctggtgtctcgctacaccgctgcaaagcaacgagcaatctcctgtgctgcttccgttctacctctgaatgccgtgtccgtgtcgacacgaaccgcggataaccctctgtcctatgtatgtctagcgtgaagaaaccagccacctattgcctgtccgtggaaagactgcacttggtaccttctgttcacttcttcggctcggccacacaccgaacaccgtgcggctgttttccctgggggaccttcggctcccccttgcactgctccacgcttccacggcaaaatggaacgtgccttgctagagagaggtgtcgtgaatcggtgatatgtaaatgcagatttcggtctccaacagtgtaggctcctaatttattccccagcggtggagatgtttgctgtctctcgcggtgcaagacgcgactgcttcagagtggaaggtggagggcggcacgtgtcttccataattctggttcccccccacagcttgtagatgctgctccgctcagaagacgagcaaccccggcggcacctcctgcctctgcgcttaccaactcttctctgtgcggaagacagccgcgccccgtgcaaagacgtgccagctttcaccaccggaatcgttcggaaactttcgagatgatggacactacacgaaaaccgtccctttcctggtatcgtgcctgtggacgttcggtcgtactgcattcggttctgaccggctgtgtttagttcattttaggaaaggtgtcggcctgtagacaaccattggtgtgcgtgaccggaaaaaaacgccaagacgaagcaggacagtgtgtttcacacactctataccagaggtgttcctaagggctgaccggagcgttttgctttccgattgtatacaccctctgacgcaaaatcccttcgtctccggtccttcatcttcacgcttttttaaggaggggtttcctgtaaggtatttcagttgccgctcagctcccgtctcttccccattcgattctgaggtcgagtctccctactctcggcgagaggaggcgaagccccgtgcgcgggtgatacacaggtgttccctgcgtcttgtaggcatttcagaacgggagctccgcgacgccaattttgtctcaggcgtctgtggtcgatctggagatatacgaaacggaggcgattcgtgggctctaggcgggattttcgtggaactgcgaaaatccatcattagatacacactctccagcgacttcgaaggtaggcggagtagatgccgttctttgggcacgcactgtcgtgggacctgtcttcagatattaaagcacgaatgcaatgcttgaattcaaaagatagctaaacgctgatgcctaatgccgggtatggacgacaagtggacttgaacgctgcaacagttttttttgcacactgacgaagagtcgcgtctgttgttttcatctgtagatatgttagctgttttgtggcggcatatccgtccggaaactcggccgtgggttgagcgtgcggtcaacctaaccctggcgcttaggcctgcgtctttcaactttttcgcgctgtaacgttgattccgttttttcaggttcgtcgtcctgtcgtgtacctgctcgcgacggaacaaagtccatgcgtgtggccgcttcaagatcgtgtctgccaaggtcgagccacccaaga

SEQ ID NO: 892 - DNA, 1654 bp, Toxoplasma gondii
actcctcaaatacacaagcgacaccctgaacgcgtccgtttcatacgccgcatccgaaatacatatgcatatatatatatatatatatacatatttatcgatctctatatcaccgcgtgtgtacaggtgtctctacgttcacttcgatttccatacatacatacatatatatatatatatatatacataataaaataagtattttcaggatgcgttgataggaccagtgtaggtgagttgggacgaaagtgtatatgtctacatgtgcgcagttgtttgctgaatgagctctgaactgacaaaagagccttcggagtctgcagagacgcttttgtgggtcgtgctgcagaaggagctactcttcgctctggcgcagagtggagaaggcgcgagagggagagaaaaagagcagagagaaggaagagaaaaagcaacaagggcatgctggaggcaggctcggtgccggacccgctcgacagccgaccccatctgcgacggccgccttatatatccgcacagaagcgctagagcaacgcgcgtatacaaaaacgtgcacactcccccgatatatataaatatatatatatatatataaatatattatatttttatttatatgaagatatatgcatacattagtacatgcaattctacacacatacgtctgtcgccacacgtagacagatgcatgtcaacaggtgtatgtagaaaaaaaatgcaaaataagttttttcggggaatttgtgaagactttttttccgtcaacctgatgcgtcgctgcttgtgtcttctctcttgttttccggtgacttttgcggtgtacatacacccgcgtgcttccttttttttgttgggagggcattttcatggtttccacgggggttcgcgctccagcttgccgcgcatgcagcagttgaggaatttgttttttttttctggagatccttttcttttttcttgtgagtcctttccggtgacgctctggctctcccgtcttcctgtacgtttgaggaattcctccgaactgtccgaacatgtgactcctggagaagagcggctgatctcactttctccctttctgtcggcatgcagtgtgtatcccaggcacagagttgacgggaggcgtttttgcctctggcgttttcctccccggttcagtctttctcgggcaggtcctttcttctcttgcttcctcgcggcttcttctcgcctctccttgtcgcatgaacgcgttgatctctctggccggctcgtgcaccacaaattctcagctgtctggccattggctggctaggaaggcgctgtttgctttttcggagcgcccgactatcttcttggcctctttcgtctcgttctcagtttctcttttgttttctccaactcctgcgtcctctctctttttctcgcgccgtttcggcgttccctttcttcttcctttcgacatccacgtgcactcgcaacgcgcaacctcagtatctcgccttttctgttcgcctccctcgtcgttccaagatgcttcgcgtcctgttccccactcttctctctctttaagaggcttctcgcgtccttcatccacccttttctctccctcaaatccaccttccgatctccattcttctctctctggcgcatgctctccgcgcctccggcacca

SEQ ID NO: 893 - DNA, 4723 bp, Toxoplasma gondii
gtttgagagaagacccgccgttcttctctgaaactaggagctcgaagaaggtctggcactcctctcggaattccaggaccgagagaggaacagaggacagagtatggtcgacggaagaaaggacgcggagaagaagagaggaaaggagaccgatcggcctcgtgtacctggcttgcgaagcctgcttcagcacggaggctgagctgtaaggagaacgacgcagatggcagatgtaaagacgacgaggcttcttctgttcgcggtgtcgtcttggcgtccgtcaagtttttgcgcgagaaccggcaaggagggagaagcgggtggagcgaacgaaagggggggaagcgcgcggccatcttggaagcaggagagaaattccagttcgcccttgagggaatccagttgcgctccagcggacgcgcggaggtcgaacagaaacggactctggcgcagcgagtgctgacaaagccgcgtagttcacggacacgacagaaagaagactcaaaagaaatgacaatttgcatgcacatgcatcccgttttccaagagaggatgaccaccccgagatggctcttcagttcactgaaatctgccgcctgcggctgcacgggggacgcgcatcggtgagcatctgttcaaccgagggaaaggcgggcgagctggggtgtacatacacctgagggatacaaggccgcgagaacccccctcctctgggcggggctctaaagtgcatctactccaacttctccgggcatgaatgacggacgcgttataacaacacagaaggaaaatacagatggggaagggaggataaattggaggaactgaatcctcggggctacgatgttgtagcggaaggagcaagcggagtgtctggagaggacgcctggtggcgtagggaacgccttacggcaagtgacagagaccgtttcgtctctgcctcctcctacataccgcagagagaagcagggaagatgcgcaagtatccgccatggcctcttgtgctccggaaatcggttctctcctgaggcgtaacacaaggttcccaagaggaatccacacacacacgcacgtgtacaacgtggaagacaacgtaaacatggaacgtttttgagtgacgacaacgggaaatctctcactcacatccgcggaaaacggagagcttgaccggggaagtacatgcagttcatttgacagcacgaacttggatttccgtcgtcgcgcgcgatcctgaaaacaggaaaatcgcctgcgggaaaccgcacagagttcacaaacagcaaggcgcggcccgttgccagttcgcccagctcctaatggggagggaaagcggcaaggcgttttcggggagcatcagcgaaagactgagaagaagagtcggaggaaacacgatgcgagttggaggaaaaagctaccacagcgaattccggacgaaggcgcaaccacgaataggaacccaaactctaggcgtttcgtgtgtgcagtgggcttaaggagtgaaacatgcagtttcagcgagttcttgaagcagcggaaacgcttttctgagaaatctggcgccaatcgatgcgggtttgaggtcatgcagtcctcgcatgccacaaatcgagatatacgcctctgcatgcgctttcctcggtgagcgcaacgagactgtgtctctcagttctgacaagcaggcccgcaaattccaacttcagtggacgatagacacacacggtgacaagcgactctcctttgtagaggtggaggaatcaccttttgaccttgacagactattcagggaatgaggtcagagcgaaccatgaaggttcacggaactcggtttagaacttgctcacaaaccacgacaggagtacacgtgaatctttgattgttttcgtgctcgtcgcccaccaccgaattgcatgcatcgcctccgttacagtttcagtgtgtttacatgtcgcattgaccggcttcgacctcctaagtcggcgatcgcttcacggggatctgccgcaaaatgaatcgggatgctggcgaactcctcaaggtgtggttcggctgcaagacgagactttgtcgcgcgccttccggtggaggaaggcaaagaaactggctgacgacgactctgccttttctcacccacttgcgcaagcaaccaccgtcagcttgattcggtcagggtgtcacaggccgtacctctgccgtgaagcgtatgagcatttgcgcgtaattaaaaatgcctcatcgttcctttctgcattgtcgaccgcggacgtatcaattttgtgccatgtctccattatacgagctgatacgtgtgcaaaagtgccggacgtgtgaaaacgccagaaaaaggggtgacgctgctgcagtcaacacagagtcggtacgaaactgaaacaaggcagttgacggtggggggaaaaaacagttgaatatcgtgtattagtataacaacgataataacggtaaggtgcgatccttcttggcaattaccagaatagattccccccaaccccgcgaaccaagtactcaaacaaggtggtgaacttgcaccagagggtgtttccgtcggcagaaccggttcgtaagcgtctcattcatagctcgcgaccgtcgtcgaaatcgcctcttgctgcagcaaataggagtatttcaaccgataggcaaacagttggttcgcagcgacacattcttcgagaggctttcctcttgaaagaacggaacgcatccggcgcgtctcaacggcagcggaaggcttacgcaccagctcgagctgctgagtggtccaatttttactagtggacgtcgttccaatcgccactcgacaaacaacacagtcatgccgacagaaagtgcagaaggctcacaaagcaacggtgtctaggctcaacgtggtctctcagccggacttccttggcgcatgtgccgtcacaggatcgtgtacacaaatactgtatcctctctgatggatctaccatctttacagttcttcggctggtatttggttcgccaattctttcaggttgacgtgttgaatatcaactatttttcagtgacctggccgcttcagcaggacgtagaaacttctgtttgttgcctagtgtctctacactcgagaattgtttatggcggcagtacttcaccgcacggtcagccttagatcccatggcactccaatgtttcttgcgcatgactcgtacttcaacttttttttgagcaaaacgaagtcaaaggaaaggctctcgaatgacggatagactatgctggcggcgaccgataaaattcgtgagcattccaccccggtatgcagctcttacacagcgtctgtattctcaacgggagaaacagatctggagagacagaaagcgtttaagacgaatggtaagaagtattgcggagcgaccaccgtactcacacgaaagactccaagcctcctccccggtcgtcaagaagttgtggcgcttagcgcggcaggccgtttcgatctccgaagccgctatcgatgagttttgactcgatcttcgggaaatgaaaggactcgcctgacatctgtggttcagcaacaactctgtcgaattgggcgcagttcatgttgccaggtcagtgcgacaacggagtttcccgcgtcaaaccataaatgtgcgcttaatgtggatgagtagcatttgagcatccgcgggcattttatcagttttttatttccagtttcttccccaaatcggtcgtcggattcgcgaatccttcaagactatatcggtttttcaaaggcgggcactaaataaactggggaagccagatccccttcgtgacgtgaggtgtaggggttgtttaaagccgcacctcacagactgaagactggcgaaacttcctcgcacgaggcaggttggtttccgtctgcttttaaaagcgaaagataacatttgttggtggagggtttgtctttcacagctcgcacggtgccgcccttgccgcacgcattgtcaggcgttctgagcgctcccgccaactgaggcagagcgtgaatgttgtcatctccaggcgacttggttttcacagtgaagtttccttcttcatatcgcagatgccggctcgatgtgtgttctcgcaacctgctctggactgtgaaactgacagctcgcttcttgcccacaaaacggtctgccgctccccgggtctctctggaggcgtcgagacccggacggtgcccgaagcatgcggcgcgccgacgatttcagtgcccagtcgccaccggcagtggaagcgatgtttcttttcgtgaagttcgctgtgtgtctgcgagcgcctttctgcgtgtcgccgttttttcccctattagtttgacctaggcgttttgtcgattttccgggtttcgatcggccaagagccggcgaagggaacttgcttttcgtgtcgaatttctccactggccgcttttcgcagcgttgccgagttgctctgagttggagtttccagtcctcttcttgagttctcccggaaagggtcctgtttgtgcgcctctcggctttgagttttgcgtttccacgctgctgaccgttgagattcgcctgcatctgtctgcacttttcaccgaaccagacttgcgcgggcatgcagtgtagcctccagagcccgacggctgctttctgtgtgttgtgcgtccctcggccgcaggcagggacgcgtctgttttcccgttcggaaattgccgtttgccgctgagttcattccccca

SEQ ID NO: 894 - DNA, 3823 bp, Toxoplasma gondii
tctcgcgacttgcaggcgaagccgctcctcagaagaaacttttgcctgggtgaggtcgtcgtcgccttcttcgtttgtgcgccctgctctctgcgactctgctctcggttccacggaagactggagagactcggcaacttcgtcgacaggagtgacgctcagcaagagagggatgaggagagaagccgagtagacgtgaggggcggcgtttaacgcaaagcccgacagccagctgcagacggaagcgccgtcgtacgagctcaggatttcggatgtcatgacacctgcgggttgctgcggcgcgccttgcgacgaatggcgcggaggactcgcttcccgagagtcaggagggacgggtttcagcttcgcgaacagcaggggaggagcagaggcaaatacgtcgacgcggaggagaaacgaaacaggcacagacgaagaggcgtggttcgaagagtctccttgccaaaaagcgtctccaaatgccgctggctcttgcgcagctcgaagcgccttcgcagccgccagcgcccccaacccgctcaggtatacagacacctcgagggtctgcgccggcgcagagtcgctggttcccggcgtcagagttccttctagaacgacagagtctctgctttttttgaacgcattcgccacttcttccagagagagatacgcttgtgtggaagtcacgactcctgcgggcagcggcgcgggcgcagccgaggcagacacagataaggacaaaatgccggaagcgactcctcgaggccaaccccagcaatcgacagacgccggaggaccagtagcactgcacacagacaacaggagaagagaccacaccagcggaccgcaccgccacaggcgagaagcctcaagggaacccatcgtagaaaaaatgaaaaccctagcgaattcgatagaatgaaaaatgtgggtcaaaagaaagtgctatgcaagagaagtggtttacgtgagcagcagattagaaaaaggttcgagaataaatccttaaggggaaagtttgccggagaactactctggaaaggttgacgcgaacgaggtggcggtgacggcgtatagagtcacacaagttcaggcgtctgtggtgtcaagtccgagaatcccggaaaaagggggctaacacgagaaggccggcgtcaggcggaagcacgcggaaatctctgagttcgtaagaaaagactcttttaagatgtaaacgtcattccacgagtgtctagagagcaggaagaagcaccggagactgatgccgactagcaaggaacgacgacacgcactggctgtttctatcagaccaccactcagattatacaggtagaaaaatcaaggaaatgaggaaaagacgaagtggaacagcacttgccactaagcaatacaccgtagacaaggggaagaacgcggaacgcacgccgagaacagacagctcgccagcacacacgaggtgggccggaaagtgtgaaatgcactgcttctcacaagctgaatgtgaaaaacgtagtcctgggaggaacgcggagaaagttgccaagggaaaagaacaaaaacgacggtacaaagaaagattaacggtggaacgctttaaacgcccgctgtcactcatgaaactccagccagccagtttgccaaggagcaacctcgaagcatcgcggaaaccggaaagccttgcgaaagtgaaatcttcggagtccgtttcatagttgcgactaagaagccgaatcaggaaaaaaagagcaaaagagaacagagatacaactctttggcatgatgaaagactgcgcagtgtcttgttgaggtttacccggcacactttcggcaaaaagcgccgtgtcgatggcgcttgcacactcaaattcgtgacattctcggcgctggttgcagccgcgccggaagacacaacacaaagattgtctgaggaaaaaactaagcgaatctgcggcaggattcggctttgaaaacgaagaagatccgggagaaaatcgtacacgtgctaacagggtcccggcgggttgcgtacaccaggtgcgcgactctagcgtagacatgcagcaggctgctcgacactggaggtaatttggaatctgttttgtcgctagtttttcaacaatccaataaaacgactcgcgagtgtcagaaaggagcgaaactccacacctgcggtgggctttcttcgagcacagtctcgagcttcgagtgtgccacgccccgagcggggaatgcctgtggttcttatcgttcttggggggccagcaaagtcacaggaaaggctcgctgaccgttgacagttttctgttcctctgtcatgtcacctcctcacagatgccaactgcgcgcggtcgtcagaaagatatccggcccttcaaatcctgaaactgaagagccgccgtgtacccagcaaccaaaacgaattcggcgaacagacaaccaagaaaccccccggattcagtgcagctcgacttctgctggctggccaaagggtggaagaccttatgcggccggtggtacctataattgaaatcctttccgatcggatcccatctaatagttgcggtttacattggaacagggtgtcttttctcgatgaaaacgcgggaaatggaacatcgcgataatctaggttccagaatggaagtggtggtgtacaattgcagaagctttctgtattagaaatgatcgaggtgaatgattgcactcaggagcgactgcgtcgacgcctcgagctaggcccggctcacatcagggtgactagtcgattggaagttacgactagatgaatcgaccacggtatatcacaggagactctccgttgtgctagcaagtacaggcagatgcagctgaagagtttgcgtttcagatatcgtgattacgttgtcaaatcccttcctaaaacatcaaatttcgacatttgcgagagttcgcaattcctgatgaacgagtctacaagcaacactcaatggcaactgcaagtcgacccttcagccacaatctgctgatgcagaccggaaagggagccgggggtggtattcgatgtccttctacgagaaacagacccgcttgtccggtttctgtcaaaacacagctcaaaaacccacccagtctgacccttctggcgcgcgactttttcttttagactgctgcaacgatccgaagccgaacctgctcatatcctgcgaagatagtggaaagtatacgagcatctctgctggttctttggacgtccaggtgaacatgacactcggatacgttttaattttaacttactaaagcccacgggagcgaagcaaacagctgcttgtaagcaaatttcctggttagatgcgtaacaactccacatcctttagaaatttcgtcgcggtgccgagttccttgtgtacagccgaaagaaatgtgcttcacattactcgtgaatgagtgcgcgagagcgatgagtctacggatttgtctggcccacaccttctcgacatgagtgcgagaggggccgggcgacccgtccgattccatgaagcatgcttggcgtcttttctgatacagcaggcatcccggtgacccagaccgaatgtgtgccgactcaccgggatttctgcggtgttttactgagtgtgagtcaaaaaagcgtttggtttttcctttcacagcatacgtgatcattgtatccggcgatatgaagttttgaaacccatagatgcgcacgttcgttccgttcgtgtccctgcatctgcttaaagtacgtgcggacgataattatatcaatgaattaccaatttaagctgaagatgcacttcgcgtggctaactcgttagctcgtcgacag

SEQ ID NO: 895 - DNA, 3825 bp, Toxoplasma gondii
cgtggtgcgttttgactaacgactgtagatataccctcttcaggcatatcaggaaagctacccgctaccggagatcccccttcacacgcactgcccccgcctacagcagatgtcgacggggatgcagctgctctggcggtatctgccgttgtgggcccgagctctcgcctaaaatctgaagagtttgcggtcgcttcgtttatcttacgaactatttcttgttccggttgttctgattcaagctgtggccgaccgcaccggctacaccgtgcattgtcccccgccttccgctctgctggggcaaggtttggagtcctgttgccggaaaagcattcagagagaactgatggcagaaggcggcgcaaaaggtagtcacagcagggcagtaaggagtcccgcggtcggacgtctggagaccccgcaatgttgtccgggactttcccttgactgcaggcacgggacacacccttttcgccactgcgacaacgggatctggcatcacgcgaaggcccagttgacctgacgaattgagtcacaaggcaccgaccagctcctacctcgaaggggtgaagcatccgcatgccagtacgcgattggtattcggtcaaactgcaaaagttcagagaagaaagagcaggggtagaacagcagaacggccggggcgatacagagggcactcctctacctagcacgaagctgttttgacccgacatagtggtggctttgtgtagcaagtcaaagcgttggagaagaagatgtgtctggtctgcggagaccgacgaagaaggtcgttgtctaaatcggtacaacagctcgtctcccctgtatctggtttatacagtcaaacctccgggcccgaagaaacagggcacggcacacacgcgttccagttgttcatcatcacgtgcaaaggttacaggttatagtctcctggtgaagcaacaagggagccagcacatccgttgtggtgtgcttttccaagagaaggcggtatagaagtctggtacctcagtgtagtcaagacttctcctggagacaatacacatgatacgatagacagaagtcaaaatcaaacgtaaaatggactgttaagttgtacgtctcggatggaacaaaccacaaaaaaaaacaccggtacacacgagtcacgcgctagcgcgcatgcacgcgtaaatctcgtatacatcgaagccacaagtcgcgcgaactatttgactcgttctcattgccagcgactgtttttcattaacacgatctttatcctcagtaatggttgctcaaaaggcaactttgtgtcattgatgaggaaacggtgtcggaaacacatcacattttggagcagcggatcaagacggtcgtccatagcgctgaatcagagccattcgcacgcggtcacgcccttgggaagaaccgtgcgtagtgatattcttttcagttacaagtgtggcaaacagcggaactgcacaggatcccagagatccactgcagaagaaactatcttggagtcggaaatacatgtgatggattttttcgctgttgattcacgtgtgttcaagtaccacagctagagctcgagccttcgcaaaaaacagcagaatattttgccgttgaaagctccgcttcttgacagccaccacgtgctggcaacgcagctgtgtgccatcgtgacacagttttctcgcatcctgttatgcttgtcgttagtacggaactgatgtcaacaaacgtcaattggtcgcataggatggtggtagtggcattcagaaagaaactcaggcttgttttgtaaagacattgtgtaatattggccagctcacttaagtgtcactgtttatagcaatgaaatgcgagttatgtgcagcttcagtgctacttaagggatatgtatggcagcttggttcgctaaaggctggaatgcgttttacagaaaaaagggaaacgctacacgaaccaacaatgggattagtgcaaaagcggctcccctgggggaaaatgaagtgaggggaggcattgtgttcactcggagcaactcatggtcgagtatcgcggatgcgaatgtgaagaaatctctccgctgtcagcctgtgacagtaaggtgtaatccagctgatccccgccgtgggagtccaccagtaggacattgcggcagcccccaaccgttgaggtaccacatgatgacacgattgacacagcagcgttctggttaacttgaccgctatcgccaaggtttatatcgtcgtagtctcaggttgtatgttttaccacttgatcaaaaagtcctaccatcagcaaaacgggacaatgggcggtagcacgctgacgagcattaattgctttacttattagtgcaaatattcgagcatcaaatgcagccagcaggtatttaagatgcggttcaataggagtaccgcgcatcttcggaaacagactagtgcgaatggggtcatccacggttgctgctcggcgacaccttaggcattcgaacatgcagcaagaaggcaacaataacaggagcaatggtagctgtttgaagaccccgtttctcttgccctagacatcgtctttcattttcatacaagtacgaacgttctgaaggtgcaattaagatggctgttgagaagctctcttcaccaccagtgcatcaccgacaaaggcgctgtcagtctgtccctcctcaagagggtcgtcacctagacaagtgaagtttcttgcagttcttgcctgttcccacctctgggaggttgcagagaagacatgtgtgagtctaagaggtaatctggcataaacagtggagcctattgacaacagccgtcgctgcgtgttctcagacgctgctctcgttttatctgtccagtgtccattctactgaaaaccgcatagacacagaacccaaatgtggtaacatccctgttacttttaaaggagcggtgctggtgacggatggcaatcctgacgccgcctgtggacaccctgggggaacacgtaacacaacattcaggcgccttagtcacttcaactgcgtatgtcgaaaatgtttcttgccgagcagaccgacataatatctgtttttgtggactgctctgtagacacctcttggcagttgccggtcacacactcctcgctttacagttaacagcaccagagctgccatgaaaaaaggtttactctgcatgatcgcagcaagcgtccgcgctcggctgaacaaattgcttgttgccctgtcttttgtcccacatgaagccgccttctaaagagtgaactattctcaggagattctggcggagcacagctttccgacatggcgctcgtttccctaataggaacaaaagtttgcataagatattattgcactactgctaccgtaaatacattgcaacggcctcccaacgaggtgatcgctgcccctgggacgcatccgcttccctctccaggactgtggcacttctgaaagatgcaatagcagctcgtggaaaataggtatatctgctacaatttctagcggtcagggtttggaatatcggtcactctcaaacccgcgtaatgcccagcaataaaatagctccagggaaagcccctttatctgtgcgctgaaccttaaagcggcactctgttgcatagcgaagtgttttgcaggcactagacgagggaggccggatgagggatcgaaggagagttcacgttgccacgaactgcagccacaccacggacaaatcgcgcagggcaaacgtggagttgcaatttaaaaggggagtcttgcagttgacaccttgtttagatgtggcatcctagcacccggatccaccaccccgttcccacctaccgtaa

SEQ ID NO: 896 - DNA, 3197 bp, Toxoplasma gondii
cagtaagcaaacgaggttcaaaagggccgcctaaagctcttcttttgcagcttcgggtgaataaaagagaccagcgatgaacatgttctggaacgaagcgctcctccgcatatcctgagactctccgtctcttgcccggctcttgttgactccgaaaatctcaagtccgatccccgacggaaccaggggacaccccagagacgaaatgtctcgaacaactgaggatggaaaacggaaaaatgacttcgaagaagtccaaaacttgatggagaggtaacgggctctcagccgcacagaatcgaccttctacatttaaggaatgtccatgttctctcagtgaacggaatccacatgtccagaactgcctcctcccacaacgcgctctgtgtatgtgaaaagataccttcaacactcacacggatgcaggcacacacgcacgtccatgtcgatgcaattggaggctttgtccaattgcatgaaaggtagcgctcactgggaactctaatgacagcaggacgaagggtggcagtcacagaaagtgcgacccgtctgtcgcctagaagcggtatccgagtcattaacccaagagaaaaagaagtcaataagctcgtttttgtctgctgagaaaacctgttttcctccggaagagaacaggaggctccagggacaggcgggtgtccagggggagtgatggcagtaatccatagatcacgcgtgaaacgaaaaaagtggagcagctggatatgaataggcaacgaacgcgctgccagtgagagaaaggcgcaaccgaccaaacacgaaggcagagaaactggcgatcgacgggggtagaacattaaaggtccccgaacgcgcacatgggacgcagggggaaaggagaagtcataactgaggcattggaggtacagaaaaaggtaggacttcgcctggacgaaagcatatgattcgtacgaagccacttgccccagaacaaacgcaaatccttgaaacctgcgcggacacctgactcacgtagagaggcgattcattgggctttcaggagttcggcgctgcgcttgttccacgacataccgctaaaaagtggagagcacagaaaaaaatgaactttaagtactctgtcacattttcttttgcactctctctttctccgtctttcccgtcttcgtctgctcgcctcgcctggtcacccacccttgcgcgtggtcgttgccgcggtgcttggtactaatcctcagaacagagggagacactgcgaaaaacagctcgcgagggagcttcacgaatgcagaacaagttaaatcgaggagaagtcaccttcgtggaaaaaaagggagaaaaaagccttttatcgcggaaacgctccgactcccagacaacgtggcgggctagcgacttgcgctgtcgagagacaagagggtcgcgaggaagaaacgacaaagacggccgcgagaaaagccaaaaaggccgcggactcgacgactgctcctgcgacaacaaacctagaaaacgtttcaagaacaaagataaattccggcggcgcaacgggcgatgcggcaacgacaagcacgcgggagacgcgagcgcggggaagagaccggttctcacagccaggctatggcaagatggttaggcgaacatgactttgacgaagaaagaacggaaggaacacaacaaaagaagtaaaagatcctgctggcaacggctcacgagaaagcgcttttggggcaggagcgggagcagcaagccgacagcggactgtcgaggaaacgtggacacacgttctccaggatcgattttggctcgacacaacacggagttatttgcagagcgccagggcggatatctggaaaaccaacgcaattcgacccttcgtaatgtccggtttgtgccccttcagctcttgcgtgaaaccccgccgcgggatccagccgttgtgcccttgtcttgtcgaagaccttatggaaggcattttcagtagaaattcagttgtgggtttcatctggtttcgcggaactgtgcttccgcttcagacacagatgctctctcagtcttcgcgcctgtggacaacccttgtccttcgtaccaggctctgtacaatgctacagaaattgactatagtttctattcagacactgttgtaaagaatctttccgtctcggtgcgtgacgaacataggaagtgcttatacctatggaaaggagcctgtcgtcagcttttcatttcggaaagcaatgcagcggcattccgtcaaaccgtgcaggtgccgcctgctactctgacttacgtcgagaacaagacaagtctctatgactcgtttgaactctggcgtttgtgtggccacagcaaagtcctggtgctacgaatcagactttgtctggacttcagtttgtaatccagaagccagctgctcgactcataagcatcagaacgaaccgctgtctacgcaggtcgctgacgtttcaggtagacctagcggttgctggtggagtttgtcagtaggctttggtctatcctcttcctcatgcgcctccagagcttgaaccagatgcatagttttcgacacggtacatcccatcaaaataaaggaagccggttccttcgcaaattggatgcgatcggactctcgtggtagtgcgggatgttgtcagtgaacgacagagacctcccgtggaggagtctgcctagagcgactgtaaatcacggttttttgtcactctcgtaatcacgaggggaaaaactctgattggctttagaaagatcagtagtgctagactctccgcgttcctggatggtttcttgaaatgagaccgctgctggctgaagctcagcatattatacgagtcaccttcaaccgaatctgtcggtcaattcgtatagccactagcgctcagtttctcatcgattttccggtgtggtcttcttgcaccactctcgaatcggagacacgcgggtttcctcgtgaaatctctcttgaaaccgagggtggaaacggagcgcgcggtctgtcccagcggcggcgcagagttgcccggaggtcgtgtgcgtgcgctccgctcgagaaggtcgtctttttcgtccactaaacttggatggaacggcgcctcttcggtctgtcaggggaaaacgcggctccacagggaaaacgttgcacctggttttcctctttgagtacggacagcctcgggaggttgcaaaca

SEQ ID NO: 897 - DNA, 2342 bp, Toxoplasma gondii
cgatatacgcagagaaatctcgagaaccgtggctatgacgaaaaagtcgtttctctagatggagaaacaaccgacaccggctctttaagaagttatagttttcctagatgcttatggggaaaaagggggaaaatgacacgtggattatctctggagggacacaaaaagcgctagaaagaataaagacgcgatagacgggggtgcgaaacaaacaaaaacctgcgagagatgcacggcagttcagagcagatgcgttcgagagctgttgccgtcgaacggacgaccgtagaaataaaacacaacgttgtaacccattcaacaaacgttcgcggcattccttgatatatgcacataaccgaaaaccagacgaacccgatcgcagaacagaacgatgtgctttgaaaaatatacacacacaagtatgaacagatgtgctcgtgagtctgcggctgtcgacggctaattgcgtttcggtgtttgtacacgtggatggatacgattctgtgccgcaacctgaacgtcccagttcccctttcttcttacgaaagggcactaactacacgagcatctcgccgattcagaaaaccacagcgaagaggaggagctctccaggtgccgagtgacgcaaaagagtcaaacaaaaagcgcaaaacacgacacagagcgtgcacgtgaaccgaggctgaagcagaactcgagaaccccgcctcagtcccggaagagtctggcccgttcgacgggcgcaacgggtccactttcccgggggttcgacggagagaacagataaagctgaacaaagagcgtgaagagagctttcaaacacgcgaggaacgggaggccgacacaacaatggcagctgtacacatccacagagactccggagattctgcccctgttttcgagttctattgcccccggttaaccccctaatttttttccgagttcaccactcgcggcaagacgcaatgcagggacgaaaaacgcagaggggattgttcagagacgagctactccggagaaacagcggccgctatccgtccttttggctagaaaaaaaaggtcttcggtgagaagggatgagcgacggcactatttgctctaatctacagatatcgtacgaacgatgcggatcttctagtggacaagtcctgccaatcaggtgagaataaaaaagcaacggtgcctcgcatgcaaccttcgcttgccggcagaaagccaggtgcagactagcagcaggtcattagacgaaacgacgcacttatgccccgagtgctctctctggaaccgagaaaacgcgtcactcacaaaaagccatagttataagaacagctgatctaacacggacactaactgaacggcgaggaaatgcgtccgcgaggtctcgcaaagcaaggaaagaagcttttaactcccggatgtaagccggaggaagacggcggagcgcgcacaccaggtcagagcgagaggctcgagctctatcgaggtcgagttcgcggattaaaaggaaaacggttcgggaaaagctcgagacacacggtcccggcagagctgcgcttgcgcacttgttcattcatgagatagacgcgaaaaatccgcgaaaaagtggccgaaaagcgacaaagtcactgcctgctgtttgcgcgcggcgggcaacctttcctgtgcgaaaagcgggggttttgcctgtgaaagccgcgaaacccctactgagtacgaaggtttaccgagggtcagtttctttctgacgaatttccctcaaaacgtaaaaccccgtggacaagcggtgaacggaaactggagaaatgctctccgacgagtcgccagtgggggctctgggagggaccttgttctgagggaattccgcttgtgcttcctctccgcgcttcctcatttgcttcctctgatttgtgttgattctggcggtgcctcaccagctacttcagcggttctttcactccttgactttcctgaatgcctcggtgcttatggtcgctctgtccgtgcagctttttctatatagtccgcgcacatgcacagttgcacatgccagaatgcggatagaagacacaaaaacactttcggttcagtacacatccaatcagatttgaatgcagttgttgttttcgcttattggtgtttcaccgtgctggcctccgtccgcgggcacaccacctcttttcataaaagacgtctgcaggtacgcgcaagtggaaacaggttccccccttgacgtcgtcgaaacgctggtgcctctgtagctgcatgcctgtcttgcggcttcctctgcagacctgcgattccgttcttaatcgaaatcattaaacgctaaactgtcttgaaaa

SEQ ID NO: 898 - DNA, 3441 bp, Toxoplasma gondii
cgacgtaaggtggcgaccttcatcatgtctaacagtgtcttcgacaacttcttcgctttgacatacgttatccatcaacagcctctcattggtttcaccgtgctgcgtacatctaggtggcaaatttggggatcgagagcgactagcgcagacatgtattgagcgttcctgaaaatgagctgccacagtagttcttagattcgataatcaaatgcccttgagatctacttcctgtgctgtgctcagacaagggtacctaggatagagatactggacgtcgtagaacgtgacccacaggaggcttcgcgcacctgtttcctttaatcattgcagccgctgcttctgaaatagtgaccgaatagctggttgggtcccacactgtgctgtttgctcggctccttcctctcccgacttaatgtttgcctcattccgccgatccttctcgcatccttgagacttctagagcacaagaacgatcagcgcaataaaaggcggccagagcgtgtcactcttttcaccttgagtaacagatgccgatgtgacggagaaatcgtcttctgcacaagttacgtgtatgccacggtcactttctgaattgtctaagtggtggctgtggctgtctcccaccaacgtggggaggctggaccgaaggtgtgtatctcgggacaaactgactgaaggtgttttcaacgcaactaattctactcacgttattttttgctcttttcacttatgcgtctccgcttttgtgtttttgcctgtggccgtctgtaatccattgcaatcgcagtccacaaactgtttggggtggcgattgtcttccgaacggactagaaccgtcagtgcctattacctgctacagacgggacgatcgggtgattgacacaaatacgagtctgcgagtgtcaagggggatccgataacgctcttcgttttcgttaaaaggggcatacactcgcaggaactcaagtcatatcagtcggggagatagagtgcgctttcccggctgccgcaactctgacagaaatcacgagcctctgcgaacggcctgttcctcgatctatcccagacagtacagtcgtgcctcacatctgggtgaaaaggactacgcatggcggaaacacggtatggtcgttgtgtccaatgatgttggcgttgcagtcgtccagtaaaactgtgcaagtttttccttgctgctccatccaaagttgttgacggcaatttagagcatcatcaaaacaaggcgttccggtctggtgtttcagctgaactgatctgtgacgaagctgcccagcaggctctggcgggccttttgaagatttctgcgactcagtgcgtgcgtgctgagatgcagttctgacatgcagggtcttcgcatgacctggttacactgtgacgttttgaacccccctctctcaggttacatgaaagcaatagcaatgtttctgttgtgtgtcaccttctggtgctcaacttgccgcagtcacttggaatacgtggactgtgcttcctatatcacccgaactgctgtacttcgttaagatcgactggaatggaatgtttaagaaaaaaggagcacggcttgtttgcctaactgttctgtcgcgttcgcagcagcgctgtgaaaactctgtgcatgtctgccttcgggtagtccactttcgtcaggctgaaaggcactttcagaatcctgtcgcgtggaaacaatcactgattgttcggtctgaccgaaaagacaggcagaggcaacacgagtgtgcacgtggcatgcctcgtttccaccttgcgtttgtgttcaaaagggtatcccgtttaaagcgttgcgcacgacgaaaacagcgaatcatcgtggtatccaacagcaaccgaagcattaaaagaatacattaaaaatagctgctagcagaaactgctcacgcaccagcgacggaacgagaagtccattctgcagctatactgctgacgctaagactcctgagtgtaactcaagcgctgtagcaaacaaaaccaatgagcatcgtccttcccactgaaagacacttgactacgttactccatcggtgcctctaagatgagactcggctgtataaatacatgtatatatatacatatatacacacagttacatatatgctgtaagttttcggcttcgttgagactccacaaacaggtatggacgttcgcaggtgtatctgtccacatgcgaatgtcgaagtggagcggtcgaaacgctgaagagccacgatttcgctgtgcagttcgagtgtatcccacgatgcgcaaaaatgctccagtgtccgccacgtttgagacaagaatcttcagcgatgacctcacagagcgacgccaaccctcccgcagcatggttgcctaagttcgtgagtgcatcagcgcagtgtgtttcgcgtagacactctcacggcgccaaggttgcggagtctctgtttgccgtttgttgtttctgcgtcgtgatgaaacagttccgcggaacgcggcatccacaacagctccccacaagcctgcgagagaaaccggaatctgcgaccttgtgcagtgtctcagtcacgcagaaaagggccattctgagtcctcgacactttgtcacacaccgttttcactccgccgagatctgacagaagagcaagagggtcgaagcggttctttcctgtctaaaatcggagagcgcccgcatgctgtgccatgtggcgagatctgctcggtctcgcccaaatttctgtactctaccgcgttcggggtcgtttttccgctttatgtgtgtttttaaacaaaaggcttgtgtggcaaccaggtctggcacctgctgagtagctggatgtcagcgaaccgagttggaatgcagacaacaacgcaaaatctctcgcccgctaaaccgaaaaggcgcttcttttgccgagtttgcgcgagacagcggcatctgttcccagcgcgacggcagcgttccacagaggagattccgacggaactgagtggaaaggcgcctgccgaactggaaatgaactttaggaatcggatacgggtgtccttcccttgctttctcgcctctgcaaagagccgttggtgccggtttttgccgccgtcctgctctcaggcccctcctgggtttcggcgccggccatgtgcaagcaacgtcggtcgcactgccagccccgccagaaagttccaaccaagagtttctccttttcactccgttccgctgcagtcaaagctgtgagaggtggcgcgcgcttgaagagcgggaaagacttcctcaggcgcgctgtcggagattcgcatgtgatcggagcacacatgcacagagcgacgtgtgtcgatggtgccaggaaaccacagtaaaatgcgattttcctcggctctttcctccacgacttctctgcctcctaggtctcgaagcatcgccgtcatgcctttcgcgaggtgata

SEQ ID NO: 899 - DNA, 2600 bp, Toxoplasma gondii
tggtaaactcgggaatagtgaatagaaatagatctgctacacacgatgagttgtcagtcgatcaggtagctccagacggccggggttggactccgtgttgcagcagtgttgcacactggggctgaatcgaagagaaagaaaacgtgtgctgatggttggtctgcttcactttaaggtgcatgcttatcctgcccatagttggactataattctgactgatttttcgcattctagcctgtcatgatgaggctgcatgttatcgagttacccgtccgtcttctacttccctgtgagtccgttgtaaattgactcctgtggattgccttttgcgaggatacaccccgatgtggttttttatacgatatcacaagtctgctgtacgttgaaaagagaaatcatgactccaagtgtgcactgcctttccgtctcttttaagaacaagtccagagttaatgacgggcacagtctggtttagtcactcattcaagtcttgaggttcgtgtcttgctctatatgatcaggtgaagtactgatcaactcgggtagttcttctgcaaaaggcttttcgtacagtcgtacatatgctcacacgcacttactgaaaccggatcgtgccttcgctgtccctcgtgacgttctatgcgaaggcaagtttcacagaatctgggacctagggagcggggtgactctggggggcccacaattatgattcaccgcgtatcgaggctcgtttggcagcatgcgcacccgtcgccgcttaatggtatgtgagttgaatcgcggcgaacatgcctgtatttttattgttactaaaaaccaacagaaacgagaaatgtttcgctgctgtgtttgcagaagggaagacaaaggattcattcctgtcaaagaagagtgcgcgaataagacaggtcgtttataatctggttccatgtttcctttctgcgtttaaaactaaggtttccccacacgaggacgacttccattgctcgttcgtgccgatcgtatttctcagcctgaatgagctttgcctccaacacgtccacgagtaaactatgacaagggaaacacaactgcgttgccgcactacgatactgtacagtctctgttcacgattacgtgttgcggcgtacgagttctgaccctggttgttacccgcattaagatatgtgtgatgtttctgctacattctctgacagtccgtatcctgttaatttctcggcatttctccctggctacatggatcattacgggatacttttccttctgtatccggtgttcatgcattctgtcttcagtctgttttcactcattgaggactcacgctgaacgcgccacacagagattattcacggaatcgcgtcatatatggtgatgagcaaatggtatttactcccttgacgaactcttatttatgaacctgtccagcaggcatgactcggctctggtacttcttagaagtgtttcgtttatccctgaagtaggggactctcacagaagctgagccatggatgcgatctctgaagattctgttccagatgcaattgcccagcagaacgatgcgtccgcatctggggcagctcgtgtaactgaagacgctttgcccaaagacaaggaggggaacaaggaacaactagagcagatattagaatcgaagcctaatgatgtgtatgggacagcaagcgagcacattaggtggaaagtcgaagaaggagctaccagcggttcaaataccttggccagtgcagtactcccgccgtccgacacccaggtcaattccgacgattccggcgccgcatccagatttgagcatattgtagctcttgatcagcaagcggtcacgatcaataaattcaatcctcccatgaaccgtgttcgaagagattcagctcgagggcgagcaagtgttgtcccagaaaaggaagatacgcgtcgcacgtggtacttgagaacaagcagattgcttttaggagcagctgtggctgcattcgcgtccattgctttgcgggcatttgcgttgtgcacgaaggaaggtttagcacgagggcatcaccaaagcaagaccggcgagaaagccctgcctcatatatcccctgtagtattccatttcggcgaaaaccccggattccgatcccgcaacctgcctcttctccccaccataggcaagcctgactcaaggcaagaatacggaaaaaatcttttacatgcgcagccagccctagacccgtcgcagcacgacatcgagtctcttcgacgttcgtgctctgagtttgccactgcagaatattcacgcggaagccacgacgcagacgaacaacgtaagggcattgtaggtaatgagcccaggagttcctcaccggaagcggggactctgatcccggtgacgacatggatgccagtgcttgatacaggaatattaagtgctcttattttggggattatgcatctcacactacctgcaccggcagcgcgaagaccgggaaacgcatcgctccaggctgtcctcacttccgctgcaacccgccccagtatatctggcagtgcggcaacaaaccagccagcagataggaggggacgataaaacaatctcgcgacagcacgga

SEQ ID NO: 900 - DNA, 2288 bp, Toxoplasma gondii
acgatggacagtactgaaattacacagccactcagtgtgcgcaagcgagaacggaagtgagcttcttcacctgtttgtgatctggacgcgatcctcgacaacagtgttctttccgaaagaaatcccgccttgtcctccatcgataactgtagctactccaatgcagcagccgtcgtttagttccacattgcccttcaggacagcccggggatgaacgagagccccttgcaccgttttgtcctgaccgctgggagattccgttcccgcagcttgaccagacacgtcttgttgcttgtcactcgagagggcacttgcttggcttgaggaggccattttctgcatcagctgaagtcgaagcacaacacagcatacgccacatcttcagcgtactcgagacagggcagaacgccaacttctccgaacacatacgggctttgtcagcgaacagagaggagctgaaatctagacagatgcattttgctacacacctgaagtggcacgttgattccatgcagagaaaaacgctctcgcctgagaagtagctcgttctgtcgctcataagtggttacaggaatgccaacacggaaggacatcctgaacccccaccggcaatgtgtcttcaacccatttgcgcactccgcaagcagttgcctctccaaggaagaaaacaggacataggagttgccttattccgatattctgtggatcgtctctgaggcagactacacacgatcaaatccgtcaagaacaaacgcgctgcggtaccatcacaagttgcctccagccccctgtggtttcgtaagtgcacatgaacgagagcaagataccctgccggactatccgtgatttccatcccgtcaagatagcagtgacagtctacttgttgtaacaggttccgtccacggtgacagaaaagccgtcataccgtgcaagtgatgctgcacgggagcgtacggttagccgacagatcaaccacgtggacgtgacctcgcttccacaacaaatccccgcggtctcacggctgcgtgaaccacgatgagatacgctgtaattgtgaaacaaactcataaaagtgcctgtgtgtcctggaaaacaaacatagagaaaagagaaccatccgtccgcagttgatttgaatgtttttttcaacgggacaacggggcgcagtgagctctcgcggcaaggcggggctgtatcgaccaggaaatcagagttgttcgtggtgacgatgacttacgctgcgcgtcactcagctgatcctgaattggtacgttcgcacgtgaaaacaaattcggcaacagcaggcgcgcctcagtgtctggcgcaaaaaaaaagccgcgcccccctgaccttgatgatgtcacccaacagcacgctttgactggaccgctgtaaagagatagaccggcggtgtatattcgaaatgctagctcggatgaggttccgcccccccgtcctgaggtgcttttcctatcttctgtgctatctccaacaaatcgagtaaagaggaagttatctaacgaatattcagtgtgtgtttggttgaccgactgtccaatcactgcattctttgactcaccgtataaaggcgcgtctcctaccctttgacacccgcacacaccgcatccaccagtcacgtgtaacggtttttgtgttccggagaggccgtgtgtggcatcttcgctacttccacactcactcgctctttttggcgtcacttttgctttccactactcacttggtggctgcagaaaagcgcttcgaagacgagagccgtgtgctacttgcggtcgacctctccgtccggagttcatttgaaccttacacccgttgcgcgtccgtaggccggtgcagttcctgtcttccgtgcattgttcagtcttcatgcattgctcaaacgagcacgagaaacgaggtagcgggaattgtacaggtccattgtagccaattcgttacctctgtgtgacagcggcttacacgggggaacgcgctgacgcctggttgtacggcatgttcgtgtcggcagtgatatccctgttttcgccacgatcctcacgagcacttctgcggcagtctttttgagtcacatgcagttctaccgttcaatgaacgcacgaatgacgccactgccgtgctgattaattgctgcggatggtgtcgaatcagacggcggcggccgaggtcacctttttggaaaggtagtgccaaacaaacgtaatgttttaatgcgggtgaggactcaggaaagtctgataattgtatcttacacggtccagaacgtgagacaa

SEQ ID NO: 901 - DNA, 2697 bp, Toxoplasma gondii
tcgtcgcagggctgaactgttgatgaaacgtgtctgtaagcctggggagttcttgcagcgtgggagtactatgtgtatgttgtctcttcagatgccgctcgatagctcgttgagaagtccagcctgcagccgagttagcagccctaccgccaaacgcagctttcgcagttactctccgagtgagaatccggatcgaagtgaggaggcgcagcgtcgagctctcattaatgacgatccagagcctccgccaatcttagggttggctgacatcagtggcgatgcccgcctctgtctcggagacaagatcttcaggacggatgcggatttctaactggagatcagaaatgtacaggtggacagtgaggagatatccgtctgatgtcaaacacgaaggcgggaatgcgagttgggtggtgggttggagtttgctagggcgtgtgtcattataaggagaaaaccttttttgcgaggcggatgagcagatgtcattttgaccgatttttgtgttactcggagtcaaagggcagacattttccggtttaattcttttttttccgagacataaaggaaactgaatggcaggagggtctcttcagaatgtgtccacccacagtgccacagctgctgtggccagttgtcgtacagatagagcctcttgttagaagcagcagatctcatcaacatcttgaagagacctggaagcccagtaaacctctcaacgccggcatagctcgtatcactcctgactgagcacctccgccccactgacgaggggacactgaatccagaggacaccgtaccttacgaaacttcagaaagaactagaatgttatcacctctcgagcaggccagtagacgaaggctgcaggtgttggccacctatatttttctctgttcgagcgttgacgcgacggccacagttcactcttgcggatgaaggactgaggtcgcgcgaattcgggcgttgtcttcgaagaacggcgtaatggttacttgcactgtgtagtggtaccatgacctttttcagtagcctcgtgcgtaaaacgagtttgtctactccgtgagtcgacttcgtctctagcacgacttcgggagtggttacatcagatcagtctattggcgttcagcttccttcccagtggttttgcctttcagagttgtccattgcgatctccgagtgcttgtcacctcaacttcatggggaggagcagctcggtccgcggtgcactttagggagcctatgattgtcgggacttactgtgctgcactaggggattacagaaaacaccgagacctttgttgtaggacagataaccggacatgtttgtttggaccattcaacagatcgtcctcacttacgtgttaccaccccagcaaaataatagttctttcaacgtgcttgctctagcttgattaactggcgaggctaacgtctatgaaagcgacattggcggaaggttctgtctgcttcttcgtagtccaaacaaacatgtccggttatctgtcctacaacaaaggtctcggtgctttctgtaatcccctagtgcagtttctcagtacttccagtccgaaattccagaaaatgacttgccgttttctgtagagattcagctaggtagtcgagaacaagggactcggacgacgacgattcgacgatccctcagtattcgtggcaatcttcttcgtttacaacaatggttggacacagggggctccaaacagtggcagaccgcaagaggggccccccgttgctcgcgatgctgtagatcgcagcctttggttccgtgacacagtactgccggatctggtacagtttcgttgcaagcagtccagtgtcacctcctacggagaaaccgaaattcttcattaaaatgccatcatttgtcaagctttccgaagcgtcgcatctcttttccggatgtggggcctggctgatgtttccgatggggaagcttgtccgtctcgtttgaaatgccgtgaatcaaactgttgcctccagatgtcccttgatcaagtaaggtaacacacatccgttcagctaaagcatcttcattctcagcataaacgctcgaagatgtgtcgcacaaaacggcaaacgaaatgatcgatgggaagcgaaaaacagcccgagtaacccttgaattcaacctaggcagtgtgttgcccagtcagacgttgaactatcccgatgccgatcatttttttaaacgtgagttcgcatcgtgcaattgttaatttggtctagacctaggaagacaacgtttggtagtggctgtggactgatacggactttccacgacgagctatttaagtgcgtgtcgccggcgacacaacgggagagcagtggtcctgtttggcattcaaacgactctgccgtgtggttcaaatcgttgggaggcagtttccacaagatgcgttctcctcgatccttggatcagcttcaagccccttggagggtttttcttgtgagtataattcgtcgttacagtggctagatgttagcaacgcaagcccccccgtttgactataccaagggtagatattgactgcggctcaaagaattttcgctgagtaggcaaaaacgctacatgcatataacagacaagagtgtttctggttgctggtcacttactctccgccgactagttgaaagataacagaaagggatcggtagccaaactcagggtttctctcaga

SEQ ID NO: 902 - DNA, 2435 bp, Toxoplasma gondii
gcgtaggttctgagagtgacagtgcacgaagaacctcagcgaagaaggggatttgtgactttgctcgagcggtagatctatgcattgcttaccggggtggacggcctgctgtatctgcacagagtgggaggttgtgtgggttccaccttttctctgtttcgtgtctggtgcctacgcaggtcgtcgcacacaacggcgtctgggctggcgtagctgtgagcactcttgtcgggcactactcgttgcgtcgctatgactacaaaacaaagctcattttgcttcccttcattgcctacggaggctcctggcttggtcgattcctcgcgaacggcttgactggacgctggtccgagtggggtcgggaccgcgctttgggagagttgccgccgaaagcctactttgaaaagtagatgcgtgtgcagggaattggtggagaggactggctggaagattgctctgaggagaggcgggggtgaccctttttctaaatgcgtttagagacggcgaaaaatatgtttagaaacgacgcgagccgcggaagtaaacgagactgcaacacacaaaactgccggaacccgaccagggaacaaacacatgttacgttttagggaaccaagcggaacaggctctttctgcttttcacgcggaacagagctattgaaagcgttgctgtgtaggtcggggtggtagggcggtgcgcggcgtagcgtgaaaacacgaggtgtacaccactgaagtgcccaggtgagaaggaacttgatattttctctctcgggcgcaaacggatctgtttcatcggggagtttcggtttttttggaaaacgaattgtggattatgtgaccggttgtacccgtgaaaacacacatgctgaagcgcgaaacactttgttcgtacaaagagttaaaaaggacgcttcaactgcgagtggaagcgaccatgctagatgagggctggagaagttgaccaggtgcgtgtgggtcgcagaaggtagacatggcggagcaggcgaagtcgaatgcgcaacagcgagcagggcgcgaccaatgagaccataagcttgtcatagattttgagcagtgtttttttgcgaacagaatcactttccatacaccggttcttcccggaaatcgcttccttctcgaaaacaaactcttcacgtgacacctagatgcttgaaaacaacgaatatacgtatgagtcacataatccatttttggtcacgccaccgcctccgctttggcttcccacgtactgcggatataacaacgtactttcctttgtgaagatttactttttgatggtgggtgtccttttaagcgcgctcgcatcacaaatgtcccaaactgcctttcggacagagtcggcgccgatgaaattgctgcagctagggcgcatgttgtgatctgcgacagtactctgcgtctgcttatgggggggaaaactgggagattagatgcaggcgagagagtaaatagaggcgtcatgcaagacacacggacgtgctgagttcagtacttgagttgatgtgtcgccgcagtgccgttaaagtgagtggtggcgcctaacggaagccgaagagaaaaaacataagcacgaggcacgtgaactcgaatagttgcaacactggtgtttccgaagaacgtggaagatctgtacgagacgcggccgtatacgttttctccttgggttcgtgaacgcgaggagacccagattagccccaaggtgcgggacttgcaccgggcacacttcgcaaggttcgctgttcccctgccttgctctgaagatctcttatccatcagcttattggtcgcggaaactactctgaaaactgttcaacacagctgggtacaccttctccagtatctcgtcacaagacacgatctgggcgcccgcctgcccggatcgatttttccctcgttgtggtgtgcgcactccgtctgggcacacagcagcagtatcgatctgcattcacgggagtggaccggaagagaggtgccaaatctccgggttctccttcagcacaaatgcatgccgctcaaacaacttctgtatctcgctgaatggagctggctactttttctgttgtcgcttcgatcggcgcaggtgtcaacttgtagttccgagtatgacagttttacgcagctagtttctatgtggaaagatatcgagctgctggaagttgtggtgcctacactcaagcgcacagttcttttcagcacgtcaccttttcttttttcgctttttcgaaactggagacaagcgtgttgttgccgccgctgtagatcgtttttgccctgacggaagctggctcgttggacggcgacaccccgcggttccgtgggccggtttccatcgggcgcttcctcctttcttcaccaactaagcgctggcacaagttttttcgtacatttcccggaaggtccgcatttgtgca

SEQ ID NO: 903 - DNA, 2060 bp, Toxoplasma gondii
actcaaaaatactggttttcacgagagttcctacctggagcttgaagaggccaaaggcaaccggaactttcttcataccctcaccccatgtaacaccctccatttgaatcgacttgaccttcttgcagacatcatccagatcggtatctgcatctgcgggtttgacttcaatcaccaacatagacttgttgatcacaactttcttcttcttttccgcctccttcttctttgactctgcaagcttcttcactgcttccttgtcctccgcgctctcctcacctgaaaaaaaacaaaagaacgagggacgatgagctcttcatccactatggcatttgcgtcgcccatcatgaaaaatcctctttcacgtagctctgaaacaaaaatctaacacagcatacgtctcctcctactcctgataaccgcacatagttgttgatgtttttgtcgatcaaactcgcgtcgcggatctggggtgacataggcagactggaaaaccctgattttctgttctccacaaacagggtaggaggtgaatacaatggatttcgcttctaaaccaacaatcaaagtcaccactagagaacgacatccacgcggcagagttcgcgaaactgagcacatgtggattgcgtaggcccatccgagcacggtacaccgcgctgcatgcgtagatttgcttgatattcagagatcagagcacgaagaaaagcctgtgtatgctgagcgttatactgtggctgcaagtgcctgataacgggaggcaaacgcggtgatcgcctcgccagtctatccagcaggcacccccccccctttcccgccggagagacacatgcatcgcttcactcctctgagtgcctatattattatcagtgccaacgcaccaaacaaatcaaaatcatcgtcgtccaccgcagctttcttgggcgccgcagcggcgtctccccacgtgagcgtgtagtaggtacacggggtggcgagttcgtcagaggtcgcgaaggcagtcaccattgtggacaagaagagacaaggacagagtgcagaaatatgtctgtttgtgcggatatgcacggctgcggaagtggagaagaaagttgtggtgcaaacaccttcgattctgggctcacgaacttgtcacatgctttgtctcgttacggttccgtacggcgaatggaccgactgcatgcacgcaagttcttctcggacggtgccgcgagcttttgacaatgttcgcgttcgtctctcccgcaaaatcgttccgcatgccagataccggagttgcgcagcgcaggagcattgccataagaaagacgaaatgtagaagaacgaaatatccctgcactctcatgggtcctaacagtcttcattgactcgagaatcgtgatacgttatgctcgtcgaacccggtacacactgtttgcctcatccgtttctgttctcacgagagcgtgcagactgcgtgtgactaaccgttctggggctgtctggccctcctcaaatgaatacatgttttcattgcatgctttccggaaggttagacgagaacggggcaggggaaacggagacatcccatcctcggccggtggagaggtaccgaaatcgctatcgatatctttattgttaacctcgtcggtggcatgaagttgctgctggctaaaaatttagctaccaatcctgtggagatgtcaatgctgcgctgttcccgactcttcgctgccctgaggaaatgttgactatctcgtgacaacgctgacatgcatagattttgggtcgcctcccctgaaaaagaagttgctgcccccgctccagctcaaagcgctccaattttcgcttcttttctgtgaacacagctcgtctccaaagccagtggccaactgttcccaacccccctctcgcttttgcctgcttctacgcgcagccgcagccactcggagtttttctcggagtcctggctaaaagacgctttacaggtgtcaaaacgactaaaccatgcaacggctacgaaactaaagggtagattttttctggtacacaaacagtctgagttatattttgcgtgacaa

SEQ ID NO: 904 - DNA, 4257 bp, Toxoplasma gondii
cgtacaggttttcaggcagccgcaagtgacgcgtcacttcagacaagcgcctttccagagccttcgacgagtgcagcatccctctatgcattcaagtctaggcttcttgcccttttgtgtcttcttcgtgtcgcctgtccagtggagaaagccctaccagaaatttccataaagtttggacgaaccgttggtctgttttgtacaggaggtcgtagcctcggtcctgaaacgctcgccagactccttcactcagctgcatgcagaggaagtggagaactgccaagaatgtggttacgtctccgcggctcaggttctcatcgtccagcgcgccgggagctgtagggacactcgggatgaaggactggagcgcgggaggatatcgcagacgcctcagagcggacctaagcttcttgatggatcccgagagatccccgggagaggaaggcggaggagaagtcagagagaagcctttcggagacactccagccgacgacagcggcgcggaagaaggcgaacagggggaagatgcaggcagcatttcatcgtcgagaaagggccggcgaactcaccaagagaggaaaaaagatctgggggacagaagaaaaaatccagctaacacgggcaacgacctggcgatagtggattggaagggggcggggggtatggcgaacaggttttcgaaaaaaggtgtggaacagggtgttctttggaaaggatgaaacggcaatacgggcttgcagttgaaacgaaaaagtgatgggcgaagtggatgcaaatgccgagagaaaaagctacattcgtgtgtagagacgttgaattggagcgatacacaggacctcggtcttggtcagatgttaaaacgcgtgaagttcgtcgcaactcgttcgagatcccccatatacctgcaagcgcagacgagatgggtaccggctttcaactgcatagtagagttcttgagagaaggcgtccgaaacatactttcaaacgcacgcggaattcacagctttctcccgaggagggcatgcagagagatcacaggaagaaatacacagacttgccgaatgcgcgacgacatcccctctgccctttagcgtggcaacaattcggtgttaacgacggtgcatcaagaagaaaggaaagaaagccaagcctcctgaaaaaagtcgtaaccatgcgaaactcattctcgtctgccttctttcatcgcgataagacgcaaagacaactgacctctccagcatgcgaattgttgcttcaaagggcattcacggagagagttgcattatttgctcaacagaaaaagacagcaacacttcaacactaccgtaaatagacagagaggccatctgactctggttctgtgtgcggtatcaggacgtctcgtgatttcgaatatcgaagaagacaagcaagaggaacgtgttgctaccaccgaccctcttttcagacgtagatgcgctccctttcttcctcaacctagtccgcttttgtacctgcctacccctactgacagtcttagagcaagctctcttcagatatgcgtcacaggatctgtcataatggacctttgcacttactcagagctgtatgtatcactggtgggcatgacaatagagagctatacgcccgttgactgcagaattaaagatagccccagcaatagcatggatggaaactgcatctgtccgtctccacagaccattaccaaatccaccatcgttatgtggatggatcaaactaagtttttcgtacagactgacgtttcggatctgtccaaacatttcagtgccgcgaggacagaaatacggaagggtacgcagctgcggcgtcattgccttcccgtttccaacatattatgcggtgatcaaagaatttccatccaactccggcagtttgcgattattcgtgacaacctctattgatgacgaattcgcaccagatatgcatgcttttgcagaccggagcataaattcatcagtgactgcatttccagagccgcacctgctcatacgacttgtgcgatcggaacactacacaggttctaaatacagtagctttcaggagatttgccgatttcgaagcggcggtactataatatctggcttcattcagtttcagttacaccagcgtggacgcatacggcaaatcgaatttaacggcaagctcctgcaggaaacggtgcaaggtgaaaacaaacgtctccataacgcaccccgtggttgttttcggaaaagacaaacgagcatctggtcaaccgttttctttctggtatgatctcctactccttatgtacgcgcgtcaaagcacaagaaaagatctctgtgcgcgaggtcgagactcaacacccggaaaactctagaataaattcatgtttacgatatacacagtcgttaggccgtcgcttttttttgttaccgtagttccgcgaggattcctttccactttttctttgtcagcactatttcacagcagctcttatatctaatcgatcctggaaagcttcagaaaagtcaccaccacagtttccaaccttcactggagaatcttgctggccgctgccagtgaaccggtcacttcaagtcgatatctcgatgtgctcttcaacctgttgactttttgacaaagaacatcaccagaagcttcatgtcaacgccacttgaactacgctgtgacttttttaccgtcttaacctgcgcctgtgcatcttttttcgtagcgtcgaccaccaaacattcccactgtattccagaggttgtttgcgttgtcgcgaagtacgaaagatcttgtccgacacttgccgagcactcctcaccttctctttaacaacgtttcgttttctaagccccgttcctatgcacgagacaagaccaggcaaaagtggggcgggccctctttcgcgtgaattcaactgcctctctgcgctctgtctagctgtgagattggtttcccgagcgctctggcattcattggacggttgcggttccttctgatttctgaatccgcgagtattgagctctgtggagctaccaaatcaaaaatcctctgtaaaagagagacggcgctgtggcggaaactctccacaaatgcaagacagaaaccatctgtgctagtctggggttcgctcgatcccggcagttgctaagactgagggtcgctagcgctcccggctccaccggtattttcttacgcgagttaggcggtgaactttttcgtggcaaagctgacaactacctcgcctgttggtttctgaagagtcacacgaagccttctgtgcctccgtttcggcagaagagcctccgcactcacttctttgaagtccatgtttctcctcaagacaccgctctgtgcgctgggtcgggtgtcttacccgcgagtctgctgcatcgctagctcttgtacaaaggaggtagagtggcgccggtacggactttctcttcggtactgtctgagtttttccagtttctggagatctctgcttgaacttgtctgattggatccagcagagccgtctgcggatcacataagctgtgaacggaacaaggatttccctcatcttgcacaagcttctactcggcttgaacttggctggcaggcttcgcgagtagaccgtgtcgagtcactccgaatttgtgttcgtagcggcagcccacaccgccacaaaggtgtgcttccttaccgcgaaatttgtcggtttcggcttttttctggttgcaccgttttagcgcggacatcactcgggcattgatcgtgcttagaaaccgcaagtcgcacaaacgggtctgagaaggcggttcgatgcctgagtcactaatgtgaatgttgcagtggctaccaacgccatttctccgatgaaactttcccttcgtccggtgaacccgacggggaactgctccgactcttcgaaggaactctctagtcttgtgtgtgatcttttgtggtttttttcgtcgtttctcgggatctccaggaccggaagcgtcgccctccacctcaaagtccatcgtttcttcgtttcttgtttcgctctcgatttgtttctagtgggagcgaccgccgttcctattacccttctgcactcgaagggtttttgcgttcttgctcccgccgtctttcctgaaagatttcaaaacctctgcttttcctcggagcagcccactcccgtatttggagggtattagcgttcgtgtttctgcatctcctggacgcagtcttcaaacccccatgtccctctctctcttcgttcactgatccccagca

SEQ ID NO: 905 - DNA, 2396 bp, Toxoplasma gondii
cacagccatttacttcttaaccgtcccacagtcgcgccttggagttctggcgctccctacgtgtgaagcgtggacgactggctggctctcgtgccaggtcaagccggtctctggaacttggtgacggagtgcattttcgttctcacaccagggatggggcagccaatccgcaaatccctagcgaggaaccactggaccgagagcttcttgaggaccatttcctcacaagtgctcaataaagggctttttcgcgcgtagctcgcgtggacggcaagctgatagttctcctctgtgcatgtcattgcgcaatttttgggggtgtcatgtcgattcgccgctgtttggggccagtcaaaaaaccaagctgtaactgtcacatgttaccattccaccgtcgtgatgaccgaccgactgttcgtgtgcctctcttacacattcgcctccgcgtccgcctgcccacatgtgtggcactttgtcgtgctttatgtccgtccacgctcttctggacctctccaccgtgcggcttccgtgtctagtctcgcgtgaaagaaaatgggaggcacccctttccaggcaccacgcagagatcctcagtgcccgtggaagtgaagactggggctgccggaggacgcctttctccggctccgccgcagggttgtcccccttttggcgcgtccaaggtgctcttacacagagttgttcgaaagacacttcggcggcaggacataccgaggcctaaccagtttctgctggttgaggaggttctcccctgcgatccggcggttcggcctgcgcttgatcgtcacgcctgtctgcgtttcgactgttttgtgttgtagagcgtccgtgtgtgttttcgatccgtagggaagctttgcgacagaggggatccgatcctgaggagtgtccagtccgaacaaacacgcggcgccagttggccataaaatctcggtgttctctccgtcgcgtcacgttgacaaacttggcctgctgagcctgtctgaaccacggggtgacgtttcctgtgtcaagtgaccagcggaacgcaaatcgatcagacctgagcacgcgcagctagcctcactcacaagggaatagaaacagagaacgcttctgtccagctcgcagcgtcgtatcgactgacgttgagatacgacacgcacattcgacctggtcgcctgtccaggaggggctgccagttcatagctgttgccgcagtctccaaagcggcgccaatcacgctgacatgcatcaaacaccagaaatttcaccttcccaaacacagagagcgctacctcgacacaccaattgcgcgccgacttcagactacacgtcagccgccggcctcgacatgcacgggtcacggaccaggtttgcagctggggaaaaacaacattatctaattcggctgctcagcagcaaaaacgcggctgctgccattatcgtgagagacaaagtggcggagactcacgaacaccggctccgttagagatctgaaattgcacttcctttgttggtgcgagtcgtgtcacacctcgactttggcgagaaggaaatttgtccccaaaccactacggtggttcaaaagttgtttatgtctgcggcactggatgtcttagatgtttagctgtttcgtcttcgaagcgtgatctcgtttgaagtatcgatttgattgcctgaagggggtcgatacttcttcggtgctcggacacgcagcgtcaacgttcagatggttattgacaacgtggttcgacgtcgtcgtgtaccacaggtcggggacgtacgtcatctcgctgaaaatcaggcagaatcacgaatttgagtgcttcagtcgagtcaacggcaagtgtgtgaaaagtcgccgcggtcttaacgcgcatgttacatattatccatggcctacctccccgcagtatttgcactgattctagactgaatggttctactgggaattttgatagaaaacatgcagacgttgtcaaggccatgtagaccgcctgtcgaaggaaaacgactgtgaattcgctgacttcccagggggtgcatgcgaagtgtttctagcgggggtgcaaacggctcagtggctaccggtctaaattgttcttctttccaattttcttgacttacattacacaacgcgttgacctcatgttgaattctccgctccactgctttcttcgtggaacgcgttccacgtgtcatttcgtgtaatcagcgattccctctcccgaggcggtcctcccgggcccctatttttttttgaaagcccggttttcaattttgcagtctctcctcggtctccaagagaggccgaccctctcaggtggagcctccgcccacaggggcgttccagtccacaaatttctctgaaatcggcgctcttctcgagctaccaa

SEQ ID NO: 906 - DNA, 1410 bp, Toxoplasma gondii
cgtgcttggttcatcgtcagtgagagagccaaaaaggagaatggacgaagggaagaagtgtggcaagatcggaagtttgccacagacgacgcagaccacgaggcagctttctggagctaaccttaccaatagaacccgggcaggcagaaccaggttgctgactggtcctctatgtcagggccgacacccacagtgtcacacattttggccgcaccaccagcaagactagctttggcggtgccgtcactttttctggatcttttctgtcttatatgtcagcggggagggatttaaatcggcccgcagctgtatcgagtcagtgccagacgtagaaatctagacacgggaaaagattgaccggcagctgccgttgagctcccggaaaatcacaggtacgacgggggctttccactcgttccaatctgttgtttcggcagcttgtgccccattgcttggactacacagttcaagaagtcggtgttcaacctactccagtcgagcaccatcaacctataagcggatttactcggagaccagaccggtgcacgtctgttcacaacggtcttgacaatctgcatccgaggacaaaaaacaagcatatgttctgttcatgcagctcggtgtctgacagtcacgggcatcaatgtgacacgcactggcacgttctcagcaggcaaacaggattaatcagaggcacatagactcgttacgtgagtgttgaactttgcatcgtctgtgacgaatcgaagtgttgaccattgaaattttagcatcgccaaccaacaacagtgacgctgcagtgaacattcctcggagctcggaaaaacgtgctagtctcaaaatccagagctccgttcatgattcgtattccagtggcctcttttttgtggttgacccggacggaaaaaaagagaaataaacggccctaatcctccgatctagagtcagcgctgcaaacacggcaatattgttagacgcggagttgctagactgcatcagtggaacctaacagttacctgctgttcaccgacgggcaggtggtccgtttaaaaggaaatcaattgaattcagttcttgcctcttgcaaggcgcaaatgctgtggctccagtctgttggcctcctgttgagactctgcctcgtctagcgctactatgttcaagctagccttcccataaagtttgggttcttgcgcaaatctcgcaccttgagcttgcagaagggtcgccatgcacaacgcgtatcggcgtgcgaaattttttccttgtttctcgattgtcatagtctgcttcaagggcgtcacccgcgtttctctgtctagccctgtcgaacgtccgggcggtcaaagtgactgcagtgtgcgcttcctccgggggatccttcactctaccgccacccttcatcgggtaaga

SEQ ID NO: 907 - DNA, 3179 bp, Toxoplasma gondii
accaaatacataagacagaattttagcacctgcacaagattccatacggtcacatctcccgaagaagtcaatggaactggggttactactgatcccaagaatgaagagaacgggacaagtctatcagaccaccgtgttacacgtggaatttggcacagcgctgtgcgttttgtggaactgttcttcgaaggctgcacatccaatcgcgtgccacaatgaaggtaccgctagtacttgattacgttgccaataaagcagccgagtacgatctgcaacagcaagtaaaaacatggagacggaaggtccaagtcgctgaggtagaggcaagaagagtaaggcagaaaatccaaggcggacagctctagcacgccacaaatttcgaatagcaccgattatgtagacgcccccactgcatcctcttctctcccggaattagcgagaatcaggcctaatatgttgactacttacctgctgcacattccgcatgcagttgctgctgtctgatcctgtagaacattcaagctgcatctcctgtgtatgctgctcattctggtgcttcacccgcccaacctccatgtaccatgggcgttcagaagtaccagaatcgtgggacttgaggactgtggtaattttgatttcattcctgctattcgcctcgtagatccatttgtcgcattctggcggccttggaggagcttctaaggagtggtcactgggatgtattagcgttctgtgcaacacattcaagcactcgtttgcctcacggtcgtaacacactcagggaaaggtgcgtctagctccccagaaaacactgaactacccaaaacgatacaccgcacattgggttatcaccgaccgttcgaacggtagggaagtcgcctacttgctctcttttgtttgcaggcgaaaaccagcagaaagcgccctgcggatcccgttgccgttgcttagacggttacggagcgccccccttccgcgccagttcaaggaagaagcttgcgatagcagtgtggtcgttgtatcccagtcatcgcttgttgtgctgcagatattttaggcgcgtcgatccgccttcctgaaatgactatctcggcgtgcaaaacaccaagcgaccatgtcggccctcgttcaggtactcgtttcttgtacttgtggcatgtgtgcatatgtagtcccacagtcaaagagttttttttgtatatgtgaatcgacgcaggttcctgggaaacgtttgcagccgagcgaatcacacgctgtcgtggtactcaagatacgaatgtaacccttcctggcttggtgatcgacttgatgctgctagtcttccatctcaggtgtactcacatcttttactgctggctgcagaactgtactggactcccagtcaccatcatgacaatgaccgttctgacacgagcaacagtgcgtctgttccgagactacgaacaggccacacgcaaatgccgtaaatccctcgagacgtttacgtcttttttctgtgtcccactgaaggtgacagcgtactttcgtttctgtacaagggtctagggacgcccctgccggtgcacgctgactacgtctgccttacgcacgttctgagtctttgctttctcattttatgcctaacaaggtgatcggggctgagttaatctctcagaaacccttaaatttcgcttcctgatgacaatctccactcactgggcagctgtgtcagcaaagatcccaactactgcagtcacgttttctcggggttactgtacatcgttagtctacagcctcccacccatgggtgatacacatttttgaaagattgaagcaatccgaaaagaaaagacgtagcaggaactactattgggttgactttgaacgttatcactatactgagcgccacacacaatgccttcctacattcctcatgaccgcacggtgcctgacagcctatcgtcgacccgtgtttctaatacgccagttcggatattttgccatgattggacaacttcaattcaacatgtgtacataaacggtcgttgccgtcgttacgggaaaacaagaattgagtgtgcagctgtagccttttcgtctgaaggcgccttgccgtttttcttcagggagtgattcggcacgggaattcagccgattgatcgtgtagacgcctggtgccttctacttactgtcacagttctactagagaattcccgcagattcacgggaaacgcgtcggtcttgcaaacaacaaagtttaatttcagtatccattcgccgcatgcagaaaatattggagactcccccccaaaagcgttatcgaccccctaccgctcagcgccctgtcggctctttgtgggtttgtttgtcgtgtgtcattgggaaaaaaattattgagtttcttgtctcctcgtctcacttcctagcgggatgccgttgtctcaattcaccaggacagtcagcatctcgtggctacctttttccggattgcgagtgtgcaaccgcgccattgccaactgcgaggctggcatgtcttcagcgcgtgtcctacaacgaaccccctggtctgctacgtcccctcgacaattgccatgtttagaagctgtagtctacctcatccgcgtacctgttcttttcctttctttaccaacgtttctgtctgtccctgcatcttcactactgcgttcaaggcacgcctgctttccaattagcgactttctcacgccttcagctgctggccagtcgccagattctgttgcatcgctttcatcgtaacgtctccaatgcctgagcttgccctcacctgttcgaagagttgctgagactgaaatgtccacatggtagtttgggtgtcttgagctgaagcacagacacttctctgtgaggcgggacgaacgaggcaaaatgtcatctcgggggggaaacagccttgcccgctcttcctttctacgccgtccacactggaacccactcgcgttctttccttctttcgttgtttctgcccgctctcggatagcggctaaacggtcgagagcagacgttctttgcacaatgaggaaaaacgcgtacaggcgctgacgtgtaggtgtcacggactccgtttcgttcccgccttcttatttcgggtcgcggtctcgtcagcgtagcgaccagtttgaaagaaaacaaagtgtagttcctcctttttgctggtgcggaaa

SEQ ID NO: 908 - DNA, 2599 bp, Toxoplasma gondii
tcactcggtgtgtgagtgtcaatgagtgactgtgacatttgttctgcgttgtccacttcttgccctcaccttgccactgggtgcgcgctgttctggctgctctggcgcactgttgcggcttcatccttcttcactcacccgtcttccaccagctcagccgccagctccgagtttccacacccgacgtggagaatcctcgaccctctgttcttgtcaccatcaccggctgcgcttcgctctccgttctcctctttctgcttctctagacgggtgggcacagcctcggctgaaccttcgcgaagaccgtgctctctctctgtcgcctcgcgggtccgctcctttcgcgctcccgctggaacacgcaggtcgagggagtcaaggatcgccttatattcggagtagctgccgtaccactcgaaggctcggtcaccacgggaccggaaaaaagcgttccaataggagcgcttgcggaattcttcgatgctcgagggaaggagattcattttggagcagggagaaacgcagaacgggacgagcgggaaaagaaaactcgagggaacgagacgctacatgaaaatctgataaaagcatcctcagagaggggacggggaactggacgagtgcggacgaaagccaaagacggatgtggaaccggaaagggaaatactgagacacggcgacacggagacggagacaggagacaagaggagcgggaggaaaggcagcaaggccgaggagcgaagcgacgaactacaaggagagagaaaacttcgcagcaaccacaatcgaaacaggtgcgcttctctcacgaacaaggagtggggtactgaatttcgacgaagctggtcccgaatagtgaaaagtcgcccagctggatcgccgcactctcaatgtccctacagcctttgaaggcttcatagcgcctttgcgagagttccgtcacgaagcatattatatgaagaacacaaaaaatacatatcgtgtatacgttgttttgctccgttgcagattgccgaagccgcaaagccgcaaatcgatgatcgctgcatgctgtcgttgtcccgctgcagtctcgccgagagagtggactccctgtttgtgatccgtttactgatcaacggagacggaaactcccctttgccagtgtgtttcgagcagaacgtgggatctgcttcatccgaacaatgctgtttcgaatacgagcgcgagacttgttggatcttcggcagtgcctcaagcgtctgcatgccagttttttgtgtcaagagaaaaatcgcatgcaaagtgagacgatgacacaacgctcggaggctgcactgtcgttgccactccaagctgggaaggcgcggcaataatccgtcgcttttccattcagtcctcgcagtgtgcagctgaggcacacgtcacgcaacgagtgttcgcaagccgcttgtgacttgcgaacgcctacggtaaggcgagaagcttcaagtcaaaacatttttctgcacagcgttcaccggttgctcgcgccagctagcgacgcgccaccagcggatcctgcacggaggatgcgaagtgactcgatcgactggggctgagccttcgcagagttgcgattttgcgatggaatgaacacctcgagtaagcggcacgacggtcggatagtggccattttctatacaaaggggattgaaaagacagagcaaactctcgggtaactggtggtcgttggtcctttccgcttcctcgcaggtgcacaagcgaaccgcggccaaatccggtggggtgccctgaaaactatggtttgtgtccggcgcctaatgtctttgtcgtccgctttcgagtgctctggtgtatagacggaaaaggtcctagaccggtggagttttgcagtcaccaggtgtcccacgtttcgggttttccggagttcttctgctccccggtcggcgacaaaaagagaggcgggtggatgtgcagtgcccgagtcgctttgaccaccggattgccatgagtgcttctgctgcacgaaaagcgttttccagacactttcttcaagtcgaaatttgctgtttcgacgcattctccggtcggtgtgcgcagcagggatggtctgtcctccccaaagacccggggaagtttctttccagctctggaacaaacgcacacacagtccgttcaaccttcacttgccggtgcatgtgtcggctgtttttggccactttttacgtcgaatctctgtaagtttctcaccgtttgcgttaggaggctctggagatgcgccaaagagcctcagcggaggagtcgtagaccgtctcggtcaaaattcggaagcaggaacagggtgtcgcagtctctaatgtctcgggtcaaaactcccgtgtccatggtttacccaagcacagtttcgcgagctgtctaggtttcccacgagtacccaaggaatagtgacactgagttcctttgttgcgttacgtgccgccgatcgtccggggagtgtagtgcactgaaatgacagagagccggcttcccacgcaggagagttcttgaattcccacattcgccgccggccaaacgatctcgtttttctgccacgctcctgcccatccgccagccaaca

SEQ ID NO: 909 - DNA, 1635 bp, Toxoplasma gondii
ggtatgtatgtgaaaatgtgtttcgagggtgaggagcgcgtttgtccagagttttttctcgtggccgttgtactccgtcggtgtttggcgtgggttgtcgggagaaggtggagacggttttcaagagtcgttgagaggcggcgcaggaatttcagtccttttgcatgcactgctgaagactccgttgtgcacctcctggaaggtgataagaatcaaccaggaagactcggggccgagagacgaaaagaaagaccgtcagaggatccatataagatggtcgacccctcggtgaggcaactcgaggcgcggagaggcagtctttccgagacgcaagtcgatgagcagcagcctctgcagaagcagctaggccaggcacagccagctggctgcagcggtgttttgttgttctacacgatctcccagcgctgattggaactgcgtggaaacataaagcagtctaggaagaactgaactggaaacgagtcacttttcgaagatgaacacggaacagaaaaggcacacacacacacttgcagaattttgccttgtttgtcaccagaggattcctctgcacttgcatgtgagaaaatcgacttcagtctctggcttctcttttcgtggcaaacaggcgcgaagagagaggcccttctccagggagtctaaactgcagcagtcgccttgtgtgcagccgagaacggagagtacaatagatctgaccccgccggcagctaaaaaaggaacatggcaatgcaagaagtccaaaaagtaacttttttagagatactggagagatgtcggagcgcgcgtgcaacgcctagggcggctccaaataggccaacctcaaagtgaggcaacagagagagcagacatccaagttttctcttccacgcaagatgacgtttctctcactcgaatcctacatacgccttctgcgacgaggtacaccggcaaggtcgtaactcgatcacgacggtttctcgctcatctcgcgaatctgtcggccgcgagcaaggtggaaggcgagaaagcgctgcactcgagtgagtgtatgcgcggaagcctcgtttgaggccttttttgcgttcgtggcttctcccgagacgtcttgtcgttttgtctctttttctgcatgcactccggcacgacgttccaagccccaataacaaacgactgtctccttcccgttcctcaactgattcctttcgactttgcttcgacgagtttggtgtctttccaagttccttcctcaggtgtacgaggagaaacgctcagtgccgaccagaggaactctcccccagcagctcggttccgtcctggcgggcggcttgagtggacctgcagtgtttctcctttttgtcgctgctcttcttctgctttctcgcagcgaaaagcgcgaacgcgagagactctttttcgggggcggagatgcagctgcgtctcagaggccagacagcgaagaagacgagacgtcgaagacgaaacgggcacccgcagaagacgaccggccgccagaggccgggcgtcgaaaatgcacgagattgctgggttgtcttcttctccgaagaaatgatccaagacggataaatagtcaaaggctcggggaatcttttccctggtcgatctgttcagccgcaa

SEQ ID NO: 910 - DNA, 4702 bp, Toxoplasma gondii
catatgttcttctgtgtatgctccactccgattgccgaccaacggaacgcgcgatccgtccagaaggaacctcccttctcctcgcttcgatgaacgagagctgccgcaagtctcgagtcaaaggccagcggtcggaacgcagaaggagaagacgaaggggaggaagaaggagaagaagagggagaagaaggagaagaaggagaagaagaagaagaagacgaaggggaggaagaaggagaagacgaaggggaggaagaaggagaagacgaaggggaggaaggaggagaagaaggagaagaagagggagaagatgaagaaacagaatagttttcctttctcggttcttgaggttcttgtgagggcgacagacggggcgaatgattcaccttctcggcgagggcagacgaacaaaaatgtgaattctcagaggagtgcaggttggtagggacgacgttttctgacgacgtcattgtcgtggcggaaaggaaccacgctgttcaaatcgattgaaaaaatgcggaggaacattcgctgcgattcgacagaggatctcagcctcgacacctcacggtcgccacaaatatcccgacggagatgtggatgatggaaaagcgaggttttgagaagatttcgtcctgccgtttgtctctcaagtttatcgatccacctgcagtgcctcccctacttaaaaggagagtgatgcgcaggtgtacgagcatatatgcacataaccatgtctgtgtgtgtatgaagatatcgagcagcaagcatgtaaaagctggaaaaggtggaagaggagcaccaatggcgggtctcgtttcgtggaactgtgtctcgtttgaatcgtcgcggtgcggccgttgacacagatctcctttccaggggggaaaaagaggcgagagcccttaagactcagtgaaactagaagggtacggcaggtgaaagaaggagttgaaaggagaagaagattccagaggaaacggtgtgaacaatgtgggtaaaatcctcggagagccgcaagccaagactccgcggtctcgacatctcgaccaagacctgttgtgcctcgaacttcctgtgcaactaagatagcgattttcacggaaaaccgaaaaaaagaacgcctaccccaatctcctttggaggacacgagtcgttcttcgagcaagatgagaaacagcgccgtcctttcgagttctacgaatgtgcacgctcgtcgcttctcgcctcgacttcgtctccggatttgagggctgtgtaaaatcagagaacttctccgattcacggacgcatgcaactgagatttgaagttgtgcactcaatatgctttgctgaagctttctctagccggtatcgagtgatgggagctctcagcggagacatgggaacgagacacccaaaggaaaagtgcatgcgggagacgacggcgtttctagttggacagggcagcgagatgccgcaaatatgtttttgttctgcttttcagtgtatgcgtttgcatacgctgtttcgatcgtagaaaccgtgtcaggcgttttggcggaaggcgagttgttttccgttaacaagtgcagacgttatcatgcaacgggaacagaaggtagatgtgcatacagtactcgcatatctacacatgcatgtacgacgaaatatatatctatatatataagagtaagtatttgcagatattgctggatgcgatcagtttagtaccagctgctttcaatctttcttcaatgtcaatgactaatgttggtcagatcgtcttgtgtaccatgaaaggtgttgtttttcctaggacggacgtctagccgacagcgttcgacatcgacatctgaggtccctgtggttcttggaatatccgtctgcttttttatttgaatcgagtcagttctcttgtatctcttcctatccgcgcttccccagggatgggtcgagcctcggagtgcttgttcgtttttggggttcgtgcttgggcaggggggggtcgtggactcaaatggacttcgaaactctcttgtcgtagcaaagagttttcaaacagacgccgctaaagtctggaatgtcccaatttcgacgaaaagcgtggcgttattatcatatagcctctttgggcgtcgcgagatgttttggtgcctgaaacgcgcacctgacttgaaccagacggacgaatgtttgtcttgcgctgtaattgttatgggagtgttctacaaattatagaggacacgtgtttaggcccgactctcgcctttccagcatctccagttcacatcagaaggaggggaaaagggtcgggacagcaatgacaactctcgtaccgctgcacaacgaactgcgcacctgagaaccatttgcggaggtcgacgtaccgagagtttcctccgcagctgaagagtcattcgtgcatttcttctcgtcctcgtgccggtgacaagcatcgctgcggtacacccgtgtaaaagggaagctcttcgccaggtcctgaatgttgttaaacacttcagagtatttcagggtatgtcaagcgtacatgcaacccactacaatggaacacctaagcaatggtgatggacacagtcatgcgattctgtccttcttttccttttcttgtaagcgcgtgaggaacatgcggcacaatatctggcgtctaaatgacgccaaccaaaagtggaagacaacgttcctgacaaagcaagtgttacgctttgacgaccagcaaacgtagtactgtagcggattgctacttaatacaaaccttatgtggaagatgtggagaatggcatacgaatggggaactgcatctagtcagaaggatggtagtaaaagagaggaagcatagtgaaattttatcgctgtgatggcatatcagtttaatatttccttaacagtaccggcaacagcctaaatgtgtatcgacgaggaacgtgtctttgtgtaaagtcccgacggcggagacaatgccaaagacgttgctctaaagtacgtaaagagacatgtgcacacgcccctctgatggtgacccgtggtagatagtccacggagtcaaggagtaatacgagacaaatataactttcgttctgtgatacatcaaggggtggaagtgaaggtggggtatggctactgataggatgatcggcggtttcaacatctaatgtcctttctgggtagcgccacagagcagtgttcctttccacatttccagcagtacaactcgtattataaactccccagaaaaaggtagttttagtaagaaacgtagggatcccattttgtagtctgtgacagcagggagtctagaatcggttgttacctgattgctattacatgcatgatatcttgaagtatggttcttatcagtggctatcctatccccagtgctctgccgtgggtactgaaacacatcctgcttagatggcggtacacataagcgctcgattccgggaaaggtacccagaaaagggggcaacggacgggcttctgtgttgtgttctatcgcaaaatgccgatacacctttgcaagtgacaaaacctttgacgaggctcagacgtatcggaactgaatgctgcaaagcttggaatgagagctaaaggaatcagacatttcagagtcaccgaacagtgacttaacgctctgttgccagcacggggacatggcgttgtctttcccctaacccttggcgtgctgaattttctgcataaacacttgaatacaccagcaggataaaggcgcacatgaatatatctctaccctcaatggaaacgctatgactcggaatgccggaatatgcaggctggatggtttttctgctgtagcaaggcctgttgttccgtcgcctggtgttgattcttgccctccgaatacgcaacgacttgcctgaggtcagccccgcccttcgctcagcggaagtagctgtgaagggacatgtcgcgttggataacgctttgcaacggacgtgtattgcggtactgttgccgtgacgaggaagtttttctgtgtctctaacaagaataccaataatttttgcgtgaggacgcttgcgcacaccataggctgatggcttttccgcccctctccgaacagccatctagcggcgtcgcgctttttcccttgtctcttttctcattcccatactagaagtcacgtttttgttgcgcagagtaagctgattcgttgaaaagagaagtgacaaccgagaagaagccgtcatttagcagggatttttgtgtcccgtgctgtgttgtgattatttaactcctgtgcgtgtgctcgcgtgttccagcatctcccaacaggttgttttcttgctgcagccgtctcgttcctccccgtcctcgtattccctgcagccatctccctgttttaattcatgtagtaggaggcaatcttgaatgtcttgtgttctggctttcaaggacacagctgtccgtcaagaaatctcgtcatcattcattccatgtcaatcttcaaccgtagcccattcccttgtttccacaaacagtttcctttgagcaggttctagcgtctcgttcgtttcatctcagggtgtaactgtaaccaggggactactgaactcaagctgaggactaaactgaatacaaccgtacaaggattcattatttgtgcatctgcgcatataggtcgctaatcagttacacgtatgctaaacatgctacctttccccggagagttgttttttcgtga

SEQ ID NO: 911 - DNA, 2672 bp, Toxoplasma gondii
agtctttcatgtacagaccttcattttcgaagtcgttgtctctctttcttcttcctctgcctccgaagccccggccgcctcggcctctcggcgacgccccctcgccctcctcgcgcgcaggtcttctgtctccgcggcctctcgccgcctggttcacaacgagagcttggacggcggctttcttcggctcggcctgttgctggaacctctccagtttgctgccgctctcgcctgcatgtctctcgtccttcagctgctgcatggcctttctcgcgtcctcgcggtcctcgccgcgtcgcgcactctgggccttctcgcggctgctcttcttctgctggctttcgagcgccgccgccacgacctccttgccggcctcgagcgccttcttcgctgcggcgtaggagaagggcaggaagcgcggggggccctcgtcttccttgcccgttccagcctctcggccaggagcctcgctctccgccttcctgtgcaggcgcgcctgctggacatgctcgcgaagcttgaaggcgctctccagactcgccacagccccgcccagaacctgaaccgtcgcaggttcgaggagaagcaatccgttggtgacgcgcgtccccgcggcgaccagcatcttcaagcccggcaccagcggcacgtccagctgccggcagaagtggtgctcgatcgcggtgtacgtacaccccgcgccgtcagtcagtttcagcagcagcatccggcgtttgtggcctcggtagcacggggcggcagcggccgagcggaagtcttcttcgccttccttcgagggcagcgtgatgtcccgggaggagagcagcatgaggaagagcggcgccgcgagtgccgacgatgtcttctgtgcgagaaagccttcgggcagcggtggcgagagacggagactccgcagatccgaagtcagcaggaagcgctgcaaagtctggagtgagacagacccggaggccgcccgcgacccccctgacgcggagtcgtcgcatgcgtcggcgagcaggatcggaaggagttccaatgcctccggcttgaagttcacactccactgctgacgcagctgagacaagacggccgctggcacagccatggttgctgtctgagagcgagcgccactacagaggacaccgccagcaaggaaaggagtggagaggcagagaggagagaaaggcagaagaagagaaagagacgagagggaggcaggcgcggtaggatgctggaacaggcagtgtggaggaagtgcaaggaagaaggagaggtacgaaggaaaggcgaaagcgacttggaggtccgtggacaggaaggggcactacgaaggaaaagagtgagaccaagtaggagatgtgcgacctgaagagaagaagccagaggaaagaaagttcgcaggtgactcttcttgccactgtgttcacgaaaacgcgacagcaagggtcttggccagacgccgggagacggcacaagtcgacgagagcaaatggccggcaaaggtctacggcgcagctgcgagggggtcgtacccccggcacaatcctagaaaagagacagacaaagagccggggacaatgcatatgcagatcaagacatacctatcttgggccgcctcggtatccagcacaaatccgcagagagcagcagttccggggcggaacgcgaaccgcgaaggtgccgactttgagatgtacgaaccgctggcggcagaagagatcccacggctgtctttgtttaaggggaagaacgaaatgtagaaatctacgagtctcctgtcgtgcgggagacgctttttcagtcggtggcggcccggcttttccgccggaccgctgcgcatgcgcgcatgcgcgcatgccgaccgccagtcccattgcgatttgccacatcgagtctcgcgatgctgaacatgttgacttctgcgggctgttttttcgatttcccactccctaaacgtccagacacaacgacgcttcttgttgaggactcgccggccctttccgctgtctgtggatgttttgagtgcactctccgtgcaggcgtcaagcatgcgttctacgccgtttcactttcgaatttgaacggtttgtttagcgaacctcctcagagcccgagagaaaacgttttgctcaacgctttgcgtccgatcttccgaacccctcgccctccggtgtagtacatctgggcacagcgtctcgtcgcagcggctgttcttggaggcagcgcacgagggtcattcttctatttggccgtttggcggctctttccgggaagaaatcgtggcggacgcgaagaatcgaagcgaagggaagttcgtccgcacgcgaatgagtacgttcaccgtctgttcctcagaacggagtctccgtagtgcgtcgtccagcgaactggagcaattttttttcgccccgcgaaaagactgacttcctgcggaccgcagctgctgacaacggcgccgcccccgcgcagcgcctgtcccacggttttttactgggaaatcgactggcgaagatagacacttttccgacagttatcctccgcggacaagtgaaggacacagacggcaacgcagattccagcagctcggattccgaggcgagcagagcgcgagaaggcacttcgccttcttcgatcgagaaaacaaggaaattcgagacaggggaaaaacgaaa

SEQ ID NO: 912 - DNA, 1242 bp, Toxoplasma gondii
acgcccagaaactctgtagctctgtctctccttactcactaagagccccgcttccaggaatgaacatctacacacgggaatcgtccccatcatatgtatatatatatatatatatatatatatatatatgtatatatcgatatatctatgagtacgcgttttggtcactgcttcggtcgttttttctgtatggctttacccggggagcagcggacgtgcttcagcaggtctgcctggagcgttgagggcgatgaggctgtagggcatggattgtgtagcgcccgttgccgcttcttcctctggattgtgggtgattctctggaggagcactcttttctcctcctcaaaggcgaggccttcaccgtgaaaggctcgtgcgagacgaagcggcgaggcggaaggtcggttgagagcgatcggacgcatgcgactgccgcaggactggtgccttcgcttcgcagagggaccggagggaacggtggggcaggcggcttggtctgcagagtcgacgaccggcggaaagaaaacgagatgcgccatcgtgaacaacagggaaaatcaggtgcaagagtgagcgaagagagggaaggaaagggacagtgggtggcgcgtccggtggaaatcgaggaaggaccgaatcaacgtgatggagtagaccacgagctacgggagagtggagcccggcggaactctcagactgaggccacagcccgcgaaagaggagggatcagatttgatgcaaaggagcaaagaaagaaaggagagacacggggaaaacgctggacggcaaggcagagagacacagagagagtagggaccagtctagtctgggatcgaggcgtcgtcgcttgttgggggaaaagaaccggggaaactcgaacagcgaagccggaagctttggcgagattaaccgcgaacttttgcgctgtgtccgccttctttcgatggcaaggaaaggggagaatttcttcgtctcgtgaaggacagggtcgccgccgacgcgagtcaagacactcacgtggactggtgagcccgaacctacagattttaccgactcgagttcgagaggagcaagaaaagacaactgcagaatcgagagagtggaccaaagaagtctctggacttgttgctctcaagctttcgcggatgttctcccgacgttttcagctcgattttctcggtaggcgaggaacaaacgcaaaggcacgaaccggttgagctctctttgccggcgcgctacga

SEQ ID NO: 913 - DNA, 2105 bp, Toxoplasma gondii
caccttttctttcttgacatgcgctttccttactctcgcgcagcgtagtacgggtctgccctcgcagcgagggatgatggtgctgtgcttgccatgcttgaagaagaaatccatgaaaattcaagaagaattggaaaagaaacgtggagacgacagacgaagagaagaagacgaaggggaggcaggcggaggtaacgcagatgaacaagctggagatgaataagaagaagaaggtgaagacgaagagttgcgaggtctccggcaggtggagcgcaagacaacgaagggaaggaagaccggaaaaaagagtaaaaaatacggggggaaacggagaaaaagacaaaacgaaagagaagaaaacagtgactacaccgacgaagaaaaaggagagaaaaagagagaaaaatggcgaccctgagaatggcacgaggctgggttgaaggggagagcgaggacgacagacacaacagagttcacaagactcgcctgcgacgtacggagaggcaacgactcaaaacggaacagatgaaaacagcatgtatgtgtgcatggttttccagtccaaaaggcgccattcggacttgtgcaggcaaacgcgccaaagtccttttctgcagcttcacacgagaagtgcaggggggaagcaaaacggtcactcgcagggggcgacacagtgaagcaaagcgaagaagtggacaagaagagaagaaggcaggaagagaaaggccgctttcttctgacagaagagcgacagcgagctcccgaaagacagcgcgagcgtctggagttcgtaccccgagacgtcgatcgccacagacatctgcagagttaaccgaagacagtcggccgagagggaacaaaggctctgcttgtaaacctgttcgtttctctctccctttttcctcgtttcacctttgcctccttttcctccgttttctactgttgtctcgccctccagtggcagcgctgtggagcgagaaaagtcgagacagctgagagttgctgccgtcctcgacggatagttagggaaagcgtgactgtagagagtctttcctctccgagccaaggcgttgaaaaccgacaatgcgggtgcctcttgcttccgttccgctggacgaaaacgcttgcatgcaggagaaaaccgtcacgacgccgcaaggcaagagtgtcaaatccttcgtgtgcggcggcgagttctcctccgcaagcctttttgtcttggttctctcgcgcccctctgcacagaatgcggcgaacgagaagacttcgcaggaggtccgcagaacttcaacttccagctgttcctgcccggtgtgcctgcggtcggcggccgcggccggaccccagcgtgtcttgcgactctcagcttccttacgcggtcgcgcggacggtccgtgtatcgaacaaagaagtttaaaaacggcaaagctgacaggtcccggcgttcttcttcgttttgtgccgccctttctgccacactttccccccatttaaaatctgcgttgccccgacctctctcggctggatgtgcaggcggcggacgaggcgctctccccgtttgcctcgacatctgcacaacagcgggggggggagtcgtggggagctgttctcaggtcttgtcttgcgtttttcaagtctcgaaagcggtttttgcgaaaaaattcagcagcagatgattcacagaccgctggctccgctctcggtatcgacagtttctcgatagtccgtcggttctttgacgatttttcgttctccatcgttcctgttctgaaagtttcgtttgtcctttcacctgggttggttgctttgtcctttttcttcgttgtcctggcaaaaggtgctctcttgtaaattgcgccacgggcctctccaccttgtgtgggaactttcctgtcgctgttcttatctcgtttacccctcttcgtgtctcattgttttttctttgttgtctcgctcctcctgtctcgtctccctcttcttcctctctccttctctctcttgccctcctgttcttgtctctcttctacattagcgcgttccgcgccgcctctcggaccgtctgagtccaggagaggtcggctggcagtcctcagtgcggagcagca

SEQ ID NO: 914 - DNA, 4491 bp, Toxoplasma gondii
gactttctttcacgttatgttcatgtcataggtttgaggctcgataccaacgcgacccgaatttcgtcatgaagagcgagtgacggcgctccttgggcgttgtgccttcatttcgagaagtcttcacaggtgtggattcgcgttaattgagtgtaacgtcgctacggggacagctgctacgacgacagtcgcacgccttcctggacaggttgcgcattttgaaggtgcacactccacagcgacttggaccagaaaattggtaaagggaacccatgaaccggtggaagcgttgaggcggagcccggtcttctgcgtggcagtttttgccgccaggacgtttctcttttctctaggggaaattatctataccctcccctggaagcgcgactgccactcgctgatcgcagactctcgctaatgcccggtttttgcgcaccaggaacagtgtcatccatttccagtgtcggccgtgcgagacatattcgccgttgctccgtccctccgttacgggtgcttttttttgtgaagagaatcttttccagtgccagcccagattttcggtgccgcacgacctgctttgtggcagtaggaatccgaagtcggcatgttccgtcgtgtgtgggcagattctgcgcgccaccgcattcttcgtttgtcgtctgtcttctattcttgcatgttggactattcctcctgggggaagtcgtacgttctgcttagcccctctgtcacccctgcagtctccactgatttcggcgcaccacgccacatctccgagttaaactcttctcagagttgtttcacacgactgtgctctcgagcgttgcattgaggtgcataagcgaacagatgcagaaggtatgaacgctggtcttcgtgaaagcagccttccccaatcgtgcatcctaaacggagctgcaaatactgttcgcggggccgtcttctacctcttcaaaagtaacacggcgactcctagctttttagaagaaagactgcggtgttgttgagcgcaacacacgaagccgtgtccagcgtgtcttccagcaggtatgatgatgcatctttttttgggtcaggaactttcagatgtgcaacagcactgggcgtacgaagagtgccccggactgtccacagagggaccgcagcctcttgttttgcagcttttgtacagcatcccttacgtgcgtgaggagtacgtgagccagtgtaactcccgcgaggccacaccgtgtgcgtgcttccgcttaacgcggagttccaaacatataccatctcttcatccacttttgccgcgtgcctcagtagagccacgtccacaacggacaacccgatggccgtgagcgacaccgtttctgctcagccccgaaagtccgcacacaaccttcatacgaatttagcaagatcttctcggcttttgtcctttaggtgtcgagtattgaatcacgtagtctgacccccagagtgatctgcacgaagttacacacgcggaggaaatcgcacagagataagctttttcatgcaacggctgtctcctttaacaggtggacggggggcctgcagagagggagcagcagacacaattacactacgtcgtgtactgggactgggtggcaggggcaggacagtgtgacagggaaaaccgcgcacacagacgtcgcaaacgagaacttttttgaaggcaacgccacgccaggtaccaccccgtgtttcagtaacacagtggggatcacatccgtcacatcagagcgtgggatcgcttgcgcatgccactgggacgatgctttgcattgtagagcgaattgcaatgccaacgcgtggtgtcaacccctcggcggcaaacggcaagctcccgccgcggacccggtccgcaacgggatgcagagtgtacatacacccgatggtaaagttcatatccttactttttgccgttttttacgcacgattctttctgcttttttgtgtacgcattcaatccacatttcccaccatggtaagcgtcaaaaccatccagggggagcgactcagtgcgtgtttctgcttgggtgtccagtcgtccccgtaccacaattgactgcgtccgggtttttcaatcctgtcgctttgtgtccgcacgcttgcacaggtggaggggcgcgctttcagactgtctgcgtagcatctttttcagggttttggagcgaacgttacactcacactgagtggcaaaggataaggggtctcgttagtttttgtggcgcggcgggtgctcccgtttgccgcctgccatcccccccgcccccgggctgcgacgacagagacggcacaggcacggatgtgtggctaggcagccgtagcggacacatgttgcactggatctcttttcgctattttaggggtgtctgtgtgcttgtggtttttgtgaacagtcgggatacggtcttcccatttcccaggaggtggccaaggagctggccgagaacgcccggaagattgcagcgccgggcaagggtattcttgcagccgatgaatccactggtgagtttcaaacagtctgacttgcgcatcaaaaagcggcattgtctttccccttttctcctcatcaggatattcataactgtaccgcttggaagtctgtagctttagggtagtcgccgaatagctcccctgcgtgtgacctcgttttgtatctgtgcacacctgtcgagtgcagtgaaagaaggcggtgttttcgagcccttgtttttacgaggcagtttcttgacaggagcgactgggtcatttgctgaactgaggctgtcttaccgtcaaggcagcgcgagtaacgaatttatgaactgttttgtcggttatgtaccaggcaccatcaagaagcgcttcgacagcatcggagttgagaacaccgaggcgaaccgcgcgttctaccgtgacttgcttttcagcactaagggtctcggccagtacattagcggcgcgatccttttcgaagagactctgtaccagaagagcccgtcgggcgtgccgatggtagacctgttgaaggccgaggggatcatcccgggcatcaaggtcgacaagggcctggagactcttccgctgacggacgacgagaaggcgactatgggtttggacggcctctctgagcgctgcaagaagtactacgaggcaggcgctcgtttcgccaagtggcgtgcggtgctcagcatcgacccggcaaagggaaagcctacaaatttgtctatcactgaggtggcccacggcctcgcgcgctacgcggcaatctgccaagcgaatcgactcgtccctatcgtcgaacccgagattctcacagacggcagccacgacatcaccgtgtgcgccgaagtcaccgagcgtgtgctagcggcggtcttcaaggctctgaacgaccaccacgttctgctggagggagcgctactgaagccaaacatggtgacccacggctcggactgcccgaagccggcgtctcacgaggagattgctttctacaccgtccgcagcctgaagcgcacggtcccgcctgcgctccccggcgtcatgtttctctccggaggccagtccgaggaagacgcttcgctgaacctgaacgagatgaacaagatgggaccccacccgttccagctctccttctcttacggccgcgctctccaggcttcctgcctgaaggcctggaagggtgtccccgaaaacaaagccaaggcacagcaagtgctgatggagcgcgcgcgcgccaatggcgaggcacagctcggcaaatacggcggcggtgcaggcggggccgctgcggcttcatccctcttcgagaaacgctacgtgtactaaacgcgtggagagaatatcggtggatacacaaccgtgctgctctgcaaagggatgagaacggatgcgattttgtcttgcgcagtctcgtacccgtgttgagtgtgcgccgatgtgaagcgtgattcagtcgccgtggctcgaaacgaacgtggaaccagggaacttcgacgcaggtagaccacggggtggagagtacgtcatgttgctagaacgcagcttgtttcctgtcggtgaagtttgaacggtggaaagctgcgctggacaaacttgtatccgcgagacgaacgcagtgcgtctgcggacaaaaaccgttttccgcggcgggcagccggcagaaaggacagtggtgttgatgtcgcggtggaggaacctcgcaaaagccagagccaccgtcgatgaagcgttgaacttcccgtgcatggacagcaaaacagatttacgcaagaaatcctgtgggccgtggttgctgcaagtaaagtagcggtgcctcgtgaaaaaacgcaggatcttgcactgttgaatgagccacgtgaaactaacgaatcggacaactgagttgtggaatctgtagcagcgagctatgctaagacttcagcacagtagtgtgggatgtgtctgccagaagcaaaggggggttagtgtccaaattcgaaagggggctgtttgacttaacaa

SEQ ID NO: 915 - DNA, 1983 bp, Toxoplasma gondii
agttgctttgaacagagaatgaatcccgatcttcactgcaggctcagctggtgcgtcgtgctggcaggaacgcgagtcgattgccagtggagagtcgaccagacctccatttcaaacgtcgattctctttgctttggagcgcaaatacctctggctcctggcagtaatgtggctcacagaaatcattcggtagtttgctttcattgtgcctggccatacctcggtgtgaagtcaccatgacactaatcgatctcgtctgtgtgtctaagtcaaagttgatccacggtgtcgaatgtcagtctcttcctcgcattattcgagagtcgaggcagcggccaatacgcccagcaactagcatgcccttcttctctgtgtcagggagaaatgcgccgccaacggtgtcctttcgtatcgtccacgacaaggtgaaaaacacagctcgctttccttaacggggagatacaagtgtcacaagtgtactttttgacacttccacaaccagtctcggtagcccacaaacgtaaccttaactgtgcaacggagatcgctatgctggggccactcatcccttactcaaagtgtgccaccaggaactgatttcacgttgtcacggaaaagaaagacttaagtgccgacctatctggttcctgtgtttccgcactttgtggtgaccaaaaaagctagtttgacagttgctggtccctgtttgcgattgtcgccagtgtgctcgaggaaatatgggccttttgacacaagaggtggagagcgcgaattacatcgggaggtcaaaggccatgacgtcttcgaaatgaggcttgaacttggcgacaaattccttgtgctttgggtgctccgcgtacacctgcagctggtccttcccgtggaattcagagtagagaaagtgcgagaagccctttgtccgatcctctgttacagaggtccgcatatcgatgaagaagtcgagctccggaatgagagctttcagctgtcggccgtcttgaatgaactgttccaggagttcagccggagtggccggcttgaacttgaagcacacaatatgacgcaggccgtatgccatcttttgaaaaacttccgtctggtgaggcgaacgggggagcagaggcggaccgtgcaaaggcaggaacgaaatccgtgctaagcgacgcacgaaaaatacacgaaacgcggcacccaggacaaatcacggcagcgatcttccacgtcgtgtctccgcttctagttgaacgtgccagaagcggcatccaatgctggcacttcaggtgccacgggaaaagtcgctgaaccccgtactgggtgtctccgcgcagaagacatcctccagcatccgagcaagaactccgacagcaagaaaaaaagaccgcgtcccaaactcgtgtacacctttccagcaattaacaatgcagaagtacttctgcggaaaaagtttccatctcttcctgacagaaagtacaatttcaatgcacggacacacttaccacactcgaacaccagccacgccacaacatatccgatgtacatagagtcccagatgagacaacatatttccagcctttcatgctcttacacagcagataatccgttaacaacaccttttacctccaggtcatgaattaacacgaacggaactagaaagcgcgacgaccgccaggtatcagcgactgaagagttccaacgcgatcctccgttactcagggactgagttgacgtcgcaaaatcgagaggaaaccgagcaatgcagggacgggttcacttgcatagctgctctgcggtaagtgttaaaaaactgggcgattttccgtcattttcgacagtgggaacactttcgttcgctctgtttggctctagacgagggtcctgccctcgactctgagaacaggtgcatgcctctggtagtttggagtagccatctaaagccgatgcaaattcggtaattgtgaggcagtttccagcctcgaaatggta

SEQ ID NO: 916 - DNA, 1905 bp, Toxoplasma gondii
aattctgcaatacatgaatttccagtgtggcaactgacacatttgctggaagaccttaagacagaaggatccgttgctccactagaacgcagctggaaattgactagaaaatatgttgctgctggcaaagctagatgttggatggtagaagcttgtcacgtccctgtgactcgttcatggatctccgttagtctaattataacggagagcttctccctatatctgacgcactcaatgaactactatcctattaacatgaacgctcgcattgcgtcgtgatttatagtcgagctaggaatcggcgaactacgtaccggcattcacatatatttacatagtgcagttactgtttttctcaacaatagaggtttccacaggggttaagtgcgcagatcctccgcacggcacttttcggcactatctaaaattctggagagcccctcaagcgggaaatcggctctcgcgctgccacgatttttgacccgtagtctgcgtgcatgttttgaccaagtcgagtttgtggtaaaacgcgtccacgctttgtgggtaggcgcacagacgagttttaatctttcatcgcatgtttgacatccaagcacttcatgcacactcaagcataatcagtggcgcaccccatgcacgtttgggcaaaatgaaagggtatctcggaaggctcgcatcacgcagaaaccgagtttgtacaagcggttgtcttgtttccatacagaaacggaagaatgcagtggcgtttctcagcatctgcggtgactgtttgtgataagaacacagtgatggaaaacgggctatcgccagcttgccgtgttctaagtgtgcacacaagcagaagaatgctcgagtgttctgtggttttcctttccttactaaactcccggctgaaagcagcctcaagagttgttctgcctactttgcgaaaggtttcgtgcatcgagaatggaagacaaagcctcctctatttttcgggtggttccgttctgcttggaagtgcagccagcgacgaccgtgtctcgtgcacgatgttactgggccacgtgtgcagtgaacattcatggaatataatgtctgtttcttcccagggtttttgtttcgagtgtgtgaccgactgggttggaaatggagttcaaaataacaagatgacgaggatcgcaaatatttttggcgttcgtagtcttaactgtacgggtgtattttctacgcttgtgtgtgcgcatgcatccgatgcgtcaaagatggccttctacgacagcggagctgaaatacagagctctacgaaagtgggagaacttcgtatcatatatgtgttctgtctgatactatatcgacctgcgtggagtgtggaatgatgggtgtgccagaaagaaatccttaggtatggagacgggcccagaattgtgaacggttgctgcaagctggcctgcaaatcctgcccgttggtgtcgcttttggtgactctagtttgtccaagaatccatgaaacggagacgtcagtttctgatagtctatggagtgccgtcatcccctctctcccatcctgtgtttccatcgtagattcttcgttgtgcagtgacaagtccgatagtcggttgccgcacttgggttccgccgtcacttcgtgtctgtcttcgtctgtttcgaaaacatgcaagctaagaaaaaacggattcttccatgagatgagttggatcaagaaaaaagtacaggagtccagggaggccgaattcaaggaactagggcgctcaacataacgggcaacagaagtatttactccaaacgctggaaacaaccggtggctctctggccctggcaaaagtgcaaagcccaataattgcctcaccagcttttgctggacttcttgtcccagctttggcggttgaaaaagtaaagaga

SEQ ID NO: 917 - DNA, 5013 bp, Toxoplasma gondii
tcccttcgcttcgcattcgagagaatggagaggcaacagaagaaggcgtcttcccgggagaagagctgagagtgaggaggccctcggctgtctgacagagacacgcgaatgcggctgcgacggcaggtcccctggtctccacctcgccagcgtgtggagggcggtcgctcttaggggggttcgactccagtctctgagcgcagaggccgcatcggtcggcacctgtgaaacgtcccactcctgctctcctgtggtgagactggaaacctcgccacgatcaagaagctctctgtttcctgggaggaacgagggcgcgaaagcgtgaagttcatgtccatgtcccgtgcagctccaccaattgtctctctctctgcacccagctgggcgacacaagcttctccctacccggtgtttttctttgggaacgcgacggcgcatctgtgcatatgcaaaaggtccatcaggttcttcactcactgcccgagaaccgcatgcagtgacgaaggtgaaaggcgcccgatttgtccgacgcttgccccgcttccctctgacagacaacgaggaaaaaaggggactcaattcgctgggagagaaggcgatataccatgcgtcggactgcccctccaggctgtggagtttggggagagcacggggaggaacggaggagttgttcccctcatcttcgccggtgcaagtctctgaaactgcacaccccggagagcgaagggaaggaggctgggacggagaaaggcgaagcggggaagcgcaggatgagcgaatctgaaggaaactcagcagtgctaaggctctgcaggtggggagagtagacgagagaggaggacgacccagacgcgagaaggaaggaaacctggacggagactgtgtctccgtcacaggaggcagtgaggaagcgcgaagggaagaagagagagaagaagagccagaggaaagtccatgctgagggagaggaaccgcgtgagtcgcttctgatgcaagaaagaagtacagcacgaaaaacgcgagagtaggaacgaaactcttgacaagcgaccggggcacacagcgacacccgggagacccgagcgaaacgtcaactctcccttcaatccaaccggagagagaagaaagggacatctcgctcttctgtcttctcccgataatcgataaagggagaaaagctgttgaggctgaaagatgcgattcctgggtcgcatgcaatttgtacggtggcccggaaacgaagacgagcggagagtcggaaagcgtcgatacagcagggtagtgtcagagacagagcgaatcaataaaaagaaaaagggagaaatccacgtgaaagttttctgtctccttcgtggacgcggtcactcgctgaccacctgaacggagaatcgcgtctgtagaattcgcagcacgaaagaaaccgaagttccgcaattgtccttacccctcttcgaggtaaaacagtgtagatcgacgaaaggagaagaaaaattgttctcgttctgtctctgttctcgctctggcgagaaggccgcccccccccccctctcccaccaagagcgcaaaggtgtggaagaaggagcggcgtgtgggccaagatcgtcgttttccgcgccggtccacaaacgaagaggtaagaagaagtgaagctgaaggagaggaagaaagagaagggaagaaagagaaaacgcgagaaggagcaaagcgcagcctctcgatccctcaagtcgattttcctttgtttgcctccggctcagtctcgagctttttctcaatgtctttactgcatgcaacacgagacaagacacgagactcaggaaggatatggtggtcaggtactccattattttcttggaaacggaaatcgtcctaaaagatgcaaatgcccggtactacagacgcgtataaaatacgctagctaccttgttttcatgttcctgacggcgacgtctctgccagcgtctgcgatttcgacgcatacacggtgtctgatgtattaaatgtgtcctgtcaactcgttgctcttgctctgtccacacgagcatagcacctcaacattctggacagacgagcggatttatgactaacgcgggtgctcggttattcaagcttctcgtccgtgcgtgcaattcaacactggggaatctctgaggcaaataccactgtaaaaagcatctgctcagagatatacagatgcgtagatacaagtgtagttgtgtagtctctgcggacagcgccagcgtgttttctcgtgggcgaaagcgagagaaacgccgccaatcttgaaatgtgtaaagtaggagtttccccagacgtgtggtctctctctctctctctatatatatatatatataattacatatatatactttcaaaactacatgcatacaaatgcatgctggatgtgcatctgtatctatgccaagcggcaataactcgccttaagcgtcactggcagggacaagttcattgctgcttttacactcgcagtgtgtctgccattccacaggtgaggtcgtcgacgtggcaagcttttcagagtctaagattcgtttcttcatctcgaatcgtggtgcattctttcgtggagcttagacgccgagaaggcggcatgaaaaagagtttcactgtcccgcatggatgtggaacgctggcttttatcacttgcagcccgtgtggcacagcaaaagaaagaaacggctaatacagaaatacagacgagcaacgagattcccaatggagacacgacaatagagagaagtagtttgcgaacggagcaagacgccggaacagaaaagcgttttagcgaaaactcgagagagtgaaaatccaaaagcaacgagaggataggggggaagcggacttcacgatagaggcacagaggccgagaatgtgacggacagtgaaacgcagaacaagggatatagcgggaagaagagagtgttcgaggttgaaattcggcctccttaccacgcggtgtacctacggacatatttttatgctctgttagttatgggcagctacttgtgaagggttccgagctacgtaggatccttgtgtgacctctgctgtgggctgcctgctcttccaaaaaacgctttggccacttggtgagcatggtaaacctccagcggtactgagctagagagagcgagtcaagagcgttgctcctttcgtttgtttcttcctcattcgcactgccagtctcggcctctcttgtcgccctctgctctccctcgcctagccacgcctgagaaaagagacagcgcctgagacagcaggaagagagaacagaagaagtgaggagaagaagagagaaaacagcagaaagaagaagagacagaaatggtgaggagaaaaagagggacaggggagacagagaggaaaagagagacagaagagacataaaaacgagactatcgaggaacgacccgaaagaggaagaaaagagcgagtgagattcctgtgcctcacacacaaagagaggaaggagagagaggcaactggggccagccgcgtttcagtcttcggggatgtccgctcataattcaaacgcagtgttcaacgtctgcttcgatttgctgtaagttctgctccacaaaatcacctgaaatgcttctactggtgtaagttacaaagatgactccccatctgcactttcaagagcgtgaagatccaataatatggttacaaactcgatcattttcgtgacgggtgcgtaccccccccctcccctgttaacggcgcggctgtgtgacagcggtgacgtattgtcttgttctctccaggtgctttccctgtgtagtgcccttcactttgtccctccaggatccttcgttttccctctgtgttttttttctttcgcaggaatatcgtgtttcctccgtcttcagagacttcgggagactggcgccatgggcctgtctccgagccacccgcgtctgacggagcgaacaccggagacaccggcgactgagaggtgagagcatgcagaagagacaagcgggttctcatgttccgcctcgcttgtttctcccgtcgacggttgttacgtgtgtgtcttcttgcagagtcaaacaacgtcgtgagtccccgttctttcttctcgtctgcatcctttccccggctcttttcgtcctgtctcccgttctggattggccccggtcggtccggtcgtcttggctcgttgaataagtctcgctgagtgtgtgttcgcaccgccacgctcctttttctttctgtcttcgtgcttgcgtttcctcttcatctgtcaccgtctctctgtgcgcgtctgtctttgtctctcgcgttgtctgcctttctgcccttgatcgcctctcgtgcctcgactctttcttcacctttcggccctctttctgccccgagttcacgccgtctccttcgtcggtctccttttgtctcctgctgtctccttttctcgcgctgcccttctctcaccgttcgtcttgggtcgcttctcggccgatgtgcttgcggggaaaaaacgccgtttccgtccgttcctctgtgccgctgcacacaagcagcccaaaaattgaggaaaaattgaggtccattctctcagcgcacaccattcgttttctgcggcgttttgcggtgacacttcagtgcgctcgcaaacacagcgagaagaccctgcgacgaagcttcagacatttctagttgtgagagcaggacggaggcacagcggagaactggacgaggacgaaacaaacgaggagaaaaaccgcttcggaggaagcgagaaaagtcctcgcgaccttcgcttctgcaaaaggcaacctctctctgtttcattctcacctcgagattgtgcattcgaataaaccgcattgacgaggaaggctatatcctacacagagcaggcagctgagtcttttctttttggccaagtcaacctaggatctcctcctctgttccctcaccttgagatctgtctcttagacgcgcgcgcttcttcttctcacttgcgcaccgctctcctctccaaga

SEQ ID NO: 918 - DNA, 2778 bp, Toxoplasma gondii
cttatcacatcacctctgaatccctacaccgagctgaagtcgcaaaagcgaaaaagctggaaggacgcgagtaagcgaaacagactactcttggacgcacactggcgggtctctcctttgtcacgcgctctctgctcctgatgtgttccacctcgaactttcgcctttgtttctgtatctaaatgtctacacacgacgaaagacacggcgactcttgatccgtttctctgtcgcttctccaacgagatggaaacgcgagcaaacacgacatgcaaagaactcgactgtcgctcgagtagcaaaattcatctgtttccaccgtcggtttttttttgaatcaaagacacctcacgccccaccatcgttctccagggtgtctgcagagtttccgttaaaatacgtgaattaaaatgcgcaaatggtgcacgtagaaaacgcaatccggagaagccaagactgaccgatgtgggccgtttcttcttcagtgcatctcgttctgcaagcttcgtgttaacgtagtacgcgaacgccgcgatggcgaggacgagaaggacgagaacaacgaagatgcttgtcactgcaagacacagggaggagagcagccagaaacatactgaaaacaggagcaagaaaaacaaggaaagactcctcgagaggaaaaacagcgacgagcgacacaggacgcaggaacactgcccgcggtactcgcggggcactccgcaacactcgagtacaaaaaatggtagagactcttcttttcagatttcgggagggacgcggacacagctagaattttgccggaagccgcaaaatccaacagtgtagaagcgaggagaattggagaaatggggagaggacaggggggttaacgacgcacagacggacactcttggaagacgaagaaggcagagaagagcagattttcaacgacggggattctgctggagaagtgtgtgaggagcgagaggctgttgttcttcatttcttcgcaacgtgacaagcccgagaccgcgtttaaacagacgcatgcccagtgcctcaaaacccagaaaactcaatgaaaactgcccctgccgactcccggcaaaaagttcccgccaacctaccggtggaagaaaccgccatggtggagggaatggcagatccgtggcaaatcacagacgaaatcgccgaagttaaacagaaagaccagatacacgtgtggacacgcaggtacaccggtgtctcgaccgcagccagggagagcagatttccctctttcaaggacccgagagtggttttcttggtggcaaagaaaggaagaattcaaaaacagaaataacgaacacaaacacaaaccgaacacggtcttcagagcgagaagaaaaaaccttctctctgctcgagggacttttcccgacacccccccccccacccccctctcgctgcgagaggcccccggggcagtcacctgcccttgtcgcctaaaatcggatttgtttctcgtggcagcggggcgagaagctcttcagtttgagcaaaagtcaacctttttcaagcgagagacttcggggtccatttcctcgtcacagaaaccagatatacccaacaccagctgctgcgtagtgaggcggctgtgcgcctaccctcggcgaggcaactccgacgacgcagccgagagtcgacaagcgcgttttctctcgctttctctctgggtctctggaccgtttcgattcatcgcgacaaagtcgcaagccgtcaaagttcccatcttcctttcaagactgctgcactcgtcgaaagccgacgtgtgtcagctcggaacgccgtgaactcgacggccttccccactttttcgctcttggcgtggacggagaaagtccgctcgcgagttccaggcaaccctctggcctcggggggccgccgttgcaatggctggcctgttccgcagaacttccccttttttctgtgttttcgacgcgcacagaactctttttctgccctgtcgttgcgcgcttagctcactcgtctcctcgcatcccctgaaaaaaccgaagcaaagcgagaaaccagtcgccggagctgctggctggcgcaggaaacctccgagactgtcttgcgagaaaagccgagaggcctgcttctttccttcttctcgctcgtctcccgtgtctcccccggccaagcggcagggtcggtcgtgggtgggagatgcgcgcgtttttgatatctctcgagaaaaaaaagagtataaaagagtttttcactgcttctcgcgtcccgcgtcgtgtttccctcgtcctgtgaacgaatcggctgcttcccgcgagtccctgcaacttctctcgctgctctcggggttgtcggagtcagcaccgctgcgttcagcgttcctgcgaaaaaaacggggaatcgaggaagttctttttcgcttcgcgctctgttttctccacgaggtcgctcggctctccttctctcttcctcatcatcgcagaggcgccgaaacttcgagactccgacaaccagcgcgttcttcccgcgccgtgaccctgacttttttctggacaaagagaggccgttcaggctcggcatccggcgacctccttcctcaccaaccggtgcctctcgacgtatccgagcgacatttcgaactgatttcgcttttcgctggagcttctccacgcgcaagccgccgctttccggcctcctcgcctcaccccacctcccctcccctcccgcccccgcagtggacggacaccgcgcaggttcttcgagcaagtcggttcgcatttcgcagga

SEQ ID NO: 919 - DNA, 1762 bp, Toxoplasma gondii
atcttctgttgtcccgtgcctgttgatgctctagatgcaatgatgtctctgacgaaacccacgtacgcctcttctgcctcttctggttccattccggtacactggcgccatgcgttcctgagcagcatagaaccaaacagagcaggcctctttgatcaatatgggaagtcactgtgagacctcgaaacgagtttgtgcaaaagacgattggacaaggttggccataccatttggcgtgtcgagcaagttccacgatagacggttcggggtcggcgcagtttccgactgtagcctgtttatagaagcctgaaaataaagcaagtttcttcgttacgcaaaaacttcaggcgcgcgtgtgccacaccgaattcacaagaaggaaaatttgatcttgaaaatgcgtcagcatgctcaggaaatagtgctccggcggcggtacacaattagagaatcaaatgttggccacttcttaccgtagagttgcagctgatcctctactggacacgcttttccgtgcgatgcaacccaagacgtcgcctcgttaaacgttttgggcagttttcctgtcggtccaccttctacatcgtcggttgtgaattcaattacagggcagtgttgaaataggagtcgggaaaacgctctcctcagttgccgtgtcaaacgaggccagtcggtcttgcacaagacatagccagtcactaggcaggtggctgtggagaccagaagggtcccaagatgtacaggcctcgccatgtttattatatggttgaaagaagcagggtgacagattttgggtttgcgcgactacacgattgcttactatgaggagaagcgccgttccataaccaacaacatagaggcgagcacttccggggcttaatggcttaacgaggcagcctgtgagacacaattccactttcccagagctgcagagcctcacaagataaacacagaccgatttttataaagcaagccacgcacgccgtgctccctcgactcgtccgtggtcttcgccattcacactgacgaacagaccgtcccatatacatccgggccggcggctccggggataacagtcccccgttttctccttgcgttctacagacaaaacagactgcacacttgttataagatagtgtgccttttggaggaggtgacgagggaggaaattccacatgctttctcaagttagcgggccttgtgactcggcgcactcgacagcacaaggttgcatgcagacgggcggctgacgtcccgttttttccgcaacagatgagcatgcagtggtgagtacatcgaagcaatgtcttgcgacatctttcttcttccacgtaaaatcgggatcccacgcgaacaaaagataacgaacagtcattcatacgcgcgttccagtcgctggggcttgtggatgctgtcaggccatctcagacaccgaaaggtatgtgaggcggtttttggtaaagcagagcctccatgtttttgggaagcgtttgtatcttcggaaactttctttttcaaaacagtctcttcatgcttacagtcgggaaacgcgcagaatcacggcatcttggccctctcactctcaagagatccgctgccttggcacagcagtgaatttcttcgcggcgggcacccgcagcctgagttttcttcagatttgtcttttttttatctcgaataagtgtagaaccgggcgttttgcgcgatatttcctcttcccaattgacatcgtctgctaccggggaagcactagagaggatca

SEQ ID NO: 920 - DNA, 3829 bp, Toxoplasma gondii
acagctcacttaccgcgatcgattagccagtgattgaatatgaacgctgtgcgatttgcccgggagcgctctcctgcaggtgccaggctctctcggacaagaaaatggcatgcaacggggttttctcttgcagctttttcttgtcgtttgcctcctatctgcatccgcgggagaacagtgtgagtgccagacggacgggacacgtgcgttttgcgcgtcgtcaaagtccgtttgtcctcactgtcaaactcttcccgggctaaatcaagtgtgacgctgagtcagcctggtgtcttcccgtttcgcgtcgattcgtggttttcgtgggtctcgcggccggcgactgccaaagattcacgcgtgtagggcaatgtggcaactgggtgttacgtcgtgttgtcattctgaatgtggcttttagaagaaataggcggtgtcaaagatgtagggaactgtcaacggcacctagcgagaagtcgctaacgtgtcgcggacgaggggtacttttcaggagtgtgtatggaaagccgtgcgtgctccagcgtgtggagtgttgccagtgaacgacgaagcaaagatagtgaagtaattcagtgaaaagaacgcacgttcccacacgatacattattatgtaaattcagtgtactactgcagacagttaaatcctttaccagcaaagttaccaagatacgctccggttcatcaaagtaggcaggattgccgaggcgctggcgttagagcttggcaaaaagtggccgttcgtgcttcgacgcttcttcgtagcgccgatcagctttccacgaaactgagaggcagaaagcaaaaagactcaccaacaggcgaaggcagtcactggcaacggtagaatcgctgcttgtgtttctttgcccacagagccgaaccacgagaaactggatcccgtggaaaaacgagggcgtatgtcgatattcatttatttatctaattaccgggtatatacgcattgcgaggcaaatgtacatgaaaccagagattcaaccccgattgctgagtcgggtgcgagggaaagagacggtctaatttccccgggaaatcggagtgctgcgatgtcacttttcttttgctgcggtaatcgattccttgatggcagcatcggctttaattttgtagctagtttcgtggacgtgtcgatgcggaccatttggcaccggcagtcatgatggaggcttccgtccaagtggtgggattgaggcagcaaagcatgaacatggattctgaattgttctagtttgcggcgttctacttggtgctacgtttgcggctgtttccggcagtgcgacacctgtaggctaacagggagcacacagcggaagaaggggactctatcaataaaatatgaacgctgtgcgatttgcccgggagcgctctcctgcaggtgccaggctctctcggacaagaaaatggcatgcaacggggttttctcttgcagctttttcttgtcgtttgcctcctatctgcatccgcgggagaacagtgtgagtgccagacggacgggacacgtgcgttttgcgcgtcgtcaaagtccgtttgtcctcactgtcaaactcttcccgggctaaatcaagtgtgacgctgagtcagcctggtgtcttcccgtttcgcgtcgattcgtggttttcgtgggtctcgcggccggcgactgccaaagattcacgcgtgtagggcaatgtggcaactgggtgttacgtcgtgttgtcattctgaatgtggcttttagaagaaataggcggtgtcaaagatgtagggaactgtcaacggcacctagcgagaagtcgctaacgtgtcgcggacgaggggtacttttcaggagtgtgtatggaaagccgtgcgtgctccagcgtgtggagtgttgccagtgaacgacgaagcaaagatagtgaagtaattcagtgaaaagaacgcacgttctctcacgatacaacaatggggtagtgtagcattgcaagcagtgacgcaaaccgacaataaataacggaagagggaattccttttaacatgagtttcgaacttcttcacagaaatttgccattgatttagataactttcgctatggttgttaccctctttagctgttgggtactcgtaggccgctggtcgcactcatcgaagagggccctcttgtagccctcttgccaccgattttgaagaaacccgctttgtgtacacccttagaaagccccggctttgaagcaagcttcgccttttctttgttctgcacgtccgagacggactcaaaatttgaaaagcaggctgagaacattctgaatatcaagcagagcgcgtggttaaaacgtattttgtgcttcagttcgaagtgtggtgggcgaagagagaccggacaaaaacgccgcagcttcaccatgtctatttctatgttgagatgtcatacccatgtccggaagaaatcctccgtacttcgccgaaaacaatactcccgaaaagtaaaagtttgtaccggtaaacactgacctctgaaactgtagagcagcgaagcaagaccggaagtgtgcttttgcgccagcctgcaactgttcccgtttcgacgggctagtaacatatgtcggcctttctcctctggcgaaatctttgtatgccgttgcagttcctgcttaaagcgcatgtttcgcatttgttccatcctttcattgagttttaaaatccaatttcgtgttggaacgcgtctgactaggagatggacgcgtcgatgctcatgtgagtcattcgtaggtcgcactcggaaggctcgcgacagcaggaaaagagggaagaggacatgtaggcctgtctcagggtcacgaagccaggaagaagcaccccggacggacaagcatgaggaaaagtcttggcatccgtccgcaagtggcgagcgcgcaagctgttcgtgtggtttattgcctcgtgctagccacagacccagttttcatatcggagaagtgggctgcactggggcgccgatgcctggtgaacccgtattattcctgctagcacctttttgagctttcttccttcctcagaaagagagagacgtacactccgtatacgtcttctttctgccaagtttttttctcgctgagacacggcaggcttccgcgttctttgtagatctcgcgagggaacaagcggacacgcggcggcgcgcaactagctcgatgctctcgcttcctgctgactgcctcgacgctggtcctttttcacaattcccccgaagttagcgtcgttctttgttgtggtacagaccactccactcaattccgttttcaggagtagtttttcccgactgcgctcaccagaaatccttttttcctgacgttggccactggcacgcagagagccgtccgtctgcctcgtgtcccctgtcaagacctgcacagggacaagacctgagaagcgaggtcgaaaggacaggtctgggaggtgtggtccgaccgggaataaagcgtttctctgtcttcgtgtctctttcggaacgttctcgacctctgtttgatgctttttctgtctgcaattgccgttgtgaggagcgcatagagaggaggcgcggacggcttccagcgctcgctactgctctatccgactcttgtcagctgtaactcaaagagcgctttcctcatccctcagtttttgtatgactcttcaccggtaaacatttgaaatcttcccagattcttcgtaaggcagagagtttcaacctcggttttgcttggcggtagacagctcaaccacctcaagagccactcgtgtgccacacgccacgacctcgcctgaactttgacgttctttgctgacaata

SEQ ID NO: 921 - DNA, 2668 bp, Toxoplasma gondii
ggtaaagagagctagtctctcgctcataaaagtcctttggttcaagaacgaacggtgaaggcatgctccgacgaaggtcttcacggtcctctctcgcacctcagcactttcaactggtaagaagcccatcgacgagcctaaaaaatcagtttcatcatttagtccggtttatgtaattgttgcctgaaaaggtgttgcgcctgctttatcgattgtaactgctgcttctggtcgtcggacaaaagctggcgttgagccggccgaagatgcctgccgcgacgcagactgcggttgtcagcaaacgcgagatattcgcgccaagcctcagtgaaaagctccagttgtttcgaaaccttttctgcctcggtcacttcccgaacccaaggcgcttggttttcaggtgatgccttctcacaccccgtcgggtgcttctctgcttgtctaaatcgccctttccctgagaaaatctcttgaacagcgatgctcgggatgcaccctgtaccccgttggataggaagcgcgtcgtttccggcgttagacgacccgtccgaaaatccaccttcaggccgcggactgtgtgagcctttgctattcgtaggttgaagtgcgacttctggaccaccagtgtattggcactcagacgcagaggcgatagcactagcggcttcggaagctgcagccatatgagaacggaattcagcacgagcgaacttgtccgccagatcgcgcatgggtgccgagccgagttgcgttctatgaactcgtaacactcgtcgatagagttgaacagcttcacccagctggagttgaagccggtcaaacagaggtacaagaatttgcgacgccattgtgaacgaggcaaatgtgcacgggttgacaactgggaaaaagcacggagctatggcgagtgtttcacgtcgaagaggcgcggcggtcgctgccaacactgggtgtgcctgcgtatctcgattttcctatcctgcgttcactctcgtacacccatttagccctttggaaaaggaaaaactctcgtgccataatgtgtgagttagctgtcgttgttaagcgatgtcgcacacacagcggagcttcctgttcgtctcagcagttgacatctggatgaacagtgacgcttgacctcgaatggagcaccatgcgcggtggactgtccacacgacagctggagggacgccgctccttgctggttttcccgttgaccgaaagtgccgtagaaagcaccgatatatattggtgtttgtttggcagctgaaaaagtcggatttccccaccacggatgagaacagtggccgcatgcgcgccgcgtttttccttcgaaatttcaccctaaaaacggtttgacagaacggagataaatctgctggagcagtttcagagcaacgggctgaaacagtgtggcatgttcacaccaaacagatttcggacatacacaaaccaatgccacaggttaacaggtcgatccggaagtcattgaccccactcaaaccgtctggcattcgcgagcctcgatgaccgtgcggatgaaagaattaatacagtccgcattcttctggaatgcgtcttgtacaaactttaagcgcttatgtggcaggcaattaacaactgggtcttgagactcaattgctaggaattttgtgcgcataaggtgactgtgttagctaaacggggggccaggaattgatcgcccgcaacttttcgcctactcttagcgagctgcgctgtgaggagacacagaccaaaacaccatgtgccgtagcgtgtcggtgtcttatagtgagaaaccgcaagcatgcctcatcatggaaatgactacgagccgttccttctggtagccaatgatcccaatctactttaccattgcgacctgcgttcaaatgttatcttttttccggcatctttgcgtacgaagcttgcccacggtgttccctcccaagacgacaggcgcaaccgagggttctgctagctgcgacagcgaagagggcttgcagttccgtagcaagttattgcagagctggcatttcgctattgatcacctgaacaactctggcggtttttactgagttgaagtgcgtgtttccagcttggtaccgacgtcataagtggaccgttaatgagccgccatccaatgccgctcgactacgcccgcagacgaaaaccggttgtgtctcgctagatcttttaccagaaactctggtaaccgcgtatacagcacggatttaatccctattcaacatccgattgtctatctcttcgtctcaatctgttcgggttttttttgaagaggagcactgttgctggatcactaggtgactgcaccctgtcttacgtcaacgcaataatcggtacaatgcccttgtcttaggtcagcgcttgtctaacgtcagtgccttgaatagtgctttcatacgagaagtaactttcaatccctgagttaattttcttatgagaagattgcattttcgccatctgcttttgtatttagtggcggccctggttttgacgccttctaggtccggtgcataatggtgttaagtcctgcaggtgttgcggattagccggcgtgcaaacggcaggcgcacaagagtgaaaaagacagtcgttgtcgagacacccaattggactgcttgtttagctgacacacagttcaata

SEQ ID NO: 922 - DNA, 2942 bp, Toxoplasma gondii
ttttgagtcgaatcgacttcgtgacacgacacccgagaacgcgagaggagagccgatcgaagagcgccgagcctcctcaggcggtttttctttagaacagtgcgtcgttctggcgaatggttaacagatcgtttcttctggcgcttggtatatgtgtgaggtggagaaagtgaagaacgcattttgcggctggaggggcagtttcccccaaggtttggccgcaggcagttctgcgacagtttgtacacagttgcactaggagagaattcgctccgatgttgggcgcggactctcactggacaagcggtgcgccaccagtgtcacttgtcgagtcttgtcaatggaaaggtatctcgtggcgaggaatttgaatcttttcgccttttcgatttccgtacgtgtcttcacgggaagtcgcgtccccagcggaaaaagtctgtgctcgcccatgcgcatatttagttcttcctggcgcctacggacagccaagttttttgaggcagcgggcgcctctgcgcatctgtgcttccgtagtatgtcactgtgtggcgcacgcgcgccttccgtgtaacagttttttatccgtaaagtaggacggatctttgctatgttttcgttctttgtcattcattttgaaggtggactctgtcatatccgagacacaaaacagttgtcattccttgtagaatcagttcgccaccctcgcggtcgcgcgggacggagaaaccttgtccagaaaatagatcacttcacagcttctccgagttccacttcagcgcgcggaaacccgtagtagcatttaggcttctcacttgaaagtgtacttcagcatgacaccacacaagagactagaaacaccatgcaaatacgatatggtgagaccgctgtgatgctgcagcgcgacatcgagccgacgatacaatccgaggagaagaactcccaaattatctgaccgggcaccccggcgtctgcgcctgagaaagctgcagttctcattgcataaaatctgccaacatgcttgttcggtgatggactgtttccaaggaaaccttcctcagggactcggcagtacacaagaacttgcaggacacgaggatggataccactacaggttcagacttactgtccacgagagaggagagcaaatgtgccgcaagtggctttttctgcatcgtcaacgatagttacgctgtaacgtatccaccaggagcgagcttttcgtcctggacgtagggtttgccttcaccagaaatgaggctgagaggagaggcagacggaacataaatgaagcttctttcctgcaagagccagatgaagcaacggccttcacttttgcactcaaggatcactttcgccactctgcatactctgcatgcaacagtgtcttttcccctcgtagcagatgtgtgtcgttgtctctgaaccaaccgttcgtctagcgggcgtttccaattccctgccgcaggaattaggcatctcctgcgttttgcttcgtttctgcagaactgctgctgctctttttccttttttctcggcggtttcaaggtcttttgtttccttctggcgtagaaacggccaattcccctcaacagtctgaggttccggcgcgtgtgcagacccgtgacacacctctctgattcgtttagaaaaagtccgttttttcctgtcgttgtccttttcattccttctctcattcatttccctcgtcacctttctccctggcttgctggcgtcttcgcggttttcacacgcctcgactttctccgggcctcctccaagcccggacagcggcgggcaggcgaaaccacgagaataccacgaaccttttccttctcttccgttttctttcctctcctcccttttgtcttccctctttcttccttattttctcgttttcctgtctcgattttttttctgagtcctttcctcagtctttctcgcttctgcaacaaggcttgcacagaaacgagggcgtccacacttgcgttgctttttcctgcgctctgtagcgactctcgagagacagtggagttttggagtcgctgggggacggcgacgcgtatagagaaaaaccgcagaaaagagaggcaatttcgctcttctcccttctctggtctccgtccgcgtttctccctccagcgagcgaatcgcagactcgcggaacccgtcgaattctccctttttgcccagccgctagttgacactgctccaagaagcatttttatctccgacactaggtcgaatgccccgggatactcgatttgtcaaccaggatacatacgtgtatgtttgcgtatatgtagcgctcttgtcgattttactgcgcatggcgcttgatctatgttagtgaggaagagaatgcgcgaccgcttgccggccgttgcttcgagcgcgccccgcggcgaggaaaggacgtagacgaccgcgtcgaatccttcacttggtcgacggctggggtcacagaggccttcctgcgggcgatgaggcagcctcgcttttcgcgagtgttttgtcggtcgacgcggtgtgcatcgcgatgactcgcgagtcacgcaaaacgcaaagcttcagctgctctcttgcctctcgcctttgaagacgacgagaacccagatccgcgacgatgcccccgctgccttgatgcgcaggtcaccggccggcggatcttcgaggaagcacacaaacgaagggaggaaagaacaagagcgaagaacacgagaggaatccggagaggagatcaagtgaacgtcagagacgccaacaaggaagaaaatacgcgacgagaagagcaagagcttccgcccacctcacggagttcgagcgcactcctatcgagactgctctgtgcaggccggtgagacgcggcgacagcttgtgtctcctccccgtcactcgaggttcgttgcgtctctcgcggaaaggtcctaagctgcacactccaa

SEQ ID NO: 923 - DNA, 2673 bp, Toxoplasma gondii
ctttttcaacttattgccttcgccctcattgttccttatcgccgaaacatgactgccgctgtcgccacatggagagggcaccgacgatgtaccaacggagaaaaacgtggtggtccttgtttgggaattcccactggggggaagatctgcatcggaaggacggtgctccagtcgcaacttacggaaacgccacaaaagcagacaaaagaacaaagtagaagtggcaacaaccaacagggtaagtgttgactcaagaggcagcggaacgcgttctcccgagcatagttccgaaagggataaagactcaatgctgaagaacaatgcccgtgccggaggcggagcggagggaggatctgttgatggctgctccatcgtgtaaaaaagattggagagataaatcaacagagatggaaacaaacatcagtgccaatcaacagaccagctggcctcactcccatgacaaagccgcaactgtgcggaggccgacaccattcagctgtcgagaaggatcgagtaccaaacacgctgcatggtgctttctgagcttgttcgtcgcaggcactatcactggttacaaacgccgcctatccgggaaacgaagatgcaggtggttgcagccgcatgcacagacagcggcgacactacagtttaggattgtcggcattcgccagacgacaacttgcagactcccgtggacactggagcgctttgaagtctggggccaccctcgcggcaacgacaagaaaatgtacatcggaaaggggcaaaggacaccgcgagttgtgttcggtgggtctctttgtgttgagaagtcattggttgtgacagaagtagacccaaaaccgcgtcacgcagacggacggataagcacactcaagacttgaccgttaatgaaacacggttacagactctgacggcatctgagacaccaaaatcttgtaagattgtacagatggcttgacctctgatttgaaaacgtgaaaaccagaggatcacaaaagaagtgaaggagtgttgctgtgcatcgacggccgctagggatttcgcagtaggcatgcgtccaccatttagccacgcgcgaagatagagaagaggtgtttgagtaatttctcagggaaaattgacgcgaagaagtagttgaccaacagaaaaagcatcagaggagaatcctgggattactgaaggagcatcacagaatgaaaacaaggtcttctccaatgccagaatttcggtgggtgtgtctcctgtctcccggaaaatgcaatgctgcgcacggtgtttgtctcgctctagggggttgttggatggcaagacagccaacgtagaaacgcgaacggcccggtcgagtcaactcgaaatctactgctcgtgataatctggacaggggagtttcaaaaaccggaggacaccacgaatgacctaaaatttcattgaactccttgcacacatggtgctcaacctgaaatagcgagactttgttccttgcgtctccgtccacttaccccacattacaacttctgtagttctgccgatacagtacttcacagctgaggcttgcccgaattatcattccttgcctaacaactcgttcctgacacatcgcaggcgtatccggctcaccctgtgggctgagttggtatacgtttttgagaagcgaaatgctttcgaaaggtttctagagcttagaagtgtcgccagtgtttagccttgcttttattgtggctggcttcatgccaacgctagtgcatgacgatgaattatacagccatttgaaatacggatgaacctggaaatgcgcgtgctcggctgttaacattgttgcggtcttgattgacgtaagattcggacttttcagagtcccggtgctccgcccgaaagcaaacgtaacaacctgctcggctggttgaattttaacagacgtgcttctcgcgaagaggttgcatctacattaagtcctgctgtgtagtctaccattaagagaatttgaggaactggggttcaggctatacttatctacaaacgcgcaccatctccgaacctaactctaagaaaaattatcgattcagtgcgagtaacccgaaaagggtttttcttcgcggctgccccaggagaagcctcaaacagaaaacttatgaagaaatcacccatagactagaaaccgctcgagtattaaatggcgaaagttcccatcactgttaagacaccacatggtgactactccccgatgtgtttgatgcatagttttgtcgttgtgccggcgaatcttgtgtctaagttcggcttgtcacaaatttgttagtagtcgtgaagagccattggcacagtctcagcgcattcctccgttttaaaaaggcgtcgtaggagaaagccttcaggtacacactacaagtgtgctcgtagtcgtaggaggaaactcggcttccgtgcgcgtttgcgtctctggcaacgaggtacctctgcccgtcggccttgataccgatagcagttgtggcaagcgccgttcgaagaacaagaaatagcatgcattgcacttctctattgttttccgtcattcttcgcgtccgtttgtcgtaacgcaaatctaagtagcgcgatgagtatctatcttgtacattccagtccttgtcctcccaaataatacgccccgcatagatcacctaagttctacgctca

SEQ ID NO: 924 - DNA, 1903 bp, Toxoplasma gondii
aggtcagtgtgcaacgatccgcagtgaacgaatgagtccgtttgggggccttcgatttacgggaaattgaagagtgtggcgttgccatccccccgggatcgagactgaagattttgcctttccactacacagaaagacctgcagctttcgtcaggcaaagagagaagtcgtgaaattgtgttctacagaacggtcccgtattccgttcacatggctctccagttttctcgcagtgctgagatcgaaatgccagtgtcatttccccccgagttccttcccgtccatagagaaggccaaccatttactgtccaccctcgtctgcagggcttgtttcaacgtgtgaactggtaaagagaggatgcggattttaacaaggggatctatgaagtgcacctgtgtcagcctcgcagacgagcgcttctcttttgtttgcatgctgtcggcttcactcgccgtgaaacccgcaatccgctgttgcagctgctcacctgcaagattccgcttcccattagcaaatgacagaaaggctcttcactgtcgttccaacgtttgcttccttagagtagacacccaatcatctggacctcttgcgttccgtacacacgtgcaaaggtaattcgtaccgagaaagactcttcgcagccgctaagaccatccgaaattttgtaaacaggtttggcatcatcgccaaggaaattctagttcatgtcagtacgtgcgtgcagtacaaagcacacgcagagaggacaccagttccctttgtacgcccgtaaaatgagaatttaggaaacttatcccaggcgtttaatatggtggcaggaacgtggagagaatccaccacttaggagtgtacctgctaaaactgtcgtcaaaacctttgcctccacacgaccattgattgccgcttgctattattttgtttcgccttccgtgcgtgccccgagggcatgcgtaggtttttccaccagacttccttttcagatgttacatggtgattgccgctgccaacatagcgagaccggaggcaagacttagagcacttgaggtgtctgtaggagtagaagccttccgatcttcgttctttgtgcaggacaaagtcaccatttcaagaacagcgcacgagcttcgcgcttacctcgcgtctttgttgtgattttcttccggagcagaaaccgtattttgacaggtgcatgcggcttcactcaaactccaaccagctgttcgttgcacagtgagcggaactttttgttttccacacagtttgataaggttgttgtatccagcattttttgcaagagatcatttccaggaaatcgaagcgaagccgctcctccaggctcacaagacatgtccagtgagttgagcgcgtgtctgtctctgcggaaatggaactgcatgcaccaactcgatcgcgtcgtgtcgttttccacgtgcagaatgcgaggcctgaattcgtcttcttcttctcctaacgcgtatggatatcattttttccactagtaaacaaagaaccaaacttcgttctcgctcctgcctctggaccacagggagccttgtctccgctcaaagtctctttggcactgcatgcgcgctgcgcgtgtgcagagacttccacgctcacttgattgggtctttagggagatcttttcttgcagactgaaactgagaagcctttcaattgtgtaaaggaagtatgcctttcggattccgctgcatgtgaatgagcagaggtctctcgcttgtgcgtggcggagatccccgcctcgcggtgtacgccgtgcatggcgtctggccccaaactcttttctttcgttcactgttacttttgcgcaacttgtcacgcatttgtgtgtttgagacaatcaaaaccgttcgttttccttcaaaaaatgcgctcaaaaaa

SEQ ID NO: 925 - DNA, 2017 bp, Toxoplasma gondii
gcagacgaaattcccgaagtggagaatgtgtgagtctcgtccttgtgtagctgcggaaaaccagagtgagagccagttgtgtagttgccgcaagccgttgggcggcccccgggccgaacacgagtatctccccgtagagcaaacgacgcctccgtacagtgcatcagcatgaatgtcagaagctaccctcagaaaagtatatttctcctgtggaccagctgcgcacgtggacctccagtgaaggtggctgggaaaaataatctgagcagtagcagctgcaggacgtggcggcagaattttgcaagcggggtgacaccacagtgtgttcgctagtcgggcgccgtagacgaagacgaacacagattcgttccagtgactctgcagcataggcgaacgctgttgtagaagagaaaaacaaagaagtcaagaaggatgtgcggctgcaaaacggcggatcactttgaagtggcgccgcaaaacggttgctagcggaagtgcgagttagcctcgtgaaccacgtttcacgagtctagccgaaacagcgacccaaaattgctaccgctgtacggtagctgcctagtggtaaacaatgctactagcgtgcaaatcaggggtttggtggactggtgcctcgctataatgatctcaagaaggggctcgtagatggtgctcgtgcaaatgattcaagtgtaaaagtgacaccacaggagttaatacagtatattcacttaaatcatttctagatgtattggcgtggttaggaggaacgaactttgacggctgccgacgattttgtaggtatacgtgagagtagtttggctgaacgtgtgcaacagaggaaagtttgatgcgttgacgggagcaggaaagaaggggtgacgggtatcatctgtgagaatgaaagaccgacctgataaacccattcacttggtcagatgcaactggctagcgaatacgcgttgacgtttgccgcgaacaaacagggtcacctgaagctaacataggattcgggcatagtacaactgtttaccagctgaatacaattgtacacatgtgttgcgtacctttctttgatttcttgagcgaacagaagtcaccggagatgacggctgcaatacaggcagcttgaaagagcgtcagcagcaaatctatataggggtggcctctgcagtcaccgcagctgcgtaccaattaatggtgaagcactcccgcaaccatattgtctcacgtttgagacgctgaggcaacagctgaatatcgcagcttgtcattttactaccatttaatgctgcgaagaagcgtattgaaaattttaattatgacacccgccaaccttgtcaaacaccgtgcatgcgtcaacccgttttttggacgatgacacaaaacaacagcgttgtccttttcttctggcagtaggtcctctggagaaagaacgcttaggttgagcgaataactcagaggtttatcgtgttgagcagacttaatgacaagctctttcatggagcatagtcaaacaaaccggcaccgagactacgctctgtgagcgagttactacatgcaaatatggcggccgaacaaaacctgccaattagctatgctgaaagagtcggtccggtgcatttttttcagcattccgcacacttaagaagatccttactctttttgcaaccacaaaaaacgcagcttctgggtcccgtccaatgcaggaagtccttcgatgcttcgtttcggtggatttcggtttccttcctctcactccgtgctggcgtacaataacttcctgcaccgtcttgcagctgcgatggtacgccctttgtcttaagtgcagcagtatggtgcccgctgccacaggcttagcaggcatgccgacaagggactcgaagcaagttctcgtcagctttgtagggtttgggtaaatcgtgggacgtttcagcatcccgaacttcagatgctgacccactcgagtttcgtcttttacgagggttaaacgatccactatccttcttcacatccctaa

SEQ ID NO: 926 - DNA, 2043 bp, Toxoplasma gondii
agacgcagacaacaaggcgcagcgaaaaatggcgaaaaccgagactggcgttcacgatcggaccgagacaggcgacggacagagcaaaggagagagacaccgcagaggataaaaacaggtgaaggaaagagagaaattacaggagggaaggagcaggaggagagaaatgaaggagtgcacagagacaggaggaaaaaaggaagaaggaaaaaaagaagtgggcgagtgatgaaaaggaagagcaagagagaaatgagaaaaatgacgggagagagatctgtcagccgaaggtaggtgtgtggggttggtagtccgcatctgggtttggggacggcttccgcagcatttgcgaccccgctaggacggttgaggcgctaaaatcaactttctcaaacagaacgcgacggctttcaatcacgcgctgggccgacgaaggcatgccctatcggctgtctggactctgcaagtcgcatgcgtcgaggaatgctcttgagacagctcacagtctccgcctgcagaaggaagtatcgtgtccctctgtggccacgaacaggctcttgcagcgactctgtgaaagcggaactatgccagcgtctggccagaataaactctcgaccgcacgagggcgcagttcgaccacggcttgtcccggaaacaacaagcgcaaccttcttgcgggggatccacgcgtcgttgaaagaggaagccgcacctgggagacccgcgactccggagagctcagagaacagacggaggagaatcgaacaacaaaacaagtcaccgcgaaacaccggcagtgcgatttgccgccaagtcactctccctacaatcgaattgacgcgggaagtgaacaagtcttctgaggcataactccgtctgtctgaagtatagtaacctacacgtgcaagtcggaaggtggagggagtctcagagttcttcggtgtacagacaggccgttctgaatcgagtcctcagcgctgaatgcaccgccgagtctctcgcaatgatttccacttaaccgtaaccctccagtttccctaaaaggcttcaggaaggcacgaaatgcagggtaagcggcgaagaaaagcagcggcaaaacgctcggaagtctctccgtcgggaaggcgctgtcaatcacgttctcgccggtggcgccagtcaagaacccgctgctctccaatttgggctcggcgcgaatgcatgcgactttgctcgcaaacgcgcgcaaagaagaccgtcgtgtctcccttttctctgcgcatctgcatgcccccctcgtccgcgaacgttcttttaacagggcaacacgacgataggaaaacgacacaaggacacagcacggaaggggtttccccctgttgactgctcttcctgcctctcttgttccctcctctttaaagaagccgcttggaaaaaacgaacgagcagggaaaatgcgcgggacaggcgacagcgctgccaccggcaacgcaaaccgagacaccgggctcacactctgtcaggagcatcagaaatgcgcgaccgttctagaaccacgttctttgcctcttttgtccattgacacagagacatcttttctgtttccgtcctctgaaacagcgctcacagttccgtgcttcaccggtgtatagacactccggcgtccgcgtcgccggcggtgagttgccgtgaaagaacgtatctgctcttcaagttccccccggtgaacacagctgacactcaccgccgaagagtttgtgtattatgcagtggttcatctcatgccttcatctcatgcctgaagtgatgtgctgtagacagcgtggcgggcatcagaccgaacgtgcgatgcataaatgcatgttggatgactgcgtgtcagaaaagtgcgcccccttcccgagaacaaacgagttgagacttgcctagagttcctcgcaagcttctcgactcaggtgcttcgtcgtaactgcaggcatctctctagcgtccaggtatccttcagaagcgtctcgtgctgtccgcgaacgtgccccgcgtctcggccatgcacctgccccggaa

SEQ ID NO: 927 - DNA, 5038 bp, Toxoplasma gondii
gaaggccctgctgcctctgttgctgggctctgatcttctctctcatccgtttggaggcgtggagagatctcttcttcggactcggagtcgtgagcctcagcgggagtctcagcgcgactcttccgacagtctggagcttcatcgcgctcagactcgtcgccacagctcgcgaggcgcttcgcgcgctcttgcgctctgcgaattcgcgcagctacctcggcacacaactcggcgttgacaaagacgaagctgctggacctggacaaggcgtcggcctctgggcttgttcgcacgatgctgtcttccttcagtttcttctcccatctcgcgtccgcgagccaggaagagacgcgcgactgggtcggcgcccaagaggaaggagagcgagggacgctcgcaggcggacggggagacggagggccatcggacagatcggagtcggactccgagcacgaggaagcagagagggcaagtgaagagcgctgctctgcagtcttgctgtggagtctttcttgggtgccgctttcatccgcagcctcacacaaaggatcagacaaatcggaatctcctggcgcgttacttgcgttaccacggactgagcgtcgtctgcaggtcgctaaatctgaagacgagcaaggagacaaggaggacgagcaagcgcagggacgttctcttggcgacatgggggccgcgagaccgtcaggctcctgggaaccgcgtcggagcagaggacggtcgctaatagagggagaaacaaaggcatccggtttcggagcagtggtggcttcaacctgtccagcgttttctcccgcaggagaggtgagacagttccgttcagaagcgaacgaatctgacaagttggagtcgcgagagctgcgccgccgccagcctcgcctgtgcctcggagaagacatggtcgaggagggaagaacgctcggaaagagaagcagaccgcccaagcacagaactgaggcgtcgaggcagaagtcgaggcggaagcaggtgaatctgtatcgctcagagggaacaacgacgtttgcgtctagacagcagccgaggcaggggtgtgtaccgccgggtcaaagtgagatgccccagccattatttttattcgttctggtcagcgaactgacggcaaattggctgcgtttcgcaggccatgggacacggggcccaaaggaacttcccccgccgcaggccaagcatgcaagttgtgccagctttttgccgagctttatatttttggcaagtttcgaggggaagtggaacgaaaaaacaaagagagcgaaaaaacaaggcaaacgaagtggacatcgatacttgatgatcttctttgctgcgccgtccttgcagaacggttgcacaagcagaaacaccagagaaaagtgaaaacagaggcgggagaaaacgcgcggacgcgcggaccgaaacaagggggtgggcaggaggacgcgtcgttcatccgaacgcgtcagattgcacatggccagaacgaagagggatctgcaacgatcaatcgagaaaacgacccaaggcaacggctctttgcaggcaaggtcgcagcgtaggaaataaagccgactcagctggagagagcaaggaagacgcacaagcgtacagacgcaagaagagacgtgacggaggaacgtcgggaggccgcgagctcgacagctgcgacaagacagaagaccgaactatccggtcgagcaccgacaacaacatctggtgcacacatctgcgcgacagtaaaaggtgtattcttactcaacgcagcaacaacaccatgtttggacttttttcagtggaacaaaggagggaaaatggttgtgtcctgccgctgcgcaaccgagggaggggagggggaggagggaggggggcgaatcgtggaaaacgcagatcatcacgccaaacctgtttgtaaacggaactgtcgacccctatggcggcgacccaacacgagactgtttcaaacagagatctttcactcttcttctcctatcgatcttgccaacttggttgtattacactgggtaagcggcaggaggctggggaaaagccttgcagggtgaggtcagagaagccacgcacagagggtctcgtccgcaacccttacagcagtagaagacgacagacagtgaaattcagccccgtttcctttcctctgaagagaaaaaaaccttcctgtctggcctggaaaggtggaccatcccatccagcttctcacagattctcgtagcccaccgcgggtctgatgctaaaattcctcaaaacagagtttgaccaagtccattcgcttgccagaggtcaccaagcagcagatgggaactcggaaactgcgtacgaaaagtatgcttgaaggaaagagacagggaatgagcggaagagttgagatgtatttctttgaaatcgtcttcatggaagaaaactatgaagtcgcagaaaccatctctatcgttcagtttctgtcagagtacgtgaaaaaacttacgggtttcgaaacagaacgggccatccttttgcattacggtgcactgaagcacagtccccaggtaaaactgcaaagagtccctgttgtgctgaaaattgcgtaaagaaaacgtcgcactaaggaagaaacatgaacagctccgcagaaacatttcaaaatgtaaccccacgaataagtatgggacaaacagtaacccgactcattgaatcgatcagcctagattctaaaactgctacaaattctgttttacgatgaggacatcctcctgcatctagacgcttttgcgtgtagttttccaatgtttgtatttatcaaatccaagttgtttctgtcttcttgttcggaatacacacaaaaaacgtctctcgtcgcttaagaaaaaccaaatgttcgacttgagtgcagccgacgtcttttcaagcatctgttatacggtttgggtcagtgctttcattgcgcgtcgcccaatttcgtcacatatgagaaatttgcatgactgcattgcgatatgacagcttctgaagggcacactagaagtcggtacaatatccatggtttatcatctccctggaaagctggtaccagcttcacgttccctaggcaccgcggaaggctcaatcggctgggagcggggtgctacacgatgagctaactcgctagaaagacagaaaatggggagagctgttctcaattaccactgcgcgcgtaaagaagagcaaacgaatccggaagcagagctagtttctctcctggactaccgtcataacgtgacactcactagcggaaatgatgcgttgcttatcataactgaactggaaggacccgccgcttgcgacgccgggcccaactgattccgacggccggttggtctgcaaaagtatcgataggactgccaaacattcgccaatttcgtattttcgttcgtcgttcccctgtccgctttgcgtccgggcgtttcacgactgggaaggatgagtttgttcaagaccagcacacggcacatctgggttggtctcttcgagaagaggctgtccctgggagtcacagcgctcccttcctgaagaaaaaagtctctgtgtgcccgacatggatgtgcagttccagatgacacgactatcctttgcgcctcttcatgtttcatcaagaacgacaagaaggattgactaccgactcgactaatcaacgcttcgtccgctggattcgcgtgcgtcctgttttccttttttgccactactcgctggtcttcggagctcgcaacacacccggttcgcctcgtgaaccagtgagcatctttaggtgaacaaacagcgcagattgtccacgtctgatgaccatcaagcgtctcattttaccccatgtcggtagaaacaatgacccacacactcagctagctgcgaggatcttccaagactcggcgctgtactggcatatgtgtgagagagcatgcacctatctgtgcatcgcagtcctgtttgcagtgattttggatgatggcgtcatactttgtggatccgcccgtctgttgctcagagtggtgattccagagtatgaatatccaggtgaattacacattcctgacggaatgccaggcaccagcagcctggtacgcggagttgtggggtcagagtatccagttcgagcagagaaaccgacgatttccaaaatccccgcactgcgcatttgtcaatcgacaagaactacgtcctggaacggtgacaaagtttagtcagtgtcgaaaggatcttccagttttgcaaaactaccgtcaggcaccgtcgcgctttttaaacggcgagtcccagcccacccaccctcgtcgtccaccttgtcttcgtttccccctgggtgttgaagggtcactcgactcccctcttttgcgacttttcctgtgatgagtgaatgcgttttgtccatgcagctgcattaactgtttctggttaaggaaccagggagaccgctgtttttttcgtttctgcttgtagcttctagttccatttctctcctcgaaatacggcacatgccagttggtgtcgcatgcagcagctgcgagcatcgattggctgtctacgatgaagagtcgtcaagtccagggtggtcattgtttctcggccctctgctctgttcgacacccgtttattcgctgctggtttcactgacgctctttccacttgtccaggtgatttgttgtccagccaaaatccgcctcttgtcttgtgctgccttcgtccccttcctgcgaaaccccccaagtctccgagaggcccccctcaaattgcccgccgcgaatttgcctctggaaacaccgcagcagttacgtggaagtattccagcctcgactttgttctgtcgtcgcatcgcctctctcccctcgtttcaacttcctctccttccacccagcggcgatcgcggctcccttccctccgtgacttctttgccgtgagtgaagggccgcgtcgttcttgtttctgccactctccattgtttttcctggtcgccttcgtttcagatcttttctcgcgagttcttcactccttctggatcgtccaccga

SEQ ID NO: 928 - DNA, 4125 bp, Toxoplasma gondii
cccagttcataatgtggtattcctatggagattgtcagtgttctaggacgaatatgaaaagaaaaaaacaactcgggttggaatggcatgggcaagagtgcgtgtggcacaccatttgtcgacgaacgaaaataaagaaagctctcctttcttgatgtaagtgatatttgatccgtaccttggctgcccgacacgtatgactccatatcaacaccttcactgtatacgaagtccttcactttctgttccgtctcccgtgcttctgctccctctgtgatctcttcagtcttttgctgaggttcgtccgtcgtggatccacgtgctgcttcctgttctttcttcagttcgtccacgattctctgaatactctgtaagttgaagctgccatcttcctgcctgggagcagcgtccaaacctgcatcgccctcatcacttgttaataccctcgcgtcatctccttgaatcgctaccgagacattttccttctctttatcacttgttattaccctcgcgtcatctccttgaaatgctaccgaagccttttccttcccttcaccacttgttaataccctcgcgtcatctccttgaaatgctaccgaagccttttccttcccttcaccacttggtaataccctcgcgtcatctccttgaaacgctaccgaaactttttccttcccttcaccacttgttaataccctcgcgtcatctccttgaaacgctaccgaaactttttccttctctttatcacttgttaataccctcgcgtcatctccttgaaatgctaccgaagccttttccttcccttcaccacttgttaataccctcgcgtcatctccttgaaatgctaccgaagccttttccttcccttcaccacttgttaataccctcgcgtcatctccttgaaatgctaccgaagccttttccttcccttcaccacttgttaataccctcgcgtcatctccttgaaatgctaccgaagcattttccttcccttcaccacttggtaataccctcgcgtcatctccttgaaacgctaccgaaactttttccttctcttcatccttattttccccaactaaatcggctagtacgaaaccctcgtcctcagtagccgaggacgccttggtagaaaacgataccggcacctgagacactacgactacaacggcagccatcagcagtgttcccaaacacggaaagcattttgtcctgacacggaacggtgtgaaaatgcatcgcttccggctgagaagcgctgctgagccgtgacacgatgctgtagatgccatgttgtccaggcaaggcaaaaaccacataataaacccattgaggaactacttcaccgcgtttggttcacgaaatcccttagaaaataaagaaagacgtgttcaatccggagagtcaatctcacaaatcaacaggacgccgtttgctcgcttcgtatattaactgagacgccacagcgaagagtcgcgagcctctggtgggttaagaggacgcgtctctaatttcatggggttgaagccgtgtgtccccggcctcgttctggacgtatctcaggagcatcagcaggacctttgtgttggtgacagcaggcgaagccatcggcatcggtcttcacagtaagagcttagtagtatgtgttcttacagaaactgcaatttcgttcgtcatgctggttccaggtttgaagcgtagacgcggaattgttgcgttgaagaaatttaacatctgctttttgtgtcttccaaacaattgcgcttacgaacagttgtttccttgaattgcgtcgtttcagttcgcctgggaagttgggatcaatcactgccggttcatttcatcatgaaacatactggcagctgcatcgcgacgatgcaaaatcggacaaaagaactcgaacttgcatcttagtgtcagtgcattttccatgacttctatacgaagaggtggtcgaaaagcactaagacggttgcggaagaacacaaaaacggatgtcctccagtccttcctagcgctattatgtgaagcgctctggtgtgttgagggagactgttttaactcgtggccataccagccggccgtgtacatcacacggtagcgtcggaactgcgcctagaccgcaacctttacgcgttttcgcgattgaagaaaagttaccataaagcttctaatgcatcatattctgtcacctagccgcatgcttcgaaacctgtgcgtcccttgtctcggttagccacctgcgaacacctgttaatccagctgccccatcgtatcaggaatggattttcagtaggggcctggtgtagcaagcgaaagagaacacgcccgcgcgtaggagtcgatatcgaagatcaaaaggggggaagaagcatgacatccacatctagctttttgttgcttggcacttcgtttctgcagtcggtgtgggcgttagctggtggggggttcagcaacaacgtgtgtcagatgctggggtccctcttagttttgcattaggacttccaagacctgtagttgtttttacgtcgcggcccactcgaagggggaaggtcacgatagtgtgtgtacttagagtgatgtttgcaaagcaccacgcgcgtttggctagagtaacggagatgcaagcaaacgcagagcagctccaaatgcccgccgctgtcctctctcaagcggttctgcttgcacctggctgctttgggcttagtatacattcataggaatccccaaagataactacaaagtgaaaagtctgtaatgcctcctgcatcagttcacagagttcatccttcgaatgtgggaaggcgctggcctttgcaaaagtgcagagggagaagaggacatatgtcgccataagcaaaaagataccaccatttcatgaaagtctaaaaagaaggaaagtggttcgtgctttcagctgacatatctgcctcgccccttactgcacgttgagaacatcgatacatggctgcgttgaggcgacatcgctatagctcggcacattcagaggcagccggacgtcgagccgtctcctgtaaaaggaattccaactcatttttgtcgggttaacgctcccatgtttcccatttcattacactcctgtgatgttgactgatatactcaaactcttctccgctggtttcgagatttgcccgggtccaagtggtttatagaggcggcgagctaccgtcgagacccgttgcgaattgcatgctcagaggaaaaacgcagcatcgaagaggatggaagacctgggttttattggaggcttctcgtggaaaacttgttcttagctaggcagatctacccttcagttattagttcttatgttctgtggaaataatgtggaaacgaatgtggtaatgacagcaaaaaacagaagacaactcttgccgcctcaggaataagggctcgctccctgcacgggcgaatctccgttagcacacttggttgcaactttctcactgctagttttgctggttttctgccgtggctatctcgtctctagtagcccccgggttacacattcaaaaacgtgcgtgtcgctgtgtcgtttttatctcgaacgtgacaaattcttggggccagcgctgcagtccgcgaatgttcatttttactcttaccagttggctgtacacccttcaaacttttgtgtgtccatctgtcacttcaaagtgctgatcgtcgttatgtttgtgtcaaaagtcgtagtgctcccgacttgtcccttcggccacaagccgtggataaggtcgcatctcgaatgaggtggctctctgcatggatttcgacgttttcgagaggaatcttgcaccgtttagagcggttctgggtgaaaaatacggtgaggaaggtgtttgccctattatttctgcacgtggcgtagatttcgtggacttgacgctcggtgaccgtgagctgcggattgggaaccaccgcagtcgagatctcgcgaaggtggacccacgcgaaggcagtaaagtggctttttgctggctatgaagtgagattacagtttgttccagtgctcttaccattgcatgtgtaagatgtagtgcaagccgtagagctctggcagcactcagttgtcaacgcggactttagtcaaacacaaaaatcggatcacca

SEQ ID NO: 929 - DNA, 4753 bp, Toxoplasma gondii
gaagacagcctgattcgactgatgcttcataagaaggaaatctttgttcaccggatgaaaactcgccttcgaaatcgacggacgggggtacaagcacggaaggggagagaggggaaggatggcaagcgacaggaggcaccgcagctgcaaagaacgcgagcgcgcgcggagggggcgaggaaagagaaaccgaggaaaaagttgacacactgttgaatggaggagtgtgttctcttcctcaactgcctatctctgtagaggctgtggagacctgctcgtttcgctcgatgaacacccgtggcctgcatcctcatcgactaccaagagagtcagacccacacacatgtacatataaatacatatatgtatatacatatatgtatgtacatatacatatatatatatatgtatatatatgtatatgcactaccgacaggagagatcgacacttacaatctttcaagacccacggccacacacaagatgcagagagctgaaccacgacgcacgtgacttcgatatacttatatatatatatgtacatatatatatatatatatacatgtaaaaatacacaattgcatgcgttgactgcaaggcacaggatatgagtagagacaggaccccagagggactgtcgagtgaagggagaaggtgcttacggggggagtcgacggggtaggcgtactggagtgccatggtctgcgggagagacgatccgttcggatatcggtttgcggcttttcgatcggcgagcgtttgtcctcgtgaaacagcgaggtgagagacagggcagagatggagaagagaggacaacgaagaccgtgcatgcagaaacgcgactcagaagggaggagctggacgggatgtaaaactgccgtgaggccagcgacgcggggcagaagccggctgcaaagtgtcttcgcgaacagagagaaagctgctgcgtgtcttgtcgcagtcgtggtcagaagtagctcacaacggcggtgttcgccgactttcaaatacactctgcagagggccgtcgggccggaggagaaacgcgcggacagacgggagaaaagcggaaccgaagctggcgctggaggtgaccgcgcggtgtgcgtactcccgagaaacaagttgcgtcccggcgaggggaagcctcagagcacaagaagaagagagaaaaagacacgaaactgcagagacacgagagacgcgaaatgctggaagcgactacgaaagacaaacgccagcagagaggctccacacgcggtgcgctgttcgcgttgttgaaatgaaagacagcaacccctaagaagcgacgccgccctcggctgtcaggaagttcactggaacgcatttgttgcgcaatgctttcagagatcttgaactttcgcgaacagcgcaagtttctccagcgttcgcgggcacctcccgcaaacagaggaaacggcgccgctcgcgcgcgcgagacaaaggggggtggagagaaaagtctcccgccgctgtttgtccacgcgaagcatctctccgtgagacgacctgggcaacgcacttccggcaagtttacgcttccaactacttgctctctcgagtcaggaacaatatctgcagcagctgcacattgtcaatgctgtgctaaacgatttgataacgattcggggacggaaatacctcgtgaatagactccacaagtgaaaacggcatctgcgagttccctgtaatctccgtgtccagcagcttctgtatcttgttcgtgagtgtactgaacagttggaacttcttctgtcttcttcaccgcaccgaaagacaggtcgccggtcaggccggatgcgctggcaggaagagagtgaggggaacttctttttacagacaagaagagggaagaaaagcacagggacttcgagggaagtggggagtcttccgtcactttttcactgggttttcttagagcacagtcgcgcagaacaaaagacaaacgcgacagaagctggcagaggaaactcgtgcgcaggaagcgcctctgtgccatatcgcacctctaccgcgaagggaaatgcacatgccacagaaaactttttcagtttgacgtcaagcacagaacaaacaggcctcgattcccatatctgttttacatatatgtgcacaggcattcaagcagaggtactgggatgaatgcaggcttgtgtgcacgcattcaaacacatatatatatatatatatatctattgacaggtcttccagtatatatgtatgcatatatatatatatatatgtacgcgtattcaaacaaaaaacacttatttgtgtaaggagactcatgtcaacacattggaagggcggtgtatctgtatgtacgtgcgagctggccgcaagagcgaagttgactggactccaagcatgtggagaatgagagtaactgttcgtcgcggcattgcgcctttgttgttggatgaaagttgtactgtgtgtgagcagaaggagctggaggacctggggaaaacgatcgacatcgcagcgagtggaggcgttccgctaagtatcttttccgtgaagacttcttgcaatatctcctctgcaagggcaggggttcgctctgctctacttcatttataaactccagagagagatccctcgaaatctccccaggtgtcgccacgtcttttgtaaacacgagtggacgagaacagcggaacggacgacaaacgcgcgatccggagtcaccgaacgtttctgcggtgtcgagacactccagcgcgaacgagcttcgccggttttccgagaaaggcgagagactcgaggatcaagaaacagagatgcagccctgtaacttggcagttttttccactgcgtagcccctccgattctccgggagaagactccgtccgggacggaatacaggggaagggaagttcttacgttttgttgcacggcgaaatgcgtctgctttccacagttctcgcgccgtcttgatcgaattcgcgagtgtgcgtgcctgtcctgaactgcgcgtttgttgcctaggagcttttctccagcgaccagagcatggaactagttctggcgtgaacaccagttcgcagagtgcggcttccaaaacttgctagctgctgtcgagaacacactcacaaagaactgcgcgctgagaaaccagtttgcgatgcagtgtgcctgagcaggcggatgtacactttggatgttgcgcgctccgacagcttctctcgtcttgtgacctttcattcacaagacttggggactgcacagctggagttgcagctgcgtaactacacccgtggatgcagggtcaggcttgtgtctgtctctcagccactgccttcctcagcgacgacgcgctactttggggacttctcttcacttgcggacactttgactttcacattcgctgcctctctgccgaatttcaaagaggcaaagcttctcagcatcccagctctccattttttcatacgtgacctgcaatttctaggccatcgcgcagcgtcaacagaggttcttttcaaagccaacagctgggtgggactcgtgtcgccacttacgctccggaaagtgcagacctcgagcccaggacccaaaatcctaaacaggactcgagtgcatttccagaacggcgactctcgacacagacacacacccaacaacatgcagagacgcgtcgaggctccgacagcccctcgacttccgcccagctctccccacacggcagctgcttgcaagtgtctctccgtcttcagctgtacatacaccggaacacccctctggaggtgcagggaaaagagtttcgtttcccttcctcttcgcggggacctcgttgacggcgcggcagcgtgttgcaaatcgatggctgcatgcgcggccaagacagcgcgacagtctctggcgcgaggtcgagaagcgggtgcgaggaactcgcgcctgtttgtcgcggagggcgttccgaaagaaaaaaattgcacaagccgcggggattgcagagcaggagccgcttcagacctgcgacatcgcgaaagctcttccggacaaagcggaacacgcgcacatgtctcgcaagccgccagtcccgagcgctgtcgacgtctctgctgtctgtacacctgacgccgagtgctcttctttttcgtctcccgagagactgaggcgttcttctgcgcgtctcccgcggaggcttgcgagatgaaggcgcgcgccgccctcgcccagtcgcccattcctccgcgttccgtttccgatcctctctttttctcgatccttgtctatgcagtcacacctgcggtgccgacttcacctcgcgcttttcgacctctctgaaagataccgaaagtcgctgtgcggagcctggctcccctccgcctgccaggttgccccctcgagctccgccctttccagtcatcactgagctccaatttctgctgcgtctgcacccattttttctccacctcgccgcaactccgtgcttctccccttcttcccttctcgctcgctgtggctcttcgagtcgccctgcatgcgacaacatacacacacacatatacatatccgcatcgctgcgttgtcttctctcaagtctcaagcgcgcatgcgccgctgacctggtgaaaaaataccgcgcagtccctctccacggacctcctcgactgcacgcgcctttttctgtgtttgtgtcggacgacccgcgctgtttgggagtccgccggcagccgcgtggctgcgtttctcgaaacttctctcgtgtcgacagcagaggaga

SEQ ID NO: 930 - DNA, 4233 bp, Toxoplasma gondii
acagtttagaaaaagtagtgcataggcgcgcaggaatcatactagagagaggatgtgtatcagggtccgacacttgaagtcgacctgcctcttcgtgcgagtttttatgcggataatgcaaatctggccgcttcccagatggactgccgtttttcgtgcggcgatcttggagggcgcagttccttctgtccgtgtagtaaatacgaggttggtaaaacagggcatctgtctctctcagggtagggtatgcgaattccgatctcgtttcgtgtggacttttagagggtgccatttggcagagctggcagagtgcagccagcgaattcgtggcgatttttaacaggaatgcgttgctggcattccttcactcatcttcggtgcaacagttccctgtagagtccttacaacagagacaaatgggcctcgacgccattttccgttgctccgattttcgcctcgctatccaggcgaagggaacttgttccctgtgttctctgtcgcgcccgagctgttccccatttctcacaggactcaccgttacggctgtctcgttacagggtgcctggatggtattttctagctcgtgtgcggtattggaggaaattccgtacaaaacgctttactgcagaactcatccagtggcgtgtgctactcatcaacaaatgaggaaaaggtcaacactttaagcaaggtgttctggtctctggagggttcgttgcctcacgttttccggagctggaagtcttgcgggagcgcgcagaacggctttgcagaaatcgtgcgttccccgttacatttcgttttgcgcatgctcgactgaaaggcttacagaaaaagggtttgtgtgcgtcacgagcgaagttgctgcgatctgtcgcttgtcgaggctacaggaaagtctaatggaaacgaattacgcgtgaaaaaacgaggttttttctgatagctcaaaacgtgtgcatggtcttaccataccgcacacacagtgtcgcggaccctggtccgcttcccgtgaacgttttctggatgtacgatttatcttatattcccggtttgcgatttgcgcatgacaaacgcggcttccgagaaccaccgccttggcaactacatcagtcttgttaatctttgttccgtcttcagtgacgccacccaaaacgtccacggttgtgttcccaactggcacgactttttcttcagaagaattgtctaacttgggaaacgaagcgttcactgaaaagaaatgccaggatgacatatcgggtttttctcgaaaacaaactaggtccacactttcatctctgttttttggccggtgtctgcgcgaaaccaagcagggtctttttaaaatggaaagcgcgaaccgcagatatactccgtgtggaggagacagaaaagcaacgcactcagagagctcttacaaagttgccagtctgttgcgttcttctctttatataatgatcagtactggggctgcatcaacttgccatcgagtgcttctggtagtttatttatgagatttggaagagcgagtggttaggaaaggcgcgaggtagtccttgacactgaatccatcagtgtgaactgtatcgttattttgcagatgtttacacagttttgaatgggaggtagggagtaaactgtttccagagggtcacgaccctgctcacgtattgcagctgacggtgaactgtggcgcctaactggatgttgctcaacaacaacggagtgtgcatgtagacagctgtgttgtgtttcgtggagaatctcagaaagtcaagttggttgtgtctatgtgactcgctgcctacttggcatcagacgagtattgttcaccaagactaccgagaaatcggtgacattctagaacggataatcaccttgttgagcgcggatactcgcactcttaccatacgctacaaagaagcctcccctccggtcctgtgaggagcagtgtaagcatgccaacgcacggaagatggctgtttccccccccccccccgtcctctcttaagagaaggtaactctcgctgtgtctcacctccggcaaacatcaccgggagcttgggaatatcggcctagatttgttgtcttgtctcccgcgtttcacacaaatgcaaagccaacgtgtctctccccgttgtgtactccgtcccgcctaccagcttctttttctcacccttttgtaaaaagactttcggcgcctcttggggaatcatgttcactgacagaccgtgaatccatgatttgtgaggacgaaatgtacgagtaccccaaacgagaaggactggggatacggtcaacgtctgcgaaaacactgaaaaagcatgactgttgaatttgtggctagatgcttcttcctaggcgtgacattgagggacgttccacccggcaaaattaccgaaggcgtcgaagctgtctgtaggcacccgaacctcgaaagcttaccgcttgtacgtttaccagcgaaaacggcacttgttcgaagcagccgcgctacacctcgctcgaagcttcgcactctgtgaattgatgcgcccgtttctttgacaaagtgtggaggaaagacagtaacacgtcccgataagacctaatagaatgttcctttgtattcactcaatattatgcggttgacggacaggagtgtaataaagaggcgtccgtgtcttccttctgacgggagacaggtcttccaacctcggatactttatggaagctcagccttaacaacacattgctcgacagacgcggcagtacaagtcccctaaacggaagcgtccagacaaatttgttgccgtgaaatcggagccaaacagggactgcacttaaaagtagcatagcacaggccggaatgaactctgttttcagaaacactttacactgggtgttatgcgggagaaaaactccctaacctacacgtgtacttcgtgatcataatgatggggcgagaagggaagggcgtttcaatgaaaaggcatgtcatttactttgcgttcgacaactggttacactcttttcatggcctttgttagcggattcactctaccacaggcgaccgaccctacatatatatatatatataacattcactcctttgtttcgtcaaagtatcacaagtctgttttcctgatggaaagaggacacttgggtaccgtagtggagagaaaagtccggtctgcagaaaggcgtctcacggagtttgcctgctcctgatccaggccccctttgacgtgaggcgaaagagtttttcagggcgtcaaggcgaagatgtgtggaagcacggaatcaccgcgtttgtcgatttccgaagcacttgagaagcgtttctcggcttcgcgcagtgggaagatgggaagagacagctgagagagagaccggctcagagcaaggaactcactcccggcttaaagtatccgataagggcgagataaagagagcttgattcgcagaggggagcggcaggttcgcctttcagttccggcagcgaaagtccacgtctggcgaccgcagatttgtttcaggaggaaagaaacgaggaaaggcgactctctgaaagaagtcgaattcttcagcaacgcaagcagcccccccaccccagccccccggtgctcctcctctctccccctgcactcttgtcaacggagaagagacgttttttttcttgagtgtcttctatgcagaaagcactattcgttgaggaaaacgagacttctggtcgacaaagaaatattcttcctgaattgactcgcaaagaacgcaagaaaaaggcgcagcagcagctcgacggcagctcgacggcgaggtcaccgagacgcagagccttgtatccagagaccgacaagacacaccctcctggaagtttttgtttttgcgttttttcttttgtcagttgtctccttctccaagtgctcaactcttcgttacttttgctacaagtttgccgtccctagtcgccctttgctgtcttcattgtccgcctctctctgactcgttgtcttgctcttaagatctcggttttgaatagccacaagacgggcggagtctctctttcgatgttacgtccagactttcgatttggctcttgcttccctccagtctgaaacctttctccttctctctgttctcaccggttgtcttttctgcggtggaactgtggattctgcggatgagccctgcgtgcgaccccgagtgctgcggtccctccgttcgacttttcctctctgcggagaggcacaa

SEQ ID NO: 931 - DNA, 3961 bp, Toxoplasma gondii
ttccactcggtacgtgtttctggtattgcacctaattgaaactgtagacgtagtcgagggggcttttcaggtgagcctgtgagtgcaatcattgcttttggcacattgtagcttgacgacaagcgcagcacctgtacttctagacgtaattatatatcgctttgacctaatctccggatgtcattcgacgtgttccagcatttgtttccacacagcatcaggaggcgcatgtgcgaacccgcccttttcaccccagtaattagaatgttctgctgtatgtcctggtgatttttctgtggttgtttcaggagtggacattggcgttcctggactctctggattccgagggcagcagttccacaactctgtccccctgtacacccggcgtttttacccgcatgtgaacaattttgacgggtttttcgtggcaaagtttaagaagctgtccaacaagaaaccagagcgcgtgcaaaaggatcgacgtaagcataacccttttgtcaaagtaagtagttcgtccgccacaacaagcattagctctgacggtgattcgcaggagaatgaggagcaatcttcagggacggaaaatctcgctggagagcgtgaggcaacaaacgagcatcttaaatgaaaagcggggctcatgcgttcaactggttatttctcaggtgtgggataaagagcactggactccagaatgcatggatcagctgatgacatttgaggagaaggagacgacagaatctaaaacgtcaatcacaaaggtaggattctttccgcaattcttcgtacagccccgttttgtgtagtttcttaccacaatctgtgtgatccctcgttttgcagatgcctcaagggcagcccgcatcttttatcttttgtgcacacttctaggttcacaccaagcgtccacgcaatgtccgcaaccatgcgtatgagtggtcagcatgaaatagtgtgccgctgttgaaatcagcgctgaaacgcttttggattttgtggctgcacacgtatgttggcatgttcgcaggagaatagtggaaagggctccgcactattgccgatgagggaaaggaaacagaaatcgggagctgatagggtaccctcgaatgcggaatcaaaaaggatttcttcagtacgggaggctgcccctggaagagaggccaagacgtcaaacacttctcctgtggcctcgggatccaggagtagtgagggttcctcccctgtctctccgaagcaatcagtctccagtggaggagcgagaccggctcaggggaagcggccgcagaagatggcgaatataaaggggaaaaaaagcgaatcgggggttactgatttgagctccagcgatagtgctggtagtccggccccgacagaggtcaagggagggaagggatccgcggaaaggttaggtggtcaaggcaaaaccgattcggggaaaaaagtcggtgtgactaaaaagaattcttccgttaagacacatgaaaaagcaagtatttctaagaagcgtgcgtagcttgctggtggaagggggtgacggtagatcttgagtcacaccacttctgtttttgctgtgttgactttgtttgcgttgcttttacttcttcccgtttctgcaaagcaagttgacacaaaaataaatttccctcttcttcagtctgtggacggatgttttgtcaccaacacctcaccgtagagaaactctctattagtacgtgttccagtgaaaggcggagcaggttctttcgaaagatcgaacaaacaactcatatggatcgcagcccccctactgcaggaaagggtaatgttcgccgatagcgcaccacttaagcagaagcttttgcaccaaggcttcttcttgtgtaagaaggctctaatgtacttgaaataatgtagcatttgcgccctgattttgcacactgcgaacatctaggagaaagatggttttggaacagaaggaaacagcagcttttctgaagcgtggcgcataaggtgtagggatcgacgattactactaacgtgctgagcggaggaagcccaagacgtgtcgatgaaagaaagacactgctgacctaggctatggagctactggatgccaggtcaaaagaggaaaggtgcagtgaacctcacattcagataaattaaccaagttttttgttttgcaacggaatttaagtgggagttattggctagacattttgcaggcaaactctgatgacgggaccgaaggtgttatcaggtcggcacaaggaagtgataggaaacaaatttcgaaagtgcaaacgctgtatggcattggttttttgatcgcgcatacgtacgtacgaagatgcatatgcatctatgaaaggaccctgaactacttttgtatacacgacgcggcagctgtcacggcgtacttccctcacttccccttagtgttggaacgaaccacagacaatgagtgtatgatgtcgtagaggcgaacaccgtctccaccttcgttctgttttgaaaaaagccccgttacctggcgtcctatgtgccgcgaacaagagccgcgccatacatacggctgccgcgcgcgtgtgcagcggcgttttttgacacggatgtcggaactttttggcagctggtagcaagtacgccgtcattgcgatctggtggcacgttactggaagttgtggacgggaaaagaacggagaaggtagagtagcgtcgacagtacctgagacccccctccgcgaactggatgaaagcaagagtggggttacgatagattctcatgcgaggcaccaacctttacactgaggacactgcgtcttcagacccgcgcgaaagtggattttgttggtggttactcttgggcaacaaagccggaaatgtcttgtccgcctgaaaaagtggttctccgtccacatctgaaacacgaacttggcaactttccaacgccacatagcttccttcgcacttttgaggcatcgtatagctgtcctgtcctctccgagttgtcccagcagctcgaacccacacacttaactgttgcatgctgggagggtgactggtgcccatgcgccgtttgtgacatgagcgacctccctcggtgtcggcgttcttatggggttcttttggaagagctgagctggacaatatttttaaaagcattgttggatgatgtcaccaaaaacgaaaggatccccttgtctctgttagatagtggtcgccccttcgaactggacatcagtctttacgatcgttccccgaaaaagagagagtactgcaggttaatggatgaggcgctgctccgtgttccccgtgtcttctttggcaaaacgcggatgtcagcaaaacaggtttgtttaatgtcttcctgtgttcatatttgggagtgctgcggcgatgtgaacggcttttgaactgtcgaattcaccctcatgtgcgggtttgttctccaaagtttggcctaagttcctgaagcggttccacattgaaacattattgccgacgagcgtcggctttaggttccgtcagcgacctcccaccacagtgtatgagcacgtcggcgtcacactccactttctgaccgcgcgtggaaactgtcttagggtgatcctgtcttatgttccgtcaaaccgtgagtctacctcgtcaaaatcgcggcacatatctcatgtgtcttgtctccggagagattggaaacttttgattcaacggtgtgttacggctatactccactgtgtacagggagtggatttgctgcccgtgtttagccgccagcctctctgttccttttccgcatccacccccgatgtccgcgagcagcactcgttgtgaagtgcggaccgcccgcgtttcggctcggcacgctcgtatctagagtctttgagtatccaacactcaacctcttatccttgctctttgccctcattcggatgaccgacgctcggttttcccccagtccatccaagtgcagtcgcaaaaa

SEQ ID NO: 932 - DNA, 2306 bp, Toxoplasma gondii
agagtcaagtttgcgcggtgttgtagatgaaagtgattaccatatattgttttgtggccagataaagaaccaaaacaatgatgaagtggtgaagtatagtgctcgattgcagcaggagaagacgcatggtaacagtatgctctcctggttcctttgtcatgggcaggcctatgtgttttttgcatcctatggggaagaatgaaaaagaatctagggacgtggagagcaggggaaagacaagaatgtgtcataaggggtgttgtgcacaaaggattcattttgttggtaccgttgttatcgccacggaagagtgtatggagttacgaaaaggagtggtctgatttttaggcaatagtggtcttgttctcaagtactgcggtaaccaggcaaaacagagcgcaaacgtattgaaacaatatgggggaaaacctgtcaagtcctgatatcggccgacgaaaacctcaagacggcttcatcacaggggcatgtgtctcctccctgcaagtgtttttccttgtcgaacgtgaacccgcgtcgtcatgagatgcagactgtagcacactccacgcgccttcagtttaacgttaaagacaatggagcatatgtggaagacttggtgattttccttgcgtgtttactgtgatgaggtttgcctcaccgtctgtgcagtgcttactcacacctctgcgtcgacatggtagccacaaaaggcacagtggaggcacaacgaagcgcccgtgagttgctaagaaacctcgatattgacattagcaggagtcttgttcacatgttgccacacatcgatggagaaaggatcagaagctggttagggcttagaggattcatggctggtcgcaagtcgatgctgtggtaaagtagacaacaacgttagccggtctcttcttacggcaaacttctgcgaggctcaaattgcggaccatcctcttcattaggggaggaaccggaggcattcgacaagtttgtagcatctccttttcctagcacactctgggtgagtgatggagctgtggttcctcgataggaatcaacacatccgctggaaaaggtactacattcacttcgactggatccggttatttgttagaactgtttacagttccctagggaagaaaccacggccttctaggtttagtgttaatggaattttaggtttaggccttgtttcctaggggttcacatttccccctccaggggctttcagcgttcttctgtccagggtttagagttgtttacggcttaacggccgaaccttttatacgacttattagggttaaggaattttttatggttgaaggtctagggtttctttaaggctttagggtttagtgttagtttaaggcttagagtttagagttagcttagggattttaggcttttaggggtttttcagggtctagggtttttggcgtttagtgtgtgcggtattcctgtacagtttcagtgcagtgaggtcctggttccgcatttcgcctgatcctgcattggacactaaccacttaatcaagtaatgtagcgatatgcgcacggcggaagcggacatctaagtgttgaggcccactattaaaagctacctttgtatgaatcacatccttggtatgacaaacgcctctactactctttgaggcgatgtgactagactggactgcggtagataaaggacctttctttttttcggatgttcaaatggactttttgccgccttattgtgccggactgcagaccgttgctggccattgcctcatttgtccttcagctgtttttatggtggaggagaactaagttgcgttttcttgtctttggcggaaacagggcacgtgtcttgtacgcgaatggatgagcacgcagcaggagcccgacgctgcgtggtgcgtgctgcaacatcattattcgtagctgcttcgcggacggcgcaagctccccgcacattctgttgacctcaatggagatgcatgcaccgcggagggagcagttcatctggaaattacacatatttggattagtcacctaaaaacgcaacaccggctttatagaagcataaataagcaggtcaagtagttcatggattgaataacgttgaacactgccctggtgacccagggtagtctccgttgtgtctctaccgatagtcgtatagacgtcccgatttgagacggttttcgcgaccaagcgcgaacttgtgattgttgttgtgccggtatcgtcccgctgaggttcactgcaaacgataaaaccggtatcctattaagtcgtctcaactcggggtgttaccagcagtgaaagaagaa

SEQ ID NO: 933 - DNA, 1329 bp, Toxoplasma gondii
atgagactttgaataatctgaaagcgacacaaatgcagatgcgaagactccgcagctcggcgcagcgtctcttttctgcgcttctctcctcggggtgcactgccacagacaacaccccgacccaccttgcctctttgcatgtccacatgatcatgaatgcatatatatatatatatatatatatatgtttaagtatgcagatgtgattcgcgctacacaagtatacacagagccgcaaataaatgtatctaaggaatgatacgccgctatctagggatgcctccactcctctcggcattatatatatatatatatatatatatataattatatggtggagtttctctcagcgtcgtgttcgtttctttggttagttgtcgctgtgtctgtagaggagagagactaggaaatcggacttgtggagacctcctcgtgggcgtacatgctgtctctccggactctgttgccagtacatctgtgaaatggagcaccatcgcgctcgcatgttgtgtctgatctgttcctcacctcctctcagattccccaacattgtgtctcgacctagatttcttgttggggctcctggcgaatcggattctctagccgtctccgagattttaggagaaacgttttcggacaggtttctctctttgcgaggtgagcagacttgcaaagtgtgtgcgttgcgcttttttgggattcaatctttttgattccacttttttagcgaatttttctcggtaaaataaaaagggtttctcgtcactcgcaggtggagaggcggtgtccacgaatgtcggaatgaagcgtcctctcgagagtcttaaatgatcgtacacgatgctgaaagggtgactcgcatgctgctgtaggggtgctggagctattaaagaagcagaagatatgtaagccgattgcagcatacgaacaagatacgcagaatgactatcatacaacgtacacaaggcaaaaaaagaaactgaaacacaggaagcctttcgttgctgctctacattcgtaaaaaggatcctcgcggaacaagggaggggaaacagtctgaaaaggaattgtagaggcgcaaatgcaaagacatgcgcgatgcagcacacgcagaaatccagaaacttcaagagaaaagaagcaagacaaagcagagttcctcggggcgcaagcggcaagattcgcgaggccttcagtcctcacagacattttttcttttctacgttggctgttgactttctttgtcacttgctttcctttccgattgctcgactttggaatgagaaaaagtttgagttcgtctctcccctcttcttcggagatctcgca

SEQ ID NO: 934 - DNA, 3973 bp, Toxoplasma gondii
aatgtttggaggctgatgaagccgggaccttgtcagggcgaaaggacagcgaaggagactcttcggacggacgtgtggggtcggccgcccgactcggctccgaaggagacgtaggaaactgaggagacacgccccctgatggagtcatggcgttcgctgatgaaggagacactgcatgcgctgtctccgcggcgctccgagtaggctcttggactgtccccacattcggatttggagtctccggatccgacagaaaagacggtgaatctcctggactgttttctctttctcgaggtgacggggcagctgtggcggttgtcggttcttctgtcggtggacaagactttagtttctctccagcttcgagtaccggactttcagggattaccggcgaacgcaggctgccctccgcgacctcttgtttaccctttgtatccgcgttgcctctcttaacctcaccttgcgttttcttctgattcgttagctctttctcatcaggtctcgcttgctcaccgttctctgggtcttgtccctctccctgtgcacttgtggggcgtgttccagttcgtttcttttgctcagccttcctatctggagaagaccaaagcgcagcctgcatgctggaagatggccacggttcagtacgcgaaggcgggagacgaatgaactcgctaactatggggtggatgcagacactatcgccgtcacgggagatccctttgagtgcttcaacgagttttgcgtcatcgtcttcctcctgggagatctctttcgcttcccgccgccggtcttcacccgcgtcgcaagcactctcctggaaatcgaagcgaaggttctcgctctctagtcccccgcgtttctcctgcctcgtcgtcgctgctccgtcactcgcaggctgagcagagtctgcgatttgtcttgaagtgcggcgcggcagctccccttctgaatgtgcttcctgtccgtcttctccacaagggagtggagggaagggcgaaatgccacgcatgcgcaggcgccgcaataggcgggcgtggtaaagcccgcagtgcatgccaccaatgccactgtacagaatgagtgcttttagcgtcatcgtgaacgggagcagaaaaatgctggagagaaatgtaactttttgcggggaaaagatcagacgctaccctggcgcgactctcgcaggcacaggctcggcgaggctgattccggaccgacttctccagaaggactcagtggcacagcggaaaacgaggagggaagggaggaagaaacaaaccggaacccgaaaattggatagaaggtgcagagacgaaagaaaatatccgccgtgcgcgacctacacgtaaacaaacagtgtctgaccgtccctgcagctaccaccacaaaaggaggcagtgcgggccggtgacactcgcggtaggttgttggtccaatgcaggaacgctccctgcttctttgacagctgttccattggagatttacagggaaagaatcaaaaaaacatcgagtagaactctgagacagagagactgccgtttcaatgtccctcacccgctaggaaaaggcgagaggcgaaacgccaacgaatttgggatatccgtttgtgccgtacctgcgaggcacgttgcacaggaaggcagttccacggtctttcctgattgagaaattcggaatttctgactcgcacgacagcgtagaccacatctcgtttcgaactcctaccagggtcacctgcccggagcgctgagtgcatgcatccgtcggattttgatgcggttagaaacgtagttcaccgccagatgtaatgcgtgagctgggttaacagtatgcggaggcactttgtttcctatctaccatttaaaagtgtgcaaagatagtcattctatatgcagtgaatacgctgatggattcagttcctctgcatccgcctcaagtgacgcgagtttgaccaagtgcaagggatgtccaattccacagttcacttcgccgggggaggttttactaattaactgagttaaataagacagggatcatatgttggttaacttcaatgcccagggcagactactggattgggtacgcagggcttttgtaacaaagcagggagaattctacatgggggcgcttcatacaagaactcccggatttcgcatacggaatgtgtcgtaagcgcacaccagaaaaccaaagggaaggaacctgtggagtcacacgttacatattgcccaacttgcttggcaaacgagctcaggttgagacaaggagcgatatccagctgggagctcccactgtggaaagcgtactatctttctgagggcaggaagttagagattctctagagaagcgtggctatgtcgaaccgaaagcggtgaatacatggatcggcatccttgtatcactcgtgagtgatggacgtccgaatgtggatgacatcaggtttactgttcgccgctgtttaatcggtgctgctgcgtttgttccatgtgcttgtggaaaacacagagagtgctcaacgaaaacaacgcatttagcacgtgagatccctcagacctttcctacatctttcaaatcccgttccgatgaaagaaagaatgaatcggacatcggactctaaaccttactagaacgcctggcattcgagtgcgtcggaccaccagaaacccccagggttcttgtttgttcaaatgttctacgcaaagagggggcagttcccagaagatagttacagtgtccatttcccacttcggttgaagtgcggcaagatctccagaggtaaaagtcattctttttaatctgtcgcttgcatccaagtatcccgaccacgagttcaggagcacggaaactgcacgtgttaacccgttttcagatgcgaccctcaatttctatcgagtctgaggacgcacacgcacacacaacttcgtgcgacatgctagcaaacaccattcaggtacaatatgatgacagctgtgatgcagcggagcattgaaaatgctgcgtacttgcattgataatgcatcggtggttatcgtacaagcactccgattccaagtgcgagaaagtgagtaattccaaaccataaactagcaatccccactgtctgcggcacgagtaaccaggggtgcttgcaaaccgtcacgacatttgaagccgatgcacgacgtggtcattgtcaagctacgagactcttaatgaaaaaaactctagtaaaaaaaggaaccagcgtttttttaccacccatgtcagtgagtgtgctcccctgcgtggaaaaaaggcaacgaaaaacgcggtttttagcttgcttcgttcaagaaaccgctcgcccgtctctcccaggtacaggctctctcatcagcaatccactgccggtgtttttttgagagcgtgtgcgacgaccgcatccagcgggttcgactgggggagctacgaagcgtttttgacaaaacgcctttctaatctttttgacctttggcttcggtgttgtttttgcttcaatctgcaactcttccggaacgtgaaaacgggtttgcgctgtccgttttgctgcgtagaggaaaaatacgcgcggtggtgttccgcagtgccgcgtgtatttagctagtatttcctcgtccacgaccgaacttcgcagtttttcagacggtaaaaaggtgcgaattcgaaccgtgcccaccacgcggccacgtcattgtggagtgtggcgatttcgatggttaagattcgaacgacattcgaataactatttccctccggagtaactgttgcaccaggccgtggcgtagcagctgctctactcgctctcaccctcagagccacttgcatcctagcagaccaatctccgtcgagcctgcctggagaggcagcgtactttagcggtgttcgttaattcgcggttctttccccccttctctcacgcaggatatttctcgtctcgactgcagtaaatatcggtgctttttgccttctggaaacgcca

SEQ ID NO: 935 - DNA, 2363 bp, Toxoplasma gondii
agtgcagatggcacacaaacgactgcgtaggaagagggacaggctgtctccgccggcgacagcgccgtctcctcgctttgtcagacagttttgcttacgcgaagactggcggtctttgcatctgaacagacgagcatccggcgtctgccagggagcgtcgccgggtctgtccttccgtctccccgaagctcttcctgactctctctctctcgttcactcgcggcgttccttgaaggtccgttcactctgcttgcacagggaggccgttcgagctgtttgaccctccctctcgggatttttgttctggggcgcgggagtcgccccgcaagcctttcatcttgacctccgcgacggagacagaggagacaggcggcagcgacaggcgccaaacacgatcgcaggcagagctacctgagaagttcctcggcctccgagaagcgccgcgcctgctcgcagagtcgagcgtccgatgaacggcgagaccttcgagggagagaagaactctgggtctccacggctcgcgtccgagcaggtggctcgaaacgccggcgagaggagacgagaaggcggcagaacgcgactctccggccgattgtccggagaagcatacgaggctcgacgccagccggaaaaactcggtgacgaaggtggagaagcacgaagaaaaagtccgcgcgttcgtttcaagactgctgcgcgcgtgtgtgtgtgtgtggagctacctacagaagagaaaaacgaaacaccaggaggggcgaacagaagaagccggcaaagaacgaaacgagaagtcgagggtggacgggcggggcgggagaacgcagccaaaaagagcgcgctctcgggagctttcgaaaagccacgcgtttttgctcgaccaacaccgcagaaacgaaaagccgagagcgcgtcgggatcaagttgcctttttccgcgaaagagagagacggcgaacgatcacggcgagacacaaaggagacttcctgcttcctccgcagaatcgaaaaaaaccgccaatggacacgtggagacgaggaaagaaaattcttcctcgctctctctccggggagagacaaactgccgattcttttttcgtcggtgtacgctgaagacgcttcttccccgtcttcttcttttccctcaacttttctccgtctctctaagaagcgaaaacgcgacggttccgggagaagacgcccgcggaaaatctcgtgcgagcgcgaaaggtcggaaagcaagaaacgcgtgaaaaagtccgaacaaagctcgtttccacacaaccccttgctttctcgtgaaggaatctgtcttcctcttcttcgtctataagccgatcccgtgctgaaggggcaaggagagtggcgcccgaaaagccgctcacgcgctgcgagcggcgctctccgagatgagaaagtttggagagcgtgagagcggccgtcgcagagaagcagggaacaaacaagacttttctccggacaagagacggttcgaaactctgctgaaacgacgaccttccttttctggagctctcctccgtacatcctttcggagctgccgagacacacacgctcagactcataaaaccaccactgactgacactggcaccagttggtcagtcgcccgctcgggcgtctgtcttgaggacgagagtgcagaagagatgagagaggagagaacggaggaaaggaagggacaaaaagcgagcgagagagagagagacaaaatacaaacacaccgaattgtcgcaaacacactcgcagctcgacccccagggaccgcacaacgcactttttcacggcgcgaaaaagtcacggaaaggagggccgagaggaaagactgcagacgcgagcagaggagacaggatattgttttctctgtgccgcgacaggacaatggagagaaaagaatactctctctgggttctgccttcttttcctcttctgtattccggcttctctcgtatgtcggccagcgttcgtgtctcctctctgtccctggaaaactcagtctctgcagcacgcgtttcactggcaagtctccagatggtaccatacgtgaaaacgaaaaactcgacatgcggtttgacgcttcgtttctttcagtaggtcgcttgtctccttgcgcaatccagatccccttatcttcctgtcctctcccctctttttcccctctcccttctttctctcgtcgcctcgttagtcgcttggttctctgcttcctttctgctgtcagccggatcacacgctctgtctctccgtttagcgtctctcgttgcttcgtgttctttctgcgaattgcattttttcctggaactttcttctttcgcacctcgttcttgtctcgcatcgtcttctctgcgaaa

SEQ ID NO: 936 - DNA, 2727 bp, Toxoplasma gondii
aaacctctcaacgaagttgtctccgtccacggtgtctgcttcttcgcctcgcgtctcttcgtctgctgctctgactggctgtctcgccgcggcgttgtcttgcaggtctgcttcggccgtcgcgtctgcgccgtgacctctggagttcgccggcctctcggcgcgcgcggcctcggtgagagcggccttcttcccgcggcgcatgcaaaagtccagccatggctgcggcggccgctggccagtcacgaggtgtctgagctgcgagtcgaactgcgagagcgaaggtccaccgccagatgccaacgcggcgttcagcgtcgcgtcgcgctccgtcaacgtgcaaggcaggagtcgacgcactcctgcaaaaaactcggaaaagaaccgcgaagaatccggcgagaaagcagaagaggaagaagaagaggaagaagaggaagaggaagaagaggaagaagaagagagagaagaaaaccgcgcttcctccgggtgcggcttctggagagactcaggctcgccgacccggcagtcgacgacgtggatggaggtcagaggcagcggcccgaagaactgcggcacaaaccgagacggagaagaagcagaagaagccgaagaagcagaagaagaggcggcagagagaggcgcgcgctcgtcggcgagcgaggagagatgatccatcggccgggagctgttgggggtgacagtgaggaagggagtggagccgggcgccggcggcaggccggaaaatccgagggcgctccctgctggcgaaaacatctttttcaggaagacacgagcgagaggaagggagagagaggaaaggcaagaggccgagagaggagacgcggacgcaagaaaaaagatggtgaacagaggagggccgcgaggagaacgaaggaaggaatggagaagaaaggacaggagagaaggcagaaaaagagagaggagagagagcagaggagagaagaaagcagaggagaacaagaggagggcgagcgagaagaaaccagaagagaagagacgggaaagggggaagaagagagaagagcgagaaaaacagacgcacgaggaaagatcgacgcgcgtcttcgtctctgtgaaaggggaaggacgaagaagcgttgagcttgcgtcgcgtcttctctcttttctgccttggcagaattcagcaaagcagaaaaagcgaaggcatgtcgcgtctacgaccgcacaaacactctcaagcatcaaggcctccaaatctcttgccgattctcctcagctctggttcgctctctcttctccgtttccacctcgcaggccaacgcggcttcgcacaacttcgcttccttccacctccctctcggtgtttcgtctctcttcctgctttcgagttctttctcagatcctttcctcactggacgtcttcgcagctgtcttttcggaccaagacctctccttccatcgcagtgaggagggtgccgcccgatccacgaacaagtgactggcgacagatctccgcgccgcagagagaggagacgccgaaagaaagaggcagaaggaattgcggagactctcttagaatatcccttgggtctttcagagcggcgacttgagtacctttcacaaaaccttctgcgcgaaaaagcacaagcgccagctgtgcgctgtctaggtgcactggcgtcggcgtaaattcggaggcccgcgaaaaaaaaacagagtgcgaaaggaaggctcgcgcatgcagctgcaggcaggcggacaggagcttttttcggggatttatgacgatgcccttcctcctctgtgtgtctccacccgcacatcatcgcgcattcgccgagagagagacggggaggaagaaaggaatccgttcaaagaaccggattttgcaggcaagcacaagcgtccgcgtcctgcatttgagaggctctcaccgtcgctgcccaagcgaagagagcgcgaaagaaacgtcgtcttcgtcgacctcttggttcgagctcgacgagacgcgagatcaaacgaggtgtatgtacaccccacgtcgagggtcgctgtcattctccgtggttcgtacggacgctccaggcattgtctggcgccgcgttcgcgtcttggcccatcgcgaagtctttgcggtttctgtccaggcgcgagagtctctttcaagcgtgtggacggtctcctcgtctcgccctcgtctcctcatcttctcgtctctgtcttctctcagactcctctctggtctctcgttgtcccctcgttatctccgctgattctcccttttctcttcgtttggctctctgttcttctgtctgcgttcccccgtgtgtttctgctttctctccacctttgtgttcttgccttgaccaaaacaagcttcccggctctctcgcgtcgctgctttttccctcgtctctcttcttctttctcttctccgttctccctcactggtttgcgaaagacgcagccccctttccgccggccgcactcgcgaacgagtctctttctgctgaagagagacgaatgagaataggtttgtttttgtgagacagccttcagctcgcagcggagcagcttgtgcctgctccgcctggtccttcttcttccgttttttcttctccctcgtctgccctttctcctcgacccacgaacccactgtctcccccctccctcaactctgtctctgttctcgcttctgcttctcgtttgtcttctcctttgtccggctgtggcgttgcacca

SEQ ID NO: 937 - DNA, 1572 bp, Toxoplasma gondii
atttggttagtgaagaagggcaccggagtcccgattgaattcagtggcagcagaacggttgaggggctgcagaagtttgtttcggattacgcgagtgtgagcgggttgtttgatgttactcgggatgaactgtaaattgtttttaggatctggtcaagcagtcacggcgaagtatatgctattattttataggagcataagtggtgtttcccagaaggcatgcattatgtgtgggattgctgttgtcccctctttttgtacgttatatactgcgcgtgcggttcaaaagcatcgtttgttaagattctggttggtactaatcgcgtgtctttgcggggtcacatttatgtggtaacggcgtcagaatgattcagtcacctttcaaaagcaagaacttcagttgagccacagcggccggcactatgatgtggattgaagtttcatcatatcgatgtagctcgcgaggctgacgacggtatcaagaaattttagttgtctataaacattatcaatatttgggtatcctaccacggaatgcggtgtctgtggcaggaacttggatatatactaaggcatggcgcccagttcaagattgctacctaactcttccatggatagaaactggctcgctgccagaatgcttcatttttcgataactcacttaagattggccagcctcgcgcgagtgagtacatgtatccaaaactgtatcagtcgtcctccgttggcttccacatcggtggccagtagcataacttccacgttgtcactgatgcgaaaagctgccgcagtcgttcacagagctattgatagcgtcaagccacaaacttaaaagcaaatccacccgttgattcgaagcctcccgttgccaggcagcgtcttcttaccagtgctcgcaaatgataaaaacgaggtgcttctagatttgttcaactgtaactgacgggaagcaacacgcgaagcagaagcttcccaacacgtccgggtttcctctccttaagatattctctgttgtgtggtggcagttcactgcctcggaagtggcaggagcgagcctctctgtccagaaaacgaggcatgctgtaggttataatttagtagcttgtgcagccccgttcacagtatcgagagtggacatgaatgtggaaagcgtgacacaaacaacgaagttgccgtgagccggcggcaacagaaagaagtgttttgcccgtgcatcagctagttctatgaaggctagcgcaatttcgggtactaccattcccccctcgctggtatccaaacgggagggcctgaggttcaaacccaccagtttgttattggatggcttggttcaaaccaccatccttcctggcctttttccgcactgttcagttgcacaccacggaagtactcgtccagcaacagacagacagctaccgggtgcaccgggtgtctaaatcggcggtgtgccggcagcaaaaaccgtgaattagagaccgactccgtacccgaccggcccgtagttcgatgaccaagcttccgtccgcttgttcccagagcaaagaaaaactgtgagggtaagggggggcaaga

SEQ ID NO: 938 - DNA, 2525 bp, Toxoplasma gondii
tggactgcgtatttccacgtacttgagtatggagaaagtaatcaccgaacttcttgtaaaaaagccgttatccacctttgaaccgcaagatcaattccagctccgctacagcgttttccacacctttgtctcacaaaaaaacagggcaaaaattgttgtcttcctttgagtgcgaagatgcgtcagtttctgaagtaaagccacttcaattccgcaaatatcaaaaggtttccaggatggaaagaaaccggttttcaactgcacgctagatttcgcacttcctccacatatctctcagaaggtggtatcgccttcaactttggagggaaacaggtgctgagctcagcaatgagcattttcagattccgctcaacgacgtcaatgccaaacagccgcacaggtgcgccacacccacgcttgttttttttcgacaggggaatacctttgtatattcgtggctcggcggttagacaaagagttcttctctgaagggcccgcgatgagcacgtacgtcgttctgcagtgtgtagtgtgcatctcctatttccctttcacaatttcatccgcactttcgcgtcgaggtcccacggaggcgacttaaatccacgtggtgggcttttctgtttacttgcacgtccaagcatgttgccaggcaaatacgtttcaccgttatcggtgtttcgtggacatgatgataacgtaaagagtaagaagccaccggttggggattgccctaatcgtacgcaaagtttcctgtcgctatgcaaaacgctacggtacgaacggccacatggcacacggactgaactccagaccccagcaaccagtgccgcaagaaacacggggaacctcgtgcttacccggttgtccgggaaagaatctacttttctttggagcgcttcgagggacttcccgtcccagtacggtccagcggttccacttcttccacgacggttccctgcttcttggcactcacaggcctgtcgaggtaacgaaacggcattatccaaaaagcacggcaaacgaaaggcacctcgcggcaccagcttaacactgattgcctttcttacgaagcacaatggtccacccaaccaatacggtccagttgaatgggtacaacttccttgccgaaaaggtcacatgagtccggcgcaccttgctcacgtacgtgcgcggagtttgtacaaaggtttccttcttaaagagcggccttttttgccagcacactcatggctttcgactcgcccggtgggaagcgctggggttactcaatttcgagcgtttcctcttttggggggggagtgcgtccgtgtgtgatcttgttttgaggtgtatgtacacctaagctggttgcgagattctcgcagtttgcggagacatgctttttcgcgttgttctctggtaccacgagtagctggcgtatgcaacgagggaacaaccgtttctgggtcgttttttgtcttggcggttctcttcgtgtgacgcgtggcgcagagtttgtccgtttccgtttgtcaaaatttccgtttccgcgtccgcggtgtgggttcgagcaccgctgaccagcttgcgttttccaccgacgaaactgacacatgcggtgagccttgtttcgttctttgcgcgccgaagcgctcgctgctggtttcccgcgcctgtctggaagaagacgccgttctctctctgtggataccagacgccgttaacgctgctgccagacaacttgaaagtgtttttccgagagggcttttccgcagttccaaaacattccaccgtgtttctaccgttttgtcgggctttttcgcgtgcacgcatttccgtgggacaaccatcgtggcccctgctcgtcttccactcgccaccgtaaaagctaggtttccatcgcaccgtcagccaccgtcgaccgtccacccgccctccccccctggcgtggcccgtctcgcgactcactttcctcggaaccgagtcgcgattgtgtgcaacgaagagcgaattttctccatttccaacaaaaagtgtctcaacgaagcggagaaacatcgccacactactgttctccgccccattcttccgcatttccaacctgtataaaggtatccccttttctctgtcgcggatgtgtgtgtgttctagcctctgtgtatcggtatgcgatgtccaaaaagtagctgagtgcgttggcgtctgtgtgtgcgtttcctgttgtctcctttgtcctcggagtccctccttttgatcgtttccagattgtttcctcttggcgctcgccagcctccgttctgtcgcagactcaaaaccgccgtgtccacccgctgttggcggctacacacccgccacctttgtcttctatcggtgtacacacccccctcccacacttgcgtgcgttgcagagaacgcatttttttctttttccccgcttccccgcgtttctctcctcagtcccccttttcccagtgcccccggaagtcgctcgtgtgcccgtctcaactctggtgtgcctgtcgccttcccgccgagcaaaaaaa

SEQ ID NO: 939 - DNA, 1708 bp, Toxoplasma gondii
gagaaattagtgaggaactgtccagtgaaccacagaaagactctcaggaaaaagagaaaactacgcagctggtcgacggcgacaatctccctgatttcactagactgttgagcacagccgaaaggctttgttcttcacgaacagctgagtggattcttcttggcaatgtttctgagatgattttgggactgctcaagacgctggtcgcgtcgctggttccgcacacagacgagtggcaccggcggtcatgaagcattttgtttggtgtcgttgcttgcaattccatttgcaacgctcgcacatagtcgccctcagcgtttctctggctgactctccgtttccgcagtcgtcgtgcacctatctacgtagctagactttcgttcggaactcgaaggggacggaagtcttccaactctcgacttctcctgattgatcactctggtggcttctaaacagtgtctgaagatcgtccgcagaaagcgtggaggtctcggtcgatgcctcatgacggcgcgtcctgaagggaatccaaaaggcttcaccggcgcgttcggaagtgtttgcgaggcggcggtgtacgtacagctgtcaaacttggctttcttctctcagaagctgagcattacacacttttgttgcagcgcttgggctcttgcaggaaccacaagttccgttcaagtcgattgatgccatttctgttttctgagagccggagctgtcggttgatgtcaaccgcgcgaagacagatcgcacaccctaaccggccagcggtgtgcatgcagaacgccacggagaaaaggcacttgtctctctgactcccgattgaaaaaacacgcagcaagagcgaactatctttttgatcaaagggcttctctcgcgacgaggatgctccttctgtgcgcgaggagacgcggtgggaggcgccgcgtcgtctgcagtgtctctacacacacgagccgcttcgcaacgcagtcgcatcgtgagaaaagcaggacttccttggttctatctggcggacgtgagaaacgcgacttcgtctttgtggagagcaaagcaaaaaatctgcagtcgcatttccgcatgcctccgagagcgaagaagaggaggatttttcggtaaaggcgggcaggagagagacagcagtttctcctttgtcttgacgcgaggaggggagctcaccggtcgtctcccgagaaaactcgtgacattgcattttcctgatgcctttctgcccaattgacagtgtctgctttttcctcgtgagacgcgtgttttctttgcctctccctattcgctttgggctcctcttttcctccggttttctgtctgttgctgaaacatagctcgctggcggtccacggacttcctctgaagtggaagaaaactgtgagttcaactgaatttcgctctccgtttttctccctcatcctttgccagttcgttgtctctctcttctttttcaccttcgaaaactgctttcgccctcctcttccgtcttccccgtcttctgcttgcgtctcctcagaggcccgctgcgccttcactcccctcccttcgttcccctgtctccccgaccgtgaagtctttgatttcttttcgcttccttctccttacaaatgtcacattgccttgactgtgtgtgtcggttttctccttcgctcctttctttctcggtgcatttttctctatctttctctgactttccaga

SEQ ID NO: 940 - DNA, 2470 bp, Toxoplasma gondii
gagaacggacaaaaaggtgaagacatctgcacatcgattgtgcgtgtcggggctatcctgagcgtcttccacgctcttgtttatcagcttcctctccacccttctcggggtttgcatttctctccagagtttccgctcggcgcctcgtcgaagaaacggaagcgcgacagaaaggatggacggaaaggggccgagacggaagccgatgagagctccgtccatggcggatctttattcttttcagaggcacatctcgaacgccttctgttcttcgttatcgacgcggcgtatcgatgctcgacagttattcgaggcggcgaagagggaggccacaagaaggaggcaaggaccgactctctgctgcttcaactgctgagtaccgaacgaggtgaaggcgccttcgcagccgacgggggctcttccctcgcggcgctgtggcagggcctcgcctctttgtcgccgaaggaacagcaaagagaagtcctcacgggtggcatgttccttctcggcgaaattcaagaagtgcttaaagacgggggacgcgaggaactggccctcggcctcctggctaaagtgcgcacgtctgtgctgtcctgcaggttgaaacggaaggtcgacagccagcaacaggccttgctccagccgcagaaatacgcagagaagcgacgccggcaacaatgcaagaagaaactgtcaaaaaaaagaaaggtcgcgctcctcattgcgaaaaaccgaggcggaaaacgaagagagaaatcctgataagcagctaccggcacgactcctttgtttgcctttttcgaggtgtcctcttcttgttgaggaaagtcgggtttcctttgccgagcagtatgttttttgacgtgagtgttccgccgatggcctgattctctggacgtctattttttcttttgcagcgcagtggttctgatgtgagtgtacggataatattgacgcaccgtcgctgacgaaccgcctgtaacactctggaactgatgtctccagtatttgtagacagaaacgtcgctacgcaggttcccgtttgactccgtatccggaacagcaacgtgatttcggtattgctttgagaatattggattgaagtcccaaaatctactgttggccagggcatacacacaaacgtgcgcgtttcatcgtctcgaggcggagttattcctgtttcttgtgtctgacatcttcaaagcgtcaacccgctaatcactctcgtgttgagatagtttctgcaatatttagttgacatttttagtcgaatatttccaggaaccacaggttaccgcgacgaacggtagctgtcttcactgttaaatcaacactacctctcattaaccgtgggaaacacggcacaaacagagaagcgaagcaaatgaagtgacgtcacagcgttgcgcggctccatggcagcacatgtaaagcagcgacagaaattacaggctcccatattttgtggtatagttccgccgcttcgctggtttcgtcacgctttggaaatcatctttccgaaacttctgcccccgagtctggtgcatgccgagacatcagactgatgaaccgaattctctacgaaagagacaaaacgcgtacagaaacatatctggtcggggtcaaaggtgcagccctgcctttgtaaagaaaatgaaaacaccctctcggttttgagggtcacgaggtattccggagctctcccaaaaacccagtgacgttctgtcaggtgttaaaaaaagtcacctaatgagaattgtgatacgcaattaattgagcacacttcaagaatcccggagtaagcgttaagtggccaacatagactcttgcgggtgaaagaattcctctgcgttgccaaatgcttggggtaatgcccctgtggtgacctccatagagttggaacgaaggaaaagcaggctttcgtacacgccgtttccttgtccagggaaccggccgcagctacgcaactctttcgaccctgaagtgtcgagttattcctcatcatctctcaaggaagtcccccagctccgctagacacaggctgtctcggcctcagttacacaccgtgggtcaaggtttttcacctgcctaaacaaagttacaaggcatagctgccggggcacccgtgaaacgcagagtccaaaaaagtgaatcgcaaaaggctgactgatatttgaccgcgagaactcgcagtattcgctaccgtgtggagcctcgatatatctctggttcttcgagcaaatactccagcccggcactctccgaaactcttatgtacacttggaggtcaagtgccgcgactgaagacgtggttccattcattctgcagctacggttcctgactggcatcgctcggtttgtcgtccgactggcgggcgccattggaacgaggcgtcgcttgcaaaataacgcccccgcagcccggaacagctataacattaagagcacttttttcagcggggtccgccga

SEQ ID NO: 941 - DNA, 429 bp, Toxoplasma gondii
ggcagtagagaagatgtgaaagggagaagatatgggagagagaagaggcgctggacaccggacgcacttttgcactgccttgcttttgtttttgttcttcagcccgaacgtcttgtcttcgacgattttctgcttttccctctcggcggccttctgcatgccgcgttcggccttcgcgtccttcttcttgggcggcattttgacaaagaaaacaaagagcgagaggtttcacagagaaacagctgtctactggtcagggggaagagtcctatgagagagaaggcagagtctacagggcgcctctcgtcttcggcggaacccggaaaaaacgtgaactgcttcagaaacgcagagagtggttcctagagggagttcgcgttggttgggtcgacgccagagagaagagagaaggaatttgaagagcgagaa

SEQ ID NO: 942 - DNA, 2329 bp, Toxoplasma gondii
gtaggctgttatgaaggacgacaaacaatgcaaagaagtaaaacaccgcgtccgccaagacccgtttgcaggtaaagagaagaaaggctgatagcgagatgttccttgaaagggtttacgacgagtgatttctagaaactatcgctacaactgccccatgtgtgtccttgtcttttggggcttctccatagacacaattaggaaatcgatacagactatgcgtctaggaagaggcacatgaaaggcagtgcatgaaagaaggaatatgagctttccgcgcatgcctatcgcgcggtagggacactctactgtagagctcagagctccacacaccttttcagggcaaaggatggccatctatacttggtcacaatgtacatcggccgcgtagtggaataacaatgtcgtaggatattgacatccaacacttttagctgtcataagcagtccattggggtggtggtgtaagcaatcagaaaaaaagtcagtgcatgtctatctgcaataggaaagacgcaactaagatctgcatcgtgcaatcacgactacccatatatatatatatatatatatatatataggcaaatgcatacatgaaaacatttgatgccatacgctctgcatgttgaagcaaggaagcgtccatcctctagttcgctcttctaatttttcaggtgggaacatatctcaggaaacaggggttccctccgcgagtcgcgtcgtagttccgcactcctcacaatcacaaccagttaaaaatagctacaggatacgaagatacacaagagagcgagaacaaaacaatggaaaagaagtgcgagatagtgaacaaaaacagcagggagcatagcagctgcaacgaatgatttcgggtagcaccggtgtgtgtctgtctcaagcacaagcacgtgtactttccctctatttcgtcctcccccgttgcgtgtctggatttctgtgtgtccgtatgtctttctcttctccgtccctctttgtacccccttgtctctcttgctatggtcaacgctggtgtcgcctgcgtcctgatcgcgtcctctgtcgctctcgggtgacagtttcggaggcgctgactctcctgctttccacctttcatcgttctgtgtctttgcctgtacatctttattcttctctgtttctccgggctactgacacgctttttctggggactacatactacgagttgcactcctggtttacatcttaacggcgtctgtttcccggctccaagttctactgtgcttttcatgaccatgttaagtgcattaagcatgattatatccagcttatcttcgagaacccaacatgtgtatacctgctgtacgaatatattcactcagttttcacctctacgcgcttttgtcttgtctcgttcgattactcaacatgcgctgttcgtgccgttcggttatcagagagactgccgcagttcgccccctctcgtggtacgagaggaagcatcgggcaagaagtatcgaactcgcggtaagaacaagcgaagacatacgcaaagaggggaaagcagacgaagataggaatgtccccgtcgtcgcacaagatgatgtgtgccgccgtccgacctcggacaaacagaaacacgaacgacatagacaaagcgagtccaaattcgcgtcttcgtgggagaggggaagagtgagctttgatgtactacacctctgaagggacagagccccatctagaatccgggggttctctgggataggctgaaagatgtcattggcacactcgcgagggcgaatggacgcgagttcgtctttgcgcatgcaggagcacgagaggcagagagttcggaccgacaagcatttttcccttttttccgccctcgcgtttgttcctttctctttttttccctggaacgtggttcgattccgtgctcattttcttctattttcaccaaagtaaaccccaaggacaggaagccacaactctctcgaatcgccgttggtcgacactcaacggggcaacgcgttttctgtttctcaccttcagttcgctggattcccccgcccagtttctcttctttcccttctcttccacgcttcctgtacggtttttctcggtctcagctcgttagttgcctccacgcacatggggtcgctctcctcgagcgccgcgcctctctttttttacgcgctctaccctctcgttttctgatcgagcgttgcctcttcccgagacctttctctggggagaggatacatcgtacgagttcgactcctcgttcaggtcttgaaggtcgtctgccctcgctcatatctgcttctcccctgagcgcgcctgctgaccacga

SEQ ID NO: 943 - DNA, 1262 bp, Toxoplasma gondii
aacgagatctaaagaggtggtcgtacgtgcgaaaactgcaaaagcagaaattaacggttgcgatgtcaactaggggtccagcggctccctgtcgggactcacgacatcaggaggatagtgtttttgaactactgttttgacgagcaagagcttctgacactctactgcctgccgtaaactctcgtcaccttgtcttcgtggctctcgagttgcactgtacatctggtgtagtcgcagtgtcaagctcagactataccaagctctttcaacgcctggtatttggctgcctcttgaggggtgtcgtggttatcttgcctgggctcgcaccaatagcaccagcgtctaatcctcccctcgtgtctgataacacatcattccaaaggatgtgtgctcgcatcacgtgtatttattgcagaccattcacatctgaaatcacaggtttcgatcatacagctgtcggtacatggcgattgcggatgattaaaccagcacaagagaccacttggatgcctgcgatacatgattcatttcgggatttctcgagacagggttgttcccagctgctttcgtcctctgcatagacgcagccaccacaccgacttctttcacctggcggttcattgctctgttgttagcttctgttcagggtaatctgaggtattccaccacctaaacagtggctctcagagctgaatacaaacactcaccacgattcagcagctagcaagtcacactgaaccagatggatggatgatcagccaaacaagacatctctctttcgccgcgttcgggtctgcctaaatgactgtgctgcatatgggaaccgtcgagaccatggggtcaacaaacacggagaggcggacattcttggacacgcgcgcggcgattctgttcagttttcactgtgaggttgacagccggcgaatggagaaacatcactgtcttcttgtgggtggcaagtgcgacgcgccgctattctgacttcgtctctactggcgccaagaagcaggcgctggctggtgtgctagctagaaccgtggccgtgtctcgtgatttcggctgcattccaggcagtcttagggccggccgcgcagcgggtagtcgaaataatgcttcgaaccaacgcgaaatgccgcgcgacgcagctgagaacaagcggcctccgcgggaaatgagtggtcggctggctacctacagttgaacagtcagagcagacaccccgccaacaggcacagacactgaacgtcagcagaacggcgata

SEQ ID NO: 944 - DNA, 1678 bp, Toxoplasma gondii
aactatatttctacagtggtattagctgcatctagtggcgatacagagcagtcgcggagagtgccgcaaagacgggtgcaaagatctcctggagggggggagcgtttctcttggacgaaacggcatcgcttctctttctcaccctccatgttctgccaagggcttgtatggctcggcctcttttcaacaacggcagaactgtgaggctgttacttgtaggaagagtttgaaatgcttcagatgcatatcttttagctgtagggccgtgtgggctggaattactttcaacaccgtgcacacctggtgatggttcaccattgttcgacaagtgggcgtctgcgaggtagagggacccgcctatgtaaagctttttctcagaagcaattttacattgctaggcagtttgcatgttcaaataagacgacagcggagaggggcgactcgctgcacacaaccgtgcagatcttcacaggtgtctctgctcagtaactgagaaacgataacagtcgtgcgcttctgattggaagtgactcgtcttgagcggcatgcctcaagattcaataatgaaatccgagtcccctttaggaccgggggtgaacgcgagcaaaggtgaatcagtcgagtggtcgtggcaattgcaattatgtaaactcgagaaaatatggcatcggagaatacatgtgaacgggggcagatccaggagtcgctgcttctcgaaaagaacaacagcaaagagctcttgacagtactgagcataacgtcggattcaagcgaagttgcgtgttcacaaacaaacctcctgaccgcttcaacccaacaatacatgggcacaagtactcacaaccatgcaggttgtcatttacatatatatgtatatatgtatatatatatatatatatgtgaatgacaacctgcatatggtggtggtagcgtctgcgtgcggtggcattcgatattgaaaaggtggaattaaggtcttccactggctcttctgaagacgatgcacgtttcactagctacagagacgacagattctggcggtgaattctgcgtgtcctcgtttttggttcccgtaaagtaaaaagcagcgaagcggcaacagtccacagcaaatgtcctgcccgccaagagatgcagatgtcgtcggccttgagttccgcaaagcatttcaagcgtctgtttctcctcgtttgcaatgaagcaagtctttaattggagatgtgttctgttaagtcctgcaggacttctgcgcggaaatacacgcaaagatggatgggcattgatggcatggggagaaatgggagatttgaggagcgaacgttttgtaattgagtcacaagtgtccatccgtctgttgaggttcctggaaatcgctcttgtcttggagtcgaggtggctcaagaatacatcttgtttaccacgcagtatcttctcaggtttcttgtctccttcaaataaaacaaaggcaaacgacacgaaatttcgacgcgcgaacttcggctcccgcctcgagtcgaatatgaactctttcccgtgagcataaatcaccctttttttgctccggtttgttcgtttttcccgtcaccaagggacaaagagactcttctgaagtgacctaatgccttttgtctccctgcctttgtctccatcctcgcgttctcctcaaaggctcttaaaa

SEQ ID NO: 945 - DNA, 2771 bp, Toxoplasma gondii
tagatgcacacgatttgtttctacaaacattcgcgccaagacctgcgtaaaacctggaaatgagaattgcgttgtcggcattttcccggtcgattcctgcgtgggcaggagtgtgccgtcgattttcaaccttgtttcaaggacgcttgcatcttctgtagtcatgtactgcgtcttcttcgctttccatattcaaggggagcgagtggtgggggagggaggggcgcttctgtagtacttagcaagcggtggtgtcgaaagagacaactgcacttgtgtgtgtttttgccgagcttgctgtaaggaattccgtcggcacacctgctggacaggcggtccagcttatctgaaagctaatcaatattaattttgatgtggaggcactttttcccttacaacacagctgggtacgtgtggaaggggaatgtctaacggcgccgtgtgtctgaaataaatagcacagtcaggttaacttaattaggggtcggtgtgctctgatgtcttgactggaactttcccatgcgacgcacaagcatacacggtctactcctacgataactggagatcagagcccgctcgttcagctatatgcggtatcggcctgcctcggttttgcacgcgtagagaggctgaagcctcctcgctggctcgctgcactctgatggacgcgacgaatgatatgggctacagtcgaggttctagcacctgaatctcgaaatcctgaggtccaacaaccgcacatgtatccgcaactgtgcactgtcacgtgcctgagaacgctcgaaacagctgccaggtgaccaggaatcctcactagcgacacatgtccacgagtgcctcacgattggagacacaaactggcatctccgttgtgacgaagccctttcggacaagacccccctggtgcatccaggcgtcgacactctttcgcggcgccgatacgacacatgttatctcagaaataaccacaactgtttccggagtgtcataacaagattcgttctttcctttcatcacatattgggtttaggaatttgatatcctctcttggcaggcaccgagatctgcttctgggggcatatctctttgcgaacaagggatacggatgtaccaatcggcaaacaatgactccaaaaaggtacagagtgacgcttcgcggttgttgctgcgcacgtcactgaacacgccggtttccactctattccgtttctcgtctattaatggtggcgcaggatcgtatgagttcgtcctctaccttgggaaagaagaagtgaaagcctgtgcgttttcaccgtttcccccaaaatgaatactcctcagtacgacgcaagcgacagtagcgatagcataacgtttctagtaggaattccgcacatgaagtcgcgtgcaccaacaatcttgtccccccctgagaatgctccacgacattcagagttaactttcgtgctcacacttcccgctgcagccgagcggtgtgcatccatagtgtcggagtttcctcttgcataagcacgctgtcagttaaatccgccaacgacagaatggcaaacgctactagggaagtgtaatgatacgtttctgaagagctgctcattctaggttgtgtgccacagctatgcaacacggagacaggcccaccgatttgtcgagcccgaatcgatttctgtctgaaataggatgagtgtgtgtcgatatccggacagagagaaaatggtgtggtggtgcgacagtgtcatccaagtcttctacaagtgccttccaccggactgcctctgagaccagctgtgaataaggggcatggtgaggggagacagacctgaatcgtcgtgaacggcttggcgggtccgcaagcgacaagacacgaaggtgcccccgctcttgcgcccgtttatttgcccgttacattctttgcccagatcctcaacactcgatgcctttttttacgcagtgtttgtccgacggcaaatttgttctaacttctgaactatcgttttggcctgagcgggcaatcgaagcggtatcagtgctttttacaacgcctcaacgaatctaccgatcggtttgctgcacgtcatgatggggcttacggacggcaagtgcaccactttttccagcagtcgccgtatttcaaggtttggattcagttgtagagcgtctctggtttgcctcatgttgtttctttgcgttgctgcagtcgacgatgcaggcatgtaccgacatggatccttccttgttctcggggtatgggcaggagccgggctgcccgctgggttggctacccgcgaaactggacacagtatttatcacggggaggatgataatgtcactgtttgcacgtgcgtagagatcatgggtgaaaataggcagcgtgctggataatctgaagaagcacctgtcgtatctatcaaaacggccgatctggtattttctggacaaacgaacaagttgacactcatttgcgagggggcgcatgttccggacagcagtaagaatggaacagacaaagtgtgtcatcgtggtgcagatattgataaatgcacagaaggcgcttcgatacccgaacgtgtcaattagcatccagcagctgcttaccggagaaaagcctgaatcagtttaatggctctcaaacccagaccacgataacaccaagtcatattccctaacaattcctggtaacattcttcttctcaccgacaaggccttctccgtcggatgcttgaacaaggacagcacttcgaaagcggcatgtaaagtgatagttactctggaca

SEQ ID NO: 946 - DNA, 1838 bp, Toxoplasma gondii
agaagtcgtctataccatagtaccctaattttcatgtcataaggcgtgtacctgcttcgtccgaccagcacgactccttttgctggacttgaagatgctccatttgttctgtaacttccttcactgttggtacagacgcggtagtcattgctttgggggccgtcccaagagaagcagcaggagcctgggctgccggacaagaaagcgcccgggcagggtcctcgcttgcaggtggtggaggtggtggcgcggaggatacgccgcctggagtcacaacacggacaaaaggtatcgttcgatataatactggattcgacaatcgattgagttttttctcatcatccaaagtcgaatcagcgtcgattaaggcgtcggctcgtgaccacggaatcctggccttttgcaatgcggcacatgtgcacaaacacgctcaccgctggtttcgagcaagactcccttgcacatgtaaccactattcaatgcatgtaaaccaattagattgtcggcctactcattttagcactgacaagggccctcttgctcttcagcaaggtgtctcgtgtcaacacggatactgttgcggtgagactggcgcagcaaccagtcctcggcagcatgggtgtctcaacttggctccagtttaaccacgtttcccgtcggcagagaaacactcaatcaacaagtggtacgactatactcatgttccaattgtaccgggctgcagccgaagcctgatggggcagacgccgttcacgcggtcgcaacctaccaggcacgaagacactggcgttcggattgaagacaaaccccgacatggcgacgtgggacgaagaggcaaaggcagaactaagcactatacacaaatcgtccttccgaaaagaaccgagtccttgttgagaatctagatgagggtgcaagtcgtggggggtgacggaagaacgaatataccctgctcaccccaagaaagaaatcgaacaaccgaaacaagactttttccttaaatggaacctttggcacaactgttggaaagacagcaaaattaaggacgtggtcagtcggttcgtttcgtcacggtgcatgccacacgtacgcggcgcggccaggataccgctgcaaggagaagcacagtacgtcgtcctgcacacgtcaacacagttacgcaaggcaagaaacaacgaaagttcatatcgctattgaaaccctccaaaacctcgtgagtcaaactgcagccagtgtgaaccagcgcaccgaatcaatatgccatcgtccagaaaacaaccaccagcgtacgatgccgtggcatgggacatttggaaatcgcatattgcatgcaggaccctctgcgttctctggttgagcggggaaatcttctatcgttatccgaaagcgggaaagggcagactttctcttttgacaaagaaccatccgtaattcgaattcccttggtcacattcccggaggtatgtggaaattaagtccgcctggctggatgggccggtaggggcgccaccgacgccgcagaattcagaagcgcttgaatcttacacagtatgtacattggctgtcaatacctttgccatgtaacacgttagattcgtatctttttggcgttgggagtctatcaagcgtggaagaccagtcaatattgccactctatgcagctcgtaacaaaggctggtcagtcttgcccaggcacaagtattgtcgactggtgtacatacagtaagcggaatggcagttctgtcttggtagtatggcttaaacatcagagcttatccgcatccgcttggtcttttctgaaattaaaagccttagtcaccagccgcttaggttcaaaa

SEQ ID NO: 947 - DNA, 1932 bp, Toxoplasma gondii
agccgcctatgagcaaactgctaaatattgaagttctcgagagtgccgacatctggaatttggaacggcaatggagagtagttctgtcccccgtagtgtgactgcccgagtctcttgttgtacgtgtgggccacaagtcgccactcttctatgtgttgtcatttattttctatgaggacaggagttcaggcatgcccttacaagaaatagttgtgaacacaacggacgtccacgagatagcaagtagctcactttcttgggtcttttgttttgccacatttagcctcccgccgcactttgaatcgagttccaggtgtttcctacagaaccattccggaccacagtgatttgactgaggttggctgacaatgaaggggacgaaacactttatttggtctgaatcaatacattttttgctgtgtgtcccttgatgcccgagacacgctataggaaactccctgagttcacccgaagtggacctcacggtcagccgaaaagacaccttgtttctcgagtgcgggtatagattcatcaccttcaccactgcggaatggaaatttgtagcgggaaacaacaaagcatggggtcgtaacatcctctacaggccaggcaactctcatcagtcgctgttcgcgctgagtgttcacggttttcctaagtgttactatgagacaagatggcccatgaggtccgccatccgctcatgtcttttgttttattttggcggtgttcactgttcgagggtcactgaagcgtgtggtacactgcactcagacatctaacgctagtccgtggcttttatggcagcccactcaggcacatcgacttcgtcaggagaaatcggtttaacgttggaaaaagttgaaaatcctgccctataagaccctcctgtgagtgttgtgagctacaaacgtgtcgcccagagtcctccaagaagcatcctcatttcacggtcatgctgttttgcaacgagacatgcgctacacagagtgaattgttagagctgggggggatcctcaggcaaaagttgttcacaagttttacgatagaacgactttatgaccaaacatacatgaaacggctgaataatcctgtgttgtccacgcggagaggtttatcgctgaaagagacccttcaactcaaattgcgggcttttttactgcgtcggcatgccagcggtcgcatttcttcaatattgcatgcagcggaccccgctgccacgggtgaaccgcgtcgcgtttgcatgcttttgagccgagagacagacggatataatgaatttgcacacgccagagtacagcaagtgaaccaactacgtactgcatcataatacaagcaatagaacatctagttttttggtttgacgcagcacaccctcgtcgcaccagattcccgtcgcttgtgtgtacgatgtgaaatcgtcagttgctttcgagacggattgccgccgcttggacgtcattgatctttttctgtgccgtgggtggaataggctgttgtgtcggtgtacagcctagagaaagtgtcgagttaattttgatcatcgactcgggacggcgtcgttcaaagggagaaatcgggaccctgaaggctctgaattgtggtgaatgttagcagtactaaaggcactgtggctcgcctgcctgatacggtagtatctcttgcaggcactgtcctgacccaaaggattctgaatagcagcagcttctttcagccatcgtcccgaactgcccaccgagcctgcagccgcatcaatccgctttctgccatccgcgggttgtgtgcttcggaggcgccaacagagcagccccggttgacgaggtttcaatcaagtcgaatactcgcattcagtaggtctaatttcaggtgcaagcttcctatgggctaccggccctgttgacgccgacttttggatcaccatcacgaccaaaa

SEQ ID NO: 948 - DNA, 2660 bp, Toxoplasma gondii
aacagccgaaccttgaacaaaaatggcaaagttccaggccggaagtagcggaacgtcagtgaaggggggggggggaaatggtgactacaggtcaagaaaccgaacaatgaaggatgaggctgcagcggcgattgccgcatcagttcgaaatggcatgggaggaattggagagggtaaatcaagaaatcagatatggtcacagccgaaggcaagttctttttttgatgccacgcagcctgtgcctctgtgtggactgtgtgactttgatttcttgtgtatggcaagtttgttccgctagtgtgttcttttgtcaagtacaacgctccctcagcagcgacagaaaccaggcagcctgccttttgttagagcatttgctttctctatcgacagccggttctacttacaccagccgacgcaattgcccgagcctgtcagggtgtgcttgtcacgtgtgtggtattttaccccaataccaaatccatattcgtgaatagagaagacataatgatgtacgcactcagtcaaacgagcagtcgcgagcaaaacgctctttttttgtctgtgcggggcgattaggaaaacgaggtgactcattctgtgttgtgtcctcttttttctttttgaattatgattttttccatatggggcacgctgtcccgtacttctggaagtccgaccgagtcggctgctgtacgcacagtttcttgattcaaagatggcgcatgaaacgagattatttgcccttctcgagcaaaacgcctgccccatcctgactgagtaatccaggtgctctgctattttaaaatttagaagcttctgtgcccagcggtcagtgggctggtcatccacccgccgctgcgcgaactgtagacggctttcaggttgcctctcgaaaagcctatcaatctcaaactccatgttgtccggtgcgtttttcgtgaagagaccaggtagctcttacccccactagcatcgtacgctgacttcagcgtaggtacggcagtatcagcagcttcgttagacctactcagtgcgtctctcatcaggaacgaattcgctactcatgcgtttcaggttagatttaaggttgttcgtaaaataaaggaaaccacctgttaacgccccgccgtttgcaacttagaaccgagtttgctgtaaagaagaccgggtggttttgctcagtgggctggtgcgcggaacacgcacggcagttgatgtttgctgagaaaaacaatccgtcttcctagtggtgtccccagttcgtgatcggccgttgcactgtcgcgtcgaaagcctcgacaaaaagacacaggcagaaagacataccagcggacgaggataacagcgttgaaaaaaaatgtggcgcgcaacggcacatgcattggagaggcgcgacaggcggccgagcagacgagaggaacagtcggtgaaaatgttagaaagggggacgttcgtgtgtgacaagaagcctgcaaacagtgacgcttccttgacattttcgaaaaccctgcacgagcgcagaagagctttttaccgtgcagcggcgagtccccccccccaaggctaacggagcgacatgggtttttttccaccgcttttttctgcacacttcgcccctcccgagggcccccatttttgaaacaaaaactgcggtcgtggcttctgttagcgaaaacgaacttcattgaagaagtgatttctctggaaccggttcgcgagtccgccgcttgttttgttactgtggtggtgcactcgggccccgtgtatcctgacgctgttgtcaccctccatgccacgcatgtttgaagcagtgcacaccacataaacgcagagtcaaaacgaggatctgcttctgctttcgtggcccgacggtcctcctttcttctctgccttcgttgtttctttcccaattcctcgtctttcgttcctttcgttttccgacgcgaccgtcttccccccagctgaacgcaagaccagcgccactcccagcacgctctgcccccctcccccctcctctacgcagactctgcagctgccccccgcttttgtgtcgattctcccgacgtcaagcagattttttctcattcggtggatgttttcttccttttctccatattgctttgtttcgttctcagcggtttcccccaaactcttccttcgctttgtgggtgtggacccccaggtttaacggaggtctgccagctgcgttccactctgggaagctcgggtgtctgtacacgcgaagaactggatttctgctcctggggaaagagtcggatgcaagtgaagaaaccacttgtttccttccgcaattgttgcatgctttgagtccccacagaccgcgtttttcttttcgttgcgcttcaacgccttcgcaacgcggatagtgtgacagcgtgcccccttctgtgtcacacactcggtccagcagacaccagggtcgatctgcggccgatccaggttccgttttttcctcttcgtcgtttcctccgcatttcctctctgcggtctttcgtctccaagctgcggcctcttggccctttgcctgccttctctgtacaaattaaagacccgcttttcgtccttttctcctcctgcccagccgtgtccgtgtcgcgtcgccgccgtctgtcgagaccctccctccctccttgttacca

SEQ ID NO: 949 - DNA, 4822 bp, Toxoplasma gondii
tcagactgcacttcgagtcctgtactcgacgacggctcggcaaccacaggggaagcgatgttcagagagttgttatccgctgagttgtcttcgtcgagaatgccgaacgtcctccgaaggaaatcttcgtcttcgcgccgccagacggcttcacagcgctgggcaggcgcagaggcgagcgcgagaggagagggcagcaggggaaaggagaaggcgtcttgcgtaggctcttctttcagacgggtggaagaagcctcggagaagggaggagaggcaaaagagagccgcgagctctcgacggaggggaggtcctctgtctcctcgtcgtccgaggtccagaagtccgagtcgttgccgtacagatgcctcgccgccgcagccatcgtggcaaacaacgagagacgaggggagcagggagaaagaaaggcaggtcgtccgaggacggagacggcggcaggggagtgcaggagaggagagggaaaaggcagatgcagaagagagggagaagaactggagagccagagagaggcgtaaaagagcaagagagaaagcgtagaggtaccagaaggggaagaacgaagaacgggcggtggacgcggagagatgcgagcaaaagcgggggagacaagtcgacagaggagaacagcgagaatgttcgagagaggcaaaagcagggcggcaaggaaacgaaagaagagagaaatcaaaggtgtcagtgaagaagacggtcgagcgcagcaggatgtctggcgttgagaagaggaaagcgaaacgcggaagtgtatcgattttctacacggtcggtgcatgcagcagggaagacaagagaagttcttccgtgtaattctttgcagaaaccaagagaggtctggagtctccactccctctcagtgcgtggagacaaggcgagaaagcctgagcggctgcgcttctctaaatgaggaaaaaagtcgtttcacatgcgttccgagaaaagggggaaacgcagaacgagacaccgtcgccagcagcgtccccccatcgaagcgcgatatcagaagaaaggaaagaaccttttgcgtaggatttgcgtcgaaaaatgcaagaaaagctgattcgggtgttcacatgccggccgtctatcaaactcgaaatgcatgcgacaagacaagcagacgctcgcgaaaaatgccgcatgcatttttagagcagggaaaaaaaagggtgtgtaagcgaacatgtttttgcagtggaaaaagagtgcctttgccaaccctccatttcctgcttctcgagagacttggagctcttcagttccactcttgttcgcctccatttgtcctccatgttcttcgcgttgccctcttgcgcctctggcgtcctgcaagaaaacatcattgacgcgcaaccacgaggtatttcttttttcttccaggcgctgcaccgcagggcagtgaagtactcgaggcagcgaagtgctcgaggcagcgaagagtttcggagctcctcagcttgaggcgttaagagtgatctttgcgccacagatgattgctcgctcatgtcttcctctaccgtactgtccgctgtgtgacggtgtctgtgtacaaagaaatcccaaactcaaacacagagaaaaacagaagcaactgcgtctcagtgtcacaggggacggctgaaattcgtgtataatccggtcgcagcagtaacgagtcgaagatcgggcaaggaaatcctacgtaaatgcgtatgtgaagaggcttgcacatatacgcatccgcacagatagggatttcgattctgtaaagtgtctgtccgtctcccaactgaagagagacaaaacgacagacgcagagagacaccgcaaagaggagagggctgtctcgagagagaaggataagcgtatatacacatagggatagctcgatatttaaggagcacacaaaaacgaaagttcgcggatcgctaaataataatacaaacatgcatacatacctgttcaaggaagtgtgatgcctgtaagagatgatgcagcagctttgcagcctcgcttctaccacttgacctggatgttgtgcactggagaacgcctttcctgtaaatcagggaaactgtgcgtctttctccttggcctccgcacaagaaatgcataccgatgatgaacttgatgcaaaagaacctctggaaaagtaacaccctgcaatgaagcaactcgagcaaacgacagcgaccgacccaaagtctcgagccatttccatctctatcgacgtaaatatgtcgatctctatgcctaaatgtctgtatctgtgtatgtggttgtttgttcaagtttaatgcgcacatcgataaacgtctggcgcatgcagataaatgcagacatatatttcggtgagaagcaagctaaggactttccccaatcagacaagtggaacagctctcgttgcgtttcgcccacgctgacactccgacatgggtgatacggggaacttcttgtttggtcgtggtgtacggcaggaagaagaggcgagttcttggcatatttcccggataaacgagtttcgaaaggccttgccgcgcgagaaggcaattcggtcaagtctcaaaacgtagaagcggttcttttcccgggggtctgtctgtcatgctcccagagacatctccggtcgagtcctagacagcctgggctggtttctcaccatctgagattccacaacttttccgaggcaaagcaaattcctttttttcggggcagatccgacatctccgggctgtatgcggaattccagctgcctgacgcgcctagaacatgtctgtttgacgacgcaagtgtctgaccaagtttctcggccaatcttttcgacgttccgcttttggagagattgtacgaaatcggcatgtgtgtttcgaatgagggtagtcattctacgagagtcggtcgtctgtctgaggctttcttcgactcttctttccagccatcgcgcgggaatgcaaacgaaatctgaatctgatcttccctttctattattgatggcgtttgctttcacgttttcgcgtttcccaagaaggcagacgaaacgcgtatttgtcattcatttcaagttgttgtggcttctgcatatttcgctttgaagttggagaacccccagtcgacgttcctttcccccgttttcttcttcttttgacaagcaggacggccgttcttcccgtcgttctgctgcggccgcacggctcgctcgctctctttggcctcggcgccggcagctcgcgcgatatttttggaaggcgtttctctatcagggacgggcagagccaggaaaaaatagaaggcagagctccgttaacagaaaggcgcttttgagtcaggaaggaagaatcgaagcaggcgaaccgcgcggttcttgtctggagatgacttttctgcttgagggtcgagcgctttttttgtctcttcgcgggggtcttcacgtcgcgcccgcctcgacccgccggcggcccgggaagaagcgcgggagacgaaggccgtctgtttgcgtcttgaggaaacactgtgtcacagccgtgttttttctgaaggtttgccaaggcggagagcgaaacgaaatcgcctacgtttttccagaaaattcaaagttgtcacagacgtttctcacctcgcgagactcccgttgattgggaccgagtccccgtccgcgtcgggagatttccagagttgacccgctgcgttcgcgtctggcgtacttttaccatttgaaaacatacgaggaaggctacgcgccagtcggcgtcttcaggccgaagtcgaggtatctctcgccgcacaaattcggagaaaacttttggacggtcccgggcttcggaaaagcggaagcgaaaaagttgtgcgttcgatccggttgagcgaaccccgtgtgaggccggaaatcgcaattttttcgtctaagtgtggacggactgaactctgagtcctttccttccgtttgtcactcgttttcacctttttccttggaaagagacaccacgttggtggactcctgtctcttcgtcccagaggagacttcgagaacagacgctccagcgcttggttgacgagagtctctccctcggagacgccgtcgtctggtcagttccgtttcgtctgcttcatggaaaagtctcctggcccttctgtttcgagccaagcaacgttcgggacgagacattgacctgcgtttcctcaggcgctttctgcctggcgctcctcgcgaacagagtgcctcgaagaggtctcgatctttctcgactggtggggtggcttgcaacttcgtctgccaatatttggtcgttcttcacggattctcctctactttcttcgttctttccacgcatgaacctcgcagttcaccgcggaggatgtgtctttttcgcgaaactcacttcggaacggttcgtttgttgcgcggccaggcaaacgcgtttcccgagacgctcgctttatctcttgtttctcgctcgcgtcggcttcgtagccttccaaaggaactctcagtgaggacatgattcctaaactgcagtcaacaaaagcctccccgcctcgctgcgtcccttcaacaaagtcacctccgacgcccgtcgactgtcgcagcgcgctttgtcttccgctccgtgacgttttttcacttccaaagcgttgacgtccagcctgcgttgcgccttctgcccctcgaaggtcgagcgcccagctggacggcctctccgcgggggattcgacgcagagaagcaagttgtccccaagtgacattctacgcttcgcccgcgtacggttttgtgtccgctcttcaaggtcttccgctcgcacaccgctcgaaaa

SEQ ID NO: 950 - DNA, 2987 bp, Toxoplasma gondii
tgaaaacggaccttcctctcgcatcttcttcgcgggtgacgatggagcagaagaagaagcagagaaaggagaggaagaagaagaggaagagttagaggacgaggaagaagacgagaaagaagacgaggaagaagaagagttagaagaggaagaagagttagaagaagaggaagaagacgaggacgaggccatttcggggtggtgtctgtttcttcgtgaggtgttggacgtttttggagagggagaagagaggtcgatgaaaggatcggaggtaacgcttgttctgaattgtctcttctcctttctgttgccttcgctccaatccatttcttcgatgtctcctcctccgccgacgacttcgtcgccgtcgatccagagcacatctccatctccgtcttcgttctctctcccaggtcccggagacgcaggagaggaacgcgtcagcgaggaactagaagaaagaagagagcgtttgggagcagtcccgcaggcctctgaggagcctcgcgaggcggcgggacacagtggcatcttgcggagttggcctgaggagtgcacaggaaggcgagacggggatacgtttgggagcgtcagagggagagactgaagacggtagcgagcctgaacagacgacgtcttctccgcgcggctcttccggactcacgcaggcgcacctggcaacccagagcaaggagacgagaggagacgcagagttccgttcaatgcgtggagagaaagaacgacggagagagaagagagaaaagacagagaagacagagaagacagagaagacagagaagacatgagggaagcggggagggcggaggccgagggagatgggagacgagagcggagagaaaaacgacggctgaaaaggatcggcggaaaggcaggaagaagaagagaaacaagggaggaaaaggaagaaggagagagcggagaaggagagagcggactgggtgtgtgtctcctcgttgctcctccagggagagggaagacgcgagaaaagaagaactcgtcgacttggtgcttcgtccaagaatatctttccctggacacaggaaacagatgcgtcttcggtgtcggataagacttgtttctttcgagaaaaaagaattctctccagtcttccaccgcgcgtccactggatggcgagtagggaagacacaccggcgccggccgcgaggcaggaacccccctcgaggaagatgaaaccttttcaaggcatttttttccttcctttccgcgcttttttggatgcgtttttttctcacgatgaaggaagtggaaaccgaggagaaaggcgaacatgaagaaaaaagaaaacggaactccgcttctctagcgcatgagaggagcaaagaggggggcaccaccacagaaaaacgaaccgctcagcgaaagtcgcacgagctgaagacacaactttcgttctctcaatccctctcctggaatctctctcccttcctcaccctcctgcaatccttcgccttcttcctcacgcctttaccttctcgccttcaccttctcgccttttccttctcgccttttccctctcgccttttccctctcgccttgttcctctctcttgttcttggactggttgtcgtactggttctggttctctcctgtctctctcgcgcgctttacaggaaaaggctttccagtctcctctctctgtcttgccactgcttccctcgtgtgctctgtctcccccgtggagattcttgtggggtcgggtgtttctcgcgcctccaagtttaaggcgaggcctcaggggttctccgtatataagccgaatccggcgtcgtcaggccaaccgggaggagtcgtcccagggacgcgacggtacgcgcgaggcagcagctaagcttgcctggatctctttttccgttcctgctccttctctctctctctgtctctctctttgtctctctctctttgtctctctctctttttctctctttgtctttgtctctctttgtctttgtctctctttgtctgtgtgcgtgtgtgtgtgtgatcgcatgtttctctctgaatctgcatagaggtggagagatctgcgaaacgctgtgaattggacgcgactttgctttttcatgccgctgaatcgaggcagggacgtcgcccgcaggctacgggagagaagtccttctggcattttcgcatgcgcatggcggtcgggggttctgcacatcgcgcgcgtcctccccgagaccctggaatgaaaggtgctcttctctgtttcgcttttttaactgttccttttgttttccactccgattttttgcacttttaatgtccgccgtcgccgtctgtgggcctccaggacattctcctcgtcgcagtcggggaccgttggctggtttttcgtaccgccgaccggggagtttcctgtcgctctcctccccgttttccgttcctctttccctctctcttcttgtccaggttttccgttttctctctctcttctccgttcaaacgcttttccgtgtgactcgcgttttgtctctccgtccctccgaccaaaaacgtaccaatcccctgtccagttcagcaccgcccccgcctgcgtctcgcgtgtcttcagggtttttgacttttctttgcgcggccttgtctctgtgggtgtttgttcctctccgttctcttctctggggtcctcacgctggaaacgagaagctgcaagccatagtttcaacgcaactgcccagtcgtcttctccgttcttcaaacagttcgaggaagctcgaaacccacagcaaacgcctatctgcgcttcgcactgtcggctccttcttctcgtctctctccccaacaaaacgcgtctctctcctcgtctctccttccctctctccccctatattctccctttcaccctcccccccctgttctgccgcttcgctgggcttggccttctccctcccgatttgagagtttccgccagcttcccctcacttttttttctcattttttcggaagaa

SEQ ID NO: 951 - DNA, 3837 bp, Toxoplasma gondii
acacaatagtcagcttgcaatcgttgaccgatgctacagcaggcgccagaggtattcccgcttgcctccgttgtttgatatttgcagggaagtgtaatgcagttttttaagactgagggaactcctgaacgagtgaggccactgttaccgtctcgctccagctgtaggattccgaccttctccgctgcgtacgaggcattccgacactgtgacaccaacgtgaccacggtccgtgttaccaaggcgggagtctctggtggttttgttcggatttccaaacaaataaattaaaccactaattggaccagtgctctgagcatcgcttcacatggaagtcacgtgatctttccctgaatgtggcgtagctcattggcttcgcgtctgaggtggaaagtggaatactgttgcaaaaacagcaggaaaagcaacagaatccaaccatagaatcaaagtttcaactgggccccaacttccccatcccccgacgtcaaaaagttccgggaccgaaagagctcgtgtggaagcaaaactgtccttgaatgctgggtcacgaggctcctgtatgaagcatcgacccggttctgcttgagaaacgtgctgtttcagcgctctgctttgtaccgacagcatcttacttttctttccggaagcttgccccctcattgtccgcaggggtcgtcaggaaagctctccttcctggaaaatgtctgctagcgccggctgcccaattcctacagtgatacgtttcctgtaacacctttggagaaccaagtatcaatggtgcgaaactctcagtaccggctgctcttctttaatagttttatttcgaggaagtgtcgtgttcttctccttcctctgctgaacagaggttctgcatcattgtgtcacagcttacacagtttcgactgcggaggggggaacactgcatcaaagtcgacctcgctgtcccgggtggtattctcgtggcagcaggttgagtgaatgcgtgggctagttgccacaaggatatatgcaagtggaatgccgtctgcctcctgtccaagtgagggagaggcactataaagcaggaggggaggcgattatgttggacatcaggcatgactcacccgccgttttttgcctctgctctgcctaccttcctgggatctctgtgacatgcttccctcaggaattcgtttttcttcactgtcgcacgcattaacaaccctctctgctgtccaagacggaagcgcgtttttccctgcgtgtccatgtttgctgtggccacatacagtactgcgccccaaattcttccgcaagcaaacagacaatgtttgaaccctctggggatcaggtcgcctactgaggtaacgcgctcaacgtcgctaaagctcagtgcgctaacgtaatctgagcaggcacggcatacgcaaccggttcccagtgccactgtcttaaaaaaacacttcgaagactgacaatgcaatgaagaaacgtgcatttctttgtgggatcaaacggtgcctcacactacagacgggtcgtttctgaaatggaacatttggaaatgaacgcagcaacagccgtggaagtccagaacggccaccactaacggctgtcaattgggtatgccttccactgttgaagtgaaagtggtattacccccaccttggaaacaagcacctgcgcagtcaccctatggccgtcttatagacattacccatgtgagagggcaggtgctcagtcaattagttctctggccgtcgaccaccccgttttgaggtcacagtctcgcccactcgcatgctgacagattccacggtccctcctccactgaaaatcttgccgatcccgcaacgaggaccgcgtttcagctaacgttgacgtctgtgagacatgcacgattcgtagactctggtggggaacccgagcattctgcgggaccccagaacgactgcagtagtttgaccgcgaattcttcgccaatgacagcccacctcgcccataaaatggcacaacatacacttaaacgacgtcaaaattgtatggtgggattgacacccacctgtagagaaggaatggtggggttcgttcctggatcagaacctccgaaagcaggttgtttccttccctcacacaactgtcacattccctgttttgtgatggtccatacccgttcgtagtgaggtttacggccaaaaagcgcacgcagactgaacgggacgaactgcacgtgttgggcattgacacggcaccgcatcgatgacgcacacactgaccaggtgtatgtccacaccgcggaacgaaggagcctaggaccgtgtacgcctcattacacgaagatatgtgtatttctgttgtttttaacgggccaaggccgtcgctggtcacgacatgctgacttcagccggttgctttcccgcgtcgtttagaggagtgaacccgggaaaattcggcgttagtgaccctccaacaggcctctgcatttcgaggaatctgcagcctctgccggctgctgttacgcgccttgttcgcttcctgagaatttccctggttgtccgatgaagcacgcttcttctgttcccgatgttcgcagttctgacgggcaagtgggccccgttcttgccgttctcagcgcttgcagtttcgcagaaaactcgctctccccattttcagcacaccaggattaagccactctttttggctgcggcagcggttgctagaaggcaaccccccaagaatgagtgtgcggctcgttcctcccccccaggcttgttgctgcgtcttgtccccatctcccatggatttcttgtcttttctcacggttttcacctccctcacttgtcggtgtttgctcgtcgtcccctgatttctcgccacttcttcctgtctctcccttcccgtactggacgaggcagctccacactgcgcagggcgccgtgtgcgacttgaagagcatcccctttcttgatttcgggacacacagagccccctttcttttctactccattaagaagttcgctccgtaaataattcttttgagcaagcttaaactgcttccgttcctcttttttgcttccctcccgtccgtctctcccgtccgcttctctcgacatcccagggtacgcggtgtttttccaggtgtttcatcgcagctaacgaagcgctctttttcaaccgtccccctttccttagggcagcttcttctcgtctcgcctaggtagattattggtctcgtttcctcatttttgaccacaccctctccacggttttaaaacgtacccactcagcgccgtcaagagaagacacgtggttccccttttgtcgtctcttcctgtgcttctgtgttcttctcatcctggtgcatccggctgcaaggcgccggtccgcttcgacttcgggcataccagtgacgggtgagttttcctatcgtcttcggggaaaaaacggttcaaccaccctgctggtttctcaggcgtttcagaggaaagagagccgttgctgctctctaaacaacgactccttccgtgcagttccttgaccacccgagctgagacaacgcagttgaaaatgttgggtgtctccacctctgcccttctttcctctctgttctaagggtttctttgcttcgcgcatctgtctccgtcttccttttttcctctcttgtctctcttccccgtctcctccactccaagacttctctcaagtctcttccctttttgcttccgcttcccccgtcggtgccctctatagcgccctgcattctcctctcgtctcttcttcgtcctttcctctgctcacctgcggagattcttttcccgtccttctctccttcctcttctcgcttttcttgaaaga

SEQ ID NO: 952 - DNA, 4574 bp, Toxoplasma gondii
gactttgtctctacgcgataagtactgcgcccagttacactggttagacgtagcgttgacatcagcgggtggttttttgaatgctgcagggaagaaaacaatgttttctactatgtggataacgaacagtttagattcgttcgatcaaagctcatcgaagcgattttggcaaccgacatgaaacaacattttgagacgataagccgatttcggcttcgtacttcagcagacgatttcgacgtggcgaagcacgttgatgatcgctgggctgtgttgaagatgttcgtgaaaatggcagatatcagtcatgtagcgcttccttgggacatgcatttccgattgtcttgcgacatcgtggaagagttctaccagcaaggagatgaggtacgacttccagcttgccactctgctgtaatatagattgcttgttcttgagtaccgacaacggtctatcaggaaaaatgctgaagtccacaagggattacggtttcaaccaacctgcgggccgattctgtcaacttttttgatcgctaacggatcttgcttctatagtgataatgcacatctgcaggagcttcggcgagggatgccgctgtcacagctgtgtgatcgctcaaaacataatgagatgccgaaatctcaagaagggttcatcgagttcttagccaaacctttggtcggcgtgctcatagagggagactccaccggaacgataaagtaagtgtttttgctcatacgtactcgacgcagaaagaatttgcctgtttgccatcctggtggcaagctgaaaatatagggtcaactgctccagtaacaacggaaggtgcgtgttcattgtcactttactgcgtcggcccaggactgaggtcagcgagcagatggagcgaaatcttctacgttggaagcaaatggtggctgaccaggttgttgtgccgctacgtcctctgggccctcgaacacaagtgcgaacgttcactgcttcagcagttcggaggctagctggtgttgaaagcgttcaagctgccccaactatctcgcagagcgttatcaaatggcccgagacaacgggcaggcagtgcggaaagaatagtgtcgaagttgaaagaggagttaatcacactatcggaagtcagtcggtcactgcaatagagagcacggatccgtatccaacccgccgtccttggggagccggctttttagccaaaggcctgacatcggggaagaaatggacgggtattgctgctgcacgtccggctgcgccactcgctgatacggaagaggtcgcctctcagcgaaaacaccgttcggaaggtgagagagagagcactacgtagctctggttctcgcgtgatttggaaagttttcctccacgtcgctttccggtgaaacatcagcttctcgtcggtgcaccgttgatgcttttatagaatgaactgaactgagtaatcaaggtcaacgcttgctgagccacctgcttcctcgtcgctaagctgctgtcgtcggcggtgtagcacagtaggagtccctttcgtccgcttcgtttcagaggaagcgatgtgattttactctcctcaagtcttcttgtcttatttcttcaggaacagatacgttgaattggggatcgttgccaccgggtgcaacacgcaaggaagctgggcccattctgtttacgcaggacgcggaaacgactgaagtgtaggtcgtgcgcgcatctctccgatcagctattgttcaggcattggccattgagaacacgaagagaacgaatcacgctgccgttgctcgtactgctgtcgatgtcagtgctttgctttgtgctctgctgcccgtctctactacagaatgtcgcgcgagaactcccgcaggatggtgtgccgatataattcgtcatccgaaacttcttacggatccgacggcaacactccgtgtggtgccgaggcaaacaccttggagtcgtagcgttgaagccacctgttcttcgtcggcctaaatgactagagattcgatcaaaagcagctttatgggagtgcatctgtgttacgggtgttctattgatgtgatcgcacacccacggtacctcagattcccgagacaacgacgccgtaaaggtttggtacgcagcgacgctgtcgtgtctacttttcgcgacagaattttgtctgatttttgagttaggttcaagagttcgacaagaagctgttttgatttgatcatcgcatatacacggccattaactaccatctcgtggtcactgtgtagatatcgaagcgactcctacccatgttcaagatgtttataatgtcatggcaattgagaagcagggataaaaaatttttataaagcaaaaacaaacactctaatccaagtagtgtccgtcgagaattgtttttacaggtatccgctccctgggattccacctgagaagctgacataccacatcaactagtggcttgcccctagaaaggaggccgtgtgtgttttgttattgaaccgcgagcgtagacgtagacgtggctcactcaatcccaatgacagacaaaagcaagtcatgaagtggaagtggtgccagccctaccatctgcttgaaaattgaagaggcaagagcctgagaaaacgacggtttgctcaatacacgtcacggatgaatatattccagtcttaccttcgcacgctcggggcaacctgtacaaagcgattccgtatcaaccctgatacattcgcaaatttgcgaccgcattagggagtgtctgtcgccttataataaccttgtgggtgcaccaagaagttcggaaatcttaagaatctggaagggttctcccaggcatctaatgggtttctgctcttgcatcccgtgcttctggttatggggctcgcattctaatagtggtctcaacaggatgagttctgcaaggacgcagcccagggctgggttccaaatgcatagtttgtcgagatgggaaatggagagagcccttacaccacaaatccacggcgacctgagtggggacagttactgccactgacgagtgagtgtttagatgtgacatcatggtcttacggtgtagttagtcgaacccagaagcaactccggtgcccgatacctaatttccagtgttcatcatgttgatttggcgcgggcttgtcgcttcataccactgtgagcatatgtagggcattgatgggcatccctggttggttagtgctttgctcgagcctgtccatgaaactcgttcatttacagaacgttgtcactgacatcaccaagcgcaccgaaatcacaaattcttgctagaatctgaccaccatagtctttgatctgcatggtgaacgattgctggtgcacccatgctgccgcgcggttgtgccacaccaccttacaagtacattctccggtttcaagtccctatgagccaccgcccgccgatggagagcgaacagcccgttacatacttgcttggcaatgctgatggcggtagatgcttcaatgttgtgtgtctgatccttttgtcgaagagcgagatgggaagcgacgtatcggtgcagtgtgtacccagcgttctccatcaggatattctggaccatgaatccggagggagtataactgtagaaaacctcttcggcgcttataagattcggcgactctttgccaatctccaggcagagtacctctcgtgattccttcttcctccatttttgagttcttttgagcgctctcgttgctccagacacggcatcagtgacaagaaaaactttaccgaacgtgcctttgccaagctgtcgaatgacagaaaagcgatgcgaaagtgtgtggctggacatggtcgctgacagggttggaggtttgaaaagggtactgcagtttaaatggccttcctcattcgaaagtgttagtaggcttgggtacgattccagattgcacagctcccgtgccgcgggtaccacacgctgtacagacactggctggaccgtgcggggttcaacttcgcttcgagccacatttcattggaaggctgaaaaagacaaacagctctgtcaatggccattagaagcagactctattcgccatgatgtgaccacaggtgaggcagcgtagcttggcgtctctgatacgccagcagaacacacagctcacttgctcccttttccgccccccaccctcgtggcacggccaagtatggacagcaaaagaaaagacagacatgcagttgggagccatcgcagcaccggaaatgtgcgttatttgctgaagtagtcggggtgtaagcagttagagcaaaactaatatcttgctgttgtttttggcaatataaggatgacgctgtgttgcttgtagactgaacctcactggtaaatgggagggccatcagctccggggaagtacaatagattgttggtagggacggcaggtccctcattcacactgtcgctttttggaataatctttctcaagggggttgttccgccctcgttgacgcctgtggctggaggcggcttctttgctacattttttgagttttacccacttaccgagacccgggaccaccactgatagtgacattttccgttacacggta

SEQ ID NO: 953 - DNA, 2616 bp, Toxoplasma gondii
agaacagaggtgggcacccatgttgcaaccttcggcgatatcttctgcagcagtcgcttcgcgacaaaagagtggtgacaagcctttttcgacggcagggatgtgatcgcgttgagagtggagacgcgcatgcagttcgcaggtctcaggctgaaccggcgttctgtgaggcgtctgttccccttgtcccactccacacactggcctcagtgtggaatgcgctcttcatcctgattgcgcttcttaagctcctctccaatggggcttccgtcttgttgcctgctctgtgttccagtcaacgagaaaagcgcgttctggggtcgcctgctcttcgcctatgctgcatgcaagcctctcacacctgtccaggtcaggctcaccggcttttcgccgtgcatctccttgacaagacctacgtgtttcgtgtctttgctccgattgtctcgctgcatgcgcacgacgtgagccactcagagccgcacaaccaactccttctcatgtcttcagtgagggctgagacttgccgaccgtagctttcctaaccgccttgctgatgatctgtgccgacagactctgcttctcttctagggacatgtctgctggatccgtcactttaggaattcgaccagaaagccataaccgtctacgggaggagtaccatatgcgtgtcggcctgccgttttaagaaacgtctgcatgagaaagcttgtttggaagctattctggagctggcggctgctgcccgttacactccgtgtcgcaatacggcgacttccactgtgggccgaggacttctcgtcgtgtccatgcctctttcctgtgtcgcgggcaagtgctcaggcgtgggttcctaccagtccgcttctgactgaggaacgcgctaggaaaaggcggtggagaaacacgaaggcgtcattgtgatggcgcttagcaggggtgttgccacacatgcaagctctctgtttatgtaaccttgcgcggtttctgtccactaactttcaggttgccgtagcgttttggtgcactccccacctggcgcgctttatgggccgccgcggcattcctgttcatgtcagcaaggcgacggtgacgcatctgcgaggaaagctccgttttcgacggcgaaaatcgtgtgaaaagaataccctttgacgggaacaaagcacggtgtcaacggctctccggcaccgtgtcaggaggtgtgtagtgacaccggcagacggggctgctcggtgtctttttcgaggggttgaggctgaagcggcagcctctgtttgtgtatgtaacttcggggtcctacaactcagcgtagcacctcggtagtattttggttcggcttcgtctctagagacagctcctgtcgtgttacacaacggcatgtagtttttatatctgcgattctgcttgcggtgtcgataagctgctatccagaggcgtccgtttgaaacagtcctcgctcgtgagggaatacgacgctgcggccgcgtgaacttgccttagaaaacactgcccctacgaagaatggcagcttccactttggctgggtacggactgaatgcggcgccccagaacatcagctgttacaggaagtggttgcctagggccgcacgccgctggaaacacatgtaggcaacgccaccaatcatgatagaaaagcgtgagagaggaacacacagacaggttgactgcaagacttaacaacacctaggataaaaatccactacgttcaagccagggaacggaggatgcgtagggaggttcgcgtcgatgacaacgacacagctccggcttaggtctgagttttcagctgcaaccactttgccaagagcagtgttcgcagctggactgatgcacggtcgccaaagtgaggcggcagtgcgtttgtcggtgcagcctggacggttctccggtggttacactctaatcaggatgaccagctaacgcgtatctcggccacaggtcgccgaggtcgttcggagcgctttgtgacgctttcagataagacttgcatgggaaggaggagtcggcgtgaaaggtagcaacgtgtgcgggagagacggttggaagggttgaccgacacaaaacggggtgggggtgacttcgagactcataccccgaccgtatcttgcaggaaaacgccgtttggcaagcggtatagtatttgcttttctggagtgacatcctgacaggaatcggttttgcctcactagaaaagaaccgttacagcgtggtgagaagaacatcaaagagcaccgtcgacgcagctagcgccacggtgagtctgtggcacagtcgccagcagcattgccggtaaagagcgggagacacagactgcgcctgacttcctggctgtcgccatccacgcctgccctgcacattttcgcgagggctgggtcgcgaccggaacctctaacgatacagaagtcttcttcaagagggtttcatattccttggagtctcgtgtctgttcaccgtatccatctgtgggattctcacacctgtcgagctcgcattaatttcatgtttgccagttgtctaaaaatgagctgggggctggactccgcgtcaacagaggaaaactgctacctgatttgccggtcagctctgctcgcgaga

SEQ ID NO: 954 - DNA, 3233 bp, Toxoplasma gondii
cacggaaaaacaggacgtgagaagccgaaaggcaaaagaacacaaagaaaaaacgacggaaactcaaggtcacgcaggtcaggctggagagactccgaaaaacgcgcccctgcagctgcgcgtagacgcacctgaagagacggcaggccgagaaagagagaaaggggagaggaagaggaaagaagaaaggtagagagatgaagaacagaagatagataccaagagcggaagagaggagacggcgagaatgagagcgagatacagaacgcaaactcctggaacgaaggcggttcagagagtgaagcagagagagacgcaaacaatccgggatgtgtagtttcggtagtgttggagacacccgctgtttggactgtcgaatggaggactgagaaaacgtttcaggaaagcctaatagacagacggaagatcggcgccctgaacgaaggcaggtattctccttctcgcgtctgtcgtcttccaggaaagctttgtgcttcgttccaccctcgatttccttccgacgaaaagagttccccttccttctccctccgttttctctccctttcctcgatccccgacgttcttttttttcttctctttcctgtattcgatcacccgctttgtcactccaccgacgaggggggaggaagcgcgagcggagagatgaccggagcgaagcagaagtcgaagcaggggggacaaggagaatcgatcaatggatagtttctagagagacaggaagagacagaagcagaaaaaaagcgagggaactacatgttgctaggggtggagggacggagcagtcgcgcggtcgcgaagcgtcgcacgaagcgagacagagcgcttctcgcccacaaaatcggaaactggatgtcgattttagattggcatgtacggaataacaagaacgcaagcgagaaagtggaaggtgtgtcgactttgcaccgcgaaagtgaacgaacgcgtgaacggcggtaggagcacaccggcgagacaagaacggcaggctgctcgttctttcgcacctggtaaagacaccccacccggccagctggggagttggcgaaacagaaagatggcgggccgttgcttctcttttctcgatcttcgtgtacaagtgatagtgaaagattgacgcaagttcgcgtggagaaacaggaacttcctcgcaaagtccggcgtcaactgaacagccgggactgtgccaggtcacgacgaggttgacgtgggttcctcggtggacaagcaacttgctcttgacgaagagaatgagggaaaacctagcgggtctgaacgtcagtggtgaactgaagcagagggctcttgcttgtcgcagctacgcaacggtggcaagacaaaacagcgagaatcgaggtctcggtcttcagccggaagcggccctcattgcgaacggaaaaagtgacccttgcggtgtctgctctggtccattcaccttcttcctgcttcctctgcatacgtctttcataggctcacacaaatttaatgacaccacccgcggctaccgcctgagttcccgctcatgtaaaagcacgggagcatcagggtgagagaaaagtttcagcgtctcaccgccgaagcggtgcagcatgcagcgaagcagccaacggaagacattatttgggatagtccatcagagcgtgcacttcattaagcagaaaaaccagctacacaaatcacctgatcgcgggttgaacaatgacatatgcgacagttccccataaatcaaccgtaggcagccgaactatggagttctacacccacgcacgcagctcgcctacgtcgccatcaccatgatacttgatttagtgacctcagtgaatcttctgaccgacaaggttatttgtcaaaggcgaaggtggccagcttcacacaggtgtaggctgtgttgatttttcggacagttgtagagttattgtctcacacagcaatgctatcgagcgggggaaccgtgtgaaagaacatgttctgtatgttttttgtggcattcgtcctcatagacagaacatcgacagggggttgggcgctgcaaacggccatcttcgtcggaagtacctgccaatatgaccgtcgcatcgatgttgtcgcgctgatgcagccaaggtccccgccatgtttctttcaaagcagcacgggttccgtgggcactatccaaagacgcgtccctcatgtgtggtttgaaacacaaccaggtgtggcaatcaaaggccagcataaactcttcctgtattctttgtattctttccccctccagcagcgaacttggcaaagcagcattgaatgtcggttgacctgtcgcgaaggcatcccaaagaatttacctcggtactgttttcctttgctcagctcaggctaggcacacctcactggcttacttgctcaattgcttctcctcattaagctcagtcatatgcgggtggattctatgaagtgacaaagcccccgaagggcacgatatacattttttgaagcgtaccagacaagctcggtgtcgtctttcacttttcggcctcgcagtaacgatccacggagagtaagcaggtgattccgtcgtgcgcggcggaatgggccgctctcgattgatgacccaagggcccggctgtcggcagtgtgtctgcagagcgcccctccagcagaaagcagtttctctttcgtcgaaagaaacgtgtatgggtttgcgctcggcaaagggctggacaaaatgacaaacgagaaacttccgggtccacagtaatgttgtatgtggattaccggtaatgctcaggaggttagactacatggagtctaattaccacagagcagccaatcctgcattcgaattgtctgccccgtccgtcactcggtgtcctgtgttcgttgatccggtgacccctctagtacgcttgcatgcaacaagaggccacggccgagaagctgcgttgaacttcgctacgagtcagctcgctgtccgtcgatgaggtacgctctttcttctgagggagccgtcctacctatgtgaatggttcacatttttccttgttttgtggaaatccgtgttttgcggttgtatctggcagcagtgcaaccaaactatttcggacccgccgaaacccgtatgtcccgattgagtcgcaaaggagcagtcgacgccctagtcgctgtgcggccaatatttccccctcgaagatctaattagttggtctttcgagagttgaaatccgccgaggatgcaaaaa

SEQ ID NO: 955 - DNA, 4131 bp, Toxoplasma gondii
taagcttgctgccgtgagcaccattcatcgttgggatagttcctggtcagaagggacgtgcgactcacgcaccctaggaggtagccatcgaaactgtggggttgttcaacgaagtgaaacgatgttctctttcctgctgcagtggacttctgacgcaagcactcgcagtcacacgcatgttctgtctgttgatgggcgtgaaagatggagtacgtagttcctccgctaaaagagaagactccgatcattggcccgataaagaagatgaatgataaaattctatttttgttgagaaaagctcaacacagtctgaatactagtcgtacgcgtgtgctcgggaatatactgcaggagaagcagatgtcattcttatgcctggaagtcttgcggctcgtagctgatgttttgtttctcgctggctcagcttcaccgcataaaagagaaaagtgttgcatgaaaggtccctctccccgtcaccgctgacgtgggataaaaagcgccgtcgttcccatgctgcggtagctgttgtgtgtggccaccggatggcgctcaaaaaacgcagacgtgtattctgcaagcgcaggatttgtcgtgtttctgtcagtctccgtttgcactcttgatatttgttttcccctgtgactggatcgcacttttggtcgcaatgtgaagtggaggcaacccccggacgactgttgcctcccacctcacatcaggagagggacaagagaaaagaaaacaccaatactgccagcgtcatcatcatgcaaaacgcctacatgtacttaggttttcttcatctctttaccgaaccagaaaaagtccgtgttattcggatgtgaccgtgtagtctttaacgttctgtcagtttctgcttctgttggaagatgatgatttgtatatttacagaacaaatcggccgtttacatcggacgctctgagatatcgtacagttactctgcatcgtgtgcctttttaagtactttatttgtctccatttgtttgtgtccatgactacctcggagctgagtgagagactttcgcgcccagccgcgatgtacgagaaggcttcctcttggtgttgaagaattcccgtgtatccgcttcctttgtggatccaaagtcgatcgaaccgttctctgatgctgtatctctcctttttcaaaacaattgtcaacgcgcaggcaacccaaccagagaatacctaggcttaactcagggaggaaggcgaatgcaacatcattcatagaggtcgaagatgtgtgcattcctgtctttctctattcaacttatcaggttctgttgtagagcaacatttcgataccatcttttttttctttgctcatttcccttgaatacacttttgccgaaaaaggaacagatgaaccggattgaattttataatatgaatttgtatttcctgcttcagggataacgacagacaccgtgattttaaagcagttttgtgctaacagcatctgtagtcgtctacggccccaaagtcatttggctggcctcgcgtgctcttatgttagcattcatgtatcgttttacctcactgggttgtttggtcagacacgaggttctctcctgtgggttgcacaagtagacgttcaggtagtgagtatcgcagtaagccatggattaggataacccggagggacaggaataaacaatggaaatgttgtgttaaatttgaggtggtatcacctcgttcagtgccagtagaagggtcttgctgcttcactggccctcctgacaaattgtcttttctgtacggcgacatagaagttcagccgccgatgaaacaaccacactaattcttacgcttcctgtcattgttcatacttaccagttgttttccatcggattttgcgtggttaagcctcgtttgtgtagtaccgattttgctgcccacgactagggtgggaccgcactttatgcccctcccagttatttctgtactgattgttcgttcgtctgtttccggaaagcgagaccgcatggtcttcgttgatgagggaagcttcggctctgctgtatcttccagctggccgcaggagagaaggcaatgcttccgagaagatggcgccctgcaattcctttctctcccgagagcctcgccgagaggcaaagttcgctgagaccgacaaaagtggtagttctgcagtgtccactctgagctctgcagacgagaagaaagcaaaaaacacaacggaaattagtgatataggtcatggtgcttcgagacgtgtgccaagcatgcttcagaaatttttgcgtaagcaatgtcgtcgagttgcgatagcgggtcatttattttttctcttcgtttggaattcctggtcttcgtccgtcgatgggttggacaagaacaaaggagacacaagcatcgatttctctgtcgcagcccctgagctttctcttccagcctgccctgatggtttcgccttcgacaaagaaacggtccgtctagactgcagtaccacatgcgtatgacacatgcggatgtgtatttgtatatgctttgtagaagtatttatgcagtgtcgcatgtgcaaatatgtacgtacacacaatgtttacattcgtatatgcatatatttgggtaggtgcctccgtgaaaccgtacgcaagtctgtacttgtgcctgtactcatctcttctagagctgcaggcgggtttgtgtttgtcgaaatataaacgaccttattcaggacggttgctgtttcctgtgggcatgcaaggaactagagttacaaatagcatttctaatcttgttggtcaaagatgtaggatcagttgtttggtgagtcacttctcggtattttctgaaagctgatttcgtgtgtttatgttgtcaactgcagttcagatgtgtgcaggtcgtttctcacaaaccactcaagaaatgccttctaggcgtcatcaacgaaaacatatgcgtgcacttcgttcagcctatctctagaacgtgccctccaggctaccaccaaaagtttgtcagcgatagcacaccgaaatgtgccaaggtgaactatgcgcagaagcttctcgggtgtcatcctcaagaagagatgatcgatggactctgtgtccgcgtaagtcagttcacgtgaaggaggagcgttctaacttttgttctgcgctctaacaatacgttcaactggttaggaggtccagcagcacgaaacggtgaaccaacgagggtataccgggtttgctgttcctgagttttcagttcctatatttcctgcgctgcagtagcgaacacattgtagccacacccgagtaacagcgcagaaatcctggtgttagccacctgtcagctgggtaagctccttcattttctaagaacgattactgcccgtttcaatgcacacaatttgttgccgggctagtggacacgcgaagaaggcgatggatgagctctttttgaggaatgcaaaagcttgctaagttcaaacccgccgaatgcttacacataacggtgtagtcgcataactccaactaatgctggttacacgttgacaaatgtgtcgctttggggtcggcatgataaccgcgtctctgtctacacctggatgtgtatagattccccacgaacaggaagcatgcgctccgtagcgtctccatgctccatctgtgtgtcgttattgttttcccttcagcgcacgtacaaagaaatcggctacgtttgcaggaagggagacttggacgaaaacaacaggtgcatactgaaacaacttcttcctccaattcttaaatgcccgccgggctacaaggtcatcgaagacctatgtgtactacacagaccgatttcttgtggtgatacagatgcgccgccttctttcccgttttctcattctttagaacgagaggcagccagttttagtatcaaacgcgagcaacgcatttactctccacacaaaggtatctcgaatgcgttcaacacccatgaatcaggcgccttcttaggagtaaataaatcgccacattcaaaaaccgctaatgaggttagtcaccgtggtgttcactctcctgttttcccgtatgaatatgacgtaagtggaggaaatccagaacagtcatatgtctccgtagtaacatcgaccctcggtggacacaaca

SEQ ID NO: 956 - DNA, 2624 bp, Toxoplasma gondii
ttaatgtgtaataggcagtcgggtttcatctgttacttgattggtactgcatgcctcattcttttttctatggttctcgttcgtgggagaaagacgtagaagttgcattttaaagtgtggaagagagagtctagcttcagttgtcgtcttatgatacactcagtatatctacgagtctacttcagacacaccgtgttgctcttcaggcagctgcggtgtcttctcaatttctgctggcccaagagcggattctttctgttagtggtataatttttcatgctgagacgtcgcacttcaagcgacaccctctgagctaacttcctagcgtttgctttatctggttacctccaagaataaacgaattcacatcgggtacgaatccgatatagacgtccggatgttgagacactaacaaagagcaagcgcacgattctcttaagttggacggcgtacacgttcgtgcgaagcctgtgctaacaaatgccacgccagtccacacacggaagatacgtagatgtgtgtctgtcgtcaatcggcgtggcattgccacgtcagccgaggggaaggaacagtctctctcacggcctctccctcgttattcactgaaaagtgaacacatggcttttcgtagccttagttcgtttcctgtttccctttcaggcactgagggtcctgtcggacggccaggaccacaaaaacaaacaagcaacttgttctcaagcaaccggaaaccaaacatgacgactgaaggaaatgcgctccacactctaatatgtacttcattttgaagttggagaacggaatcattattaagctcccggtagaaacccgagacgagtttgctgccagtgagggagagcagggaccactgttttccgagtatggtggaattcccgttgaacggaacggagtggcgtgttgcgaatgaaacaattgtggcagccgttcttttgccggtggaatattccaaatggaacgcttggggcggaagaccgcacgaggggatcgattgtaaatgccgttcggttgtgcatgcaaagagtcaggtatttatactcaaaccaactcgtgtcgtctacgttaccgccacacaggagccgcaggttctttgttaaggggcagtttatattggttcacgctatatggaacggtgaatgattttgatatccttttagttaaggcagtttgacgttctgatatgagccctcctgcttttctagattcaagaggaccacatttgtcaaattgacaaacggaaactgatgtacgagtagtgtcacactgacgacgtccgggtaggcagtcggtcctttcagagtttgaatccaccggattaccgcgtcacttggaaaaaacacctctggtcttctggtttctggccgcttcgcaaacaacattttgcagaggaatgcggcctgacacaaaagaaaataatgcagggtcagcccttcccgtgtttgctgatggcagcaggcaacccgtgtgcatcacgcgttacggtctgaactgctgaagttgtaagggagtgaagagagccaataaagaagagacaagaaaagaagcagatgaattcgcgactgtgcacgcgtgcttacctcctcgtatcaccggcaatctcagttgcttccgactccactagaaactggaccccggtggaacggcctgtgctgtcagactctaggaccgagtcacttttcccgatccgactacgcaacgatttcgtttttctaccgtaccctctcgtcagcttccttttatgtcggagtcccaccctgaaacaacagcacaaggcaattcagtcccctggccttcggcgacgctggactgcccaccagatcacctgcctagaatttttactggcaaaacctttgtctcgttgccctaatgcttcgaatcctgccccagttgctgagcaaactcccgctccaccatggcacagaacggcggcggctgtttcttctccagacgactccgggaaggagaggcagtatatgcagagggatgtgtaggctgtgaatattgtgtgggttgtgtcacaggtgactttcgctgtaattcttcaccaaacctcgacgctgtatgtgaagcactgggtgccgtaccactgcctacgcacgtgcatgctgctttctgagaattcctggagcgaagttgtcacggtcaccacgcgcgttactagtttgcgaattgcttggcagagacacagaaaaggtcacccgaccagccacgaggcggtgtgcggttccggtgtatggacggctcgccgcggcagggatgtgcacgctggcgcgcagaagcttcgcgcggacactgcataaaattatgtccattttcttcccgcgagacggggtcgcggcgacaggatccgtcgcctttctcgatgccagttcagatcgcctgctccatccgcgctcttgcaagatcattcgtcgctttcgcgagactgttgtccgtcggaatgtcgatttctgttctggacgactccaccacacttcgtcatcgttacatgagaacttggcgccgttttctgcgcaaaaccctcgctgcagcgctgcagccgtttctgtgcagaagcgccgggggacggcaacacgcaacgttccttccgctccgtgtcgctccga

SEQ ID NO: 957 - DNA, 1614 bp, Toxoplasma gondii
gtggagcaagagcaagtcaaggatctcgacaaaggttctcgccatgcgccattttttttcgagaagaaaaactcaccgactgaaatacatcgcgggcattttgcgcgagggcagagggtgcgtctgcaggagcgacagagagagcagctcctgcggcgttggcggcgacgagagccatgcggaagaaggagattggaacagacagaaaaaaagatcagaagatctccagtcccgcggagaaaagcgcgacgcaggaactcagacgagaaaggagagaaaagaggcagtccttttccccagataaacaggattccgtcaagaagagcagggaagaagggaggtggaagtgaagagatcggagacggaaaattgaaaggacgatgagagacccagggtgaggcgaacgacatggaacgaagcaagtttgcgcgacgcagaggccgaatagccttgagaaaccacgaggacgaaaacaagaactgaaagcgacgcgtttacgcttctccgagagagcgacgaggctgtgctttggggaggactcaaccagagctttttgggaagctctctcaggagaaccgaggagcgcggacagcgaagacgaagcagagagaacaagagtggagagagaacaagagtggagagagaacggaggatgagtggggtgcgaaagaagcagagcagaaggaaaggatgaagaaccggagagagaaaaagaagagaagacgaggagaaggagaactctgtatctcctgggaggcgggaaacagcctgggagggtcctcgtctccgagtcgaagaggaagttgaatgaagagagcgagtggtttttcttggaaagaattcgaccacaaatctgcggcatcttcgcagcagatcgcgccagcgcatcttttctcccttttctcccccggagaaatcgaactgcatgcaaagacttggactcagccgacggacgcttcttcccgatgaacgacagctggagaattcagggcatgctctgttgagagattcgctttttccttgaaaagagcaagtggtgtgtgtgtgtaagattcggcgttcctgtgtgtctgttttttctctgttttccccgaggccctgcgtccgacaaccaagcgcaggtctccctgtgtgaatgctctctcggggaaaggaaaaacgaaacgacgctaaaaaagcagaacagacatttcttccgagccgccgacgcttcgcaaaatcgtctctcgcactccttcagaaacttgaaagccatcggcttgagaaggttcgtgggcgcaggagctgttcccaggccagactcggcgcgaggtttttaaacgtctctgtcgcgcgtcttctctctcaggctttctctctcctgtgttctcaacgtccatctggtcggcactcggacaacaacgcagcgttgctcttcttctctgaacactgtcctctgctctccttcgttctccactcgctctgcactctttttcttctccgtcttgcctctccctgtctccctgtctcctcgtgagtcacccactggggtctctgcgcctctggcttcctgccagtcgccgcctccgctcgtcctcgtctctttgtctcctagcctctacgcgaaagccgcca

SEQ ID NO: 958 - DNA, 3035 bp, Toxoplasma gondii
aaatttggacaccttccgaacctgagggcggtccagcacgagttgaagttgaacaacaggtgcacgaatcacaatgacatcttttgtacacactgagctcttcggagttgagggtaatgttttggtcatcgatgtcggcacaagcacggacctcaggtgtgactgtatgcctgagtaatatcggtcatgtgtacacttttcaggtgtctgtcggtgcgacggtaccctcgacgaactctcgtgaagggacgtcgaccaaggacaccaaatatattgtccctattcgctgcgcgtgcaggtgtttttgtctcagaacacactgcctcttgtatagattcagattatttaccatcgttccgacgtactacaattagttaatggaaagcggaatcttctgtcagcagattaccagagaacgtatgtcacgagcagtgtcgtgggtattttgctgatgcgtgcaacgatgctagagttcacccagcactggttcaaagatgacgtggctgaggcaagcgatggataaacgcgtgactgctccgtaagcacccccgcacgccgtacgacacgccagtaagcgtcgagagaactacgctttgctctgatttcaaattgaatagtctccagcaccaaattgttaacgtgtttgtgtcaccgcaagcgtcatgcaagacttgtcaggtgccaccgaaagtgatacggataggagcggctatagctgtgcaaaccatttgcgacaacaatgcacctgagttatggtagagatagcttaccacaacacggcacaatatggtgcccttgcagcgtctcttaatcaacttttatcgtcagtgatttgtttcggaaaactctcggggtctcttgacacagccgagtgattcgctggggctgggcgaaccgatttttcaccatggagtttttacttgccttgctccggaagcgaggggaaggcaggtagatatttcgagcgtaatcgcagtatccgaacggaaactgcctcacgttaattgatggtgtgtctgtacaccggaatcagtcggttggtggctcgcaggctacgatagttgttgacaggtaccctggttcagatgcaaaataaaccgtctatctcttcgaaatgtggaaacttcttcttctggttgcggccgtagggcaagtccatgataatagctcagcgtcctcggtaacaaacggttttaaacaaacgggtgctccattccattttcagaagacggcagttatccctgagcgtaggactgaggataatgatactgtgtggtggccggctaaagggaggcctccgaaactgcgcaagcccgctcacgcgtcagtattgatagcttttctccccatgtcatattgggaatgatctctgttttccatctattccaggcgtctgccaccaaccggcttcatgcacacagtagtgtcatttccaaacccgttcacggatccagggaagtgtgtttccttcgaaaagttagttcaccactgtctccacacactggagcactaaattatccaaagactgcagcgtatcccacgcatgggtctgcgatcctgacaagttgctcaaccccaacgagcaagctgaccttgaggcggaactcatgagacttcgcgacatcacagaacactcttgtggtcccaagaaacctcaattttaccaagttagacgtctccagtgacaaggatgtgtcagggtcacacttgtgtcatgttgtaggcagcagtggcagtggccatggacattgtcgtgccagagaaccaaacgccacaagaggcgactgaccactttgcgcaaacactcctgaggccagtgtgcagttcagttcagcaacccgagcacgaaaaagagcaacgccccttttcaggcagtggggagttggcaacaggggatgccatgatggaatactccttttttacgtgaaaaatctcggcacatcatctctagcaacgcgcggtacgtctcgacgggctagtgtggcagttgggcgcagagatgtttccttgcagaagccgtcgacaagcgtgtctccagcgacgagttcaaactccagcttcgccaccacatccattcaacatacctcgtgactggatcagttgctgcagctctcaaatctggagtcggccttgtaacatcgcacctgcccgtggccagaccaggtgaatatcgctatctatgatggcgactcagaaaacactggggaaacacgaatcttcaggaataggggtgattggccggattctgatattgctgttcgcagtgtacgccctctctgttgtagctgtttacttccttctcactaccgtcctcacaaaacgatatgcatcggaggagtgatgcgggcagtgttgtcaagcttaggcacaataggcgtattcttcagcacgtcaaaagcctttgtgcagaagtcacagggtgaataatcgagcagacttgggcacaagcgtgcgagtgtttttgagaaccctgagctaccgaaacccgctggcgctgctatgaaacctggtcggtagcccaatggagcagctgcctgcctgtacatcatttgccttccccacttcttcaaatcgaagcagcttcacctggcattgtcacttttaggctagctttgacagaggtcgcaccaagatgcggaacacgaaccttcatttatgagcgaaaatcacgtcgcgtgcaacacagtcaccccatcgtgtcggatgcgttgctggtagcgtgcatgcacagttctgtgccatcagcgcgctaggttgtagcacggcggcgccttagtttgaattgcttctaaatcaccatgaacgtgttgttttttgaactcagacgagatgcatacagaccgaagtatgcaaataacgcgttgtgaacccaagagacgctcgtgaagggtgcgctgggcgcctgaagttgtgatgacactcatgcatacatctctaggattctgtcttgtcatctgacatgtgtttggattcgttgtatcacccctaataactcttccgaatcacaaaatatctatcaatatatttgaatagga

SEQ ID NO: 959 - DNA, 1436 bp, Toxoplasma gondii
aagacctaccaacatttggagtcacagcgacagcgatgcaactcggatataaaaggtcgtttatcgcagtcggaatatgtctttgacggtctgagcaaatagacgtaacagggaaacgagggaaatgtccatccttttgcgtgaaatgtcgtgaagaccgacagacatggcacacatttccagtttttacggtgccagaggaacaacggtgggctcgtcagagaggactgccggtgaagtccaagaatctctacaacttcgaacgtaagaagaaacggagagaagtgcctgttctcggtttatcgaccatgccgtgaacaatacttgagtattcacgaaattgcaagtctttcctcaaatcaaccgactgaggcgcacgcgaactacagcgtttcggttttgctattgacaagcagagtgcgtcttactacacacttaacgctggtttctttacataaaaagtacgaattggcgtgcatttggacccaacacagcgaagaagcgacgtacctgttccgttgtcacccttcttgtcagcattctcttcctcctctctgataaaaaggacaagttcccacgcaagaactggaaaagcaaacatgtgctccacaccccacctgggggacaagaaaatatgcagcgttggaactgacggctacaccacgcttctaggcagaaaaaacgaggcacataggaactaagactcacagcaggaggctcgaaagcattcccgatccaggaaagttgaatttattcgcatgtaaaactagcacatttccacccgccagcaagctcaacatcaccatatcaaacatgcactttcttggcagccgaatagattcctcagcagagttcaagcatataggtatacgaactggaatacaggaactttaagaaatcggacccgtcgctgcagtttgtgagatcgactctcgaaacgtactcaaggcgctggagggtcacgtccatgagctggagtgcccggtctgtgcacgaggcacttttccaccgaagcttcaccattttttcgcgtggttatggactctttctgcacgtttagatcgcttgtaccacacaactcgtgtttcgctcctcgaaattccagctctcttagagcaacgagagtcatccactcctcgcggccacactggaggttccttccttgaagaggcgctgcgcttaggtttgacgatgacttgacactatttcgcctgaagattgatcaaaaacttgcgtctagttaagattcttcgatccacgaatgaataaaagccgagggtatctccaggcagagaaacaagtcgttttctgcctcgtttctgtgcagccgacaggacgcaagacccagtccgatgtacccttgaaacagagaatgctagttcgtccgtccggttgagaacgtcagaacgagcataagaccggcctaaactcaaata

SEQ ID NO: 960 - DNA, 2803 bp, Toxoplasma gondii
cgaggcctctgtgcttgtcccacagtcacccgttcttggaacatgtgataccgtttcagcattcccatgaacaatcgggtaaattaccacctggatcgggccagactccaccagacgaacataggcgggaaggttgttgagaacttgtttacgccttgtgtctagcaactccacattttctctcgcgtcttgagaacatctttcacaagcgtgtctgtggattcctgaaactctttcgagtcctgccattactcgttcatcagacgtgtgttcctgtcgaaacacaccttcagaggacgatgcttcaccttttcgtccattcgcgggtgcgaacgatgaagcgaagcaagacgcggaatgtgaatgatcacatctactcgagaaaggcactttgcttccgcggacaccacgacgggtagctaagcatcgtgagaattccgctctgctgcgcccggtgagctgcctgtttggtaagtctgagcagactaacgcaattccccccgttgaagggagcggatgcgcacttctcattccatgctccgggccgaaagtggcggtcgggtttctccctctctggaatttctcccacctcaggttatgaaccaaggaagcagcggattcatgcctggtggaataccagtctctcgatgacgaaacaccacggatcgccagacgaacacttttacgttgatgatgtgggcgtgcctgcctcagaaagatgcccggccgtgttgcacaggagaaaataccacgagcacaacggcatcttgacaattgccggcccgctgtgccgtgcaggtatgtcctgcagtgcatctgagacaccgtctcagtaaccggatgcagccacgccctgctactacgggttacagacacactgaaagatgccattaggactgggacaacgcctttcctgtcatttccaatagaagtcagcgcgtgtccacgcaggtgtgcgcaaggtgccactgcacccaacggtcacgctgtataatttgtgttaacaagccatggcttcgtagtcccttcaccagttctacaatcagtgacaagcagatagaaaaaggccaagggataaggtaactcacggacacggggtggcgcacaccgtccaccccgaatcctggacacagtgaacactgaagctgtggagttcctgtcgcactgaatggccgtgaattcgactctgcagtgaagagtctagcttctaccagataaattgtgtttttgatcggtgatttgctcgagtctgtctcacgtgccgcctcccaactgctgcacgcgtatggtccaatccgcatgcagcttccggtttcgctgaacagccgcagcgccactccaaagggggctttctgggaatctctactagttcaacccaaacttgtgtcccgtcaccgatgtatttccatcaacaaaagtgcacagcagtaccagtggttttcgctcaactgtgtgcagcggaatgttagcgaccgccacatcgaacaaggactcggtacacctccggctgtgtaagtcctctcccatcccgtagctacaggttcctaacataacagtacgaagacagaatctatgcgaccagcaaagagtatgtgcctgaaaaggcaaggcaagcataagaaagtgtacagttcacggaagcgctgtaattagtgcagttgccatgactccacaagggtattatccaggaacgacagcgtcttggatggacctttccgcgctcgaactgttggtgcgccgcacgagcattttcgtgctgtcagcggtctgcttgcatttagcaccaatcggaagacgcatcgctttctgggagccctcaagacctcgaagacaaaccgaagtgcaagaaagggtgaggtagggaacgtaaggcgagttgtggggcttcagctttaaaatccttttaggacgggggtggcggggaacataatcgtccagcatccagtgaaccgcaggaccaccggaatgcgtcgccccgggcaatcagtggtggggcggaccccgcagccctggttcgagttcaccgtcccatcacttctgattttccccggaatctttctgtaacaggctttttttttcaacgacccaaaaatttacctggaggtctgcattgcctgcaggcaagagaaggtgcaaattaggtaagcaaacgtcgaatgaatgtcgggccacgagctggcggtcacatactgttctacagagtttcgtgggggtgtttcttccgggtggccgcatccatttcccgaactactacaacgtactcggacgcgcgtgccactttttcccacctatggcgcccctgtttttctctgtggcagtatcaagttcaattagcggtttcccacttcccaatttgcttcccgattcgttttccactaggtcgtgtcgggctgtagttgttctgtaagcgcaccaccgcgttttgccggtgtttattcttcaactggtggtcgggctaactgggtttgatttttcgtggacgagctatgacgccacgttatctgtccaggacgcagcgtcagaaaacatcaccggtagattgtggattcagggtgttgttccccgttggaactctgaaaggataacgcaacccgggtctgggtgctgcaccaggtgccttggcacgcaaacgttttggggcaagggcaatcgagtttgtttgcgggtgtgtgcatacaaggggatcagccgtccgagaggaagtggatcgttctttccgagagacgtgcattgtttttcctgttgtttccagcagtatacccgtcttcgagaccccgacttgtttcgaaggacgcgttcatca

SEQ ID NO: 961 - DNA, 2484 bp, Toxoplasma gondii
tcgaccaacagatgctgctcctgaatttgcttcatctgcagcgcgtcgaggtctgcctcagagacgcccggattctgctctgcgacctcgcgcctgtgcttctccagcgtcttgtcaaacgcctccttcaccgcagaaacaggctcgtggcgcgcgatgcggaagagggggacaaacggagacaccaccaaagacgcgcccggaagagaagagacaggcgaagctccagagactcgtggagaggccgagacgcctggagagggagagacaggcgaagctccagagactcccggagacgcagaggctcccgagccacccgcgtccacactcgcgccagtcgacatctctgttttgggggaggaaacgcagaacggactgggttcgagaaacaggacaaacgggggagaacaggacttgagggagaggcaatcgatcaaaaaagagacagagggcagggggagggggacaagcagtggagaggagaagagtcgcaaggaaaggagcagagactgaaacaaagaaaagtgtaggcgggagagagaagagacagacgggcagcagcaagtggggacacccccagaacgcgcgacgtgacgcagagtctttcaacaagttcgccccggcgaacgcgagagagagaaaggagaagaagaaaagaaaagaggacgaattaggatggaagggccaaaacgggaagtcgatgtttcgaaaaaacaacgtcgtcgcagagacacggtggtgaaaggcaacagttcgtcgaaaagtcctttacttccttcgctctcgcgaaagcacagagggcagagcttcagccttctctgcttctctgtctcttcgcgaaacaccgcgcaaaaagacaacacaccttagcctgagcattttccatcatgcatgcacaagcccgggagtcgacgtggagagacgcgcagcaagaaaagacagtaaagacccagaaaagagccggaaataattgcgagaaagctgtactacagaaaattgcaggacagtgggggcaatcgcagtgtagcgggcctctcacgcgggaagaggaaacacgaggcgctgaagcttctcctttctgcccgttttcctgcctcttccccgcgagagacacacgacgcgcttttccttcctctctttttatatccttggcctctcgacaaacgaacagccgaagaacggtagaacaaagcatataagtgactcacttcctcggagaatccgctcccccggcagagaaagcaacaagaagcaacagaagacggcgaagaactgcgtagaagcagggaaagcgcactcgggaagattccacccgcggttttacttctacccccaaattccacatttagcgctagcaacatctggttctctaacagccggggaagaaagagaggctgcgactgcaaaaaatgtgaacttcgtggttccacacatgcacgaatcgagttttatatactacacgcgagggcatactcgccgcagagaaccctgcgcctcgcactcgtgtttgttcgcccgtttggcacggatagagggcaacgtaaaatttgttaagagtagatgcagctctctgccggtcgtttccggttttttctctgcttcgtcccccctttctcgtctctgccagcacacgaaccgctcggcacaactgcgcgcgcggcttcgcaggcggcttcggcggccgcgctccagcagctagaaaaccgactctgcagaatatgtttgttctgcttgtacttccgggcaagagaaaacgggaaaaaacacaaacacgtcctggatgccgcaatacgtggctctctctaccctgtcaactcccatttctcgaggcgttgcgttgaatcggcttatatccggatagcgctccagccatgcgcaaaatcgtggcaaatgaaccgtatatagggcgaaaactatccgtcgagtgccggggagaaagccagctgaagcgtgttgccttcagcctttttcgtgacgaatgcaacagcaaggagagtcccggattctacgacaaagcacgcagactgccgttcggaacttgcttcttccgcctgctttaattgcacgcgagaagtgggaggagtgggagcactcctgtttcttttgcactttgcgtcgggaggcgggccagaacggacagcagattcgttttgttgagtagcgggcggcggcagatctgttcgcaaaattcactgctgtgttccggcagcgggtgtcgatatacgactgaccaactttaaaagcatttaacgcgtcggaatttgtgttgttcacttcacggaggaagtcgggctctgcgttgactgtgtgccttttcctttttgtggtcaaagagttaaacggaaaggagagttgctgcccgacacgtagcagctcaggcggacgcagggccgacaagaccgccgggtggcggtttggcgtgtgcgctgcgcgtgctcgcttcttttttctcacttgtgcatgtctgtttctgctcgtgtgaaa

SEQ ID NO: 962 - DNA, 1970 bp, Toxoplasma gondii
gagcacataagcagaacaattgtggcttgagccttgcacagagctggccaaggaaacgtgtggtccccgatagccacacaggagtacttttttactgtcgcatgtcggcaaagacagaagcaccttcatcttctgccccctgacatttagagattggtgtcagtgtatgtgcacgtaaccggactcgaggtgatgtcacggagctgtaggttatacagcattctccaagtgggtggctgcagatccaaggcaaccacatcgaagacctcccgtcacaatattagggaatccagttatcgccaaaaaggccaattttttcagaaacaactgctgccgacgacaaaatggaactatgctatgtgtgccacccgtagatgactatctatttacacggaacctgctgaccaccatcatcttacgccgtgtgacgcagtgtctcccattgcaggcaaccgtgatcacatatatgaagtgagccaatcgttgtcctactggctaccaaacccacttttccagcttacacaaagcccctatataagccaggaattccttcttgtctccacaccatcttcaaggcgtgtcccgtggaagttagaagcgaacggtacactttagcgggagtacagtcggcagcctgacccaaagctgcgcctctagttggtcctcttgcctcgccgctcagtccctgctgcaactgcgccgtgcccgaagacatgattgtggaacaaggttgaatggaagaaaccgtagatgacgaacctagatattgccttgaggtcacttgcgcttggatcattgcctttgctgtgtcaattggataaaaaagacatcggccgacgaagccactgcaggcggatgcaaacatcaaggccctcatctttcgccagtcaatcgaggaatcatcagactcgccatggctgagatgttcagctgaaacagtcttccaggagcctgctccggtcgcggcgcatgtggcgtcattggtagaaggctccatcaatgtgggattcggtgcgagaccacgccagcacacatgaaatcggctggcagagatgccgatagaagtctccactcgcagatcaacgcaaaatcctggttaccttcgctgccaccactttcccagactcaagcgccaacgacacactcgaaccgtggcacacttgctaagcggcagacaacgacaggcctgcaacgagtcctagtacttgtggctgacccaaaagatttgagttgggttcgcgtgtgtcgcacgaaggcaaagttaataaaaaacagataaatggtgcgctgttgggtagaagaggatgcctggaaaaggacagcagcggacccgcaaaaaaacggtgccggcaatttgctcgttgcatgctcggcagtggaacatttcaagggaaagcgtggccgacttccacgaacggtacttgagctggcgcacgtgctgcagtatgtaagtggttgtagccgaggtaagcaactgagtcttccaaaaaacctgttgttagccgaataggagagatgaagactccgatatgtatggaaagccctaaagggccaggaaggagtgtgcgtcccgttacggtagaggaacctgggcacagtgtcgagcgtaccaactagcggtgtatcgacacgtcaggacaacattccgctgccccctgtgcagatataatccattacaggttcacgaccgaatgcaacacggtttctgattcgaggtgccccgaatttatctctaccgcaatgaagatgttgcaggtcttccttaccttcgcgcttgcaccggcacaccgagcgacttcaggtgtttgtgcggagcctgtttcgcaagacgtgtacgtccctccgggcgattctgaggaaccctccgtcataacaagcgccgatgagcaaagcaaacacgcgtgagacacattaaaggacctgcacgttggacgagtgaagtagttgaaagcgaaaatgcagcgatgcca

SEQ ID NO: 963 - DNA, 1982 bp, Toxoplasma gondii
gttgaatgacaagggagcactgaaccgacacggaggcgctggagagacacgaaaggacatctacaagttgcagcagaagagccagatcggtctttccagacgccgcatgctgtagggaactgtgcatgaatgacaacatcccccagaggtgagaagactacatcgtcagcgtggggaagcgtggcacgatatcgaggaaaataaaacacgcatagttctcaattggcgacgcgagcctgcagcagacggcagagtgcactcgcatacgcatttcgttgactgaaaacgcgcttacacttccgtagctttgtatactgcgtagatcgggccgaagcagcacacgctgctggcgaagaagtggaggagcgtcatcgagtcggatggagaggtcctggatttgactccgcgatttctttcacttccacccgagttttcccggcgagcaagcgcaggcgacccgcgagtcgtctggggcacgacgtctgtggagcagcggcggcttcgacgacacgcagaaaccggcttttgtatgtagaaggaaggaacgtaagtggatgagagtgcaggctgacaggaaggcgacgctgactggtggcgagaagacgcaggggggaaggcgacagccaagcggccagaagagaactgagcttgcgttggatgttcagcgcacacaaaggacggcgaaacgtcggaaacgaagctgaggaagcagaagtcgcccaggtggcatgccaaggcatacagaccagcaccaacgtcgaaacagcaaggaaacttccacctttgatgccggggcagaaagatcgcttcaaggattcgcttttcctcgagagtgtgtgtccagacagaagaagatccaggggtatcttcgttgcgtcttccaagaagcgcttcagacgcccacgtgagacgtgacgcgcttgaagtgacaaacagcggttctatactgttggaactcagagacaggaactcgaacgaatcgctaggagcctcgacgcatgcaggtcgacgcggcggcgacggttctcaggaaccactgcacaccaggtaaagctacaaaaacaagctgttctgcaggtgagatgagggcacctcgaggcacagtctttgcagaggggcaagactcattctgtttccctcataaagcaaataggtatagcggagaaaagggttgcatgtgcgttggcgtgcctccctcatgcagcggaagtgccacgtttctccctgcatgcagtccccccaaaaatccgctggtcttcagccacatcaacgcgtaaaacatggccttccggttcttcgctccactctatgcgtttaacgttagacaacgtgaccatctgcggtagatcacttgactttgactcttgaagtccaaacgtgcgctcaaggttctgcgaggtgtttttttcaagtgtgttggcgcctttctttttcacacttcatggtatatacacagaaaagtttttaacggggttcagatgcggatgttcgtcgcctctggcgcgcccctaacctgtttttttcgcttcatagaaggtgcccttagtcagaatgtgcacgcaccgcagtcgccgcatatgtctatagactccgtgctcaatgtttctgtctacctatacagcggagaacctgcgcagtctaagtgatcgtctaagcgatcctgcccctcgtttgctctgtttgacaccatccatcttcgtttattcctaaaaacaacccgactatgtctggagggtgtgggtttcctgtaaagctgacccctccagcggctttatagtcacttcgcgccggcgcacccagcgaaggcaacgaaggttgcctgtgaacagcaggcagtgcaacgagcaattccgcagccgagagttatcgtgctgtgacatgagactaggcttggaacgccctggcccgttcaagtcttccaaaagcccctttgtcgcttggaattttggcggaagtcagaaagtgaagatgcaccagcaaga

SEQ ID NO: 964 - DNA, 4655 bp, Toxoplasma gondii
ggcagtgaagacgcgattcaactttgagaacgtaggaggagaaagaaaggccggcgaaagagcgtccggcggcagcgccggagcagatgctgcaggacgcatgctgatagacagggtgttttcgagtccgaaaaggaggcagaggcgaaggagagaaggcgagaggcagggacgatcggcaacggcagggaaggagcgagacgacaagggagaagtgattctttattcgtttgatgaatctggaactttggtataatgtccagaaacctggtgcctggaggtagtccttgactcatggggcggcctccccacagttccttcctgttctaaagtgaagacacaaacagttcctctcaactgcctgtcggtgctcctctgtcgccacaaggtcttctctctttccttgggcgttcgaaatctccacgtcgaaacgggaaggcggggacagaggaagaaaacaggcagaggaaaaaggagttgtggactgaaacgggaaacgagacgaagaaacaaaatgagacagaaagactctgttttccgatggtaccgagatggttcggaaaaaacctccagcccaccatggcttctgtccagcagccggtcggggccgtagtgttgagaactccgactgtcaaatgtgctgaaagctaaagccgatacgaactttgccttttgactgcttccccctgcactccccctcagaaaacccagagagttgtgctgcctcaattcaaatgtttgataagaaattagcgaggaaagcccagcctacgtgaccggccgtcaagatgacgcgaggctgagaggagacatccatttctcctcacgaagaaatgcacctgtacgcgacgaagggttgaccaaggcgagacttgcacgggaaagacctgagaagaaacatgacgcgggggaaaaatcactttgactcggcgggatgccaccccccccaagtttctgctgtgtcctgcacagaatagagacgagagagttgcagataaagggaaacgagacaacttgatcgacagagagaaaaaaagacggagaaaaaaagacggagagaacggcgaaagagtgtgaagttccccttcgggagcccggggtccaggacgcagaggcaagcgggagaggagcgacagtcccgaaccatgtgccggagtaagaagcagaagcagcgtttctgaagaggcgcaaaaattccgaagcaaggcatttcacttcttctgtggaacagcaacacaataaagggaaccccctttcgcgaatcagcaacgcatgcactgcgccaggcacagcaacagcgtctgggaagggttgccagagaagagacaagaaaagaagggaagagcgcacgggtgaacgctgactagacgcgtacgaagagggcgcgaaacacaaggatgacgttgtctatctccggaaaagaaacagggaaagccgcaccttaatctaaatcccggcttcttccattttctcgccccaagcatctcgaggccagcacaccctctcggtgccctgcgagctgctgagtgagtcaactctgaggatgctcgcatgctgttttgcacagaaaacagacagaagccccaccacagcttgttagcgaaacttactgaaggatgcctcgttgcacaattgactcgaataagaaaattcactgtaaaggaagactcggctgtctgcacgtcaaaaagactggaatcacacattccgtagatatataagcggatagctgttatgttgaggacatatctaaaccgagttggactaccggttagagctgaaaggtcttttttacccggtccaagtacgatcggggctctgtggaagtctttcaggggcaaaatgtgcaaccgcgtgtgtggtcgacggtgagacttgatacagccgctggttgcaagacgccgcttattacgctggattgcctctcttcagcaaggaagaggattccagtctgacttcttcccttgcgactccatacccaacggaggaatgtatagaggaatcggtgttcgggactgtggcgccattctcagtcagaaactacacatagtcctgtctgaatcttctgttgaggaacagaacttataacccgacatactgagaggtgtgagaacttcctttcgtcggtggaagtgtacagatttctcaccgtatcaagctcatcgcggggggggagaggacagaactcgagaaacaagactaatggagcaagacctgccactgagaatgatgtgccacgattatcatgtttgctaggaagtatcgtgtgatgcggtggtctgcaggtacaagaatggaaaatgaccgatccatacctgatcttgtgggggattgtttgagtggacaggcagaacactttatcctcttccctctaatgtagtctgcagcacctcagtgcataaaagaatactacgtggggagaaaacatcgatctgatcccgtgcgaaagctacccctctctgctttttcagttgacaagcaacggtgccagtggcaaaaaccgcgtttatggagatgtcaaagagttggatttccgtcaacgaacacccttcacagtctagaagaccggtgtccgtgtctaacaagtagaagcaaatcgttacctgcggtctgaacgcaaatctacttctggtaatgtagattcagtacgtcgtcattttctgtgggcagttccttgagcgataccatcgggagccatgggtgtagtgttgtgttaggggcttgtttacagaacagccgtcaccatatcagaactagaggtacgaataagacgagtaccttttcttagaaatctcgaagaattcgtgatccacctaggtccctaacacgcatattcaaaggctcgtcatactgtcaagcgaaagtctttgagtatgacatgtcaggcagttccactttttgaccatttggtgtttatgtaccggtggtgttgcaactacattatggcgaccatgggtgccacatcactagtctactctgcgattttgtgtcaattctttgggaactttgcccaccgaccgaggcagcagagaatgcgattttcccaacgccctcgaaccatatcaagcaactagcctgcgtcatgcgtactactggtcacctatgaaagttgaatgttcaacggcaaatgctgtggaaaagccaaggaaatctcatattcgccgttttccagacaagagtgatgtgttgtttcacttcttgaggcgaaaccttaaccgtgaaccaaagtgggaatttgtgcccacggaagattccagcagccgcagagaatttgtattaaggtaaaaacccatctagctgtggcttggggcattcagccgatgcagcatcaaccctgacatttttccatcgatgacaggacacattttgattcggaagttcaagagtccccagttcgccatataaactatcggtgtgaacgcgtttgtggcactgaaagtgcaagggaaccttgctacagcctgaccgtgtcttagttttgttaagtcgactgactcactggtgtcaatttacgtttttctatattgcatcgtggtagtcagtctctatccacaggattcttgctcctttaataacagaagtagctgatgcagacttgcagacacacagaaccactgaggcaacttctccgtttctagacactcgtcgcgcatttttggtgggggtggcccgtaccgggaggggcgttgcaaaaacctgggaaatacccggtgtttacgcctccaccgtcaacacctgtcgtgtctcccagtgttccgttcacggaatgcggcaaggggttttataacagtgactccttcttcacaatttatgtacagatgaagctgtgataccatgtctttttataggcacaaacatgacgccaaaagtttcctggtgtcagtggcagttgaccttggttacaaacacgcttcctatttcagtctcgcgtcgaagtgtttccgtttcaaccgccgttgataggtagcaacgtcctgcgcaatggtacccggcaaaaggaaatgtaaagtgtgaaattgatgctgagaacgatggtttcgtggcagggattcacgtcagccatctgctgtgcagttatccgcgctcgtcgtcctttgtgcggcgctgagaaagagtattagcgtggtctgtgcacaagatgtactcgtttttgactggtctaaccgatacactttccaggtttgaacccgtctgagggtcggatgactcgaggtgcgtaaccatgctcttgaatactggctcgctgccaacagcagatggattttgagcatgtccgtcgttgtaaatgactcatgtctggttctttctcccttttttgaccccatggttccctcggatgcgctttcgcatcgagacgtgggacagcatagcgaggcactgaagaagtccgtttcaggaggatccgcgagctcactgtctgctgccgagtaatgaggtacacgtgcagactagatagcacaggtttccactctccgcattttctaccgtagccttaaccacgcgtggcggaaaatacgcataccacctacaatagctctgctacgcgtgttttcgtgtgcaggagggcgctagacacccagttgctctctgcgaccgagagctgtgtgtctcgtacgcctgacctggataaggctaactccacagtttgaacaaaa

SEQ ID NO: 965 - DNA, 3144 bp, Toxoplasma gondii
ccctgaatgtcgtgagatatcgaaataaaacaccttcagcagtattaagccggccactgggatggtgattgaaagcaaccgtacaaaacttgtctgttcgtgtctcacatctaaaacccactcagcatccatccccaggaactgtgttatgcctcacaagtggatttcttcaaagtttttgtttcgtcttttttgtcacgctagatttgatggagagctgcgagaaggccggctgtggaatgtgaagcccgggagcaagggccttcttccagacgggggcattttgttgggtggggcatgcattcaagggaaaattcacggaccgaatgggaagttgctgcggcgacggaaactttacgtcggcaagttccggaaaggcaagcttcacggtcacgggctggtagcccgagctgaagacggcgtcgttttagcggaaggcgtgtgggaaaatgggaaactatgtggcatatagttgcaggaaaggtatcataaaaaagcggtttcctcctacctgcgcactgaaactatttttggcattcatgcaacctacatactgggctaagccgagtcaggctcccgcatctgccggcaatgagaacaaaatgccttttcccagagaacagcgagagcgcacagcggtttcctccactcacatagaatgttctgaaccgacagtggcgcctttgccccagagtcttgctagcaagaggaaacgaaacgctactgcgggtggtagccgggaggatgcaagttactgaggaagcatacttccgacaggtccacagaacatgctgttctaaagttatacttccccatcctagaaaatgacctagctttaaatacagagtggtgctggacccgtccacatgtcatcgtaaagcaaaggtaaacacacacacattttgctgccgaaatcaaagcacagggaaagcatgaccgtacggcgatctgcagttgggcatggcacgtgcacatttcgatttacaggctttagagcgcaaaaaggcactgacacgaaagcacacgcttgggcagcatcgtggataaagaggaggcaggaacgagaggtgggagaagttctcaccagtcgcaaagatagaaatcttcaatgaactagaactcaatgcctcgtaaaagctgtaatggttccgttcctatccaacgggactggtcttgtctgcaagatgtagcggcgagcagcacggaaactcactcaaaagactatgtagagaggtcaacagatcttccttatctccggatattatagcctttcgtgtcaaactctaaaaactcagccattagaacgaagacttcggagtcgagccgtccgtggggtgggcgctcaatgccgtttttctatcttctcgtaaggcctgactgcccgagtcgaacttcggagcgacgctacgggtgtcaatacaacttcaccagaaacagtgctattaacgagtcgcgtgcgaacctgaaagacggcaaattcgtgtccttcagtttctgctgtgctccggatatgcgtttgaaactgtcctcacagaagtccttctgcggtatcggcgtggtagacacactgaagtcacgctcagtttgcatctttaatccatcaaattgccactcgattgcatttcactaaactaatcgtgtttctccaattcgaaggctgtcgcctcccttcttctgcagagaggacagcaggccaccagtagatgttcatgtacgctttgcgtgtccgtcacgagagcttccagttattttatacgcgattgtattccgaagtcgcatcaagattctcaactatgtggcattctttcgatcaactcttccgtgtactggtgaggttgcttcgctgtcttgccaagaaaccgggggtcacccaaagtgaagagggggcacgtaagttcacaaggaaaggttgaccgggaagtctctctgaaaactgttagtgttacatcatttttgctataatgacgtggaatatatctctcccttttcttcacatctctctgaaatttaatcaccccctcatatgtcgaaggtaactgcattttaaacggaattcagctcttcacaaggcggctgccggcgcggcggtactttgggcgcgttatcaagacagtggtctgccatgctgagtcgaatgcgctgttttttctgttttcaacccagcattacttgtctatagaatcctgtctcactattccttctttaccgttgcgtacctctctcagttcctgtttatggcgtgtcttcagtttgtgaaaagcctaacggtttgtttgagcgcggaaataactctttcccgacgtgctgtctctcagtttctaatacatcctttttcttcgtgttcacgttgcttacttgcgacttcaaacatgcatcttccctttagtgtaccacagtaaagcggctcattctgcgaccttctggaaatgcctgtcggaattttcttccgcattttctggaccggctgccacatgcaatagtgccgcagagaggctagctcgccctggctcacgcgctagcgaaggttccatgacgaacgacgtcgttccttttttcgtcgctgctcaactcctgttgtatttgccggtttgaacctctcggaccactttgtgttgtgcgctaaagccagtcattccttcaacgaaaccctgctgagaagggcgagcttgcagtcggctgccctcgcagccgttcctgcggccagtcccttcttcgcacgacacactctgttgaaaattgtggtcctcaccactgtattcccgcagatacaaagtctcggcagatggcttgggtagagcgcacagcgaacggataggcgaagttctaatcgagggtcttttcctatccgctgcttgcttcaccgccttcgttttgctcccggagtcactactggaaatttctacgcagagtccgtgtttccctcctgacgagaaacttacagcatctgagaagacttccatgttccacagtgccaaggattcgcccacaaagtgcctggaatcgtcaaagagcagtggattcattgcactcttccagcggcatcgttgcactcttcgggaatcgtcgctgtctcctggtgttgccgtcgcgagggttcgcgtttgcgcacctcatcgagtcttgccgtttcttgtgaatgagaga

SEQ ID NO: 966 - DNA, 2250 bp, Toxoplasma gondii
caatggcgcgatccaacttctcctcgtacgcagaggcatccattggggtgtacagacactcgggagctgggcggcatcgccagaggcggggaggacgccacgaagaaacgcgaggaaaacgttctccgcgcgaactctcagcgcgaccgagaagaagaggaacggttctcctgtacatgcacaccgcatgttttcgaaaaggaaactgcgaatcgagtggagaatcaactgaaagcaactacgtcgatgatcacgcatgccaacatccatatccatccaggcataagcaaagacagacgcaaacatatatatctttatctatatatgcatatatatatatatatctttatctatatatgcatacatatacatatatatatatatatatgtacgtatatatacagaggtgtctgtattcaggaaagcgagtttggaggtgcattttggcgcttgttttgatgcgaagagagatgagtgacgagaggacttcaggtgaaggagcaagagctcaacatcgctgagaagccagcgacggtgacgctccgccttcagagactgttgggataggaaaaagcgaggttgagagtgtagaagcgacgctcacaagaggaatagcattccctcttgtcccccctttgaggaggatgaaggaaaagtcctccttttcctcacttagacaagccgttcttagttcttcgtctcggtgaaaggacgacctgtttgaagaggctgaactgcgagtccccaaggcgccgcagagcgagagcgaaaaggagagtgaggagaaaactgcggagaacagctgcaagtgtcgagacagcggaaacgctcagcttctgtccaggcggctggctgcagagagggccgccccgctagctcgtcctgtgtgtgtgtgtgtctctgctgcggcctcaagtctcccaggagtttcctcggcaccggcgagcgaggcatttggagcggcgcgggcgcgcgaaaagacaggaagccggcgaacgcagcgttctggaaacaggagagaagcttcaccgcctgcgcaaacggagaaaaaacgacaaacgaggcgtcagctcagccaggaggtggagaggcgagtgtgcggtgtgacggccggccgcgagccgaggggaggggaggaaaaaaggaacaactcaggatggagagaaaacctggagagaagacgcaggccaacggtgccgaggagcgagcggtcgagagcaaagaacgcatgcactcacaagcgggtgtgttgtacttgcacacccgccacgaggatgtcagcgggtgacgtcgcgcgggagattcttcgcggcggaaagcggcgtttcggcacttcacagagttgttcgtctcttttttcgaacagacgaggaccctggacttgccttgtttcgagaaacagcgaagaaacagtggagaaaacgattcgcatccccgccgagagacaccggcaagacactcggtcgttgctcaaaacagtactgtggccgtgcatgtctcgtctcggggaacgaacgactggaacgtcaccgcttaaattccttcgtttatctgcggaaggtctcctgcggattgcctctgagcatcttcggcgaaaacctgcgggtttttctccccatttccggcgactgctctcgtcgacactacgcaaaaggcttctcttgtccccctcccccccccccatcccctgtgaagcctgttctcctttttcttcaagcacacaaagccgcagaaggcgccgttccgtctcctccactctcttcgcctttttcagagctccagggcgtcttgccctctcttcgagtcaacgtttgcgcagcttcgtccgtccttttcctgccctccccctgcgacaagtgcagcgccttccccggcctcctactacctccctctgccccccaactgacacacactgcgcgaatacctttttcctgtcttctctctcactgattctcgcagagtcgattctcaggaagatcgcctctcaaccgtttctataactttcaccttcctgcccttcccttctcctccactccccccttctcttccactccccccttctcttccactcccgcgcctctcagcctcggcgccatattcgtcttcgcctgcttcgcctcctctgcgtcttctcctgggtgttgttcttctgtgtggacgtttcgtagcgcagggctgctgagacgctgcgctgcggtttctgggcagagcagcagtggtttttttttcgccgccgcgcgttctccaaga

SEQ ID NO: 967 - DNA, 2271 bp, Toxoplasma gondii
gtccgttctgcttcaaaacatccagcaagagctccctttcttggtgccgctctgcattctgcgtcgccgccgcctcctccagcctccgcatgcgtttcagtgcggcgcgcaactcccgctcgcgccgccgcagcacccgctcaagcgtctgtttctccgcgaaaagatcccccgcctcgacttggccatccgcagcacgcgccggactctcatcttcgtcgaacagctgacacggcttgggagctgtgcgtagacccaaacttggcgggaggtctccggcggcgtctgccgccgcgctcgcgttcttcgcaccagcggcttcgccactgcgccccgccgagcagtccgcatttgctttctccgcactccctccagcttcgttgctgcgaccgcggctcggggtcggaaacgttccagaggcaagagtcgaggtcagggtggagaagaaggaagaggccgccgctgccgaagctgagagcgaggcggtagcagcagctgcggccgaggtagcggcggggctctggagagacgagaaacctgacggctgttgagaactcgaggaagacctcccaaagaggaaagacgaagaaggcgatgcgccgagaggtgactcattcaacgcgcctagaaggctgcttcctgatatctgcggcatcttctctgagcagggcgaagcaaagtacatgcatctctgcgcagagtaagaaactcgttttcgaccacataacctgcaaagacggccctaggcgccccttcagagaaaatagattacagaaaggcggacaggggtgaaatgcatgcgaggagatgttcgtttcgaggcgtcgggactgagaggctctctccgggtgacgaagaccgcctcaggcgctgtttggaacgcaggaaagggaactgggtgaactgacgacgtctggtgactccgtgaagaaaattctgttggtctccacggacggagaaacaccttgaattatcttttcttccacgagtttcttgggagtcaagcggaagaagggacgctcgaggcgcgcggccgacgcaaggcgcgcactgcgttcttggaaactcacaaagaaaactgcgaaaaccgatctcccagtaggttccgcacagacacccccgaaaaggatggcaaagggtaaaggcaagcccacaaaggccggcttggcatttggcatctgaggaaaacagagaagcaggcgaaggcatccgccgaaaaagagtcctagcgcccggtcatgccactcgcgaggacaagactcaccagagacacacatctattgagaggaaagggaacttggagacgagagaaaggagattgagaagcggcacggaagaccaagccttaaagaatagagaaaggcgaaaccgacacaaagatgtggacaaacgcatcgctcagacagcgaacggcctctcttggaaatccttttcgacgcatgcagccgcgcgcctcggagctccgcttttgagaggaaatcttctgggttttcgcgcttatgaccctcgaagaaacacacgctggaaatgaatccactatttttcgtgtctgcatgcgttttgacaggcgtagtcaaagaatagtgcgaatcgcagcgggttcggaacgtctggcgggtcctgtagaagcgaacagtacgagaaaaatcggcggcaaaatcgggccttcgtctttctgcgcacatttgttttctgttacaagtgcagctatctctctggacttgtgcaggtatatattgacacactagactcactccagcccaagaaggtatctctgattcttattgtacgcatactctgtgtggctatccacgctacgctgcctcagagcgcagcgcttaatcctttcttgactcgtccagaagagagtcgtctttgttcgtcagtctttggaggcttccttcctctttatttgagaagcacatgcaaggcttctgcttccagtcgaatttcctgggatgcgggcttgaccgtcccggtttcgtgcgaaagtcgttgagtgccggaagcagagttttatcccttcgtctccaactgtcactcttcctctttcagtctctcagcgtctgtctcccaccgtctgtctctctccgcggctgtcacgagtctattgaaagagagaagagaaaggaggaacggaaggtcttctatccatgaggactcgcaggaggcgctgacagcaagcagccctcgtgtgagagggcggccaagggaggccgagtgtacagacagatggaggtcgttgctttgcctgcgattttcgtgccgaaa

SEQ ID NO: 968 - DNA, 1607 bp, Toxoplasma gondii
tagagaggaagccggaggtgtctccatcgtttcgatctcttgactccgctgtctcttcgctgcgggggacggtctctccttgaaagagtgacgaaacatctttcctctcttctgctcgatgcgagtatacttcctgccgctctctctccggtgaaccaccagctttcagcgagctttctcgcgaatcaagtgtctgcaagggagacaacgtcggcgcagcagagacagacgggggaagaagaggatacagagaaggagaacaaagaagagaaacgagaacaagagaagggagaagcagagagagacgagaagaagagagagagaggcgatagggagacacaaggagatgaaaagagggtaaaggacagcgggtgctggctggagagggaagagaagaatggggagaagaagagcgatgtgcctgggagagacgcatagaataagagggaggtaaagaggaggaatgagaagaggaaagtgaggaagggcgaaggcgcattgcgggaggagacagtgaagaatgtggtaaacacacgatttttttcaacggagaagagagggaaagaagagcacgcgacacagtgcacaaagcctttgattcagatcactcacgcaaggatttcactggtagcagcagcaactccagaaaagacagagatagaggaagaaggcgaacgaagaaggtaaacagaggtaaggaaagtggataaggaaagacgaaggcgaggaaacaagaagatgagaagaggagacaaagaacgacgaagagaagagatgcggagagcagacgaagaaagtggaaagcgtggagaggaaaggctcgggagagaagaagatacggaaggaaggacagaagagaaaaagaagacgagtatggaggaagacgagtatagaggaagacgaagaaggcagaagatgaggaaacaacgcacagaccgtaacgagctgatatttagtcaagcgcattcgatttcgtggcgaggaccgacacactccgaaaagagacaaaacaggagaatccaggcaggccaacccctctaaagtgagagtgagaacgaggaagtggagttcgagtcaaaaagagaaaggattcgagctgtacagtgatggaccggcagccagccagaagtcgcgctgcgcagacaagaccgcctctggggggtccacacggggactgcaagaaagggaggacatctgagtcacacattcgcctcgaagtgtgtgtccaccgcgccgtctacaagatcgaagaaaaacggagaaaaactagcaagtagaagaagaccatcagagagagagggaggctgaaacgcgatgcctcgtcgacgccagttggggcgttctttgcgctgtcgatgcatgcacactcggttcggcttttctcggttttccctgcagcgactttttgcttggatttctgaagttcatttgagaagacgaaacggcagtcgagcgaaaatacaacttgacaggaagaacagctgggcctgagtcgcgggcgcgccccggtcacgctgatgcctgacaccgaccgggagacaaggaaatcgcggatttccagaaatcatcctgaccttggaaccaatcagaaacacacactccacgca

SEQ ID NO: 969 - DNA, 2365 bp, Toxoplasma gondii
cccacccaaaccgtcaaatgtaaaacgaaactgaagccgagtagatacaaaaattacactaattcgttttgatgtgaactgtggtcgcgtctcatctcccggtcgtctttgttatcgcagtgtcgcactctatcagaccttccacgtacaaaagtgtgcaccggatgtcagctgttgttgctacgaaaaatatttttgtgtcgtgagcgtcagtgtcaagaaaacggcggttctacggggtaggcggattaacaaacatagggcatgccttgtacctcttttctaagctaaacacttgctcccaagtgtgcgagaacaagcagaagtcgaggcagaaagtggctgacttttagagattcaagcgccttgttgcggtctcgcgtttccgacggtgcccggaagactgccaatggtatgtgaatcttagatacgaaaccacactagagggtaacgttaccttcgtgacacggactttccagtttgctattgccttagtaaaaaacatgtcattgagtcagtggagaaaaccgggagaacaaaatgacttcgacgtgccttttcgaagattgactcctgtctatgtacctgtccaatatgggagcagataagatccagcttcctagctcttcggtccgtgtagaaccgtttgggacagacgcttccgacaaaccttagtgcttacgaaggtttcccgaagtctctcacttacttgccagaggcgaggagcattgatggaactgttgtttccgctgattatcaaggttgtgtagtgggtgagtaactatatgttgacccgtgtcatctatgatcggtacggggaacaatgcaacgactgccacgcagaataacttcgcagaacgactgtagaaacactagatatatagccccacattttcgcaactgagcacttttcagtgatgcccgcatgacttgttagctgcatctcagttactggtgaaagcgtttactgaggtgctgcgatcctggtgagaagctgcagtcggttgtgacttctctcaccgtaggcacctgcgtagcagtctgcttgagggattaccgcaagaaggaacaggagaacgggtgtttgtgaggttgttttctgcacggtagtttgttcgaactgaaatgattagtcgttcaccggatctcgaaccgaggctggtgcctctctcgacggcatttccataaacggactcgtgtgattgaaaaggacagcttatttcgctcggacatattgggttgatccgtagtgttctttctacacatatgtctcaaggcacagcgtcacggtggttatgaaagattaatgcaacgcagatggcgttccgtgccactgtcagcaacaaaaaagcgaatgtcgtttgtcgctgccacgaagctcgaaggcagtatccaagaaaaggggaagccggatattctgaagacaaagaatacaacattttactcagaaacatttgcaccgtgtatttcttcggctgcaacattcgttgtgcacgtgatagaaaacaggagaatcgatgtttagtccttaaagaagcgttgtctagctgcagacagctacggaccaagttgactcatcgagtccacggcggtgaggggcggcgactcagtagcaacacagagccataagtcgtccttagtatttttgagtgttttttagtcgtagaattaggacgagaataccgaaaaactgaaaagacaggcaaatactgcagtggaaaggacgaaggatatgcgtcaactatgtcgcgcgcaggaggccggacgagggtcgcgcgggtcccccagccaagcgtatcatcggctttgttaagaacaggagcgcaagaagaaactccaaagcaggtgaatcgtctttttcccgtgccgacacactttcaggttctagaatctcaattgtgtttgccttaacctagtatcgagagacatatttctccatcaacaatgatagcttcccacgttcggacgaattttcgccttctgtgcttgcaatgaagaggaccggagctgagacgtttcttttttccttgagagaaggactcgcaaactccttgaaggagatcagctgcttcggcaggtattcttcgtttctcggcagaattcgatactgacggttttccccagtgtcactctgtcattttgcttgcttgcgagtgatcgtcttcgtgtctcgtggatgtttgtgcttatctgtcgaaattcgcctatccagtcagttgatccatgaagagccagccatcgaacgtctcgaacccacatgcgtaggcagccaatgaggcagactgcccttgtgtcttgtcacctttcctcgattgtgtttcgcctcacgtgataagtcgtgtattaaaagtgatcgcgtccataa

SEQ ID NO: 970 - DNA, 760 bp, Toxoplasma gondii
ggccgaaaagcttcgcctcggtcgccatcttgccaagctctcacaacgctagatctccttttcctgtcgaaggcaagacagagacaaagagtctgccatgctgcggatccatcctgtcgcagacgtacgtctgacgggggcctccaacgtactgggcaaatcaagcacttgctccatgagcgcacgcgagttaaggaaaaaaacgtgtacagacaactgcgcatgcgtctaaatgcctctacgtccacgtcagtatacgtataaacatttacatcacaacagaaggatgtgaatcctacgcgttgtcgcctccaagggtccacagaacagcagcaagcttcgagacagacgatcaccgcggcacataacgaattcaacattgagatgaaacagtctccaaactgtcattacttgaacacatacttgacacctgaaaataatctgacgaaatatcagtccgatgcacgaaacagctcccttggcagatgccatgcagctcgagtggccagcccaggtcggcgagtgcatgccaccacaaaacacgtatttccatgcagcaagagggctgaagcagcccctatacatctattgagaataagttaagatttagaaggaagcgaggacttctatcacagttacacacgggagcaaggaaaggagctcagccgcgtctggtctctgttcagccactgacgtcaacgataggaagcagtttctgggaatttccccagtccgtctaactgaactactcagcacagca

SEQ ID NO: 971 - DNA, 4117 bp, Toxoplasma gondii
cgtctgaatgtaaagctgcttgagtggacgcaacgctttgctctccgttcaaccggtgtttccgatttcggaaacgcaatgaggaagcggatgtaccaaccctttcacgcttgctctcaagcttgctttcaaactcgacctcgagttttcgtgtctcagccggtcccagataaagatatcccgtatacggattgtgtcccaacatggaccgtgacccgcttcctgtaccgttctctggacaccagtagagcttgtttccatttgttgacgcgtcccttctgctttgcgtttctctctcttcgtccctggatgcacagccaccgctgctgaggcgagactcagagtcttcctgtctgtcgggttctcccgatttcctcgcaagagtgacgtggtcgcttgcttctgggaggaacccatcagacaaacagtcaaaaacggtcccagaaataccgaaaaacttcttcaaaacactctggatcgccgccaagcccgaccgcgtgcttctctcaatgaagcaaacgtgtctgtacgggcacggtcctttcggcctcgtttcttcattctgcccctgtgcgcgtactggggagtaaaccccacagcctttcttcagattcacttccgacagctccgattcactttcttccgacggtttcacgccggctgagtgagcgaccagtgaagactctggactcgcagctgagacgcttctataggcatctaagaagtcctggctttcagttgcagaagatagaaaatcacagccattcggaaatcttctcccttcgtccccaagccacagcggccggtgaacgtgcctgagaggtacgcgtagcggagaagtgcacgacactgtagactgtatgcggaaaggaactgctgctggatgtctggcaatgaagggaaccagacttggcagcagttcgacggcctgaaaacagacacgcagaccgactggagaactacccagttccacggatagatgaggagagtgcgtgaaacgcgtacaaactttcacactttatgtccgtacatcaagtgccaacagtatccagctttggactacgtctctcgttaggtctcagttttacaggttccttccagcaaccctcctcccagatatgtgtacggtccacacagatgaagacgcacgctgttttacttccgttttcaagcagccgaaccagcggcttggcctctttcaaagaaacctgccgttgtcggggcgtcggtttggccaaaccgacgccccgaaacagcgagcttggagtcgccacctgtttagagaaacgcttttctgttatacagtttctgcagcagcgtatgcttttgtatggtgacatcgtggaagtgtgttaaaatggcgcttgcctccccttggtacatatcaaaaatgcgcactccggtttccacggcctgcccagctatgatctttctgttcttgatgccagctccaaagatctgtacacacgctgtagagtatgcctacaaacggtttaagaactcggacaatactgctacgaagaacagcaaatcccgcaattaggcaaacagtagcctcacgttgaagagccatcaagctggtacttaatggagggtacatggcccaaccccaactgtgcaccgctatttctgcacgttacctgcatcgtcgttgctaccctttcaccaagacggtcgtcgagtttttgtgcatggccactcgcgacccgaagaagaagggcagcatggagaagccccagttttcgctgctcctccactgacggaaatgaagaaaagacgctgcttggtttctgcttaggggcaacggatccactggaggcatcgttcgacgactgggatctcatgttcaaacagaaaacggcgatgtcggctgcagtacccagtgagcgcaagcagggacaaaaatgcgcattccgtattttgcacgagcacagaattcctccgcagaagagcagtgcagtcgtttcgccgtctaccactgattgtctgtatcgtgcgggaatcccagacgtggatggagatgccgtagtgaccgtcctagcgttggcaccggtgatacccaacgacgtgcacgccagagggtcagaagcaaaaactacgaaaatctacacacagtgtatcatgcattctcttcatcctcattgccactctgtcaccattccattttcgtgggaaatacgggcatgagagcgaactcattcgctgaaagttgagagcagacaatgaaaactacttgccgcgcaacacgggattctccaaggtcgaagatagtaccattccaatcgccttttgtgccacccgtgctgtgagcaagctgttgaggttctgcatattttgtggtaagctattgctttcatggcttcgaagttacgtgcggggatcacgctgcttactggccaggagagagggatctggagaaagtgtgcgtccgcattcacgaagggattccacatcgtcatgtttttcacgcagtatcttctccttttcgagaaatcggccatctcgtctgcgaccaactccctcttccagtaaaagagatatagataagttcagcgctgccgagagagaaattgtctgcggagagactgaataagcgaaagcggcactgtccgttgatcccgtttgcgggtctggacgagaatctatcgaagaagccggcgaagtgcctatgcgtaatatttcgccgcgaaaccctcccttttccgtgttatgcattccactgcgtagcctttgcgtgagatgctctgcgatttcatggaggccaataccgtcccttccagcgcctaggacagcgaatgccgcgtagacgttggcaagatcatctaatgacagcactggcaacaggggcagcgcctcgttgaaaatgtttttgagaacgacagaattcctaaatccgcagtctgccagtgcacacgcaattgagattaacgcttgaggactcgcgacccgagagaaatctgttgcgctggcgtacatttgaaggaattctgaatcaactatgccttcccgggaaaaatttgaaagaagagcctgagaagccacgaacagcgcacagatacgaatgaatctcccaacacattcacggcttctccggaccaagatggtgtaccagtgcagagaagcagagaaccagttctgcaaaaatgtgaggtgctcgtgaaggacgacagcgtctgatgtggagggattgtgggattgaacctacaacgccgattacgcgtgtacacaaggttgaaccacatcctgtgtatgctttgatacagtcgctgacgcggacgacgtggtaacagggttttgcaacaaaaacaatgttggacacctaaaaattatcaggctgctcagggtacacacaagtgtgtaccacagcgacgcagcaacactaactgggaactaaaaagcaagtcgcttccagaacacagaaaaatgcagcagcgatggggacaggtatcctgcctcatcctcaattttgggttctggaagccattcagagcagattcgtgataaaacgcgcggtgaaagcagagtggaggcgctcacatctccggcaaattgcatccaacacttggagtgaatgcccctacgatgacatctgaagctactaaaccccgcaaccacagacacaggaactgtcgtaccttccttaggaaagaaaaacgaatgcttggtcttccggcttgtagccgccacaccacgtaaccacaaacaaattgaagtccacaccttgctgaggaatggaaacgcatgtctgcttgtgcggtttcctcctactgacgctaaagcttacttgtagatggcgctgcttgtagagatgactattttgtctgacatgcagagtaaggaggtccacggtagcgccgctgtggaaacccaagcgtgacaaagcgtcggccaagactacgacgtcgtcggggtagaaagtcagaagaagtcggggtagctgggcaatcagccgagcaactagccagttatctttgacccctaatgccgcacacgcgcttaaaaccacgcagatcgactgccaacaagcaaagcgcaatgaagacgaagaataaaatgtcaaggtgccacaattcggtcgaagcagagtaaagcaagttgtgctatgtgggttaccatg

SEQ ID NO: 972 - DNA, 4830 bp, Toxoplasma gondii
actccggcagctatagaaaagtgaatagatctaaacagatagtagatggataaagtggagatgaaggatgtatgaagaaaattatatatatatatatatatatatatacctttgaatttatggagaggctaatcacagcaccacgttcaacgttgctggcttttcttcaaagtaaatctgtgtagaggatatctgaatcggattgttacctcagtccactttgtcttcgtcatctgtctaggagttttcggatgggagaagaaacttcgaggtatgagtgagagatactctgtacacgatgtggattttctgagtttgaacatcacgaaacagaaaaggaaagaagcaacagggcgtagcgatggtcgtctttcgacattatatgagcacatttgcatatacaggtatgcaagtatgtacaaatgcgtgtccagggttgtgttttgtcgtgtatgcaggaggacgtttctctctgttgatttcgcggacagtctcctgtgttttgttctgaaggacgggggaacctcgtcttgacattcctggcttgtttcagctgaacgcctgcttttttgtctcggggaagtagagagagatatgcggataagaaaggatgtttgtcccgcagtgcgttcatttctcattggcaactttcgtttaccgattccaggaagttcccaaccacgtgcaagttcgagtttcttgtagtttcaccgccctcgcgcctcgcatccgccagcgcctgcttctgccgctcgcccacgtttccagttggtcgtttttcgtttctccctttgttgggatgccagcagaatccaccttctctgctcgttcgctcggaaacgtttgtttcggtatcacggaagtgaaaaaccatctcgtgattgcgcacgttacatctttgttgtgcggtgcgtggtttggggtaaatggtactccagcggcaagtcaagagacgaaaaaaatgtgactgcatttgtctttccggcgcttgtttttgcttttttggcttcgcaacaggctctcgcacaccactcgcgaccgtccagtttatgatttcgcttttccttttcgtctagagtcgctgcagttaggtttcggtggatgcatttgcctcttgtcatcatcttagagacacgcgatctgcgttccctccttggaaacgaggacacacgaacgaagctagtcaagtctatcgcacaaaacgctctttctgtgctttcttcgattctgttttggggtttgcatcccttaaaactcggaacttggagagccggagtcccgacgtcccccaatttttttttctcgaacgccgcgtttcccccctcaagaaatacatactccgttggatgccgccattctgcacgttcggcctttttgacaagtaggccgtttttatgttttcgcagaaaaaacgtgggtgtttcttctagacttccaaggcgaacaagtagacgtgcttctcgtggctcaacggtgctctgtgcttttcgaatgcggacaactttttcctgtctcaagcagcgggaccccccctcttgcgcgttttctcatttcaatgacgctttattccgaccctcgtttctgcgagaggcgaaaaattctcatattctcctaaaccagaacaccagtcaaagctcccccccagtggttgtacagcctttcttacaatcaaacaacatagagtttctgtctgcatcgacaagagacgggtgtttcttcggatacacatatctatctatatagactcaaatacgtattgcgtcaatgtccgtgtatatgaccagggtacgcatgtcaaagtatgtacgagtgctttttaaaaggacttttatgggaacggaatagggcaatgtcagttgcaggttttcccctccgacctcaatccccgcaatccatgttccgttgcacaagctgctctctttttcggttgtttcttttttgtgcgttttcacagccatcggctaaaattcaaggagcatctaggtgagacactaacacccgtttgtttccgtattccccggcctgaacgcggtcacacagttctcgctgcatcctgcagttcgcgccgtctccttttcatttatcactagttacacgcaggtcttgacgccgatgtaaagctctttgttagagagtctccttcacgtagaacagagacaaacgctcgtgttatcctcgcaggcggcagaacctttcacctttccattttctcaacgccgtaccgcgacgtcttcaaaagctgctttctcaaacacaaatgctgaagcgaacagatgacacacacttccgaaatactgctaaccattccctcaatcagcatgcatacccacgacacactgatacaatcgttgtacaaggactggtccagttactgagagacgcacactgtgcagaaagaagtgtgcttagtaaacaacagggcgaaacaagttttcacgtggagttttcgtctcctgtttactctaggaggtaacgtagggaaactcgccttgaacacaccgttcgttacgtataacagagaaacatcacaatttacattgttaatacagaatatcaaacctctgggaagccgtgaagactacgaagttatggttttgggccgcgttgatgtacactggtgcaagggtgaatttcgaagttgctcattttgacggcaggtacgtgtcgtgtgagagcaactctatagaggtagggtttctgtcttgtttgcacgagtcgcgtttgagtcgttttccggtgttccttgcagactggccgacaaaagatgctactgttctggccggttgtagaacaccgaaggagtgttacctctgcactttgccgttgtttttcccgtttttcagttggcggaggtggcacgggagtcgcagagtttcctgggtttcctgctcgctcggagccggtcttcgagattcagtgcttgcggtattttcggcatccatcgctactaaatctggacggagaatatccgaaacagggtaagccgagagttagttcgctcttctgctgggagcggcacttttctgcgcctgagagaggcacttgtccggtgttcgcggcggccgcgttgcgcggcggtttccgtgtcggttgtggcgtgtttttcggcgtttctgggtttttttatcaaacctgcttctgcgagcccactctccagcgacgattcgaggcggtctcgcgaaaactcacacttttcccgggggttttgcgaccttcaccgagtcgtgtcaaccagcggctgcacccgccgcgggtttgagagcgctgcgcccgcttctggctcggttctgcgcgcgcgatgcttttttttctgaggattcttcgagaaacgcgtccgtttttcgctcgttttttgccgtactcactggaagaagcagcaactcgaccggacgatcgagggcgagcgggtggcgcggcttttttccggaagttccgctgggaaaatcgcgaaaacgctcggcgctcgccccctcacccgagcgctgagaatccgacgatgtacccagtctgctaggtcacgtgtgctgtgtcgaatttctgcaacacggccgccacgctctctgcgagtttgatttcttttcggcaaaatcgagactgtgccctttttgcgagggcgctcgccattcctcgtcacatagagaaacgcgttttctccgctctacagaggctcgcgggagcttcgcgttcctgccatcccaatctctaccgcacaaacaacggggcacgacggaagcggcattctctgccttttcatcttcgtttgtcccgcgtttttgcgggaactttgggttttcgcttgctttccttgctgccgaccggcttccgtgttcgtgtttccccgtggcttgttttcttcgcggctctcggacgagaaccgcacgctccttccttttcttgtccagctttttctgtcggtcccgcttttttcgtgagcctctgggtttcgcgtttttggcgcgtgtcttcttcgcgtcgaaacctgtgccttttcgccctgtctctcccccgcgagcgcggtcctttctctgcgattttctgcttcgagaaatagctctgcggcctctgcgcgacttccctccggtggaacgcgtcgctttgcggttggacgcgtctgcctgtcgtcaggctttttttgtgttcgtgtttctgtcttcaggtttcgacgttttcgtctttcgaaagaaactccggactgtttggccgccgagctcttctcagcctgactggccttcctctcttggcttcgcagctcctttgttgacttcaccttgtcgagtgtatattcctcctacgcagatatacgcaaatgcttgcgtgatctttatttgcgtatatgcacttgcccttgcacgcatacgtttttctgcgtgcgtacgatcctgttttcgggaggccaggtgtttcatctttgacgtttacgcagctcttttctgtgtccctgcaaagacctttcctgtctctgcgagataaacgtgacgtttcccctctttcaacttgtgtacggccttttcgtgtttggtgtcgccgacggcgctctgatacgcaaggctgccgcgcagaggcgtctctggggtccaccgttttgctcgcctctgttctggagaggcgcctgtaccaaccagttcgcgtgtacatacacccggtgtcgtcagcttctggagaaagacttgtggcggcccgtgcctggagggtggacctctaggagtgtcagacagttgaggattccggctttctgttctctcgctttcgcctgtcccgttcgccgcgtccgtcggacgcctgaacaacgcttttctcgagcgacgtcgacttcccgccgctcagacaaaa

SEQ ID NO: 973 - DNA, 2173 bp, Toxoplasma gondii
caaccgtccacgagacttttggcgcgaacagtactgaggataccatccgccgctttaccaagcctgcagcaccaggaggaagagctggatcgtgacgctacatgtcggagagtctctcaacaaacaatgactctccatcactttacggaatgcgagtatcaccgtccgcgtagcacggacgcctgcagcacatgattcacatcgctccctgttgatctgcaatcactaagggattatcaaagcatactcaacttacctcagccaccagctttctcaatttctgcagtatttgaggagggtgcagcagcttccagtcacatgcaccctggggaaactttttgccactttttgttgttatgagggtcccgtcgaggtcaaagagagccaggccggcacatcggtttttcctgcagaacacgtctttctctgtgcctcggtcttcccgcgaggaatcttgtgacgcgctctccatagtaggattcactcgtgcgcaaagcctagggacactccactgtgtaaatagacacccctctccacttccagaggcacaacagcctggcttttctgctgagttctcccgcgctcgcttgtatccggtaagaagcgctgagatgcctgtggcattttctgatggttcctttcgctgcaattcatcacgactggctgtttgagggccaggagaggtgctagctggttgggactgtacaccatagaaccgtgcatgcgcttgcggacagtagtgacgccaccagaggcctccgtctacacagtgccaaaagggtgaagaaggcaacgcgacttgattaagtaaacccgtggcatctgaccggaccggagtcttcgccatcttcgccgacggctgcatggtcaagaaccgcctctgctctgcctcggaaatgaccgcagctaatagagacagaatcaaaattcatgccgtgagagacgccaagatatatatagagacgaggttaccacacacaagcacgcactagcattgagccacgttggagtgtgcagattgatgagcaacagcacagcaagacaccttcacacgcgcattccggggcaacactgggaggatagcttcaaccacaacactctttgactgacttgacacttccagattcgtgaggcactgagacgcacagagcacgcgtacacaccaggcaaccacaatgcagaaacaatttgtctcgctgcagcgtgcggaatgactcggacagcgccctacagccgctgtgcagaccctaccagccatagagcagtgatatttaagtgattcgctgtccacaccaaacttcggaagtcataccggcgttggtagtactaaagcgttcaagcttaagcggcaagccccaagcttcccatgctggctaccggctatggatgaagctcacagaggacgcttatgccgagttctgcgtgcgcttccgcgtcgtcggcaatttgcggatgacggaagtagcgagaaaatagacaagccgaaacacacctttttcttcgtcatcctctggctgccagaaaatggtaatgcctagaaatgaagtgcgtagttgatccgacatactcgatcttcaccgcgcatgcgtgtgaaggccacccgaccgcatgcacggttcaaagaaccagtcgaagggtttcgaggcattccaagttcttccctctttgttgtttcttttgcagacaggaactaatgccgactcagctttttttagttgtgtctttcctcttcgtcctcatgaacaacgctcgtgcactgcccttttcttgcgagctttctctacgggttgcccgctgcaggcgctggaccgaatccagagggccttcgcttcctcatcaccgtccttgatgtgccacgcacaggtctgtttcgggcgtaactccatgctttttatgtttcatggtctgtagctgcttttttgaagtaaaggtggcacaaaaacgagacgtttttagtccatcattccgtcgagtgcgaagactcacttgcgtcttaccgcctgcggttgcgaatacagctcctttctgcggtgatgccccggcgaagcagccacacgaaactctcagtctttgaggctgtgctcacccgtttacctccacgtttttaaaggcagtgtgtctacctgaggaactgctgacgcacttacaattctgaggcgatctaaacagacga

SEQ ID NO: 974 - DNA, 3583 bp, Toxoplasma gondii
gaatgaaagcaaatgatatgttcagcaagcgggcttagcagcggatatgagtctgcttgggaaggcctgttatttgggcgagggtaatgatccggggcagccttcgggcgacgttcgtttttgctggccagctgtcgtgcaaacagtagttccacgctgcgggggacaatgtggaaagcgagctgagtcgttcactgtgttcaccagtatatatgttttttttgacttgtaagctgagtttgataggtgctatgtcggcggacagaagtgtacacccacagtgtggagggtcgacttcagtgaaactggcggttaccgtcaaaagtccatatgtgcaaaggcaatcagtgtatgagtcagattttattgtgtttcccatacgtcgaaattgaaagactggagaaagggatccgaagccacttatattcaaaagataaacgtgatattacgcacgtcagagtttttctcgtgataacgatggactgcggtgaagcgtgaaaggcgaaaaataccaggcttagcacctaaaaggagggggcggaagcagaagcggtgaaagtggagactgcctctcgccgtggaaattactgcgaagagcagcgagttcacgccaccgcttctacagacatgaggcgctccaatttatgtgttaattttacgagtttcatcaccctgaccgcaggcgcagttaaatgacgcgtgatattgtactgtagtatagtgtaagatcacatcatagtttctgccaaacgataccaacacattccggttccacacgacgaaaacccgtctgcactgtagcgtcattgcttccttcatatacaggaggacacccctacaaaatgcatcgcgaaattcccgaacgatctccagctgcgcagtaaatgaatgtagcaagacacaccagaaagtctggctgcaccacaactttgagcttcagttgcagttatgcctcttctgcctatggcgtctgttcgatggcagcattatttgccctggatattgagtctagctgctgaggcgatattggttcaacagtcgccaggtcttcttcggatggaagagcgagcatcgggtaggttgcttccgtggaggaaggacgcgtcaccacaacgggtgatgggggaacaacaggatatacttgcggagttgagggagctgcaactcttgcgggttgcacttcacttggggcgtagaaaacgtcagtaagatccattgcctacagttcaacgcatgtggaatgatttactggcgctaatggtggagttggagtgtcaacgtacagctcgaagcaccggaatagacacatcctctgttactgaagcacggaatcctctgtggtccgactctggattcgcatcatacaacgttacctggtagaatttcttccgaggaaggacactttttcttgcactcctggtgccctataacagtttagagaccacatggtgctgtgatgcgcatatgaggcttaccagatgagtacggtcctctccagcaattgctaacgagtgcttccatatcgctcgctagaagaatactcatatgaaggaagctgcttacggatagcggctctcctcataacacagcaaatctcgcaagggatgctggcgcattcctgtaagcacaaatatatttgttgaactctccctacgtaccctgtcagatcgacctgcctcagcttcctgtgacgtagcagtcgaagacagtgcggcgcacttctctttcatggatgctgcggcgaagcagagagatcattttccttgctgcatgtaaccagcggtgacacactcacccaagcggctaaacgagcaaccgcacgtcggcgggactggctcgcttccagcacgagactcgtctagcaggcaagctgtccctgggggtcttataggtcctcgtcgctctgactccgaattgcaaatatgacgtacccttatgtacatcgacgatagttgcgtacggaccgcctgttgagaggatgcccaaatttggccggagattcaccgcctgcaccatccctacccaaccaacaagcaccgccacgagacttttcatcttgttgcacggatttagaaccgtgaaggaagcatcggtcaggtacgtgctctttccaaaagtcggtaatgaggccagagatgctctacggtgagatagctcaccatcaagggagaggtgtagtgacactgttcttcgcggcaaaactgggagcatccgtagattcgacccgactgtgcacacgaacccacagattccttctcggcaatcctatcgtactggaccagtaatacattctccttgcatcttaaacggtcgcaccaccgcttgcctctcttttgtatttgtgactgaatctaatagtcactcaaatattgaaacgaggcttatcctcctgtggcctcctcgtgcacaaccatcagacgatgctggcgacgcaccggagggaccgtattcccaggttaatgagcaaagagcatgttttgcaacgaagaatcactcgctatcacgtgtcaaaatccgtccttggacgatactacggctgcggacaacgtcatgtacagaaacggatcgtctgaaggtattcatcgaagacagagaccccagatgtgagtatggctacgagtgtgtaagcaatgcgactctcaggagatgcatctgagaaggggagatttgacgtggctattacgttagaatccatatctaacaaaacgctgcattgggctacagcagggcacctacgatcgtgttcctgtttacatcgtagttccgctttttgtacttccatgcaagtacactctgtgtcatagccaagattaaatctggcataaccaagatctgctaagaaaaaaactcgctaaatgagttcttctactcgttttatgacggaaattcttcacctgtgctagtgccgccattcactcgttgttttgaacgccagattggcgggactgcatgcgcccgtccatttaggaagcttgaagtgggacaaccttgtccacatctattcgaacatcagcaagaagctgcggcaaacaatctctttgtccagttccgaatcgtaaatcagactgttcccgattccgcgggaaactgtgttttccctctcagcggaggaggggctggaacacctccgggcaatccccaaaccctggtgcgttcttttctccacgacacggaagacctcagcagtacgcggtcttagaagtactgcttctcaaaaaagcgcccatttctgcattcatgcgcatccaatgaatctgtacctattttattgacatgcgcttgtgtattgcgattcacaatccaatcgtattgtttcctcggggcggcgaagcccggacgactcgggtcttttcagctgccccggtgaagcgtcgtgctcattttgaaagaatcggtaatactctgctttctgcctgttctttgtctttaccttcaacacctgtataattctatgtggcacgtacccgtcggactccactttcttcttgccggcggttcaaaatcgtctcggagtttcccggttcgacaacttcttcccgctgtctttgatggcccacttgcagatgtgctgtgaaccaagata

SEQ ID NO: 975 - DNA, 2034 bp, Toxoplasma gondii
aggatgcagcgagaaagacaagaggaaacggaaacgaggcgaaactgagagaaagggggacggcaggaaagagacgaaccgaaaaaaggagagaaccttgcaaaccgggaagctgcgttttcgggggtgccactgctacatgttgcatgcgcagggacacactcgggtgtacgtacatctcagatcgagtacggggtgtgcgcctccagacaggtcgggtgtacatacaccccaggaacacacactgagaggcgcagaagcggagatgcctgttggacgctttggattctgttttcagagaaggcgaaggcgaacctcaagatgagcaccagataacggagagcgaggaagtttcgctgtccagtacttagggaaggcgaaagacatgctcactggcttccacgtatgtcccctcagacagctggagatgcagacgatcccttgttcctttcgtacggagtgtgaaggctcgccctagcggagagaaagattcagtcactccgaaaacgcagattcttgcgtgcatctgggtttgcgaagacggtgtctcggtctctgccctctggtctcgacgtccccccttcacgacgacggggtgtatgtccacctggaaagcgggcacggaagacccttgagggtggaaaacgaagagaaaaaaaaccaaagtcgtgtgcaccgactcgtccttctctgtcctctcttttgtttcaccacatggaaggcgaaaaggcagaagaagactcctcggcctcgcgttgttttcgttgccagggtctcttttcttgtcttcttggcagcgagagtgagagggcagcgacggtagatacgaacgagcaacgacccgagaagaaaacggacaagacgcaagcgtggaaccgtttcttttttcttcgcactctctccgtcctttccttcttccgaggacctctaaaaaatccgagaagccaagaagagagctggtgagctggccttgcgtccgccgggtggcgacaggagccggcgtccagaaggcgttattataggagtccgccgctccgatgtgcaggagaaggtcgctctttttcgcgcaaaggcggagacgtaacgaggcgtgagaacgcaggaactcggagcgtgctggagtgaagaaggcgacagaaatggagaaaaagagaatggaagtgcaggaaagacagcagcgacaggctcgtgaagcgcgagacggcgccagcgtcctttctcgttcctcccaagccagcgcagcgaagacagctggagagttccgagaagaaaaaccactcaacgaggaagacgaaagaaaagaaccgatttactgcagcctgaaaatcggcttcgacctctcgcgcagggatggcagacagaggggggtgtgctgcgtgctgctgtctggctagtcgcgcccgatttgctgcaaatctcagattagccgaggagagtgcatgcactttgcaggacagaaaacggcgtcagcagcttttcaggcacgagacgaaaaaaactcgaaagaggcttctcccttctccttcctcgtgacgataaagatgtgaaaagccgcggatatcttgcttcgccatttccaacgtccgtagcgacacacagaaacacaaaaggcactcgtccgacttctctcgctgactctcacttgtcgccagcagtttcctcgtttctcattgtttccgtcctcactgtcgtctcctctcggtttcgcttctctcttgaaagcaagactctccggggggtcgccttctctcgcgtgcgtgtgatctctcccccccttggcggcgcaaaatacggaagagcagatctcaaaaaacgaacgttcccagcttgggttccccagccgccgttgcctgctggatttttcacctctcctcgacggtcgccactcgagtgaggtgtacgtacacctcacggtcgagcgccagcggcgccacggctgcctccagaaggcggcgaaagagacgtcctcttccgccttcttgtctggacttctcttctcgacatgcactgggaagaactaccgagttcagcaga

SEQ ID NO: 976 - DNA, 1511 bp, Toxoplasma gondii
cacatggcaatccttccagatgtacaactatgtctaccttcgtatatacattcagagagagagggagatatttatacatatatatatatatatatatatatatatatagatatacagaaagaaagttttacccgcaggcaggcatttctctgttacctcgttaacaacggggagtagacgatcgaggacgctgagccggttgccactgggaagtgccggcgttcgggtcacaaacacactaagttcagttttcggaatgtttgtatacatataatatatatatatatattacacatagagagcacatatacaataacatatacgttttatatgtatatatgtggattataaatatatatagtgagattgtatgtatgtataaatttatataatcatcgtacagataggcgtttggcagccacaacagactttcaccgagtaggacagatgcgggtgctctaatgctgcgttcagatctggcgtatcctcagtccctgtaagcgctcttgaaaaatttcgacatcatcattttacacgttcgtgaaagtcattctgtccctgtaaaagacacggactctggcaggcccaaaactccgcccgtcactggtcggcttatattcggcgagagtttcggcggcgaccgaagcgctgaatgtatcgagcaattggttcacatctagtttaggctccgtccgaaaagaaaccattgagtgcgcgcgcgttcgtttgctgcaaagtgctcggctttcttcgaacggacaaggggctgatccgatagcgtatcctcagtgtctggtggcacttttgaaggatttcgacatcttctttctaagcggagaacagcatcctggcgtttgtgaatttggaattaaaaggacgcaggctctctgaagaaaagtctctatcaagccaagcccatcccacgcggtatttgcgacctggctcgcggtgtccacgcccgccttgcgacgctcttttgcccctctgaaaaacctccggctcgcagcgtagagaggcgccgtctctgaaagaacgtccgacccgaccaggggatgaaagcgctttttcgctaaacctccacgagttttgaaccgccgaagtggactccaatatcactgcatttcgtggcttttcgaaaacacacacgaagccggatagaggtaaccggtttccgttgtcgctggctggctttccgtgtcgggcggctagagcaattcggttcctcgttttttccgcggcctcaaaaggccaagcgtgtcacaagattttcctctgcgcggccaacgagctgcggcccaacttgtttgcctttttttggcgtcgtggagcgtgtgtctcggcactgggtgcacaggctgtttatagcgtttttcgcggcgtttggccggggtttcggtttcttgtataagccgaattggaagttgccatgcttttgcctggatgccccgacagcagtttttgccctggcaggtggagctgacggtgcggaggcaacggccgattccgatgca

SEQ ID NO: 977 - DNA, 4758 bp, Toxoplasma gondii
aatagtcagggcatctgtggacgggtacatcattcgaggctggagagcaggagcagcctgcgaagtgaacgtggctgcaggcagacaaaaagggaaccaacacaacataacaacttgttgcacgcgaaggtctgagcgcgacagcataagaacaaaacactacaatcacacgatctgcttcaatgttttttctgctactgtctcttttttctctctctatccacgtcgtacaagtgacacgaatatcttcgcttttaagtcgcatctgcggtgaagtctctctgtgccccgcctgccgatgatgagcacgaacgtaaagaatgcggcacttgccacaaaaaagcaacctacaaccgacgccactactagcgtccccagtgcccacttcagcgtgctccttccgtatacacacagaaaaatccactccaatcgtgcctcgcgtagttttctatggtcactgcacacgtttcctgtctgtgaagccatgaaaacgaacgtactcgtctgcggaattggggatcccggaggcgggcactcgacgctgtggccgccatcgctgtgaatctcgttgtcggtgtaaacacggccttccatggggctggattctgtggcgaacaaaagagagacgcaacaaggaatcgacagaatctgtgtgaacgcgcaaatattaccaaagtccaagtgcagaccacctcgacacgtatgcttttatgtcgttagcaaacgtgtgcacattccctgtcaacatgaagagcacaaatgtcctctcggacggtgtgcatacatgtgataagcttctcgttgaggcgtttctcagatatttttcttttgacactgactatggcgtacaaacggctgaagacactggctggatatatatatatatatatggggagagacggacatatccatatactccatggtccacaacacagcccgacggccctactggataggttacatattggcacatcgcattaaccgtcgacagcagcacacgtagaacaaaagcataggggaaaactcagcatgggaccctagtgtgtcagctgattatctgataaattttcgcattgttctcataacttctttctctccagcacttcacacaggcggggccgcgtagcccagcccgcgtctcccggttcccgtctcggcagactttttccacagcggtgatccacgaaatggctctccgcaattagaaccatgcatctcaggaaacagaatttgccttcagaacggccgtcctcaggctataaaggtcatggcttaccaacttccaactgacgctccgaagcgccacagttgagtggtgtgccgggggagacggtaggggaagttggttgcgacattgctgctgacaatccctactgggtacaaagatttctgaaattccctcaccgcttagtggaaacaatttcaacaaagacaagtgcagagagagaggacgcgcgccgatacatgcctttcgttgggaacggataaggaattcacagccctgagggacgcggaagaagggagcaaaaatgcgccggagcaaagttgctgccgcgtcggctgaaagaagctttccatttgtcagcggggttcctcagtggtgggggataggaaggccgcacacgctgtagcgtacgtaatgcacagtccccaaacgcaccggcttttcccccccccccccccccaccagggggtatctgtaaggtctcgcaactttggaggacgaaacgacctgtcgttgtgtcttacttctctgttcacgaacaggagacatcatcaagtgctgtgcatactctgagaaaaccttgtcgcaggccagcccaaacatgaaaaaccgcatagttcttctttttgcagaagggagacatcgaggggccatagcgatggactgtcacctgaatgtagcctcataccaggaagccgcgccctctggagtcacaaatagactgaatgacagtcttcacccataaagaatgccgaagagaactatttaatttagaacagactggctgtcaatgatccctgagtacaatgccgcgggaagaaacctgctctttcgtggagccccacactgctcgtggacgcggcccttgtttcgtcatgcgtgcttgtctaaatgcatgaaacagtgtgtgttggtggagaacgggggcgcggctttatgtttgcgtttctcccatccggttcatatatggaaggcataccacctgcagcaaaacgcttctgcattgcctcgctttgctgccggtaaggtacttccgatgtctgttttttaagggaacgtcaccgtcgcccccacgtttccattgcggataagctcctgtgaaagctagtgatgtaaaattatagaacaaaaaagtcaatacagaaagaactccgcgagctcgtgatgtcgacgttactgcccttagaaacctcaaacaggcaaatacggatgcacacaattctgcagacttgcgcacgccaggtgatcgcttatcacgctcgatagtggctttgacagacacgacttttgtacacactagagtgctgggaactgctgacgcttcgaaaaatccaaacaggtgtaataattccatacgtgcaacatgctgatcgctaaaggctgctgatcccacggggacattcctgcttaccagcactacacaaacagatatttccggctcccgagaagcgtgccggcacgctcgtgatgatgccgtcttccgaggtacagctactggacgcgaggctatcactgacatttcctctgtaggcgagttatgatgagtagtagctcctggggtttggtggaaccttgcaaagtttctcataaaacaacatatctcgactctacaaaaatggccagccgtgatgagtctgtcgcctgaatgagctttgggatcgagcgcgagtctcagttgttctatattaagcaggacaatgtcatgctacgctattccacctcatgacaaatgcacgatgaatgcacgaaagaggtagggggagccagattcgctgttcttttcgttctggaaatcttgtatcaaatcaggaaggtctatagctagagaggattctcgagaacggcgctctgttcgtgaagaagttgactaataatcctgtacggggcagacagcgtgcattgccatctaacatacaactgacgatgttgaactcagaaaactattgtgaatccggtaaattttcgaactcgtgcaggctatccctttagctggtacttttggatgggcgtcctgtggtgaacgcttattcacagatcctagagaggcacctccagttcaggattgttttgtccctcccgtcaaacctcggtgcatttccctcaacacgtctagcgttgctgttcccattggaatcaaattgtaaccagaaagaactgaactacttgcgaaacaaacacggaagtgaacccgtccagtctctgcacctccgtgactctgacggtactcacgaacatctcctgaactagcgttgccgccacgagataaatgtttagattcttttaagcttgcttttaccgtgttatagtttgcctacttttctgggaagttgctcaggagaagagcttccttcgtttctcctcggcttatctttgtcgaatacggtgataggatgcagttttctctcttccacagtgcctcccatctgatgctgcccttcccagtctgcgggtggccgacatgtcaatgtgaaattcaagttggctctcgttctaagcagacgcgctgtatgcctgagattttatggtacggagtgaatgcgggacggtattcagtgtcgcgccagcagagggtcccatggctctctctatctcttgcctcaaaaagcctttccttctttgcttgtccttcgaagttgacgatatttcctataatggaatgcctggtcccggttattaaagaacaccactggaagagtccgatagttgctggccctcgaagtgcccgaggtgaaccgcagaactcagtcatgctggatgcatgctgacaacagagcgtggacattgctgcagagatgaggaaaagcctttcttttccgtccgcaaaatttatcgagaaacgcttctgttatagtgcttattcgatggattttgcgtagtcgctttcgacttgtcaacgactttcaacggtaagtttttctctctggattttttctctgcagagcagctcgactccgagagcttgtcattcgccgatgttcagctaacaatcgagcatgcaaagcaaggaaagcatctgtccactcttttccctgtcacgctactttccgttctgttcctccggtcctcaattatccacctagttcgattcaaaagggattgaggcgccaacagatgagggaaggagctgttccattattcgtggcactgccgtggagggtatgtccgtgtctgtcttacggagctctgggttaaaaatacggttcaatttttctccgtgtcggcagagcctgacgccttcttctagcaagagggagccgataaggacgccgatgaataggatcctcccagaagggaagaggattccagctgcggccaccatggatacaccggtgtacaacggctgagtcgtactgaaagccccgaaatacgtggcttattttaaacgtcacgaaactaattctaatttcgatcttccgttgtttggaccgtgggctggtgaccccagttttgaaatggttggtcctgcctttccccctggaagctcagtcgattgtgaagctgtctctcttcttaccatatccttaaaggaacaa

SEQ ID NO: 978 - DNA, 1626 bp, Toxoplasma gondii
cagagtggcttcagtcgaatcacgaggtaccaaaggtggtccatatttccggggaaccaagctcccgtacaacacagggggaacgcgcgacccggacacgcgtgagcaggtgagttaagcgctctgcgccttgtgcataaatacgctctagcgccttgcagtgccaacagtgacgaagtgactagaacttgattacgattcagtagattccgttgatctgggtctgcgttttttgttgcagggctgtagagcagtttgaagcgttcaagcagcgcatcgaggagttggacgttgccgatgatgggttaggttcactgtcgactcgggaagatttccggctgtttttcttgacacccgtgaaagaaacaagcagtcgcttgtcgcctggatcatggaagttttcgtgaaggagcaggcgtaatgtcttgtgcgttgttgaggctgaatgatgtgacaacttcatggcagaccgtttcgacattcgcgggcgattcttgtcaaggaagcaacggtatacaacagctctgctgtacagatccaacggcggttttcatcttcgcagttttcttaaacaaacggcaagcacgaacagtcttagaagcaacacagtttatgaggagaatgagccttgaaagcacaaaacactacaaataatgaactagtggaacagctgacgtggactgtttgccattcgacacaaaaaattccaattcgaataagcacaagaagtcagattcggggaccttgacatagctactgggtgaactcttgttcattgagaagaccattcattcacggaagtcataactgcggaaacattgtcagacagatcggtgaaattattgctttgcagctccttcactttgtcctcaccaaaagcctcgatcgcttcgtcaagcaacactctgaagatttcgcattccacgttttctcttatcttttcctccttataatggcgtttttctaggcggtcgtacaggactgcagtatcggcacgtaggacgtagactaagtcaaaccactcgtcgggcatgaagtcgcacgagtggaagtcgacaattttattgccatcactgacgatatcctcaagcttattcacaaccaagtcttcatcgaagatgctacagtttttttcgtcatcccattcagtgaacaagcgctcatctttaataagctgccccacattcacatgttccatacccgtctccagggcaagttggcgacagaatgttgttttgcccacgcctggggttcccgtcacgagaatattcggacggtttcgcatggtgctcaggacatgaacggacaggcggcgatacaacaagtacgcggttccatggaaaatcacaaatttgactaattgtttcacacgtgagatccgaagaggctctcacgaacttgtaagcaggaaagcgcgacagtttggtagattgcgactttgcggtggctgtgtctctacaccggtgatccgcatggatttcgcacggacgacgaaacccccactttttcttaatagcgcaacgattggctcgtctcgacggtttttattgaccataaaaatcatggcgctatgcttcatttcagcattgattataaccaccttgcttcaggcggaaggtctcaata

SEQ ID NO: 979 - DNA, 3612 bp, Toxoplasma gondii
tcgtttgagaaacgtgtctgcgcttttatgtggcgagtctgatgccgccgcgcgtcgcgttgttgattttcgctgcgtgaaaatgaggcgtgtatttgcgcgagatgtctcaagatacctctcccagcgcatcgaatcgtttggttttttctgtcgctttgtctcggtgcaaatccatagtcgtgtgtcgccttttctcccgcacctcgctgctctccccgacagtgcagaagcatgtgttcggtgcaacaagcaggaactccggagacgcagggagagacgagtcgagaaaaaactcgaaaaaccggtgtttcgacgtccgtgacagctgacagcagaaacaacaacgccctcacacgcgagaaagtgccctcggcttgtgacgcacagaagctttttctgatccgagcgaacgaaacaagcttttcggggccactgagcgccgtctaaaccagaacagtggttgtacgtttcctaactgggaactcgaggaatgcatatcggcattcgttccgtcgcagaaagatacccgaggggaagccccttcattgccgtatgaaatcgatttcaacacgattaccaatgtactgtcgttggagtgccacgcctcggtttcggacaaggactcctcactcagcgagtcttctctcgaggcgctacacaagtcttgagcgtcatctgtggtgagacgaacgtgtgaagcggttgcgttgtcagtcaaaacaaatttccgttgcttttgaaggtttctgttagtgacgtacccaacacacccgaagtgttgatccaattccctgcgaatccgtctcacgcttttagatcgtcttgggcttctacagaaaagcagttcccaccactggagtccttcaaggaacacgtgtgagttcagttccccatcggtgtttacaagaagaggctcgacggtactcctcaattacacggtggggagccccaacagcaccggctaaactggtggaactacagactgtcgtgtgttatccataccgggggtgaaaagatgtcagtcagatggatatcaagatccagcgacacaaacgttattcgatcatgttctaggtgtttctatctaggtatgaccgttttcacttgcttgagttgaagtttacaaatggctgaacagacccttcagtggagtatgccgacttgaatcccgagaacaactacaggccgtcctaaactaatgagtggctgctggataacaggagtcacacaaactggttgaggagcacaaacccagacccagtctggaaattatttagaaaccgaatgttctcgccaggcgttgaaactcaacgacttcgtctgtgaattccaaaggccagctggatcacgcgtaataatcaatttcgatctgcttctctttctcaaactagattctgcgcgccagatatagaagcaacagaacaccatgcattcatacatgacagagagagtcagggtgagcctcggattctgcttggcataaagttgatttcttttatccatcatattcactcatattgtatctgttcacaatgctataactgaacaagtgtcttcctcctcagaccttgaacgatacaatcgccgccaccctttttcatgagagctgcagcccattgtagcgtcagatctgagcctttggtagcattgagcttctataacttcttattaaaagacatgcattcatatatcttcgccatacaaatttcgtcccggaaaattgtctccaaacccccttctccgttctactcgttagcacccctccctagagagcgaaacatgcatctttctcgtccccttaggcgtcccgcgtttcaaccactctcgaacgagttgcttcatgaaaacgatgtttcatgcctgctgtttacgaatctttttcatcgcaattgcgtgccggctgcccactggcaacactgtcaacgtggaactcgacacagagcgctgttgcaccctcgccgcgagaaacaacagagagccaaaaagacgatctttcccgtttctctttttacatggcaagacccttgtttgtaggagcgaccgcttgtgagtaagggtgttggaaagaaaagtagaccgctagctgaggcgttcttgtaggcagctgagtgtgttgtagaaatcgaagtccagacctcggagtcccatgattccgacctggcacactgaatcgaagtttcacgatcaattgtcttttctgtggagtacggtgtgcactgagaatgtgcgctctgtgtgacgactcattctgggtatcattgcggaccgtctacgtgactggaaactcagaactgtagaaaaaacgacgggaggcactgctctctgcgaatcacagcgcgtccaccacggacagtatgtgttctgaagagggcgcgcatcccgtatccaaccagaaagactctgggaagttgctgccaacgaacagaaaaagaaacgagtctctgtggtttccgtctggggggcccccaggggaggcaacacggtccctcttccaccttaggcagatcgcggtgtttcttgtcggaaaactcacgtattttccgtcactgtgaacagaaagtgcagaaatcgtgcttgttctcggtcggccgtgctccggagactagaaaaacgacacaagaaggcgtgcgaaaatcgcgggattgcagacagcgccgcggtcactctcttcgcggaagcaaggggcgaaaggcaaatcttctcacggcgtgctggttgcttctgtcttctttgcgatttttggagagccgaagcagatagaggatttctttcccctttttgacgcatgacggggacactaaaatggaagggtcgtttcagttttccgctcccgttcttccacccccttgtgtaccaaatgtgtgcagaatcctccgtgtgccggcacgctctctctgctctggcacccgtgcacatttcacctctctgcctctccgttttccccagtttcctccctttcttgtctctgtttcccctttttggtctttgctaatctccacagcgtccctagcgcacaagatgggtccgttttttcgccggtttttcttcgggctttgagccacacgcgaaacgcgaggtttcccgatcctccacctactccgcatgacttgttttgaaatcctttttacgagtatctctcgccgttttcctgtttgacgcggcgcggtctttcctctggagtgcagagccagcctcgcgtcgaactccggcaagacactgcggaaaaacagagcctgatgtgcgtcgccacgcagaaactagcaaggcggacgctttggctttcccctcttctccgctcgtttccaaaccgtcgacctcggctgtttttcttcgcgaaaaacggaggttctgcgagcgccaggtcgccacacttctaggcgtcgttgtgcagctttccgctgtctttaccgcgagatttcatctccaaagcggttctctgctcaaaaagggattaagaaaactcgagggaaacgcaggagtatattctggagaaggcgcggcacggaagactcgtcaccgtcgccatgcgtcttcgctgacgcgaacactgttcatgtgtgttctgcgggccagtttggtcgctctgtttgtcagaaaagaaggcaacaa

SEQ ID NO: 980 - DNA, 2505 bp, Toxoplasma gondii
gaaaggaagcatcgcatctgtcacacgaggatcttgaacggtcgtcgcctggttgtccaagtaaacgggtcgcgatcccaccactgcttccccgccgctctcaaaggctccagatcccgaagaaggagaagaagaagaagaaggaggagaaggagaagaaggagaaggagaagaaggagaagaagaggatgacacggaagagaagggagcagctgcagacgcgaggaaaggggagaagaggtgcaagtcagaagcctgtgggtgttgccgtgaggcagagggcaggagcgcgggtgaagtagcgttccaggacctgcagaagggggagttttcttcggtgttgaacgtcgcgagcgtcgctgttcgacgttccctgtctgcgaggtcaggccgggacctcaaaggacctcggtgaagattaagaaagctccttgacgacgcgcgcaccgctgtcgtctggagagggacacaggacgcagtcgagaagagagacgagagaggagagaacgaagagcgagacgaaagagaagaagagcgcgaagagaacacagtgagaggcggaacggtggaaagagcatagcagcgacctctgcagggcggtgcggccgcgcaggcgactttcgcgagtcgactcatcttgcacgagagatccgcgggagctggaaaaatccaagaactcgggggaaaacggagaagttccgggaagtgagagggagggtgtgaacacacaaaaggcgcgaaggagtgacaaaaaaaagaaatgcagcgccaaaggagacacacgtctctgccttgttccgtcacttgtaggacaagaaagctactgaggtctctatagacacccgaagctgcgagcttctgctctctgcacaaaacaaacgaatccgtcgggaacgaagcgtcaaaggcgcgagaaaacgcgtttttcgtttctccggcaaaaaaacggggaaaagcggcgaatcgcagtaaagtcgacactgcgaaaaagtctgctggggtaaaacgagaagaccgtctgcgcgcgaggaagaggaaactttttgggtgcgagaaccgcgtcgcgatgcatgcaaaaacgtccacgagcggtgaaccccaagccgagaaggaaaacgatgttcgcagggtggagaagcgagcgcaaaattgcctttcttcagcgacatgcgcgacccgtgtcgcgctctccagacgtcccctccctcagctgcgcggagttccgcgttcgacgcgttttttacctctggactgtgtagaagaacgaaatggagggagacagaggtgaaacagaaaggaaaagaagagaaacgcaaggggatgacaagagaggcgaaggacacccttcaggttccgtcgtcgaatcaggccgaacactggggtacaactgatgcgtcagactcctgcggcttctcttgtgtaagaactggaaatgtcctgtggctcactgagacaccgtggctcgggcagagaccgcgacgacgcaaacttgggaaggtcgcatttctcgaccgcgaaatcctggaaaatatggcaaacagctctgcatgcacgatttacgctcgctgtttctcggacacaccgtctgcaaacaacgctcaaaaacacttgggtaggctgcggtaagttgcaggaaatgcgtttttgaagaagggagaacggcggtgattgaagcgggagaagaagaggtcaacatctgtgtatacgtaagaaagcgcggacagaaggaagctgctcgcggcagccgaaggcagagagaccgagtcgcgcacaccaggtttctgggcgaactcggctttacagacaccgcgccgagttgagaggaagacagaaaaaaaacggagagaacaaaagagatgcgcggcgaaaagctgactgtcggcagatcttccgcgagcgtcgtttttgccgcatctgcggagcgcgagaaagtgactgcggagacgacgcgagacagccgagtccgtgtcgctcgaattttttccaggtttgcatgcagcgaggggattgaggagcgctttccacgtccttttcgagaagaagcgcgaaaaggttggacaagtttccttgcaaagagccactgtgtgtctgagaaaacgcgtttttccgattcgtacttctggcgctccccctcccccactcgggtgcagatttgcagacccgcctctgccgttctcagctccattcgcggagagaattctgtctcggattcagtcgtcccagtggcattttcaatcttcagaagaagcgcactgtttctgcggaagaaggcgggcgtccgacgcacgcggagagctccgaaggagtgtctgctctggagagagagtgcatatttgccttcctttctctcgacgctgggtctctcgctcaggtcttcgctggtctcttcttttccgctgtctcttctgtcctaggcttctcccagaggcttcttccctctgtctcctccgctttgtcctctgcgcaaaattctctcgagctttgctcctctctccttttcaaaga

SEQ ID NO: 981 - DNA, 3076 bp, Toxoplasma gondii
acaaaaacagtcgaatcaagcaatcgtcactgtgtgaaaacaacagcgttaccgtcgtacccgtgatcctcgcgtttggtgggatgtacaaactgcctagctctcgaaaacgttgtgctgttaacaaaactcatccatgctgctttctcgaattgttcagcttctttcatctgtccgtacccccgctcaagataaagtgtatcgcgtggatgcatgcaagccactccacgagagaagttccctgttccacgaagacgcgacgcgagcccatcttacccgatcccgcaagtgctgctgaggcatccatgtaccgctcttcgatgcggtaacaaacgccacaagtagttaaaagattcatgattgtatggccatcgtcgtgggagcagtcgggaccaaggcagaagacactcactccgtgcccggactggcaagcgacattggggaggagacgtgcaatgcggcgatttccctcaactttctgtccatgtttttccttttcctctgtaacggtctccaccagttttgacagggaaacgccgatgctgattgaaatgatcaaatggtgagatccatcgattaccggtgcgaagctccgcacgaggtctagagcttccgttgcagttacagatatgaagatgatgtccatagggtctagctgaaaaggacgcccaggatattttaaaagcggcgagatatatacagaaaacacgaaattgtttccgagtcggtaccaccggcccagcttcacagagcctcttctgcatctcatgcacactgtagccagtgtttacacggcgtggagagtatgtacccgcggagctacagaacatgcacccaatttcgaggtggtggggctttcaacgtagttggcagaccaatggaagatcagacagacatagagagattagtattacctcttctagtgtgtgcaccgcgaggtatccattttcaatggcatggttcctcgcggcttcgttccgaacaagcatagtgatttccgacggtagcacacgcttggacgacgtgaaacctttggctagggcaaaagccattgtgcctgccccgataaaagctgaaaaataaagggagaagcactatcaagccataaagcgacccagtcaccgctcgcgacaaaatgagtcactcttgaagctcgatatcggatggtgctcttggcaagtcttggcgtggtattgcaattaacagcgacgggagaccgcagcttcaagtgtgagaacagtcaagcggccacgcgccggtgcatgaaaaactgcggcttaaccccccaatacctgtctttgcactcccggacctcgcggacgtttcctacccggaatgcatgtgcttaagaatgacatttgagccgggagtaacgaaccccctgcgtcgaatctttttctcaccaatttttttccgtatccgctccgtcatcctgttctcgtcctgctggcggtgcttgctcgccgctggagctagtgcgcaccacaaaaggcaaaaaaggtaaggcaaacactgtgacgagcgcgtcacgaccctcgaagcgtgcgaagagggttgaaatggcaacgtggtcgacgcctaccgcaacatttacgaggaggcgagggacagcctggttcttttttgtatacagcttttgaccctacgactgaacgatgactaggggaccggaatctcctctcaccacgcaaccgcttggcgttgccccaaagatgccgattgactgtcgttctcacatgagaaatacaccagcgaactagggtaagcatcagtgatagtgtttgagaaaggatggtgccgcaacacattttgctacttctcaaacaagtgactctcagccagcgcaatcgagacgcacaccaaccgccgcacacgagacgaaccaagtctcacagaaaccgctgcggcggtctacgaaagtggactacgagagagtgagttactaataaaacagcgatgagatgttgagggactcacaatacgccataaaggtactcttatacagtttcgtttgagtaatacacagcgggtgaccagctctttcgcggtagggacgtccttcatcggcgaggaatgacgacccaagcgcggcagtctcatgctactgtttcccgaggctattcacagacattcccgcaagtacacagcatagattcaatggacacaatcaaacgccgttttacttttcgtttaagaacctgaaatgtggtttcaaccttaatcgctagcgagaaaacgcactgtcggaaggcaccgccttcctaagtctgattggcggcgattgagaggtcgactcgacgctatgccagaggtcggaatggtctgcacgcgagaagctcatgcgcgttcgttacctctagcaatagtgagctttcttttcagacgagagaggattgccttcattgccaggtccttaactaaacactcgagcagtaggaatcaatggcttcgttgtaacttttccggaccgacccggcgggagtgggcaaacaaattcgtgcacgtcacactgttgggagacatatcagcaggcatgcagatgatcaagcgcgcgattccttaccctccggtttcatccaaagaaaaattccagcggtttatacggttgccctggcaacaatttttctctgggcactttctacagaatttcgacagactcgcttgcagccaacgtgacgggaagttccgtcgtcaaacgaatgtcgcatccgaaaaatcatagcttgtctcgatgtgtctgacctaccagacggtatcctttccaggaccaagtgtacattgtggaatgcccaacgtcatttttacgagttctcagagaaaccctttccttcaggtcaatgaaagcggctgtgttggcaaacaaacctatgcattgaacgcagagtttctctcaagccacgaggagggtgatacaggggttacccactacgacatccgttccgagaaaggagcgagattgccgacggttatacgggacaaacaactagattgggggaaactgcaaagggaatgatgtagacaggagccttgataataagctcaccgtcaaggctcacgcgtgcgctggtcctgtcaa

SEQ ID NO: 982 - DNA, 2403 bp, Toxoplasma gondii
caattgttgctgatgatgatgagcttcgctgcgaaaaacaaacagaagcgcggcaagcgttatgaagtctcgccaaaaagagagaactgcatgcagcctcgcctttcccgcagagtgtgccgctccggcgacggaaacaaagaggaagaaaagaaaaggtgcgacccgctcggagggggtggtgtctcctctcgctcgtttgacctctttcttccctcgcatttcttcttttctttccggcatgtctcgtctccttcaccctattctttcgtctctctcgaagacacaaacctaatagcttctccggtgcatgcctccacagcgagagaaagcaacctaactgggcattgccgcgtctcgagaaacagcggtagacaggatctccgagagaaggatccccttcgtcccttccctcgccctctgcacatgctccagagagagtctcccatctccgaagaccgctctctcttcctcgacccgctctgactaggagggaacagcagcacggagaagaagaactcaacagaaaagaaggaaaagagaacacaagaactgaggagagaatgggagagtctctcttccggagtgtgtgctccgcaggtcaacagcggacgcagataaaaagtcctggggtctccagagggaagagttctcgcgaataagcaaagcaggaagctgggaaagcgaaaagggagcgagagccttcttttcggggatagcgctgcttctctcgttggcgctccgcgcttgggagcgccccgtcagcggggccgaagaaaagactggccagatgggggaaacaagtgaactccacagagagaaaaagacgacattctctaaaattcctccctttcaaacgaaatttccctctcggcgcccgcctccggtctcgactcgggttcctcccccacacagggcgcggtgagagtacaggatcttgatgtttctcaattttctggagttctctgttcttcgccgacatcagagttctccgctctgctctctcgctctcacctttgccagtgcggagagcgtggatggccgtcttgcacccgaggttgactttgccgctcttcatgaccagctggaggcgggagttgatcccctcactgccggacttcttcgctttctttgccattttgaggaaaacgaaaacaggaaaacgcgcgaaactgacgggcctcgagtcccctgtccaacgcctcgcgagaaaccggaaagaaagtgaacaagagagcctgcgggcagcaaaccgggggaaggcgacttcgaatccgttgagaacagggtgtacatacaccgcgcgcgattctgtgtctcccgctcttcccctctctccgaaaaacgctcatgcggggcacactcttcgttctaaaagccgatagggaaaaagagtaataattgagagccgcccgccgcggtcctgtgtcggctaataaaacgctggccgcgcccgcctcgaagctaaaattgggggccctaatataagccgacaagcccagaactgcatgcacgggcacacggcacagtgagagcgatctcgagacacaccagtcagctggcctccacggcgcgtgcgcacggaagaagagtctcgagaaggagacttgcgaagagacggaaaaaaaggatacgtccatcgcagcattggaacgcagcttcatataggtctttgcgtatgaaacactgaagctggagttttcgcgcagagagacctgcgtgtagatacacctcaggatctcggtgtctcggcgagtcgcaaggttgcaagtgttttgccacgacgctgcattatggtttttagttggacgagggaacatcacacgtgagatgtgtcttgtctttctttttttctttgtggcttttctcgtgaaggaaaagcgacgctccagagaggcgaggaacctcgatctggcaagccccttgctattcgacccagtttacgtctactgttcgaaactttacgggaacatacacgaccgtcccccgccgctttcttcaaacgaataaggcgtctcacacagtttccagatcatccgggaggagacacgttttcgaaacgagcacgaagagcaaagcggcgaacatgcaagaagggaaaacggagtaacgcgcgaagcaacgcctcctctggcctctcaggcgtggacctcaggcgttctcatacacccggtccggaccggaaaagcgtcgcgcgaggctactcgtgtgcctgacctgtgaggctctttttttcgcgggagtttctttagggcgtcttcgagagagagcctcgcccttcgccattgaaacgcgaggccgcgggcgcggtacacaagatgacagagacaggaaaatgagatgcacaagtcgctgaccaaggccctctgcttcgttttgggcgcctcaaagcgcaaaccacca

SEQ ID NO: 983 - DNA, 2227 bp, Toxoplasma gondii
acaaatacatgaaacatcgcgtagacgtttgtcctttgattccacttggccctgaactcgtgttcttattgcccgcggaaagctttgcttttctacgctttgcatgccttccggagtcggcctgtgttccgaagggaggagagaagcgttcggcgtctaggagttgtgcggtctctcgcctgtgtgtattctcgaaggcaagcactctccctctgacctcttcttcgcccccctctctgtacgtcgttctttcttcttccgccgctcttctctctgtctctttcttcttcttcgtgtcatccccgttcttgtctttgcgcctcctctccctcgagtttcgttggctgcatgcacgcctaccgaagacgcgactccaccagatgaagaaggcgaaggcggcggcggaggtccaggcgttcccgaagaagaagaagcttcgattggcgaactgcgcctcccagaactgcttccacaccggctgtcggaggaagttggggggctcgaccacccagagaggctggagaatctccttcatcggcacattcctctccagcgtctttgcagcttccgccgccggcgccgccgcgttcagacgcggacgagagagacgcagaagcgacaggaaacgagaagaattcgcgaccggcgaggccaggcgacagccagcggtggccgcgaaggccggggagagccccatggtgcgagggacgcggagaagaagaaggcgaggacagagggggagattttacgaagagacagagagcgagggggagactacgaagaaggaacggagacagagagaagcctcgaggaggaggaagaacggcagaggtggacgaagcaacacacagaaggcgggagaagaaagagacggtcgaccggcggggcgagaggagagagaggcagcgcgcagggcgtcctctctcaggaagacggaggagaaaacaccgaagcgaggcaggaggaacgcgacctcgtccttctttccaccggactgccttccactccgaaagaagaaaagaaaatgtgaagaaagcgaggaaaacgggtcacctgaaacgatgcatgccctgtgctctcgcgtggattctctcaccggacgactttcgtctcgcgccgtggcgccaacgttcacacgcacactggaggaagaagttttttcaggcacccaggagacacccttcttccttctcgcttttctagcttcttctgcacctgcgacacaagtccttcgccttctgcttccttttggtctcgcgttttctacagtttttcgcgcccctgtctggcgagagtaacctcacatatagggcgtctggttttgtgcctctccgaaacggcctctctgtctccgtacctttgcgctcctccgctgatagaacgcatgcgctgttgccgctcggagctttttccgtcggtggctggtttggttgttgagacacaactcctcgcaactctctacagaagcggaagaaaaagccgaagaaaagacgaagaattgagatcctgaagcgttctggatctctgtctttctctgtttcctctttacacgtcgccacttgtccccaattcaacaagaaggccttcggattacctgtccggagcggtgtgcgagttacgctgtccacggtcactcctgcgtcgccgcaaatcttccctatttcttggttctttctctttaaaggtctctcctccgctcgaaaagctcgtcttcctggtgaccagcagagagcgaccgtctgcgtcgaacggacgcccgagacagcttctctcggagtcgcgccagacgcagaagattctggcagactcgacctcccgcctgttgaggcgcgcgttttccgcgggggggggggggggtcgcatttgcggctctttcgatcgacactagagtctggagacacacagacgcgaagtctagcgtttagcagcgcgtttttgaggctgaaacagagggaaaagcgcgcttgcgtcgagacaagctggcgccgtgaacctcacagtcgccgccttctcgtttgagcgaagaaaccgcgaacgcgagacgactgaaatcccgcgctttctgcacagacggaggcgcgcgcgcgcgagttgcgtctccgccaccggtgcactcaggagtcctccggagaaaattcacttggtgtcttcacccctttgcgttccgggtcgctctgactttttttgtctctttctcttcgcacacctttcaagttcccccacaaaa

SEQ ID NO: 984 - DNA, 4692 bp, Toxoplasma gondii
gactctgaacttgggttcgtctgtctcgttcctccttccgttatctcccgagcagctggtcgctgcggaggaagcggccaaggcggctggggaggcggaaggctcgggtgccaggcccagaaggaagtcctcgtcatcgtcgaaggagagaggcgcgagtcgggaggaggcgcgttcaggctcagaagcgtctgactgcgatccttcttctcccgaggaaggcgccttggcggcgatcccggtggtcttgtcggggacgcaccccgcgcgcgaggagacagaaacagacgagtgaggagactcagacggagaggaacgaagcggctgcggaccaaaggaggcgtcatcatctgaatcctcttcggctgtacaagaggtgggtcgacggaggcaccatttctccgctctgacaggcgaagaagtcgcagccgacgcgagcggctggggtccgaagtcctcatctgaatcctcgtcgctcggcgtctcggcggcgattcttcctcctttagttagagaggaaggaaatccagagtgacgggctcttcgaagagccgacggaccgaaggaagcgtcggcgtcgctctcgcggtcctctccagcttctccttcgtcgcccgctgagtcttcctcttccacaatgcgctgaacatgcgctgctcttgctcgcgctgcatcctcctcccgccgctccgcccgagttttgaactgacggcccacacggatggcgcgcatttcctcttcgtcactcgacatgttttcgaaaacgcggtggaaacagacgggaagacgggggtgcaggctagacggtgccctgcacgagggaaacgcagcacgtagacagcccacagaaactaggaacagaaagctggagcactttcttcgagaaacagacagaaaaccagcatagaccacgtgtaaagaaaacagaccgcaaccctggcggttcgaaaccgatgagacactaaaccgcgtcagccaaaacaatagctgcagactcgaccgcagacgggtttcaacgaagactttttcgcctccaggggcggacgaaaaacactccctatccgactgagttgtcacgttgcgggtccctcgaccctcgggagaaagagagatcacaccgcaaacggaaaacgcaggaacataaaaggggatgaagcaacgcgagaacgggtcctgactgtactgtctgcgaagaggaaagcgcacgtgacaacgaggaaattccttacagacacaagtgaaggctttaactttttgggctgtccagaacaggtcccgaaaatcgactgaacagcgctgtggcgggttgtttgcatgcacgcgtgagaagaggtctttggcacagcgcgtccagactatccgcgctcatcgattcttgggtctctcgcgacgcgaacaggtcctcttccagcagtcgcagccgctcacaggatgctgcaaacaccagcaggtcgtttcactagttcggtttacgcattagcgctacgtttctgcgcaggcgacctgacagtcgcccagaaaacgaaggagattgcacgggcgtccgttgttgatccttcgaacctttgcagacaacacgaaacgccgggagaaactgagacaacgcagcagatgaagacatcactcgcacagagacgatgctggagctgtcgccgttttaaccgatgcagaggcagcatgcatcatcaaacttaacgcagctgcggaactattccagtccttcggtgaacaagagaaatgttcatttgtggcaactcttgctctcttgagaaccggaggggggactcttgctattcctgttctgccaatgaatcacgcttgagagactgctagaggagaccttgcttcttgtccttctggcccacaatgtgctacacaaagtctcgagctgagacgaggtgccaatgtacaagtgccgtccaagtctttgaactggccgtaccggtgcaccgctgcaaacgttcgaggatggacagtcccttaccgtgtacctatataaaaggaaatggttttctcggacctagatgggcatgcgagtgaacttcaggcacgaaaattgtcatgatggtgacggccgctatccgttgactacatctgaaacagtggcgtcggcatgggttcattcatgtagttagcaaagaggggaaaaccagttctcgtgttgtcaataccaagtttcaacggattctgcggggcctcgtgacatcgccaactgtcgcaggtgatgcgaaccgtacccggggaaacacttacaacgttgtcgagcatagatgcttatatttggattttcctggaaaatgtcgtgggtgtgtattggtcagcacatatagagaagctggcgatctcgagcaagcttttttcttggtgttacagactcccgttcgtcattaccacgcccacgtttaaaatggaagctgcggaaacaaggcccccttcagaatattagaaagtcgatctctgtgtcctccgactcacgcagggttcagtggcttgcctgagcgcgaatggacaacgacacgcaaaaactgtacagctgaaatgctctgctcgttggtttttgtgaaaagcctgtagggtcttagctgttgttgcatgtggtaaccaaggctcgcgctgaagtgaacgtgctttccccacgtttgtctctttcaaactgagactttccaaaaaattcaaaaaccagcaccatgttcaagtgtgcaaacatccatgaacactacgttgacagcaggtcatcagcaccgaacttgccgtacaggcgtgctggtcgggttcatatttcctgcaaacgaccctttcttgggtgagaagaatcatgcgttcgtattatcgtaaactgcatcttttagagacacattcacagaagtctttagttgcttttcaggaacgttgagtgacctcccgttctctgtcgcagacaggggctcttgaatgcaacggtacaagctctaaggctgtaatcagaggacttcttggcgtaaactgaaaggagcccagaaagtacaaaacgtacaaggattaatgctgtccgtcggcgcatctgcgtggacactcagtctccagtcccatgcttggagtgttgagacgagcagcgcaacaagtgacgaatcctacgtacatgtacgccaaccagtgatgttcagtggtggcatctctactaggagctgctgcgatcctatgcggaacactcctcttgaattctcctttgacttcgagcaccttctttattctgcccgcagtttcccggtcccttgttttcgttaccacactaacttttgtcagctgcctgactgtgccaccactgctgccacagcatttttacgccaggaacatcctggtgggtttaagcggtaccgatgtttaagtacacaacagttgtgtgagcactgtttcctgctctggtttccattattaaatgttatttggccccggggttcccaacgctgtgtgttgcgccactttgtctctccgaacttgtgtaagaaaaatcttatccgggcaggcgtaaaacctttcattcgccacttccttcacaaatccttcccgtgtctcgcagacagaagcggcagcgaaggaagtgtcagattttgcccggcgaagcaacccgcgagagccgtttccctctgtgaaaaccacctcctgaaatctcgtgcgtgctctccgctgttgctttgcattgctttgcatcgggaccctttcgccttccactggggcgtccgggcctcttcttcgtccactttcttttccgcttggcactgttctgccggtctacactacgcttttttctgcgcgcctcgcacgcgcgttcctcggaaatcccggatcgacgaggagttgccccctgcgtgcacccgtgatccgttctgggtataccgggtctggaagtttatgcgggggcggtcttccgtctctccggtgggagacggcctgcgctgcgcccccatcgttgacctgtcgtgtctgtccgttttccgggcaggggcattctcagacttcttcgcctctccacagttcgttcctttttttctcggtttgcggattgcgaatggcccgtgtctgactcgcgggctgaagctgcgggatcttgatcgagagggcgacacgatcccgagcgtctccaacgcggccccgtcacacagagaagtcgaatgtggtatatggggtccgcgtggcggcacccagttcttcgctctcttgatctgtagcacaggcgcccaaagcgctctccaggtcgcaacctcagctccttttttctcgagagaaacaagtgcaagccggaagtcaggcgcctccggtggcactgctgatcgggctgcgccgccgaaaacagcgcctctccccccggccggagaaactcgacacgggaaggtcacggaatgacaaattcttgttcatgatgcaaaacgttgtttgaacggccttttctcttcagcgcattctttccagaagaggttgggtcgcctcgacggggcacagagggcccacccctgtgtttctgaaagatgatgaccgttttccgggtctgccgactgacagcgattcgccggtaaccgtctcctcgccctcctcccgccccgcgaagtcttgcaagaagaatgggagattgcctcatgggcgactgcctctctcttgtggacatcgctctcttcttccatttctgtctgtaggggcccatttctcgtttccccaaga

SEQ ID NO: 985 - DNA, 3300 bp, Toxoplasma gondii
tcgctctcctctttcttgccttgccctctcccatcgttcctttcctccctcttccctctctgttctcggtctcgtctttcgcctctccctgccttgtgccgcctacacgcggccgacgcctgcaaagacattcgcagagaatggcgcaagggcggccttctcttcgttcctgcaccttatctagagtaggcctgcgtctctttcgcgaggacgcctacctggtggagacgcgcaagatcctctgccgtaaagcctgcaccccagcagaatcggcagtccgtgaggagaagaaccaacgcccatgaatccccgtcctttcttgctccatcttctcccctctcgccttctctctcgccttctctctcgccttttctctcgccttctctctcgccttttggtgtgcttgtctcagaagcgaaactcagagatccaggtgtcacagaaggttcggctgacggctgagatgaagcgaaccgcgtttcgtcgacagccttttctactcggtccatgctcgcggccttctcacctgcagcgctcaggcgcgccttgagcaaccacggctgcgaggcgtctgcggcaagagaaaggccggacgaagcggagaggggaaagagagagagaaggaaagaagacaggaacgatggacgtcagcgcatgggcggaggaaggaggagggaagaatcgaacgaaatccgaatgagcgaacaaccagcgagaaggcgcaacggctcgcgcaggaagacacgcagacaccgtagcatagttagacagaaagcaggcattagaattggaaaagattcatcctgtaaggaaacgaaggagtgcatcatgccttctagagagaccccagtgtcgaggaaaacgtccaggagcgcgcgaagcgatctgggaacatgctccgggtgttctgtgcgaacgacaaaagcttctgcatgctcgttttttgctggttcgcatggagcctgcatcctgaaacgcaggttgtattttaagtatcgaaagaccccccaaatccctccaaaatggattgttcctgcgaagcaatcgagaaaaaatcacgagaactgggctccactcttgtccatagtgccgagttctggacctacctaggacccgccagggcatctgcgcgaaagagcgtccatcctgaaagacttcgtagagggcggctctgttgagaactctggcttgttctttcttttctctcacggacgtttcttgaccatttgtttcttgtctaaagggagacgctggagtcggttcttctggttcttctctccgactcgaaccttcttctctctctcgacaagcgcgacagcttcgcctgccttcttccttctgcctccctgctggcacctcttcttcgccttccacggacctcgtactgcctgtcagggagaccggggcgtcgccgagaacggcaaactgaggagaaacttcttccacgcgctgcgtaacgaagaaatcggcatcgccagcaagcgaacaagaaggcgaagacggtgacggtgacgatggtggaagcaaagaagagagagaacgagcaggacgggcagacgtcgacggagacgaggaagacgaaggacgagaagacgcagacgaagaaggaaccgaggacgaaccagcggaagagggagacaaggaagaggtcgaagaggaaggaaagcctgatacatccgagagcctgtcgtcctggaggaactgtcggggaaggcctcgccgtccacttccggcgccttcggcggtcatggtgaacggttcagggagaaaggaggagacgcgaaaaaggaaggaaaaggatgcagaacggagagcaacgcctcctcagtccgaggaaatcctccctccacgcatacgcgtgccgatctctacagatcgacatccgtacaaataaaaatatacatcgctatgtagagaaacaagcaaacgtacatgtatttgtggactttcgacgtatgaagatgcataaacgtacgtacttacacatgcaaaatgcatgaacaagtcgagacgacgcatgtatacaagcatggagagatgcgcgccacagtcggcttcagaaactttctccgagcgtcttttgttccgttttcgcgaaccgcgcctgcagcgactctcaagtgccgcgggagctgcagcgagcgagggccgtggagagtccttctccagtttttttttcgggggaatgtcgtttccgtcgcgtttttctgaaaggttttcctgagacgttcctccaagaagatgaagttgtgttacgtttatagcctgtgcaatcgcgggtgagtctccttctgcacagaaggcgcgactctgcgaggatggactccacgacagagagacgacgttttcgcggaaaaatcggaaaaactgaaatgttccaggaggagaagagttggagaagaagaagacaaggggagtcgaaacaggtttttagaaaaaaaactctttttccggccgcgtcgaggacggagagacgtcgattcatccagaaaaaagtcaaatccagagagagcatgaagtgacccccccccctcggggtatcgagacagctgagcacggtgaaagcctcgtcttcccctctcgcctttcttcctccttctcttcgtttctctgtctgttgaatggagtattgaatggagaacagatctcttttttctaggaaaaggcacaaaaggacatggctgcggctccctttctcgggaggtcagacaccctttgtcgcgggcagtgaaaatcgagcatgcaaccagcgaaggcaggtcttcttttttcagtgaggccgcgcgacaaaggatttttttcgaggaattcgtcttctctgccagaccattcttcgaaaagtcgtcttcttggccagcgaagaccgccttcctccccgcggtcgctgaaggcctttctggaaggttctctcggcccaatactttggccgctgtcgcggcttccatctcgccgcttctgaatttactttctagaaacagtcttctcgttgttcatgagcttgtctcaggagaccatctctcctgcgaattactcatgtagatattgtccgttgtgtttcctgtgtctcttcgtctccctctcggtatctctccgtcctcttctagtcgtctgtcaccaacttcttgcctcccctctccgtgtctcgcgttctttctccccgttctctccgacactgcccgccttttctgttcaccagcttccttcttcttgtccgctgtccttgagctccttctctcctctgttctcctgggcttttcttcctctcgcttctcttctgtttctctcttctcgctggaacga

SEQ ID NO: 986 - DNA, 2758 bp, Toxoplasma gondii
caaagaggacgcacagagcaggcatgatccgtcttcgctacacaattgacgaaatgaggacagaggcgaactcgattttccagacgaggcgtaatgtgtagtacagttccggcagtccggcgacggccattgggccagcctcttgtaggtttgtatgcgtaggccgtctggatcggcaaaatataaaaacgaccctatggttttcgctcttggtttgtatggtcgttgttggtctcctgtttcaatctggagctatgtgagtgaccattcggagccgaaggatttttccggagcatcgagcagtagtatcgcgccagcgaataggtttcccaacatgggagtgttgtcgtttctctttcatttgaaagaagcgtggtaacaaatgtgtaatctttacctgtttgaacccaaggagactcacaactatccacctggcggtggcaagcttcggcagaaatcaaccagcataggcaaacgggattgcatcgaatgatgcaaaaacacccgaaaacatagaacacttcacgcagcaaggactggcatgtgtgcccgttccgccggtcctgaagtttgtttcgtcttgttaaaaatgcgtagtcctctgtaggactgtgtgccgcaagagcggcctttctccccattggatccagagctttttgtttagaatcgttgtgactatctccctgacaaactggagcgaccaccggctgtagagcaggctccgaaagtcattcacgaggctgcgaatcccgtggagtgatgcaaaaacacgccgaatgtgtcggtcagagttttccacttcatggttcatccgcaagagaagtaacaaggtaggaaccgcgcctatcaaacccaacgatttgcaaggaaacgcgattgctttctctgttttagagtgtccggcttgtcacgcgggaatgcagtgtcagtgctacctgcgagaggtctgcatgacgaaacacgccctaaactccataacgaggaagaaccgcgaaccatcttgttatcgccatatccgtcttacgaagcgattcggggggcttgagatttgaatggggttctctctaacacagaaccaccggtacttcctagctgcagttccctctccggatccctcgtccttttcgtaggcaactttggcctttccactcttgtcactgtcaattcttcgcagtggctatcagactgcgaaacatgctgattgccctttgccagatatacagcagcgatctttttcagaaactcccacgaattctctcggtttcatctgcattttcccacgcgtcaggtcaacacctttcgtacgtaacagctcctgatacccagttgcaatcctgtggtgcctacattgaaaagggattctttacgtttttccctttctctgggttcctgcagtcgccttcgaacggaagcctgccgttacagtgaccatttgtttctgaccgaacaacgttcactgtgatgagggtacgatctggtgtgcttgtccacattgagtcggaaggctcgctcgcgtcttcgttgtgtctctcgcgtccaaacgtagagccttcgagtgtgagtagacatagggtctcttccagtaagggagtgtctcagatgaggccgtctaagccgttgctaaagcggtaacacaacacacaaaccccgagagatcgtcttcccccgacctcgctctgcgagcgctccccctctgagtaaacaagggaacaagatcaagcaacgggcatcgtttcccggttttttcttgcgtatctgcttggatttcccgtcaaacctggcatcctaacaccaacagagctccccgaggtgtcatgtcactcgaaatacgtttgcacagagtcgcgcgctgccttaattgttcagtcgtttctgcccgccctgtcgatgcccgcgccgacttcgctggctcctgtcaccgcgagttgctctgcaagtgccaccctctgttcattttcggctattcccttcccggttattcccgaggatcacgcggcggtaagagaaacgacatgaccgctcttgagagcgaaagctcgacttgctttttgtgtggctggcaggtgacggacgaacacaacacaggaatgtgacccggcactggctagctgtgcactgatcgcgcccgtctgtgtgaagggaggcaccacccgccggctcgcagcacggaagctgatggttgagggccggctgtggaacttgagcaacggtcggattcctctctgagacggctgtttcctttttcattcgcttttgcaccattcattccctttggcaactttgttgttcgcgttttgtgtggttcgtacccccgagagacacgttccggcttctgcagcgcgcacccccgttggcttgttcgttttcgcctgcatttctctgcaggcaaacttgaaggtaaactcttgtacgacttgtgcttttgcccgccagcagcattgtccgacacggtggtttccgggaaaattccgcgagcctctccactcggcaagtctttgagcaagcgcagtgtgtgtctgctgggctcacgtcgttcgcgtccgcacccccttcttccccttggacgtgcttcttttttcctttcctctaacgccttttctttcgtgtcttctctcgtcttctcgcgatacaccacggccgcatcgccccctttgctgtccgagtgtctaccgcagcaagaattcccgcgtgtctcccgttacgttcagcgttcttcctcaacgtttagaaacttcttcattccccgctctttccaaga

SEQ ID NO: 987 - DNA, 752 bp, Toxoplasma gondii
cacttgaaagcgtgtagctccgcgtatttgttaaggaggcatctggagggctttacatttcagctgtgatgctttcgccgcagtgaaattccgacgtcacactttctctggcagctcgaacaacgctgctctcgagctgagtggatcttttctccagtggatgcgcggcatggtaacagtaatggctaggatagggacagtaagagaagcggtgatggaggcaggggagaaacaccagttggcatttgatgagcagtacataggtgataacacgaaatggagagcaggttcgggccaatgacggtctttaggtggtggcacgcagagccttccggaggggagtactgaatcttgtgcaaataccaacagagaccgaaagttatagcttcctcaagcgagatagtcgactcatggcaaaggaaggcggacacatcagggcactggagtgatactcttggattttccctcggcacgctcggtcctagaacatttctcagtgccaaagaaaaggtctggaaaactcatcttcgtgctgcgatagatgcggcccgtgccatcgttcgtccttagctactatgaggctgatgctgacaaaacaattggcgaattagggttatgtcgtacaccgtaaagaagaatgacagtacacaagtttggctgtcgcatcacaaacaggtagagctctctttctgacttgcgctttgtgtctcttgggtactgccgacactttgatgtgcttgctcagcccttga

SEQ ID NO: 988 - DNA, 1316 bp, Toxoplasma gondii
ctttgatgtcatggcgcagtcacgcagctgagaaggctcagaccgaggcatctcccctcgcgttcgacccgcgcatgtctctctgcatggagatcgacacatgtccacgtcgaagtctatgcagagagagacaagaacgcatgcatgcatatatatatatatatatatatgcatatatatgcgtgacaaatatatatatatatatatatatacatatatatatatatatgtggacacatgtgtgtgtagacagacttcgacataccttattgaggattggaatgggtcccttgaatccgaggttttggtagacatttttgtaaattcttccgttgacttcgttctccgcaaaggcgcgcctcgctagccagtctttttgacagcggcggttgaaggaaggaaacgcgatggggggtggattcaacacaggcccaggattacgagctgccatcgtttagcgcaaggagaggaaaaaagagaggcaaatggagtgaaaaaaagagaagggggacagagcagaagaggaagaggagagagaggaagccgagaggagagacagggagacgaggagagacgaagcgaggaaaacaaagacaagtggagagaactggaggaagagaaagaagctcggaggaaagcaggggatgaatcagaggggaaacgcgtcgagactctctgtggagaccgcaggcggagctgctgctactgctgacggggagtgacggccagtgggtgaatttgacggcagagcagagaaaaagaggtcgttgtcttcaaggaaacgagcgaccgttcactggacaagaagaaaagaacaccttgaatgggagacggaaggaatgaagcgaaaatgaacacaaggaagtacagaggtattgcccggagccggactccagcagcacacacggttgagtttcgcttcttttcaagaggagttgagcaccggcagtcaagggaattgtcgaaatgtctctctttccgtgagagatgaagaaaacctggaaggcatgcggggtaattctcaagtccccgcttcccagagagctaccatttccagcgtcctgttgacacttgaacatgcatgcccgaaagcgcacatgcaaaggctggttgcgtcgagagacaccgtctagtcgcgtttcttctgttctgaggctgcttgctgtgaagggactttgaatgaggaaggagagaactaaaaaccgaggcaccttctgctctctttctcgagcgcggctcctctcccgtcagagaactgttcgctcttttgtctgtccgagacgagggagagagagagacaagctcttgtcttaata

SEQ ID NO: 989 - DNA, 2206 bp, Toxoplasma gondii
tttcgactgaaagaaacgggatacctgttccctttaaacatacatagacacatatgtgtttatatatatatatatatatatacaggtcgaaacatatatatacgtatatataattatataaacaatcatatatatatatatatatataagaatgttaatacatatataaatacatggatgcttatgcatatatatatatataaacaggagaccatataaagtgcctgtagtaagtgaatgtcaacgtggtactctgttcttgtgcctcctgatgagagactttgcgcttctccgggcgttttaggcagttgggggaagcggcgttcgtgctttgagatgatttgtgtagaaatgttctttttacttttttagagagaagaccaccagcatcagccttctagatcacgcacactgccctgaaggatcagaaacggaagtggaaatccgcatcaggaaaacatttacccgatgcagtcttgttgaaaacacgagagatacactccgatgacgcaaacaaagttttaaactgaaacaaacacaaacactctcagcaagaagcacggggaagacggagtgacatgcctgcagtcacatgtcacatgagtatgtatacatatttttatatccccctctatatgcctcggcgacagaagacgactgaacaccaacagagagcctcttaacaggagacacaaagaaaaacactagcacacatccatatatatatgcgtatgcgtagaacattatgcagatatccagatgttcaaagaaaggagaactgtgcatcgtgagcgtgtgacttttcagcgtatttgtagtcctatgcagtttcacacatgagcatatgcctaaatttccagacgcacggcaacacacacatggctgcatggatgtatatatatagtcaaatatagactttaggaaggggtattgatcagttttgtacacagaaatgtagacaaaagatatatatgtatatatatagacgagcaactgtaaatgcaggtatatattatcgatggatgtttggcagtaaggacctgttggaatttggggagcttgttttacagtgagatggttcttgctggtgagagagtgagagctgaacacggcgatgacgactctataggggatgccttttcgcgatattgggcctctgctttatgctcgccaaagatagcaggcgaaaagcatgcatgcgaagcgctgagcaacctttgcgaactgtcgctattacgccgcaggttgttggtgtgtcgcgacaggaatggagagctttttttgtttttctcatccgtgttcaaagtcacttttttttgggtgtatgcgctagccgtttgcgatcttctcggagaagctgttttcctgcttggtttctcccaggaagttgcagacactcgctgtggagaggcgcctgtctccaacgcagacttgctcgctcccgttttttcgcgtttttaccggcaagggaggtcttgcttctcctttgtcgtcttcgttagagcaacaatttgtcttgttttctcttttctctcattctttggcctttttggcggatccaaggtgtggaggatctcatcttcccaggcgctactcgcgatcgaacgttgggtgtctgtcttatacacccgggaaggaggtgacctggggactcgcgaaggcgcttttttactcgcaaatggcatagctggaggacacaaagcacaccttcgtttttctcgttttctgctgtttccgtcccaaaattcggcttccttgacaggagccctttcgcgtctctccgttcctcctcctcctccgcgccgagtctgccgaaaccgccgctttccactcccgcggcgcgtttcccgctgtctggttggctgtttccagcctttcaatctctgcctcgttcgccactctctttcctccccctcagcatcgctttcctctgctgcttcgccgcgctcggttggcactgcaccttgcagagtcgagtttatcgatcttccgcggcgccctctgtctcacctggtgggaggagagaagaggacagtgaggggcagcaagagatgccgcgggaaggagcgacggaaagtgaactgaagcagaggaagggggagggggagaagccgcagaagcagaggcgagagagaaggagacagagagctggaggaaggaaagcgcggaagcacatttcacccatctttgaggaagtctgctgcta

SEQ ID NO: 990 - DNA, 3024 bp, Toxoplasma gondii
gtcttcaatgagaagggtggtacgaaggaggctgatgagatgatcgacttcccagccttgtcttccttccggcttaaatacggctgtgagtctgtccggcatctcgtctgcttcgttgccctgtcctccacttcgaggcagtcctcgttcctcgcttcttttttccttatcacccttttcatctggtttctctccctccttttcgtccctacgagcagtatcttcctcttcctccgcgcctccgccgccttctctcccatctgtgtcaaccactattcgttctccccccgagtgcgctctttctggggaacggagcgtccttctgcaagagaggcagtcgtattttctggtggacgtctgctggtgtgtaggcgcggggaagtattcagatgatgccttcgatgcggcgaccagagagacctctcccccgctgaattctttctcattctccccattttgcacaaacgttttcccctccacgtatctaccgagtcgcttctcgcgctcagacttttctggatcagcgaggaaaggcgcgcgccggtacaaggcggggctcttgggctctctgtggctgccgagcggaagactgccaggcagcggtgtcgcgacctcagggaaataaaacagttctgggagattccatcggtacgcaaagcgcagacagtacaaacccagcgtacatacagggactcctagagcatcttggagctgctcttggacgcggcgggtcctcgcagtcgggcgtaggagtttttcttggtcttgccagcaggatttgaccctgtccagtctggatgtttcatttctgttttccgcatcttggccttccacaccatgctcctgttcagcgtgttccctttcaacttgagagttgagtcttgcctctccgggacccgcttcactccctccgtttccgctgcctgctgttttttctcctgcctcgcggtcctggacaggtggtttctggcctgcatgcatagggctgtctgtttttggcgagcgggttgcaagctaaaggtggaagccgccgaagaaacgaccaaccagcagacagtgaggaagtcgcctttctcgcgcgcttcacggggcttctggccagacacttcatagctccggaggacagggcgttgagtggcagtgcgggtaaaacgcatgaaggacaaagaatttgcgaggcgcccacttgtctcatattcttcgtgaatttccctggtcgaactgtcgcattttgactcgagggatgggccggagtacagagctcggacaactcgagcatgcgcgctctgattcgaatcgcggagaaatcgcagaaaacgcaaactcaaattcccctgaggcgcttcgcttgttcgctgcttcttcaaaatgtggagaaaaaccgcggtgggcggcaacacactcgcacgtcgctggcgaaaaatctgctggcgtcgtccgttgccctggagctcagacgagcgctcttggcaccggtgaaaacgcagtgtccgtttgaagcgggaaccggagagaagaaacgaggaaaaatccagaaaacgaccgatggcaaatggaaaaaagagtccggtgaaacggacaggaaggaacggcggcctgttctggagggtgtgtcttgcggtaaccccattcatggcattacgcagctgccggagcgcgcggcccccccatctcatattctgcttcccgttggtaacctcgctctcctacggacgggtccacatctgaaagcttgccgtcgtgtgctcaatgtgttgcttcgacaagtgtgaagacagccgaagatgacggtaaaagaattcagtcctctcgcgagcttgaccgagaatggtccctctcgcgcccaccatgcccggaagtcgccgggcagccaggccagatgcaaggcgcagataccccgtggagtcaagcatttgaagaattccactccacgcgaaagcgcgcctccagaacgcctgaggcttctagacaccgtaatgcgagtcgaatttcgcttgtcaacttcgacgacgaggaacgggcaactctgtgtcacttggctttccctctgcagccctacacagagcacgtcacgcgatttgctacctcagccaaagtctgcccagattcctcggtgagaagcgaaggtgctaccgcatcgtcgccgcgtctttcccgtcgagattttcggtggttcgcgggcgtttccccccgtacagggcagttgcaggcgatctgtcaacgagcctcagtttgtgtcttgtgtagagcttcgtccacagcgaagcgaaaatgccagtggagaaggcggcaaacgaaatctgcatgcgcatgcagctttctgggcaaaaggaatcgaagacacagcgtagtacgcggcatcgaagacgaggctacaacgtgggacccgcctgctccttccgagagcctggcatatttttcaccaacaagaagctttcgtctaggcggatatgaagttcctctacatgggggacgcgcagctggtgccgcatcctatgtttcaccgtcgctggagtatcgactctcaaccgcggtcccgagacgcggtttcttctgtctcttggcagtgctgcggagcgccttcgttgcacattaactttttcggcagtcgcattcgcacttacgcatccatacataggcgaaaaggaatgcatgcggacgcaggctcggtacgcccacgcgttcggcctctttgacgtgtggagacgtcattgccatcctactcaacacaacagtttgccgcgcagcaaatctgtagttgttccttagtgtctcttttttctcgtcttctgttgtacttcttcgacggcatctgcgccactggaaggcctctcgtaatcccacgtctcacctgtttgactccgtccatttccgggtgacaagaagcggacgattctcatcaccttctgtttccgtctttgttttcctttctcctaaccgttttcttctcctttcttccacgcattcttttctgtcctcgcttccgtcggcccgtgtgtgtgatccttgcccccatccgaacga

SEQ ID NO: 991 - DNA, 1734 bp, Toxoplasma gondii
cattagagtgtattcggtatatttcatgttgttgccggctcgaatgttctacttgtgttgctgtttggtggatcctatgcggccgtttgactctgaagctcgttcgtgcttctggtttgcttcccctctcctcgaccatttcagatgggatggctggaggcttttcgtcgttgccagtttgccccagctgcgtcaactcgacggcaagctcattacaccgagtgaaaggattgaagctgcgagacgcctgtcgtctttgaaatctcaactaaaggaaaaaatcaaagagaaacaggccagaccacaaagtaagcttggcgctaactgaagaggacttatataaatatatatatatatgtttgtcgtgacgtaatggggtaggaagctacagcaaaggagagaaagataaaaatatacaaaggtccccagagacacgatagtgttactgacaacatacagaatcaggtcgagcaatggaagaaccaagcaccggcgccagagattgaactcgcttggattgccgtagcgttttatgagttgatagcttggctctaaaaaaacaaggctgaaaaatggaaaaaaatgtctccaatttttgcctggcacagctccacttgtgcactttgcgttcccgaacaggtgaaacatcttcgactgcgtacaccacagaaaacagaaagaaaatgtaccttgagatggcgagggtgagcttgacccccgcgtcaggtcggggttacgttttaacttcgaacggcgatcacgtacaccgcagacgcaactgtagagtcgaaatgaagtacatgacgatcgtctgaggcctagcggcttctgtcacgagcgaatcattgcatataacgaccggtgtagaagattcacagaaggcagtcgcaaaaagctacgcagggtctgcacgatattgagaaatccatgatggtactcagaccttcaggaaaattgacaagtagcgactggttccacttgtcagaatcgtgactcgaatggtagtcagtggttgggtcgttcttgggttagagtaggatcttctcaggtactcaaggagatgctgtgccgcaagcaatacacatctaccttaaatagaatctcgacggtcataagttgcgtcaaatgatctaccgaaggtgcttaacaatcttaattacacaaacctgaacccatttcatacgagctgttcgatcacacctcgcatacgtgtacgtagcctatataaaactgtacatacgtatatatacatatatagagagagttcgcagaaaaggaattgcgttgatttaccgcgagcaaacgcggcatcatacaagctgcatggaatcatgagctctacggatttgcctcacagaaaagcagaattctgcgaagagatcagggggctagagtggtgatgcgtctgactctgtgcatgacaggagcgagaagaaaaggagaggaaagcaaacgaaggcaagaagaaggcaggtgcttcccgcttcacatctacacttcctttgcccggacagtctgccgccctgctggagcctcgaagatgcacaagcgaagctcttaaagccatattacctcagttccccgctgttttctgttcgtttgtacatctggacgcgacagataaaagagtcctgtaacgagatacagttatgaagagaaggacgccagtccccgggaaagaaacaagtacaccgtcctaaccagtcacattttttcatctcagccagtagagca

SEQ ID NO: 992 - DNA, 3920 bp, Toxoplasma gondii
ggagcctacgtgaaggaaaacaaagcactagacgacttcctttctggtcgttgtgtattactgctatggcacaagtcctcctctgcaatgtgcatgttttcggcaatcaggtttgaacgagaatttagaaggccacgacaaattcgtactccaacatctgaacccttggtaggacgcctctataatacggcgttcaaaacatactacccgccagattcggccctcattttgtttctattccggctgtctcggacacccatatagggagcgcagctcggtggagcgcgcacgttcacggcctacagggccgtgtgtacttgtgtccagtgaatgcggccgtgggtattcctgagctttcgacacatagacaaaatcgttgtccaacggggaatgtcaacgcagggccccgttaacacaaaacaagtgggctccgcgtttgtaaataactgggttctggtttggccccccacaacaggtatccaggtgtttgtctgtcgcgccaggttgacggttcaggcctggcgtaggcgggctttcttgtcactagaaatcatttcaaagttatctggaaaactaaaagtgcgctggccgtaggttttttgatatccagaagcatcatatctggcgctttggagaagcgtacgcctctccatctcagccgttcgtagggatgcggctgggcaggaacgattctttagcagatctgaagctgctaaacagtgctggtgtgcatcctcttttcctctcatctctatgtcttgccatcccgcgtgggcatgttcgtaactcacttcgtatatcatgaatgccgcttttcgtcatttaccgacactttcaaggacagccatgcgtaccagtgggatcaggcgtgcagggggacgaaattcgggctccctggacgacatgaggggttcgcatcatatggctaccatataaacatactgcttgggtagatccaggctcttcttaatctggaatatatgcacgtatgactgcatgagcttccttccccttcctccagtccgtctgtggcggggtacgggtagttcgctgatggaagtggtgacacagccgttagtaacggccgaagcgttaccacacagagccgttcttttgaaatatgttccggcgaagcatctgtgccgcatgacagcggcaaaagacacgtttgtaatgcattaagaacttcgtaaagtgactgaaccttttaatcaagctgtcagatagagcgaccagcagagtacgcagtaactgcagtggccagagctgtttgcaattacagctattgtcccacggccctcaacgcagaaaccgtcactgcacaccgtattccattcaagggccctcgaggatgtgccaactgcgctgtcaagcagcactgctgtcgtgcatccgcttttgcgcctaaacaccatcttcgatgagcatttcggccagcagggcttacgtgcagtgtaagatcagtcttcaacttacagcacaatcttgaactcgcagtagagtagcccgtgtttcgaagcccatagagtgccctccctccttccgaatcttcattccggtccaccatgcgggccagctgagcgaacaagccggagtatttattatgtaaagatcatccacaattgttaatagttcattcggctgtcgcgtaacacgaagtagtttctcctcgctgcaggacggcccacaccacagccctggaatgcgtttgagtcggccaacgccagcatctgaacaatttaatcagggcagtttccatgtccaacaagcgtcatttgttggatgttgctacatggaacctctggcatccacgagccgtaacacatgccccttggtgaatcgtgttaatcactgtcgcatccgcggacggcaacgccttcaaccaggagggcaatcacggctagcccacggtttgtacgcgtaattcaacggttgtgaccttggagccgcggacggctgctgcgggacgcagaggcgtgtttcaacaaccggcgttgaggtcgccgcgacgcagcagagctgttgcggggtcgcttccggacgaggtagtgcctccattgtcacttgacttggtcgccttcattttgtcgaccaatagtctgtcgtgagggcgagaccataggaaagttggagacgctcctgcaatcgtctttgtagggaaaggacgtgtttctcagtataaaaccacagatcgaccaccggtattctccttacgggctccactgttgcaggcgcgaagtatccgacgcttccgttgcttggcattctttagccactttgatggtgcattgcgtggactgtgatgattgagttgcctcatctgcatagcaatcatttaaggtgtgtccataaatttgtacacattgggagaacgaggacgtctcgagggttggagataagtgagtggtcaacggcaaacggggcgcgtcgtggccaatggcgtgccactgctgtctggaagtggtttgtgtgtcgcattcgcatccagttccttgagtagtcgttttctatctccgtatttgtgaagcggtgtagggctctttccgattgctcgggatgtgttgttgcgctgagcttcaagtgtgctagtttccttcgctgatgatgtctgaggcagttgaagttcaacttcgcatgaccagtggccaaccggactggcggcagagcggaccagctagcatcaccgctgtgtaaccgggcgttgtggctagccggagacaactgtcccccaatggtatgaaggtgcaagtaagggacgagcagccagtttcattcaaggcccgtatgggttatccgcctctgtgtaaacctttcttcgtagggttaagggcacgcgatttgtggtttagggttaccatgttatcatcgtgtagtgccgtcggttcaggattgaggcagataagaggggctatccacgacccgggcagggcctcggggaaggcctctgtcaacgcaactatctacgtaatctgtgggtcgtcaaataatgcaggtgctgtgatagtgtgtctcttccctgcgctgaagagattcccattgatccttgaagattatgctgtagtagagcttaatttccccgttcgctctacaattcatgggtttttggttttgggtgaccgacatgatgtgtgacacagcagaatggtcaccggtttgttcgtgaccgttgcggtcgtcgtttgagacggatgtagctgtcacgagcggatgcctgctttagcgtttttgcatttcttccgttaacgtgtgtgtcgcgactttaaaacggattgtggacgactccccttttgtcatatgtgacgtggatctgtgacatctggatggagggagggtgtggatagcactggatgctagcagccagcctcctcttctgaacaccctgtggatacaatctgaaaaagatgctcagataggtaaacctgcagacttgtctgtgaaccattaccatatgcagcaacgagtccccacaggcgtacttgatgcgttgtggttctgttagtgggcgaaaagctgctgcttcgatgtgcctggtatcaccagtgcagttatgagagagttgaggttccaggtgccccgctaagcaaccgagcaactagctgtaccgactccagctcatgcatacctgtgaagtccggtgacataatggacgctagaagggagggactagacctgatttccatcataccagcttgaccgtagaaacatccataaggtcaatgagcagtgcccctttcacgctgatccctcgccgtgcttgtccgtccagggcgacgaataccgcgtaagctctgcgatgtttatccattgctccgaatacaagacggaacgtttgcttaagtcacgtgtatgggagacattgacgcagcagctgcacgtgggccaccgcctggtaaccttgtgagtgacttcttcaccagaga

SEQ ID NO: 993 - DNA, 4873 bp, Toxoplasma gondii
tacggaagaaacgtctccaaacttggatgcgcgactgtgtagataaacgagagaaaccgtttcctcccctcttgtctggttcgctgtaggtgtccatacacgctgcttgtgccatctgttcactgcgtttgccacggggtcggcgttagaagtaattccaaccagaaccggtcttgcctcacattgttgacgcaacgcttcaagtctttccctcttccggttttctctacgagactcaagctggcaaatcgaccgatttcttcaggacacaccagtctcccccttgctgcccctccttcttttcactctttctgtcgttttcacatctggttcctcgaagtcgaaagggtaacgtgagcatgcacgacaaacgctgcgaagtcgagacccaccattgtggaaaccggagtttcacgaacaagtgacagaagcggaggctggctcgtaacggcctttctgtgtcagtgtttcagagttatgttcgcgtctcgaagggaagactgcgcatgcgcaggtgcggcgactcaacagagaagaaaaacagctcccactcgggagagacacactcaggggtgtcgaaggtctcgcaaggaaaccgaagtgcaaaaatagcaaaagaaatctccggaaaaaggaagagacgaagaacgcgcgacacgacaaagatgacaagcctaggagcaggaggaggtgcctggaaaaaatcgtgactatgggccttcggagttcgtgaaccacttaggaaacacgacggcaaatgaagaactggtaccactgtgtggagaattgaaacgaaacacgcacctggatatgaaaagtcacgaaaacgtccacgtgtgcacgtattgtgtacaggaatgcgtaccgtacacgaggctttctgtgttggatacgccagacatgcacgagaagacaatggagagacgctgggggacacagaactcactgagaaggattcaaagctgtctctgcaaacaggtggagaatttcccgtctctaaaaaagaaaagatctacgcacagaagcaggagcactgcattcacacagccgcacataaaccaacacacgcagagacgtcgctccaagagaatcgaagaaacgggaactccgaacgggttcgaaaaacacgagagcctccagcaagtcgaggaaaaacgtacactcaagaagagagaaatgacgcagaagaaagggaagaaaattcagaaggaactgtctaccgtccaggcaagtggcaaagcgtgaaagaacgcacttttgcccgacacactccccccaggcacagccgtccgaaaaagattccgagagggtgggcgcatgcaggttcacaacggctgaatggggcagccacgcatgcaacgttttgaaaacaagagttcgggtgaaacgggaaaactggaaggcacaacctttgttgggggctgtgtacaggtccgaaaggctcgttctacaagagtcggaggctccttacgcaagcaacccgatcccctcgtcagaagccatccttcggtgctttgcttggtatcgatgcgtgcactgtgttgaaggcggatgtcacgggtcgcggcagtcccgaaagtgttcaaggacgcgatttacaacgaaaaatgttcttctagcgaatgcacctacgatggaaaaagaggcagcggagtgacaatgagagcagccgactggtggagagaactcattttttatgagacagacacacgagagaatcataaggctcgcacgacgcctggcacgaactgcgcgcctcaaagtcaaacgccagaagaaagaatggaaattgtttctgtccgagatgaagcgatcaccgctttttgacatgagaacacgaacggcaagagccagaaaatcgcgcaagagcacgaagaaagtatcccgagcgtgtgtgaaagctcgaaagacttgactggaactacggtgtctcgttaccatggaggtgcttttcgacctggataggcggcacgcatttccgttattacgcatcaggcgttgtcccttagtcacatgttctccggagtagccaggttttcccaactcaacagtgcgagtttgcgcaccaagttcgctggtgttaaccgatctcttgtgcttgatcgcgtggaggcgacacgctctcaggaaaggacttctctgtgtattgctgtgagggcaccgattggaaggcttcatttaaatagttgcaccagcgataagggacacgtccttgtttgcgctgtacatgtggacatcattaatccttgtactgtccctggaatggctaaagaactgtcagcgtctaccgcaaagccaggaggcatgcaccctctctgttgcctatgcgagcgcggaatcactgagatcttaatgcagcgcaatgggtcaccttagggaaaaaaccaagcgctgattcctcctgcctctcacccgttcatcaagtgcgtgttccactctattactgcatttggtaaggccaattcttgcccctgaggtcgacaccatgtcacgtcacctgcattttgagcttcctaaagcttgtagttggttccccggaatcactcatttgtagcatgcaggccgttacaaagaaccgacgtagtcatcagctataccgtgtctggtggtgtatttcacagagaattcaggcctgattctttccgcaccttggatagccttgcacagttggtggggtcagataaagtgcgatagcaggaacgttaaacgagatccacaaaagtggaggattcacgagcatcagactcctgcagagaaaacacgtaagagttaatgccacggctgcgaggcgaattttaatccttcgctagcaaggagagaggaatgaaaaagttttgttcttttacaaagacgtcggcaaagacagcgatgcgcagggacgcggtattgtgtcacacgccacgggtttttcttttccctggaccgttgctatggattcaggcgtagaagtgcttctttggtgctgtacttccgagtaggcaacaggtttgagaggatgaatgcaggcatggatgccgcgtgtattgactcacatacagatgcagaagtaccgatgcagccgttgtgggtgccaacaataataattgtctctgttgcaacttaaaggtaaatggatttcacatccagacgagtacttcttactcggtgtatctgtgcctgctgcgatcaagacataaagctccactaaaacaatgaatggtagtagacacccgcgttacatcaaaggcacaaggcgactaatgcactgtagtgatgcgaagaaaccagcagcctaaaaagcgcagcaaaacgaactgtagaaaactgattctggcctaaaagaagcaggtgacatttaaagaaaacactcatcctccgcgatgcttgtgcttatgttttgacgaccgtccaaccaactggactgtcaagccttctgctacgttctttgtgtctgtatattcttcctgtgtcacacagttctggatcgcggatcatttgtacagaaatttcagtcgcaggtaaagttgtgccctcatggatgtcatcgacatggaattgacatttgtaggcgaaaaaaccaagtaagccgaagaactagcaaaagaggccaaggtaagacgtcgttacgtgccgtccgggtgacccgcctctcgaaaactgacacgaatgacacctcgatatcacgctctggctgtgaacgttggcagcgtaccgttacaaaatacccactcacccagtgaaaccataatgtgttgtctgagatttaccgaacggcggaaatatcaaaccagctacgactggcagctcttttctccttctttgttgcggaatcccgaggatgagccttccaggagcgcagtgaaactgtagacactagatctcctctgtctccaacaccgacgggcgaaacatcgtgactgaacattccgtaacagcgaagcgcctgacattatgtaagatcatagagatttgactagaaatgaaaagaaagaccggttaaaacatggttctcgaacctgctatgggccgccgttagcgaatggtgatgtgcgacacagcccagtcgaattaaccgacaatcatgacgtttctttggacaagacgaagctcggcaacgccagtaaaggaaactggcattgtatactagtaggctggaaacatggctttttcgaatcctcaccgaaaagccttggttaatttcgtcgacaactggcaacgggcaaccatggaggctagccgtacatgcggtgacggtgtctgcgtcgttaactgtcttgctcgagtcaagtggccaagtcgccgtaaatcttttgtagggaaacaaaccatatgcatacgtatatgtgaatgaatttgttccaggttcacttttaaagaggaccaagtttttcaaccaaaggacgggagtgacgctggaaactccagttgaagttgccctcttcataaagctggtgtcccgttccaagacgttccgtcgcctccagtcgcacgtttactcttcgccttctggcaccgcgaacatccctgacttcctccacaagttccatgtagcgcgctctgccatctggaggatgtttcgtaactggcttcgtcgccattgcgtttctgcaacaggatgccgcggagttgcaacaatctagcaatacttgggggctctatcgacgtcacatgcggatcccacacaaactccttgcatccatcaggttgaaaagagaaacaatttcagttgagttttttgcaagccactctcgtgtacctctgcttcaaagggtctggactcgaccatccgttacgaagatgatgcacagcagatgcggactgttgtctgacggccggtgaccctggtggcttactgttcacgtcgtgcatggtctggaaaatgtttcaaagaaaa

SEQ ID NO: 994 - DNA, 2037 bp, Toxoplasma gondii
gaatcacgacagtcaccgaagctgagacaatagaaagaccctttctcttttgtgcccccaaatgggcggtctctacagacagctaccacgcagcggagcatcgcgaggaccggaatccccaataagagaagaaagccttttcctctagacggctatcactgttgcatccgccggcgactataaccgtcactgtgcaaggcaacggagattccctctgtgcacactcctcaaagcactcgaagaaaaatcaagcctttctgggtatgtttcactgaggtgacttgcgggcactctcccagctaagtaacgtggtcaactcatctctaggaaacggaaaccgtgctctctgagactattttgcagcacacggggctgcgcgagacacagttccgtagtcgcgaatcccactgatgcaagggagacggaaatctccatgcatcgtctgttttatgttttgtctcaacgtcctgaaagttgacactgaaatagattaacttatattcgtgtccgaattttccccttcgcggcgagcggaacagcggcccctgcggcacatggaatgaatccattgttgccctctcacaattttcggactttcttcaactaataaattgtgacagaaatgacagagcacttaccgtcatagagacaagaagaggcaacgaaaccggcggagccaagaaggaccccagcgcggccgatggtcgtgaggagtctctctgccattttcgacgctgaaagaattcacgtgttgactcgaagagcgtgttagactgttgtccagtaaaagattcagaacgcgaacttcgtacagggacgaatcacacgacgacgcaaccgcacagttggattctcgcggcgacccagagttgagataggtgcgaaaattgagctccaaaagacagtagaaagtgccaaaccgagtgcaaggcaaaaactgcgagcgcggttcgttgtctactttcagaaaaaaaattcttcctaaaaagctccctccgcggacggatgcgtggcgtggagagacggaagtcttagcactggtacagacgcaaaatgcacgtaaagttggtgtctcaaaaaacgacaggtgaatggccgggggtgaagaaagaaacggactttctaagcaaaaagctgagaaagagggtgtgagatttactgttttcttgaaccgaggaggggaacagagggcggagcatgtgatgacgtctcgtcccgcacgcacggggaattgtcggggcgaccgcaatttcactgtttgtgtcacctaggaaatcttccagtctcctctccgttctaccgggtttgcgtgaatttaaagcccgttaaaccgaaacgtgtcttcttttttgcggcctgtcccacatgcgcagcagactaagccggctttgcctaaggcgcgttttcagcaaaatcgaaaagccgccgcggaagtgtgcgccttctgggttgaaggccgagttttacacctcagcaagtgccttctgtcttaaaataatcggtcgcatccaggcagaagtcccgatccgctctaaatccggctcgcctgcagctttgcccagtgtgtgtgtcgagagaacagggaaagtgtctaaaacaactaaatacaactgcgggctgtgaagacggcagagtctcgcagccggtgcccttgaatttctagactcgtctctgcgcgcaggccaccaacacgttggtgaccggaactccagcatctcgccccgttaatgcgccgccaccccggcacatcgcgtggaggcaactgcggaacagacccaaaatgttcctacgggtgctgcgggcgccgcacgggacgcgaacccaagacgccggctagtttagacgcgggtcagccctgaaccccggacccacggtgcgcggaaataccgacaacagtccacaaatctgcctgatcgcgcaacagccaccgtcattattcgtttaaccctgtttcagcggatttttttggtgtacgtacacgttgccctcgggcagagattcgcacctcctttccagctgcactctacactatcaaaa

SEQ ID NO: 995 - DNA, 2340 bp, Toxoplasma gondii
agagtccatattcaatttccctgtgtccaccagtaagcaactgcttatcgtagttcctgcaggtgaaaccggaggtacacatctgctctgatgaggggaaaaacctatcaacttcgtgacggaaacctgaaatttgggccatgaatgaacagaagaaaacccaacaaggaattgcggtatacagtcgatgcccacttacctggcgaggtatgagtgaatacgtgccaatgagaggcgggaaaagtcgagctcctaacaaaaacgcagcgaacccaatcccagcaagcgtgagttcacaatctcattcggtacaacatccttgccagactaacactgaagacgttattcacgagcaagttgggcttgaaagaacgcattacaatcctcggttcactgtctcatttcacagggaagtccgtttgcatgagtccatgtgcaaaatttgtctcgagccgctagcgagcccacgtcaagcggttttacctcctaaaagtgaagtctaaccaaacgcaccgtttccaccctgtcgcgtgtgcctccgtccgccacggtcacaacgttaccgacttctgtgtgctgagctcacctgggacggagaatccaagagagggtggttgatgtggctgatcccaagacgagaatagagcacgcgctgttgaagcggccaacttccgtatggccacgcaactgtaacaacgagtttcacgttgaattttaggagaaggttctcgtcgagtgcgtgcttcagggaccccacaaaaaggctacctttcgtcagagtgggtaccaaacccggaggatagatgtctgtgggacacttcggcatgagactgctagcgggtgctgaccctgctcggattcgctccgcggactgaagagtcactggccttccaacaaccatattgcgtactgtttcccacgtctcatccgcggatgtgttcaccgacgaagatactcctggtagtgaacctccaacggcagaagaagcactctgcattgacgccacggaggggcgcagagagccgcgggatgccaactgcgaattattcgaggtgccgaagccgttgcgcgataatgcagaaatgtacggtagccagatccacagtttcttatcctcagacccgcttgctccaccgtggtagaccgagacagggcggagggaagaaggtcccgaggaagaaacggccacctccatttaccgttacacaactgactggcttgaagcaggctgggacacaaaaacagaatgcagatacggctgtacagacgtgggaacgcttttgcatgaattgaaagagaggcacaataagaagaggtcactcaatcaagctggatcaccgcgtcactttgtgtcagcgcaagagggaggatgaaacgccggtcactttacacggttttcgttcttattaccatagcagcgaccttagctctttgtcaaaaaaaggctgtaatcacgacttcataatccccttgtaaaaaaatgacaccgggtcggcctcaaaaagagacgcgcagctctagtctcgtctctctattttgaaacagttctgcggccgcgggggattgagaacattcggccgaggcaagcatagtgtattaacgaacgggaggagagacacaaccagttagaaggcatgcaccgaattcgtcgcgaatatgttgccgtcttcctttcagttgatgcctcgacgggagtgcgttatcttcaacggtcgaacgctcactggaggtggaaaccgccgtcgagcgtccccaaagtatcaggctaccaacatgcgcaacgctgtgaatttctccttccttcgtttacgtacgtcggatcgcagaagtgatttgctttgaggcagtaggccaacagcgacatctcaccggatgcgacgcggtagagtcgccgtgtttgtgactgatgttgtcacaccctcttttattagccatttacaggaatctcacacgagacaacctgtcgatatcacgaattctcataaacaaggtagtcagaatttgtcacattgagacagctatgtcactttgatgaagtacggaagaacaggtccacactacggctcgcattgtgcctgtgcagaaccagagacgattgactctcttcccacttccccgcctttcgctgaaccttgcgaacagcctcgaccacgcagcactatttatcgcatcccgtggaccgcatcactcattacgggagttgtagggaagtctctgtggtggcgtatgctacaggtcttgtgtagataacgtgtgcaaccggaatcttttgctggaccccgtttccgtaagccaagccgtgcgacactttcgttcaaacatactggaacaggacattca

SEQ ID NO: 996 - DNA, 1831 bp, Toxoplasma gondii
ctttgcaaagcgtgcgacatcttcgggctaccacatgggcatctccacacctcctggtcccgatgcgtttccttcccacatgtatatatgtatatatatatatatatttatttatatatacatatttaactgtttatatatatatatatatatatttaactatttatacatatgcctatgtacgcgtgcgttgacttattcactatcttctggtgcacccttatatttctacacacaaatacacatataagtatatattcatatatatgtgaatatatatatatatatatatatatatatagttgtatgtttttttttgtttgtctacgtttttggtggcaggtgatggagaaggaggcgaacgcggatggcggtaagaatatttttttgctttcgttttcagtgagaaatcgggtattggtcaggaactggacgagaagtgccgaagaagccagcggagaagtgacccgggcgagcgatggggtgagagggcacagttttgagcagtagagtttttgtggaagtttgccgccccaggaagggcaggcgtttccacacttggacgccacttcgaaagttaaagttttgctgcaggagaaagaaacgctcgagaaaagtgagaaaagcggaagaagttggagaaagtcggcggccatgccagcagagctcgaggtcgcgggcgggacggtggcaagacaccgcccggcgaagaagaggcgttcctcgtttgcgagaaccccacagtttctttctggaaaaaacaacgcccgcgagagaagagcgatcccttcgttctaaccatgtgaaattcgagggaggccaacgcggagagacgttttcttcaaagcctgtcgattgagcaaagaagccgagaggtgggtggaccgctggacgcgactcgcgcaccctccccccttgtttcgcttcctcccaccggcgtttctctgtcttgacaaagaagaagcctctggcgcggaaggtctcgcgaattttgccttgccttcgacgaatttccttttttttacctgtggaagaagaggaaggaaccaacgccttctctgcgtctcgacctccaacccagtccaccctccacatatatctgtgggagcctccctatagaggtagctatatgcctcaccctctgtctccctggatgtccttctccgtctgcctctctcttttcaccctctctcactctgttcctctgtgaaggctctttctgcggttctcctcagctctcgacgccttcctctctctctgcaacttctcgctgccgtcctctgttgcaccgctttccgtgtgtcttgcctcctcctcctcctctcgcgtgacggagcgcgctctgccggttttgactctgtgaaggaagcttctctttcctggcgacatttgctgtttcctgtcctgcggtttctttgcctgcgcgaccccacggcccagaccaacagactcgctctccctccccgcctgctcgccctctctgcgtttctttcctgtctcctcctccgtctccctcccttcctccaccctcgagccgcttccttcttctctccctcttcttctctccctgctctcctcttctctgtctcttcctctctctccgtcccttcctcgccgacgctgcttcaccgatcgtcagctactggcgtctggtgcaaaggccgtcaagaggtcgcgccgacctgccctggacagagttccaccgttccgagcgcagcttttgcctggaaggagaagcgttcggactcgcgcgaatggaagagaccgtcttcttctccgtcgtgaaatcgcttgcacaagtctcggcccatcttcgtggacggcgcaacca

SEQ ID NO: 997 - DNA, 2929 bp, Toxoplasma gondii
acttcagtagtgggtaattttactatgcatatgtgtgtaatgtgctgtacagacgttccccaagcatacagcggcccgaacgtcggacaagcgaagagcggagagcaatgatcgcgaagtggaatgaggagcgcgaagaagcgaatggatgacgttagcattgtcccgaagtttccttttgagtaactgcatatttctgccttgtgctcttttctgaaaaacacctccttagccagaaacaattcactgatcgaggatgttgggcctttcagagtccatttgccaatcaccggctgtccgaaacttcagatagcggcgcgttatgttacacgcagcgcaggcgcaggggttgttgacatgttcagcctatttcgaagtcagcacatcgggctgattcattgatgatgcccatctcaccctcttgggcagacggaggagctctgagtgccacaaactgcgatgacacgcagtctaacaaatgccgcggcgatgttatatgactaaggaagcactgacgtttcaatacgattctcacgcgggacggtcatgtcaggggtggttaccttccactgcacttgaagcccaaagttaaagtaattacctcaacccttacgcgagaaagtgttggcaaggtgaagtagaattagagattagcttgcaggctcagggagggtattcagaagcacgtttgttctcacagagtccggacagtgagtagtaccagtgtgccggcagctagaaggtagagccgccctctctgatcgtagcattcatcctaccgcaacaaaaggacatcacattgcacggcctgcgctctagtgtagctgtcggttgccgcgaagtcgatcaccgcaggtagctggagctcagtttgcatccgtacggagtcgcacttttcataggggtccggtgtacggacagggcagacgcaagtccttcgctttgcgcatgggcgtgcaagggtcccagtcgttgacgttgtcgcatcggaaggattagtaagactggcgagaccatttttacgtcatgcgagatttcttgcaattaatcagcggcaggggcgtcggccctgccccgccgtcaaagacacaatccactagcgtcgaggagagcagctactcgaacgaagcacttcgcactggagtcgaaaaagtcgttttctttacgttttgtgcatcatctatgctggcactggctgcgcttggactggtaggcacgccgcagccgatgattttccccgtcggttgcacgagtttgactgcaggggataggacagttttctaccgtttgcgacgtctccatggccatatggaacctttgcaacgctggtaaaaggcgcagatgtggtactatatgaggcgttttatttcgaccttttgttcgtcagggatcctgtccatactcagtgtagcctccgtggcagcaatgtattatgacccacctgtgtttactagtaggcagttcaacaagaactgcacttgagggtctgcttcatctgcgtactgtcagttatttccagacttgtcacgaacgccgacttcgccgaagttgcccaacacggatccccagccctagtgatctttttcagtcttcttctgttgtgagcacttcaaaaagaactaaaaacggccgcccacaacatttgccccgcgcaggccactcctactattgatctggtgtatgcaaggtatatttccggattctcttcgggtcctcgtgtcctgttgacaccatcgtgttgccttcaggttacgtgggtattctcttttccttaacatgcaagagcactgcaccgcttctgttcgcgggtacagttgggaatatctgcctgtaagttcttcctgcaaaattagccgcttgagtcaagactaataccaagtattacagaacgatagcggctgttgctgtgggaggaatcttgatgactcactttattgggttgtcgagtggaaaaagtgtgtatgaagtcgttgtcacgaactttgcttgcgatcccttgtaacctttgtaaaccgggtacccttgtagtctaccaacgcggctgcatctccaaataacactttgaccccccgtgaagaggctgctccaaacctgactcgaagagcgttcaatgttgctggctacctaccagtgattgacgccgaaaacagcacagcagcgttcccccgtgagtgtcgcttagttcggtttaacgtggcccgcattcgtaagtgtggcgatattcccgcttacgccggcattgattgttctgtgtgactgctggaaccgacaacagaacgtggacacgtgaacacgacattcctgagcgctcgcattgtctcgtgccagccataggagcagtcggccggccacacatttcacaagaaatgtatgggaaacaaaaataggcggctctccccaagcgcaactcactttggttttgtcagctatggcgcgcttctacagagtaatgcagcacgtcagttcacccactcgaaccgaaagctgatatccacgatgacgaacgttcgagtggtttcgtgatacttttgtgacacgtgcgaagtccggcagcctgctggtccttggcagtggtgggtctggtgcccgctgttttcgacacgggaatcaaagaacaatgtactaaataaaacaacaaaaaactcacaaaagcaataactgaggggctcggacgcggaaagcgacaatgtatcgcatcgccggaatgttttgtttttgcttgttctttatgaaggcacacgcttctcacggcgtgctgcttttttcgccaactgaatcaaaaattgcgacgtgagattgacaaacgcttctttccgttgaatcgggtgtaattaattgcccgaacgtaggatagcaacgtcgcgcccgccaagaacttactcaagctttctttggatactggcaccataactacggcgcacaatcaaga

SEQ ID NO: 998 - DNA, 1580 bp, Toxoplasma gondii
gaagcgggtgaatgatgaaatgatgaagccgaagagggcgtggaacgcgggagacaagatatgcggggacatgcacagggcacggagcgcggagagcgactgtgaagcgcgcggggaagagaggagagagaggtgagagaggacaaagaagagagagaggagagagaggagagagaggagagaaaggagagagaggagagagaggagagaaaggagagagaggagagaaaggagacacacagcagagagcaagggagaaaggaggagggagaagacgaaccgcccgggtcgagtgcgtaggaagcgaagacgcagggggaggcgaggcgaggaacaaaggtttctggagggggagacggaaaggcaagagcggagagatagacggggaaagagggagacagaggaacaagaaagagagagaaaggcagcctgacacacccactcaagcgcatttgacaacgggaagcaggactcgctggaaagaggaagcacaaggagaggcgaagcaacggagaaacagtgaaaaggttcttactggagctccccatcgcgttcgtctcggcttcttcgagttttcatcagctcctgcctgctcctctctgagcttcgctgcccccacttggtcctgatgtccctccatgtcctttgtgttcgtttcgagagaaaagccgatgcgacgcctgtctcttcttctgcgcctcgctccttggtcctgaagggagacgacgcccgcgccgatctgcgcctcagctgccagacggcggagaggacgcaagggaagttttcttgcctctggatctcaaggcgacgcagtgaacacagagaaaagcagacacgaggcgaccgagagagagaaggagagggagacgacgactccaaggaagcgagaggagaaggaacgccggatgagagaactcgacgacagggagggccgcagaagaaactcttcagctttcctggaaacaaagagaccttctgcggcgaagaagaggccgaagcgcagcccaagagaaaaagctcccaagcgcgcagaagatgcaaacacagaacagaagaaagaggaaaggagcaagtggggagagcgaagacaaagcaaagacggggaggaggagacggaagagcccaaaggcgaggtcctcctcgagattcaggagagagaagaacaagtaacgacaaagacggcgagagaggaaggcaaagagaagcggcgatagaagcaagcggggagaagcagagagacggaagagaacagggaaggagaggtgaagcagagaaaggggaaggagaaggagacagaaagaaacaaggaggcaacgaagcagaggggaaaagagaggcaaagaagcagttgcgcttcttccgcgattcctcgtccaagagaaactttttagttggaaacaaagacgcagtgcaccccagagaggaagggggcgaaagtgcagactcgcagatcttctgcgggagactctgctggaaaatatgttgaaaaagaggacagagaattcgccttcgctgggaaacagatacggacccctcgccttcgtcgtctcttgcttttttctttagcggatgcgcttgca

SEQ ID NO: 999 - DNA, 2026 bp, Toxoplasma gondii
cgatcgctggaaaaatgcaacgttgcattaaggtttggtgcatcacacagagacaccgcgtcagcatgtgcagcaacaatgaggcatgaaacggcttcgattttcggatgccatggcaaggagacgcatcaacagccgagctacgacactgttcgactgaattgccctttccttaccgagtctgcggatatccctgacggtttcgtcgaacatctccttctctcttttcttttcctgttcttcgcgtttccttctgtctgcatcggccgaaacgacagcgctattcgtgccttgccctgccggtgaccgcccagactttgcgccaccaggaggagttccagtccgagagttgccgcttgaatggaaaccgctgtccttcttccctgagccgcgagcggcaaaccctccatgtgcatggctggagctgccacggggggtcgcagaagtgcggtcgcaggaaggaatttcctgaatttcctctccgaggaactcgaagccccacggcacggaacaggaaggtcgggtggagtcaggggaagaagccccagcagttgacgaggaatctcgaaagccgttttttcctcccctcgagcgcttctttggttgcaggtcacagtttgagggtgagacagagggcgaggcgcctacagatgagacagcactctcaactgaagtcgacgatcccttcttcttccttgtgctgcactcctgagtgtttcctgtcggtccgctgtcttggtgatcgacagccctcagtcctccttgagatgaaactcccgccctttctgaggcggactcggcactccggcggcgcttttttgtctcgctttcttctgaggcaacaacggcctgcgaagaagagcatgctgggacactctcctcttcgtcatctccccaaaatgccgcgcagatcgcccgcagcttcgcctccgcttgcgcctgtttctgctcctgcgcatctgcatctgcctccgcgactgaagcgacctcgccgctcttcgccttcttcaacttgacaggcacttcctttccggcaagttggccaccatttctcctccgtcttttctctatgttccgtgaatcggatgaaagcgccatcgacattcaagtagtaccggaactcactcgcggacggagggcgacacgctacaggctccctacccgagaagaggagacttcgacggttcagagagtgcctgctgcagtaacattcaaaaatcttacccatggagttctgctaaatgctacatgctttcaccacttggtttgtgcgtgtggcaactgccgtgttttctaagcaacatgcatgcagcgtgcatgcagccccagtcgaccgtcgaggtcgactcaacaaaaatctgcttcgattttcgccgggtgtggccaaaaccactgtcattgactgtgtcattgtccgtcttgtctgaatttcccatcctgatccattttcagacaagctgcacggacaggaaaactccgggcaggtcacgctcgcggaaatgtcagacagcgcatcgaacatctgacgcattgtgaccttttgttttgacgtttcaaccagctttctcttcctcctttctcttatcccggtcttgcatcttctttcattgcgtacaacccttctcaggacgctcatttcgtgcgtttttttcaaacgtcagctggaaataaccatgtgcatggtcgcctacgcggcagctcatcggtatcggcgcgcccttcttcctgtgttctgcacgccacgaaccattcatgtcctcgttgaaacgctaataactgcggcaagaacaaatattttggacaacctcgctggcagcactggatgcaagtggaagtctgcgtgtacatacacccgaaagttttcggcttccgtgaggtccgctcgtgccgacttctggagccaaccacttactttctccagttccgacgcatttttgcgcacaataggatgaatcctgcagacttaatcgttctgcctgcggactggcgctttttactcccggggttggcgattctgttccagcga

SEQ ID NO: 1000 - DNA, 4251 bp, Toxoplasma gondii
acttttaatttcagtgaacagcaacagggaatgcctggaacggtggtactgccttttcttgagagtttcctcgtgcttgtggcactaggcgaatctgcacgaaacgatcgggagagagcagtgtctttttggtgagtgaatgatgcggcttccttcagagagagacatcacatatgttcagaccatgaatgaggggtacctcatctgtagtacctgcttatgttcatacacatatagatgtagatatcatcagtccgtatctctacgtgcacctatcaaccctcgtacatacaaatatatactggtatgtacataaatgggcactactgattgggccaaacggagcatgtcactgtctgttctgtatggactgttcctactgttcaggatgacaaccccaaaggttcggggaacaagatgaggaacaaaggctaaaaaacagcggaaacgactgcttgttcccaaaaaatcggccttcgatatgcgcgaaagaaaggtgcactcgtagcggctcgaaactgtcgggacaaatcccggtgcagtggtcaccttcaggcaatgcgccactgtaatgctggaaaaccattttgcattttgctgtcagtgttccggtctggtatgtctgcccatacacatgcagctgttttggaatccgtctctatctgcctgtccacaaagttatgcatttaaatgcatactgcaactcgtggatcaacaggagttgtgctttttgtgaagcacccgttctgtcacatctgatgccttcatggagaggcagtggcccctgtcaaaacacggaccgtcagcgaaaccggtgatttggtgcggtgttgcggggcaatgcgtctatcggattaagcacgggcaaatccgttggcgccattacgtttccttacgcttggcaagcggcctagagcggcaacacacatctgaaacactttctccgtgactcaattctctgcgatgcttcccgtctctacacaactgccggctgcttttgtgtcgtctacactccagcgagatgttccccatcaagttcagctgtgtcactgaaggccctccagaaacgcaaacgtcctgcccccaaaaccggcactccccccacggatggaaacttaattttcgaatgtcaacacatgggagaacatctacactggccacatctggaatagctccgtggaagtacttgtgcgtcgcctccttttgtgtagcaagcgtgccacaaagcgtatcgttcagaactgcggcagccgacggggtgaaaaagacatgaatcacccctgtcgagttttcatgaagcacgcacctccggagcacgggtgtttgttcacagatgaaaacatgaagagaaaaactggataaaatgtatgcgggcgcgcgagatgtcgcgggagggctcagcttgtggtactgagggctgtctcctttaaagtaactgtcaacggaaggaaatgttttgctgtgacggtgcggttgtctcgcgtttgtcgcgctgttcgcttcctacgacggcgtgccggaggcatgggttccaaggtgtatgtgaaaaggtagatttccgcatatgtatacacatacatatatttacatttggttccgtattttaagccaaaaagtaagcgggcacttcgactgacatctcagttaaaaggaacgatctactacgagttcaccgagagccgctggacggaaaaggaattgtgcaagaagccacaggccaaagcctgaatcgccaaggactcctgggattcgtctcactgcaagctgtacacacacactgacggctatctgaatgtccacagatacgtcccttatgtcccattttacacggtctaaaatacagcaagtcacactcgatttcccgatcttgtacttttctgcgttaagaactatccatcccacggtttagagcataaatccccccacgctcgccaacgggaggccacagcgccgcctccctgcgataacctttgatcagtttataagccattcaactcggtttgcttcggctggtggttatgacagcaccgcccagggcacgttttctcacgtcaagaaattaagacctctcgcctcggattcgcctcgccagctgaatgtccttgggcatgatagtaacgcgcttcgcgtgaatcgcgcacagattggtgtcttcgaataatccaaccaagtacgcttccgccgcttcctgcagagcaaggattgcttgggactgaaatcgaagatccgtcttgaaatcctgggcaatctctcggaccaagcgctggaagggcaacttgcggatgaggagatccgtgctcttctgaaatttcctgatttcacgcagggccacggtaccgggtctgtatctgtgcggcttcttgataccgcctgacatcggagcgctcttccgcgctgccttcgatgccagctgcttcctaggagccttcccgcctgtcgatttacgtgcagtctgcttagttcgcgccatttctggtttgttttcgaaggcagaagtatcagggacgcccttgtgggttcgcaagattcggatcaacagcacggcggcaaaaagaaactacaagcgaaaacgtagggatcgctcaccaggaaatgccaaaaaaacagttcttctcagtaacgaaacagcgcagcgctcctcgacaatacggaagaaaacagggaaaacgtgcgatggcaaaaaactggcaggatgaccgttgttagcaactatgcaccgggactcgggaaacatcaacgaacgccgtagtcgacgagacaaagtcagagtgcgacagcggtggcgtaatcgagtttgcgttttaaaaatggacagaaagcaagtctacacaggaatgcacgtatgcaaggagactctacttgtccgcttcacccgccctctttcggttctttggtgagtgtttcggaaaagctacagaggagcgagcgcggctacgggttagggaagaggccttgcagaaggtggcgtctcagggtgtccaagctcgtcgactgggggacgcggacaccgaacaagcacccgccactggccttgttcgcttcgcgctggcattccgcatataaggtcggctctgtagctctttcctcggaaaagcgagacgggaactatgccgccattttccgaatgatgtagcccggggccaatcagcattttatttccttgagggagactttaagaaaggtggcttgggtgtcaagagttctaacgaacgcaagagagttgtgcttcaataatgctagatacagtcagagtgtgccctgcctcgtcgatggcggtagactttccatctgttgcagaaagagcactccaccgtgcttgttctcaggtagcaactgcttttgttggaggggggctgagtaagacgtgtgtgtctctcacaattcgctcctggctgccagctgatactcagagtgatgaggaaaaaacgacaaggatccgtgcgtcggggaaactctaagcactcgccacagttgccaccgctgacaggacacaagtgtctaaaatgcctctctccccgattgccctcgtgtttcacgtctaacggtaaactacatcggtgtttagggaccacggctaacaaacgcagcaataaatatgtatccatatatttgcgaggatacatgtaggaataggatgtgagtgcgacccacggtacctgacagacagacgtgaatttcagcgttgctgcaagaggggcgggggtcgttgcctagctgctttgccacctcgcatccgctatggcttgtcaggatcgaaacttaccacggcagtaatggattgcgttaaaaagtcgttatgaaacagctaactgaacagtcgtcaaaagtgaatgcctgaggctgaaaatttttccccggaactctttggactgcgggccgttcgagacaccgcgactgcggcgtcttgacaaggatagtgattggcgatcgctagccgggcacaggcatcgatctctgcagcattaaaagtgttttttactttagctgagttcttctgtgctggataccgaagatacactcatgaactctcgaccgatatgaagaaaaacagtaccggctacgttgtggcttgtacatcatgctgcactgtcagagcgtggtcttggaaacagaggcatgacttaagactaccactgtaatttggcaaaacagctgtctgtgctgcagattattgattgcgaaattttgctccaacacttagcctaagtctgcgaaaggccccccatgtagttgactatgcttttgccaaaa

SEQ ID NO: 1001 - DNA, 1517 bp, Toxoplasma gondii
catgggtgacagaacatatggaatgtgggttgaccacgaaagatgtcgatctcccgccgacactagataccgctaaacacggcctgtcgtgccggtgatatacagcgaaatatcagttcttcagtcccgcttctgcagacagaggatgtgcttcttgtgacatacagctcatgaaacttggtgaggtcaggcatacaaccagcagcatcactcgccaaaacctttctagacgaacgctgacatgctatttaccgtgcgtgttgcatcaccataattctctgcgttccgcaaccccgtatcatacagaacgcggcgcgattacctttgcacttctgctatcgcattccctgacatactatgacaagaaagccatccccgtatggccgtttatgtgtagtcaacgcatggtggggcgctagcacagcagcatccccgacgatcgtcctctcgcccctctatgggtcgctagctggcgcgtagaactgcgagtctccttcatttaccttcttcacacttcatatacggtttttcgccaccttccccactctcccaagccagctcaatcccgattcgattcttcgcctttcgaagtagagcttcttcgttaacgacgttcaggatgtttcttcttgaaagagaggccatccagtccctggggaatccacttccagcttcggatacgctcatcccgtaacagctccacattggcatgtttatcccaacggcattaaaacccatcttcttgccgcgcttcactcccccatcgcggatcctagagacaataacacgctcacaagctttcccttttcctatgggcttcagaaggagctcttggtcctcaccttctaccactgtaggacgcactgcatccccatcatctgaaacagctgccttttcaacgtatccacgtctgtcaggaggctcctcttcgtcgtggcgcttgccgtcagaagcctcctgttcgtagtatcgcccaccaacagaggcctgcgattcgctgccttcagcttcatcagaacgtggctgctctactatttgcccggccccgtcacccggttgctcatccaaatattcgctgccgtcactggaccgcacatgtacagatccgtccggcggctcgttgcaagtcccagcacattctctagcgttctctccagctgcttttttcgcttcgtcggcaggtcctgctgcctccagttcttcatctctactagaggaagctgccgttgtgtcgcctctgtcacgttgggcgtcgtcagcagcggacacgacgacacaccttggccagctaagtggagcttgactactgaagtgattcaactctgcatctgagatgatcgtccaggccacgagcaaaatgcgaagcgatgagggcttcatactgacagcgacccagaccaacaacgtttccttcttgccagcaaaaggcgatgatactcaacggtcagagagtcgaaaaaaccaagtatgtatcgagctcatcaaaactgtttgtactttcctcttccaacacagaa

SEQ ID NO: 1002 - DNA, 2118 bp, Toxoplasma gondii
gaaagacacccgctgcaggtgtgtcgctttctttcattcgccaggtgccgaaaacgcggcggtcactcaccagctgtacgtacaccgcaggtcgctctcctgcgtaggagtcgggttctgtggatctgtgtttccacgaggcaagaggaagtctcgttcttgttcgaggagaggcactctatcttctctcgtatgggcgggacgttgaaatctcgcatccatggggtatgtaaatcacgtttaaagtgtgaaagtgaaggggaagaaaacgtagagcaacacagagatctacgctccgagatgggatgcagctctgcgtgctctttctctctctgcggtagaacgctggaggcgtctatacacctgagccgggtcgcgggagaggcgctgaaggcgcgagtctcaaacgtctgtctgtgttggagtcgaaagtcaaacgaagcagcatactggaatgagtcttgcaaacaacttcaagtgtgaatgattttctttcacaaacgataacaactagtgtcggcgatcggctcttctgtcggaagacgcgtgctaacttccacattgctgctgtgatgtacgaacaccagcccacgcggtgtacagacgcctcattcacacgctacttaggagtacaagagtggctatgtgaatatgcacccataaccgtctctttctccagatatatatatatatatatatatatatgtttatatacgcacataagcatttcggaacggcaccgtatggccaattttgtcgctacgagggttttatcgaatgcagcgaattatggcatctttcaaaggcgagaagtgtcaggtatctcctatacatcttcgctgtcgagcgcttgcatctgagtttcagcctgacgaaagtccgatctggcacctacgcgaacggggaacgcaaatgctgaccgcgctggctgccaccacggctattttaggtgaacatacacctcagacctcgtgacaaagccatgcctctatgctgtctatgtccagaagacgcactttcacggacgactgcttgtcgtagctctgcggcagtctagtctcgagatccgcgagacaagcgccgccccgtctccgctctgtatgtgcacccgggcgacgataagtggaattcgagcgagaagacagagaaacgcgtagacgcagtgtgttgacactgcaagtggtcgatgtgacgacaagaagaattaagttgaactggatttttttttcaaaaagtctttgagtctgcccgtcagtaccagaacccctctccttcgatttcgcccgaatcggccgctggctgcatgcgtatgctggaacgctcgccgcagctttctcttttgctctccaactgatttacgccgcgtgctacatctgcccagttctctttctgtttaagtcctccaagtgtaattttagacgttggccctgcgatcatgtcaacggaacttcgcctgcagtctcttctttccgcgagcttagggccccacatgaagagggtcttgagaaattttacaatttagcttggcgctggagcggccgcaacaccgtggtttgtaaataaagtttccttttctggttttctttcattgaaaaacgaacttcttgctttttcgtttccccgcgcgaactccgcatttgcggtcaactctgcagagaagcgttcatccaagctgacgacttgaaaatagttgctcgctcctgctttcttctgcctccaatcacattccacgaagaacgtgtcaaatctctcccacaaacggccttgtttcgggctacgggagagcttcgaactcctctgctgtcttcggcggaacgtcgtcgatcgtgagtggctcgggcggttcccggtgactgttgcaagggcgtgaggagacaccacttcgtggacgtttttacctggaataagtcgagctgtatccggagcttgattgcctcttttacgcgtctccgagcttgcctctttccgaccgcacgaggagcagggaagactgcagagtgcagactctcagtcgtcacgaacttggagctcgcctctctgtgtctactccctctcaaaaccgctctgccgaaccgcagagggaaacggcaactgtcggggttgtgcactgagtgagaa

SEQ ID NO: 1003 - DNA, 1692 bp, Toxoplasma gondii
gcaaaaatgctcttacgcgccttcgagaacgacaatgactctttgccctgtgaggcgccgctcgcgcgtggacgcaatggcctctacagggcgcatgtaccctctcccctcggcgtccatttggaggcacgcgaggagtgaagacgggagaagaccgagcgggggctgaaggggagacgcggccgccgaaaagcagagagagaagagactgaaaagagattcgaagacgaaactctcttcagggtgtgaaaaatgttccgtgaagagggagaagcgagttcagattcctctttttcaagtggacagcgcgaagcgaggtcttccagggaggaaggaagaacaatgcgtggtggagaaaaggggagaaagagaggagatgagaaggcagaagaggaacggcttaaacacaagacaggaagaatccggaaactgtgcgaattcaagtccaggcgagacacgttgaaaagaatgcaatcgaatgaagctgcggaagtcaacggtgagggcaggacggctacgggaggcagacagagaacggattggctacggcgtcaagagaaagagaaaaaagagaagaactctcgagcctccgtagagtttgtgaaaaagagaaacgttttctgcaggggggaaaaacgactcaatgtacaacgcgaaaggaaaagtcgcctcgggtgtacatacgcctgtgagatcagcagcatgcgctgctcctgaagactctggagcatctgctggcaactggttgttgagatgaagcgcaagactaagaatgacgcttccccttttcagacgactttctgaggaagagatagaccgtgtcgtttggaaggaagagattttttcactgttttcacatcgtcgcatgcagcgactcgttgcatgcagatgaccgcaaaaaggcttaaaagccacatgcggatcgcggcgcgatcgttgtggggctggcagactcttcattgttttttctttttctcttgttcaagctgcaatgccatggcgaggctctgttgactttcgctcttctccttttacaaggagagttgaagaggaattttctcgcgcttctttcttccctctcgcctgcgcctctcgctcaagcgcggcgacaaatcaccagagcgcgcgactgttctccctgcagcgaaggaagatgcggctcttgaactgttaaaaaagagttaggtacttattttcctttttcttcttttctcccatcgcttccctgctgctcttctctcccgtttgtccgtggcgttccctttttttcgtccaattatttttcttccttcttttgtctccgtttttatcatccttttctcgttttctccgtcccgtttccgccagcgtcggtggctctcttcgacgttccgcgagaccttctcgctctgaacagagaagacgaaggaagacctgcaatgcagagggcgacgaactcgataaccgcgtcgacagaggagggatgagctccctttccgtcgaaagcagagagttggcgtttctccaactctgaaacgtcgcggcactacctcactctcacctcccagagtctctcgatcttcgagaatctttccatctttttttaaagtctctgcatcttttagactctctcaggaccttatcgttcgttcgaatcctcctcgcctttccagcagcttcctctcgtccaggttctccaactgtcagacaaga

SEQ ID NO: 1004 - DNA, 2227 bp, Toxoplasma gondii
aaggaacggattttcaccggcgaagaaatcggagtgaaaaagagcactccaccaccctcctccgattccccagtgccatgcgactcgtcgctgacgccactgtcgctcctgcgccgcgccgaattcgctggaagtgaaagcacccaaccctgtggcatgcacgcgcctgcagaaacgggggcttcttcttgagaccgttccagtttccaattttctgcgtcttcatcctgcacggcagtctccctgaagcgcctcgaacggagagcttcggtcacgggtggaggattcaaagtcggagtgccatttggaggcgggttggagtacacatctcgctgggatccagcaggcccggaactcggtgacgaggcatagccattgagagatggagcatctggcggagattctgcgcacttcacagcgtgggcggcaccaagtggagacgagcgcacaagcaccgaaggctgggcatacacccgcggcacgggcgcccgtctgagagcctcctggatggggtgcgaagacgcaagaagcgacgcagcctgagaggcagcctgcagctgcccatttgcgttcgtgttggaagactgaccgcggctgctgatcgtgctgtatggggcggaagaaaccacaaaggacgccggcgaaagggtgtctacccagctggctcccgcccccgtgtcgttgctgctgcagggcattagaaacgcgagaaaaaacggcgggtgcggggttccccttggagcggagacagcagcttcgaatattgagagctagtgacttgtttcgaagtggcggtcaagtcgtgagttgttagaggtgtcgacggttcaggggttcgcgagtggcagtggcgccttggaagacagggcttcgacgcggcctccgtagggacgaacgcaacgattgaggtggagaagaacagacgtaatagaaagagacgtctgagtacagttttcttgaaaagggcatgaagaaacgctgaacgaaacgcgagagtgaaccgcgtggcggatgacctagaattcgacgcgcggtgctgggaactccggaacagccatatcgtggcaggtcggaatacttccacaggaggaagacatttgatttgtgtcaagcgaaaaacatataagaggattgaagtgaagcgaacgaaatggcaagtgactggagcgcttgactcaaacgccacatcttactcggcggaaatcgcaacagtcgctgccacggcaccccaggtgacggactctgttcttttgcagtccgccgagcggactgaggatatctttcgagaaaacgatgaacggagctggtcgcaacaggaaggcaacctggcaaatgcattggaataatagtcacgagcttgacttccgcgaagatcccaggactttgccgacgaatggcaaaaaacgaacacttctggtatggcacatgcagcaccgtggacacgctcgctggccggaaaacgactcaaaaaccaacgcaaactgaacgcacagatctcggaaacagaaaaacagggcactccgtgccagaattcaacacacaatagaaaacagtgatatctgttcctgcacggtttcccttcagacgagagactgtgaagcgggaaaagataagaaaagattcaatttattgtactcaacgttatattcgctcccgaatataagccgcggcattggtactgaccaagaaaacccaactgagaacaacgccgagaattgactcatgcaaattcgcggtttacattgactctcacccttctattccaccgattcctcggctggcctagcgtgttcactctgacgtctagatggtgtgatggccagatttgcgtggacagaacttcaagggagagtgcactcttagatcgctggcgttcatgcgtgaaacatcttctgcagcagacatgaccgttttcatgtcacatgacagggccgtaaatccacatcaaatgaaagcgcgtacaataattgatcttcgttgtgagcttcgtgagtggaatcgacgcgaacagctgcgccatcactagtgcaactcgagaaactctcgtccctgctctgccacaaactgcactcgaatgagttctttttctctctgcatcacatgcatctacacatgtagcaacgcccactcgctaaacatcagtcgcttcgagcccagatagtcgagctttaagtcatgctccggcacctttggtacggagtacgtacatcatttggataacaacaaa

SEQ ID NO: 1005 - DNA, 1884 bp, Toxoplasma gondii
aacagaaatccatacgtactcggccgacaacacacggatgcaaaacaatctcctctgccgtcaacaagtatcttacatatacacacatacatgtgtgtattcgtacacgggcatatatatacgtgtaatttgtatttaaaggtacagttatttatatggagtcaacccccaaggcaagcgcgctgggtcgtttttcctcgggattggagtcttgtatcgtttttcgatacatctctgttcctgccttttgtgtggcgttctgtggtcgccctctaaatgtataacggggtgtcagctcagatacagagacgtatgtttcttttaaagctcgttgatttgctatgctttcagttcctgtcttcctgaactcagctcatcagtgatgaagtccgaagctggaactggggttttcgaccagagaagtaagacttgtttccgccgggataccctgcctttgagagaaaccaggtgtgaccatctccggtgttgctgacactgctagtaaaggcgaagaaccgtttattctatcagtagttacgcgagaagctgactccgtttgccgtgacccgaaaacgcgtgttttactgcgttccctccgcggatctgtgctctgtttgtggaacatatcatcacttctcttgtttttcccacagaaacacaagtcctgaaaaccaaggtctctttccactgaaacagaagctctggtgactgctcggtggcaccccggaaagcaccgcaggtgtatgcacagctgggcggcatcgatctagggcaacaacttcgctgtgtttctgcatcgctttttgggagaaactcctacggaaagaacgcgtggacgcgggagtgaaagaaggaggaagaaagcacgattgagaaagaactggttctccatggctttgctccattggtgtcattttaaaagtgtcacaagccgcgttttccgtcgccatcggcgcttctggcggccgacacaggcggtgcatagaagagtggaatgccctttctgtatcttcgaggtttcggaaagttttcaagctgctgtgaatgcgaagacatgcagcaaataccgatcatcatcaactttgatgcacagatggacgtaatccgtccagccgcacggtgcagtgctagcctgaatccacgtgggttttcaggcacttgactcttgactttttaacactaagggcgttgtccgtaaaaaaccgtttcaagtcgccaaacgaggagtaatttatcctcgggaaaggctccctgatttcgactttcgctgcgtgtttgaactgcatgcaaaaatggccgcgaatctgaggccgagacacgccgtcgctttcgcattctgcttctgccttcgttgcctttttttcgcttcctttgcatttcttgagcgcacactgccgatgttcgacgacagctgtttttctccgcgaagttttccaagaatctctttgctcgccaggaggagctcgacggacgtggtgggtcactcgtttccgcaaagttccctgaattcgttttgaagcttcaaacctcagtgtagaattatacttgtttattcgcgttttcaccagcatacctaagggggatgtgtgattgttggactcgcatgtgcgtccctgcgtgtatctccagattcctggtcaatcggcttttgtgtatctgtgtctacgctgtaggtacgggagtcacatgtcgtcgtgtgtgacgcaaactggatttctttttcccctcagtcttctcgattttcagtgcggctgcagggtctccttgcgctccgagtcggtgagctgtcgctgcactacgaggccctctccgtcttcgagtcagctacgccccgtcccatccgtcgccttcttcctcttctttcctttcagcagggcagcgcca

SEQ ID NO: 1006 - DNA, 4928 bp, Toxoplasma gondii
gtctgcctgtgcaggtctcgacgaagtcgaagaagtagctggacctggggactcagcatttcctgttgaaggcggaagagagcagacgagaaacggagaggcaggtgggctcctctcttcgtcagaatcggacaaagaagagaaaccacgcgacctgtgcatgcaggagccggactgccctcgctgttctctccaccttgccgcatttccattgaaaaggcaggaagcaaagggcaacgctccaaaagaaggaggggcagagtctgcagcggtcgacgagcgagggaaaggagagaagagagaggaggaagcggcagggtcacacggcgagagacaccaggctgcctcgctgggaacagttttggaggcggctgcatgctctgttttctggagagttccagagtaaagtgaagttgtccgcctattctctccgagactctgtctccctcgaggaagactgtcggtgaaaatgtgcgattcaggaggcaactctactctcttcgtgtcgccatctgccttttcagggatgtccttctctttccatttcttctttgagacgttctctgcttcatcgtggctgatatcttctgcaccttttctcctttccccggcagtgctgtggtaccctgcagcagtttcaccgcagcatagagaccccaagccttgcggggacggcggaggcagggcgagcggcgcgtctgagcctagaggactctgcctcccctcggtttccctactgatgaaagcaggccgagcttcggtgtccatgctggcttctaagagagaagtcgtttccctcgatttcctggaaaaacgaaaaggaaaacctacatgataagcagtccactgattcggaaaaaaaagacatgcgtggcaagtgactagtgcttctgcagaaacgacttcgattcggagctgggtagctcaaagcgagttgggaaaagccactagcctagtgaaggatatcgagttttctctaatttctttacttctcaatcaagcgagcagccgttgccagctcgcacgctcggccgtgccgactttcagagccccaggatttaccctggtacaaagaagtaactccatttgtgcagaagctgagcaggtatgtattcactctgatactctcttttctggagaccatctgtagggaagacacggatgcttgtcggggtagacaacaagtgactttctgtcgccgcatgcctctcgacattctttcgtcatctgcatgcaccgcagagacgatctgacacgctgaagagaaagtcgacgcgaccgctggatacttcgctagaaagccgctggtgtttcaatgtgaagagcgtggaagttccgctttccttgggagcgccagacgtattccttttcgggggaggcgaaacatgcctcgcgaggctgagaaaaaactacatgcgtcgcttgctcgagaccctgactggtcaccgatgattccgcagagtttctaccgctaaaacataggacgcaccctcttccctgaagttctgggaacgaggccgtctccagtataagcaaacggaaaggagatttccggcagagagaaatcggaaaagaaggaacgggaagaaaaaacagagtcacaacctcaggaaggtgtgaccctcagaacccggtgacgggactgtctccgttgacttttacccctcaaagactgggacaggaggccacctgaagtacagcgaactacatgtttcgcgttttttaccagccttttcaagctttcgaatattcctttcgatggaaagtaggtgcgggaaatcggattctcttttgaagcttcttttgtgtcaacaaccacgtgcatcttcgtcgccgtccgccgggtccccagtgagtccccccgaacgggctgtacgcacgcaagacacgggtctctgtgcagagcgtcgagagggaaagaagagggcacgatctgcaggtcgacaaggagtactttgatgggggaaaacacggataaaaagttggaaaaaacgatcagttcgaacctcgtgaaaaaaagctgagattggactgcacgggtgtcactgtgcgggagggctgggaccgtgaacacccgtgtgtagtcttgctggattttgagagtttgttccctagggaattctttcttctcagacagcgaaagcagaacagctcctcctttcgggtcaactgatatgttgatcgcgagaggcgcgcgccccgtctctgcgccgcttgtgcattccctattagccttctagatctttcagcagttggatttcaatatcctaagacattaaggttacttcacatcagttatgctctaggcgtaacacatggattattgctgtcactctttcagggttgaactgtgtaaatatcagtgtgttctggtcctaccgcccactccgacttcgctgaatccgccgcttcgactccgaccgcgagtcccgaatccatccgctcccgaacaactctgtccacttttgtcagcaaaaacgaagttaacgtgaagtttttaaacttccaccgcaaagagggtcttctcacaaggccgccagaacctgcgggtgtctctccagcagccctgagaggccccgacggctcccttggtcagtccggcgacgtcgcccgctgaagtctcgtagctgcattactggttgttcgcgcagggatgtccgccaagtgcatgcaagagatagaagaggcgataagtgaggcaaggcggttggaagcgttggcatttttctgggaacaacagcaggcgtctccccgcaagcagcgagttgggagagaaagaccagaggggatacgaaacgaaggcaaaaactctcgccccgcgttcactaggtctgtgcacttttggagctgtttcgactggaaaaacgcccactcaaggccaagcgaatagaggaaaggggtcagttgaccaacagcacaggtgcttttccgaaacacacggcgcatgtcacgtacctggagcagctggggagtgaggcatgccaagagttgcctccactggaacaccaggcgcgcgagagtagaaagcaaagaaaccggcaacgcagcggcgaagaaggagataaagagacccgcgaacgtgagaaccaagaccggcagaagaacgagaagttggaaaagccgtggctctagagcgtccagcggtcattaatcgacctcgcttggagggtggcagggcccaactgacggttctcagccgaaacgaaaacagacgtggtgacaccaggtggccaacgataacaagaagtctgccctcaaaggagtcgactggacactccagcgcaaggcgctcggctagcggcgagtgaaaggctcctggcgcaggcattacgttgaccgtcatgtaacgcagagccagattaaaggctccgacgttggagaagaagcgaaagttgtagacttcgtcggcgctgtagacacacttttgcatcttttgcaagaaggggaaccgaagttgcacgtccgctgagagcagctcacagccgggttccagtgacgactaatgtgttcttaagaaggcaaagaaacgtacaagaggctgaaagcgatcagacgcgagagacggccgttaccatgactacgaaggatgtgacctaaattgttagttgacgaccatggctgtgattagcggcggttcttttctgtgtttcctggccacagaagcaccattcgtagtgcatctaccatgactgtataatcccacttcaacgcatcaccgactttccttggttcttcagaatcgcgtcttttggaggctttctggaccgcagtgttcatcaggttatttcgttgtttctgctgatgtgcgagtgtcctcatcccggatgtcagatggagatgcatgccgtccacatgtaaaaaatatactaggaagcatctaggattcaaagcgagcgagcaaagaaccacagttctgttttttccttcccacagagaataaacggtccgcgtcgtgtcttcgagtgcacgcattgaaggctcccagttctcgaagaaccccccagccgtcgccgtcactatattcttttatgccaccatttgcttccccgtagacatccctgttccagttttccttccttttagcgctgcactgagagaccgttcctccgcgacggcctcccgttgcagttcgagtctcccgtctctcttgaccgcctttcggctacgcacaacgcggggtcagccaacacctcaatgtctcgtttggggggacgatgagacgaaccccgttggttctccagaacgtgaatgccactagtcctgcttttcgacgctacaggttcgctgcttagaaagaaaaaacgcagcggcaaaaaaatcgagcttttccctcgacgtgtgatgttttcgcgtgttggccgtctttcggtgtcgcggtccgctttttcccgtttatccctgctgtcttcaatgtggagaggtgacatgcctcacgatctagctcctctgtgctttttcctgtgttcattggctttgccgactgaggcacagaaaagagagacggcacgtcctgtacgaactgcgggttttggcgctctatttagggagcctcgacttgaaaaaatgtccatttcgaaaagcgtccccggtcaaaagacacttcccgtcgaaggcgcctcccttagaaacaccagcgtgtgaacccggctgtcttctacgttctcctttctcgcctttccccgaaaccgacaacgacgcgagtccccgaacacagcttgagatttttttgagccaggggaagaagccaaacgggaagactgcccaaaacccttccctgctctagacagagaggccaagtgacctggcgggaagccggagaagcgcgaggaaagtggtgaaggggggaagggggttagaaaggaggtgtgcgaggtccccgacaacacagtttcgttgagtccgactcggcttccgttcatgtcacgcga

SEQ ID NO: 1007 - DNA, 1684 bp, Toxoplasma gondii
gagggaagagcaggcgaaagagaagatgacggaagagaacagaggggagaagaggcaagaggttgacgcggagaaacgagagaacgaagaggacccagaagagaggtcctaccgcagaagccgcgaacatgaatgggatggaagaaaggacgggaaggagacagggagaaggaagaggagcagaagaaaggacgcgagaaacgcgaagacagaggcacagtcgactgggcagagacgcgcggcacagcagtggagaagaagaaacgcaaagacgcgaaagaagcagaagaggatggagacaccgaagacgaaaagaaagaaaccgagaggcgacaagcagaaggctgcggcaggagtcgagaagaatgaggtctggagacggagcaagggaagacagaaagagaagagagacgtggattctgagcagggtgagggtcctggcgagaggaagaccgagcgtctttcacctgagaaaaaaatggcagtttctgtcgagagaaagacagcttcctgcgccgacccagttgcccgagcgacggcaacgcagccagctgcaccgccatcacgccgccgcaaggagactgcatgcgcgccctggcagaggaggcgaagaagaaaagcagatgcacagagacagagacaacagcaaggcgagaaagaaggagaaaccgagagagaaagatataaaaaagaaatcgacagcggagtaagagtagcactctttccccgacgaaaccgtaaacctggacggtttcgggagcgggtttttttcactgacccgcacagcgaatcgttgtccaagacgcttcgtacaaacactcagaattctctgcgcgtgaggctgagagagagaagaagaaatccacgaattctcaccacgaaaaaagcctttcactcgtccaaaatgccccttgcctccgctgtctccatcgtgcggcctctctgcaagagagttcggtcgacttgtcgaccttgtccataagattccggcgcggagaaaaagcaaggaatccaacacaaatgagagaagcatttgaagacagactcagacagaaacggggagttgcagaaggcagaactgtctcgagctgcgctctccttgccaactttttttcttcactgcatgcgcgtgcgtccagcggtgactcagagaccctcagcgtctgagactcggcctttcgccgaaggcaggtcgttccttgaacggaaacttttttttccgagaacagatccacatctgtcttctttctgctcccgagaaacaatcgtccgccactctcgcaccctgccctccctgcgcatgcatgaaaaagagacgcctaggctccgcagaagagccgggaactcacacaaacagcaacagtacacctctccccttctacgtatgcgtctgtttacatagttcaaacatgtcaagatgcatgcatacgccggtgtcgacacagagactgttggcgtcttgtacatatacatgttgtatgcaggtggataatatcggtgaacatgggggcgccttcatttgtgcttccagacgttcgacttgaaggcccagaaaacggagagaaaaacaacacttgaaatcttcttctgttgacgagcggaactttgccgcatgcgtcgttgatcgtgagggagtctctgcgtttgttcgcttctctgcgcgcggctctgttttcgcccagaa

SEQ ID NO: 1008 - DNA, 3526 bp, Toxoplasma gondii
tttccgatgcattttgagaaaagtgaagcagctacccgaacagacattcgacacgcgggtttgtcgccgcgagaacagcgataagttttgtgcgcagaccagtgtggatactttgtagacccacagacggccgagacggcgtatcccagaggaaaatatatctacgtatgtgcgtgtgtgactaccgtcgtcccgatgtattcgcgactctttcgcgtggacgtgtgtcttcgcgtgaacggcgcgcaccgtgggatcaggtagagtagaaaagagatgcgctggtgtcagattcttttcagtgttctcttctctctgaggaagagggcgtctttgtcagatttcggtctctcttctctacttatttgtcccgtatacacacctctcggatcgcctcagggagtgcggtgctgctctcttcagagaggagacataaaccctgcagctagcgacagcaaaggccgtcctgtgtctgccgttgaggggggcctcgtctggtggggacctttgcattgtttttcttgtgttacctctttatgttttttcaaaagaaaaaacgagggatcggctcctttttctcttcgacaaaccgcccctaaacccccatgtgtcgtgcgctttgcacgggaatcgccatcccggttgtctttttccccgctgtgttttttcacaactctcgactcgtgtgttaacgaatccaaacaccccgagccgagttcgcgcggctcttcgcgaaaggaggagcatgcacctcgctacagagagacagaaaaaacaaaacatgcgcgtgaggcagcaaatgtcggaagaaatctgctcagcaaaagcgccgtacacgcggatgcacactcagctctcctcaaactgattcctcgataacagagactttgagcaaaacacgagaaacaggccacacagacagacgcggatcctcggtacacctttcctttcgcgctttcgccaggagtgagcctgccggaaagaaagaacctacagaccagcgggcccagcaccgaacaagaagcgacgcactgcacgcacggggaaacggggaaaaccaggaagaaccgcctcgcttttgttcgcgccagtgaacaatcacagcaggaacctaggtcagctttcccagtttcacggttcaatgagtcaggggaagaaacctccatggacgatactgatatacacatacacacacaagcatgcgtggatactagcacgcggagacctttcgttctgtactcgttttcgagtcgatacagggagaagatggaaagacgagagaacggtgaaagcggttctgaagttctgaagtcccttgcggcgacaggtgtgtcacattcctttgtgttccatcggccttcccacagtgtgtatgtgcttcatcccacgtaactgggtttccttcttagttccgctgttgtcagtttctctggcttttcttccgcagccaaaaacttttggcagagctcctgtcgactccgtcgtggaaatccacaggctcaaaatcgcaaggcaagagtagcggcttttgttcgcaccccgagagaaacgaaaggtctgtctcactttttccaaggtagttaaacactcgagaattgtggcggtgtgttgggtttttcgcttatgttcctttctaaatccctttggtcagtacaggtagatgtcggatgctcggcaggtgtgtcagtgactctctgtggcttgtgttctctcgttcgacggtgcgtaaggacgcaaacatacgctctcctttgcaagcttttgcgagattaggtcctcgtggaatctcgctgtgtgggcgtgtacaccactgctgtttcgaaggcgacaggctgctttttcacgcttgtttgtccattctctcctcgctgaagacgcctccttctctggctcttaactgcgcacgccgcaggaattcttctgccaagcagacagaggacgaaaacgcaagagcgacggcagcagttttcccgttctgaaggaacaactagagacttcttcactcgcatctttctcttcgaaacagcgaaaccaaatacacgtgcatacatgcatgtttccatatacatcgatgtatgcaagagatatgcgtgcacacatttatgtttaagcgaagcgtagagagaggcagagaatacgtgacactggcaacacaatggcgtgtcgaactttctgtggcgtttctttccaactttccctcttcctctttgtgtgcttactgaaatcacctggcggcttgcgtggcggcagaatcagcgacaccattttgttcgcgagcgccgagaaaaacgcagaaaacacaaatttctcaacgctaaaaagaccgacagagaatggtgagttgatcgagcgccaagaggcaagagagaccgctgggctcggtacacaaagaaattcgccaaaatggcgctagcaaagtgttttcttgattccgacgtgttctactacatggtgcctttgcgtctactcaaagttttacactatactggaaaacgtgtacaccgagcgccctgtgatgtactactagacctaaggaacttgacaagagttcgtagttttgcgtaaacacggctgtcacttctttgggtcggctgctacagaaaagccactctaacactaaaacaagcagtacacggtaaacaaaaagaaagaagagaaacgacacgaaaccaacgcttgccgagatgtctgcgacctttgttccgtttccacggaatggctactctcgtattttcacacaactaaatcgatgaaacagaaagagaggtttcagcagctcttaacgggggtctctgtttctcgttttctgtgccgctcttcgcagcgttgacgctgctctctgagacaaccgacgaactccctcgcgttcttgtggaaaaggtaatttctttcagcagaaatcgttcataaactgtctcagagagtgtcagtcaaccagaatataagatgactgcagatttgtgatcaaaatggtcgtactctgtacataaagtaagccgtgtcgcgggtgggaaaactcgctttcttctgcctagttccttcaagatcctaaaagtagaaaacacctctttcccttggctgcttcccctctgacttctacgactgatgcgtgaactgcgaattgggtgaaagtgtctgtttttcgctacaagccatctcttttcagcttttccgtgttcctacgtcttgtgaaataactccttggctgcttttctgtgattagggacaactgttgtctttgcttcaccgatgtatatcccactctttactgttctttgcgtctccccaattcctttttctgtgccaacagcaaatcatgaagatccacgttccagaacaacgaacaaactctctgtactcttatcgcacgatgtgcgtttcacaaacgtgcatctctctttgttgtggaagaaccgttacaaaatggtaaaggccgccttctcgtcaccgactatccccacatatcattgttgaattgtggtttcaatagagtcttcgcttttcataaagagtacgcgttactcta

SEQ ID NO: 1009 - DNA, 4651 bp, Toxoplasma gondii
gtgctgatacagtccgatgattagaaccctcatctaagtttatactcggttaaacatgttagatgctagcttcccggctaaacatcccttttatttgaaacacacttcccttcttgccgtttctatgatctcaaagtaccagaagacgtgtggttccgagaatactcagtatatctataagtctattccgggcacaccctgtcttttatcggtgtgctctaaatctaaattcatcttacaattttggttgcttagttgcaatggcctttgtactaacgtttggatacttcagaagcgtcttatgcgtgagctcatacggtctgctcctaagtacgcagtaaattacgctcccccacaacgtgccctagaatttaatcgaactgcccaaacatctgcagatagtatctacacgacatgatatgcagtggcttttccgaagccatgtttccgtctaaatgtcctaaacggtgtgctgtctctatgtttttagacgcggcggcttccttaaacccatcacaatgggccacctactagcagggaggggttctatgggacccgatggggtctacagagatgcggtgtcgatctgcgcaaaactgtcgtttttcctgacggagcccggaatcgtagcagtactctttctcatcggatctaccgcaaccatttgtagcctgccttatcttttgggtctcggattctgggatttgctgacacacacgctgcctgccttatttgccgggcatctgcctgaatctgtgctaatttcatgtccccatgcttcgcaaattgcagctgggatattcattcttatttccatttacctatggcaacaaactgcaagggtcattgcaaaaggatacacactgccacggcgtttcaccgatccgtcccgtcctccaacatggatgaagggtaaagtggcggtagtgacaggagggaatgctggtattggcatggagacaacccgtcaattggcactgtggggagttcacgttcttgtcgggtgtcggcgagttgacgatgtccagaagattgctgaccaggtatctcaagaacatgccagaaacaaggagactgcaaagagtaagaaactgccggctccggttacccccggagaaatccgtggcttctatctcgacctctgcgattttgagactgtgagacggttcgctgtttgggctcatgcggaaagccggggaaagatcgacatcttggtgaacaacgctggcctgatgtcaaccgacaagttgtccatggacaagaatacaggtttcgaacgacactttgtgacaaatcatcttggaccattcttgctcactgacttgctccttcctgcggtgaaggcagcacacgggcgagtcattacaatcagttctgcagcgcacatcacgcgcaacccgaagttccgatcactcgatgcagccctatctccggaggcagctgagagagtggcgtccgcgctaggaaaaccgctgcatgagctgcaaggagagccaatcactgaaaagaattacgactcaaaagtaatgtatggcacaacaaagatggcgaacctttggtttacgaaagagctacagcgccggctggcccaagatccgaagtgccgtgtcactgcgtatgctgctcaccccgggctggtcggcacagggttgatgctccgctacgctgaaggcagcgtacattggtacacgccgatatttgaggcgatctactcacttattgcacccttggtgctgaaactgccacaacaaggggctgccacccagctcctgctttgcgtgagcgacaaagaagagctcgagccgggcgcctactacaaggacggaacaacgaattgggtagactaccttgcccatgacgtcgagcgccagaaggaactctgggcagtgagcgagattgtctgcggtatgcgataacgtagatatcatcagtgtttcttagatcatggagaaggccgaaaatgcaaataagagatcatacaagatgacaggccccaccgcccggaaattttgaactcccaggctggtggggttacgcatgacgcgttgttggtaaccctgccgcccggaaaaaaaaacatgtgaaactcgccgagcgcatgtcgactcgatgtatcagtgggaatgcagtttgagcgtgtggtcttacagtggtgaggcaaatgccggtcgcacctattccgcgtctcacgcaacctatcgcagtcaactgacgctgaccatatgcgatattccacgttcagaattcaaaagataggactcaagaacttccgtggagtctgaatttagttggaagctttagtcatgctagccgttgaatcatcagaacgccctcttacaacggcgtctgcaaacgcagtgagacgacgtcagcgtgaacggccttagattctgtcatgttgctttctgtaggaatactacgctatagctttcaacgtgtcaacagccacgaatcgtggcttttcacgagactcagattttgaatgcatcagttgagattcccttccagtgggcatatcataacagacttcatgaaaattgttttcacctgagcacctccaatgtcgcacctgtttcacctgaaggcggcttgtatagtattgttagattcaattagtcctggtagggttttcggaggcacctcgctgtgcgttgctcgctccgttagtatagcaatgggagtctggcagtagtgtcgtgaccctgcaactgacgacactcatacgaacccgtactacgcaagtcctccttcaccgttggccaggaacatgctttttccaaaagggggatgaagcgaactccgccacattgtgaggtgaactgatgtgtcggttggaagaccccaggtgctcctcgcacttgggtcatcactcgaaaagtctggagccgaagacactcagtggtatacttgaaatccttgaatcccacataatgcaaggttgacgcagtcccgaatgttccaggacgttggcttcattcccatcaatttagatgcacagatgggcataattatcccttgtacggtttgtttgcatttgctagcgttcatcatctagttagtgaagtagcagcaggatggaaatttaggatgttgcatgctacagcagcttctttcgaattcttgtgtactttaattcacacatgcgacaagggtcggaaacgggagcgctgtctggtgaccgaagtaacaggccatctctaacttgaccaccccggtgacttcttaacgattgccgatatcccacgataacgcatactactcaaaaatgttcactccatgtgaatgaattctattcacactggccagatgccgctaaactggagcgattcgaagactgcttctggcattgtgccgagagcagttgaggccaactacacaacgtaaagaaatcgttcacgaaaaaggaagtcctttcttcttaagcatatgcacatttttgtgcttcaacatacttaaatgtaccttcgagacaccccgacagctagcgatatattccctaaaatcgatttccgttctgcccgaaaacatggagcctcttcaacatgatcgttccatagctgccagcttccggataatatctcctcctacattaaactgatctgaatgaaatgaatagcacgtaatcgctaaaaacaacgcgcctcattttccctcgtggaatccagctttcaggactccggccgacccacgtcttgcgatgttaagatctgtatcgtatgaacacgtacacgaacggtaaaccagctcttgccaccaaagttgaggaaaagaaatttgctttttcgtcacaaagtttttttgacggccataaaagacgagaaagcaaaataatcttcctccattgtgtgccgacttggcactcttctggtcgatgtcgtggctcggcggtctgcgtgtgcatgcatgaaacaaggtaatttcccgggagggcagtcttggaatcgagccgtacccaaggttcctctaacagttttcacctgcgcggtgatgcgtctctggtatttctgtgtttcttctcttgaaaagaccccctggatattgtgtttcttaccagtgtgtccaactttattggcatattctctcaacagtgggctgctcggtcatctttctggagcaggtcttctcttaaaggtttcttagccagctcaaaggcgggcagagtagaattgtcttttcttaagtgcctaacctatcctttgttatcgttctcaagtcctagcatgtgcctcagaatttacctcctcgactaataaccgacttcctcccgtcgtccattctctacaggatgtttttttctatttccctgtgcaaatctgtcgctgcgccattaccacacttggacgcgccatcgacgaagcgagatttggagtgaggtgccactgtgtcactttgcccaattctgttccggaacattttaatgaggatcgtgctgcgtttgttgatccaactgagagtgtaacacctcagccattatcggcaaatgtggcaggttgcccggttgcctagcccccagtgggtggtggccgaggcagaaccaatcaagggcaacgtgttcgttgcatgtggcttcaattttttaaggtctcggcggggcaggagacatactaaacgccgctcctcgactggatagggagccctgggttgttcacga

SEQ ID NO: 1010 - DNA, 4833 bp, Toxoplasma gondii
tgcctctcagaagcggctccaggtcttcgttgtacagcttgaggagcgacttccacgcccctgcatgcagtgcagcccatgggtcctcagggacagtcatccaccactcacgcaaataggtctcgaacttggtctccaacttcttccacgccgaggggttcactttggcagtgccatacaggaagtgcctcagttcccacataatcacgagagtggccttgtgtgcggcgcggtgtcggatcatactgccgaactgcagaaaaggcgacgcgcagaaacaaaacccaggatgatacaacggcgaaaataccacgcacgcgcgcgaaaacggaacactccccggaacaaacgaatggttcgtccctggattggtatcaaacgcctgcagaaatgtaagcaaaatgtcagcagaggttcataaaaggcatgagaacccctgcgtctgaaggcgcgtcctttgagatttacacgcaatgttggctgtgcgaccgtatgccccaacacgatacgactagatgagttgcgtttccttgaacgtatacagtgtctgctccccgacgacagcttcccaacggtttcttctctgctgcatcccagatgcgtatcacctaaactgtttttcagcgtcgcgccacgcactcggtcactcctaccgagtctcggtcaagcacttactttgaacaacatgttttcccacacgggcttgccagatttatggaacagctgttgccagacgtccttcacgaagagctcaatgggagtgctgatcatatttgtcaacgcttccaccttggcgacttccgcatagtttttgccgccatcgccgtcagcggcgacgctgaggaggaagggggtgctcgccacctcggggacgggcaacacggaggagttgggcagttctccgctgagaagtcccaagaaaactgcagcccccataacgggaaggccgacaacggaacgaatcgctcgcatcgtgggtgaaaaggacagaacgcgagatgcgggatacaacgcgccacagggagcagctggttcgggctggcgttcgatttccggccactgaagtggacgagctcgccaggctatttcaagagggtgagaaagagtgggcgaaaacgtgaaagggcaactgcccgatttcataaaaaccgattgagcctctggtaagagtcgacaaccgtagcacagccgcactcgccgtgcacgcgagttgtacacaaacagtgacacaaataccaaggttgtacgtgcggtcagacggcagtccgtctatacaaatgatgccgcctcggttttctgaaaaaaacgcagattcttcgacacgaaagctttttgcgcagatgcttgtgctcccggcagtcggcggcgacgacgcgcgtggggcaagtcgattacggccacgggaggagaggggggtgttccgccgcagcgatttccccggttgaaccctacgtggtcgttgcgggcgaggaacgcgtgccggaaacaactgccagaaactctctgcagagctgggccgcctgtccgtcgcgcggcgcctcgaaaaactaggcgaggaagggcctttgtgtgccgatcctcacggcaatgcaactctgctctgccgatgacggctttgcggagtcgcgagttgtgggatctcagaagggcagaacacagacgaacaactgaaacgtcagttaaagcttgaaacaagtacgggaaagcaaggcggaagaactctggaaagctgagggaaaaactcggttttctgcgtccaccgggttcgacgggagaccgagacagtcccaacacgacggagcaaggcccacctgaccggtggtgcttccgtcacttttttggcaacggtcgtccgccctctctttccgtgcacgcaaaaccttcgaccccaacacttgccggctattgacatccacgcttcgcttctgtgcccggcttccacacggaatccagccttcccttggcgcccatggatgccagtccagcggtgtcggcacaccgtgcaccagcctttttagagactctccaccataaccataaaagcaaccgttttaaaacagccgcttgaacatactcctccacccggtctcccgcgtcgctggggagggcgctgttcgaaaccagacaccaggagaacaggtgatcttgctgcttttgtccactggagaatgactctcgaccactttcccgcggtgggacagaaaagacggcgaacagatcgtcaaccccggtgcgagcgaacagagacgggcatcgctgacggatatgtctggaaaaacggaatccgtttcttccctttgctgtcagtacacaatgagtgatcggtacacgacaccgcccgccttctgtatattatattgttgcatcttcaactcaaagttaaacggtttgagagcccctgcaggtatacacactgagactatagttgcctttaaaaaccacggcacgtaaacggagagcgcgagcatagaacactgagaaaaaggatgtgtgaagacacgtgtctgcccgatctctcgtaggtaattcactcactttttcacccatatgttcccgcctcaacctagcccacgtttgcccctgaatctgaaagatcgagtaacgcgcaatgagaggatttccaaacacatttcgatcgttttatacgtcctctcacggacgcgaaggcgacgacacaaggaaaagctcaattcggagagttgggcggacagactctcgaaggaggtatgcgagctgccctcgttcgggactgcgtcgcatcttgaataccgccgcataagcattctcgtgtttccgaaaagatttctccccttaaaacctactgctctatatacacttgtcgaaagagaacgacaggcattagcaaaagggcggaacgtcccatgcctctcggtggccgcattttcgagcttgccgctctcgctgcgcggaacccagacaaaacggggttgatggcattttagagaagacaacgctctctgcatgctctcggctgagtcgttctctacagggtgcaaaggggagttcactcctgtttaaaaactgctcgggctctcttcacccgctcggtaaatctccaatgtcacgtgctgccggggaatccgtttcacgatggacgggagccgtcctgtagtgttcatgctgcgattcatcagttaagtcgctcacgccgattccttggccagatcaacagccataaaagcgtagacaacgtagagcagacctctccatatgtcctggcagccacttgggttgtctaccaataacatagatgactgagctgtatgacggttcagctttacacttgatacgtttcgatgttaacttactacgggtcagcgggcgtgccttgttcccggtaccgcaggcattgattcagtcgatattgataccgtacgcagatacgtaccccaacgagcgagcacacagcaccgacaaaaacgacgacggcccagaaattgacaaacacctacgagttgattttaaatgatgggcaatgccctcgtaggcgctggagcccgatccttccccctcagggtttgagcttgagctgcagaaacttagcatggccggccttgaacactgacctgctatcgtgctattttccgtgagcatttcgtccacgtcgttcggtggaatttccaggtacgcgatgttacccggtgtgtcctgtggacatccaaaagtatacattgtagttgcacctgacgtcggtgtagtctctcaagatctaggtatccatgcagagcgactttcgattgtcgcctccttttctccttcttgaccatcgtgacctgtgtatgagcggcatctaggcttttgaggacgtctttgctgaatcatcgaatgagaaaggtcccaagacaaacaccgatgaacagtgcagcgttgcttctgtttccaattatcgacatatggaaagacaaagcctgcacaagcgacccaggaaatgaagaagagaaagacagttccccaaagagccattatcgttcatatttctgtggagtttgcgttttccgctgggaaaacaaagcatagtgtgtgaatcgtccagcagaatctggcgaaggaactcgaaatggacggccagaataattcatcgttctcaacagctgtgttatagacaattttcacgcatataacccacaaaaattcccgcctcccagggaaaacctgctgtccagggtagacatataggcaaccacgtttctttacctcgacatccaaaaatgcaaacagttcgtttccccctttccgtggaatttatatacattcgttcccccctttccgtgggtaattctgttcagcgtgaatgagcgaaacgaggacaaccacgaagaaatctgaagtcgatctgcattttactgacacatcacgctgtctgtcacgctgttcacttctgtcggcccctgttgcggaaacaatcgcaggacctcgttttttgtctcaatcaaaaagccctgaaattgccacggacacagagaaacgcgcatgctgttccggtttcggtgtctgaatcccttcggtggctttttacttttgagagtttctcttgcacacgccgagcggagcaggctgtcggctgttgtgtgtcaagtgtgtcaagcgtccgttttgaccccgtcgttccttttcgcatttcttcctttgacagacatcggcgaagcgacttggtgcgcaaatcaaacgctagcgagttcatctttttcgtcatttccgcctcccttctcttcgttttcgcggtccctgctgctcaaggaccagcttggtactgcttccgctgccgcagcaccctcttcagaactgaaattcactcctttttccggaacacaa

SEQ ID NO: 1011 - DNA, 2919 bp, Toxoplasma gondii
gttttatctcgcatcggttgtgtcgacggtcttagggccggagggtgtctcctgcactctcttttttgacaatttcctgtcgcatgttccgagtcaattcgttaggctaagatggatggcgacagatgctggaaacgcttccatcgccgtggtaatactgcacgccgatgctggaaaatttgtttcttttcagaatcctttagcgcggggcactcgtcctcggacaagagccgtttgtttgttgttcttgacccgccaagaaaaggatgcgattccgagttcttgctcagcttgctcaagtaagtgagcgggcgcgcagctcgacaggtttggaggccagtttctccggaaatttgaattgcctttgcacaagttctttttctgggtcctagtcacggaatgggttttcatcgaagaacgcgtgtgaatttcacttacacttccaggctgaaaccggaacgaattgtgtacatatcatgccacccggcaacgcaggtaggcagcaagctttctagctcgtgcagcagatagaacccccgatctctagattgtggcatgcatgcttttccatcctcgacttgcattcagcttgattctggtttgcagtggtttcttgtcgaccatactctgcattttcaggcgagagatttgaaagctgttttgcccctgtacacggtgaagaacattcagcctttcgacatgtttcctcacacgcgacatatcgaatgcgttatcaccttggagcgatccactaaacagtacactccagagcaacctcacggctgtccgattccagctactcataaaatcgccaaggcgagaaaaacagaaggaatccctagcgagacacatggctggtacacgcgcacttgactgagacaaacgaaaccctctccgcgacagttgctgaaatcctgtcaggcttctggttgtcggggtcaccatgtgtacggaggacccagcaaaaaggtagccgattctttcatcagatggagattctattctttctgcattgtgcattgccttcattacaattatcaaaccacacaacattcacgtgcagtggaagacgaatttcgtttataaccgtcttttgacttgtcgctgagtgcggaacggtgccgtcgatgtgccatgacgagaacatttcgtatgaaacccaactcgaattcttgctgaagcaacgatgctgcgttttaatttatggaggtgtgacagcaacgatgctatgctttgagtttagtacgcattctgcggactgtttccagtttcccctcgccatatcttagggatgttgtctgagcagaatctgtagaagtgtcggcgcccaggcctacctggagggactccctcccttctttctttgcctcttcatgtggaagttacagggaaaacagcatcgaagtttatcccaactttagtgatctttgcggtgtctggcatttaaggtgtggcaggagccaggtgtagaccagttgaatttttgtgtcgtattcaggactaacaatgcctgcgtactcagtatgattatgtgatgcttctcaagcaacaaagatcgccgttgtcgatcccagtttcggtctccagaatgcgatcgttcgcgcagaatggaaatacttcgtcattcaagaaccgatgtaggctcgcctccgttttctagtacagtacctagggtttatccttgttgggtttcttttggcatctgaaaaataattgagagcttatcccctttactctttgcatcgttggattcgattgacactcgcgacgatagactggctctgtcagacggagtcatgacagggctctgtgtcaagcaaagttgacagactcaggtctctatcgatgaagaagggcgtttcgtgtgcatgacagtaataacctcaagacgctgagaggtcgccgcgtccaactggtgtatgaaagccgtccactgttgctttctcctggagtgtgtgtttaataataaaggctttcggcgaactttactttagaagggccttcggcccgagtggacttgactatccggattaaaaactcgcaaaagtgtggtttctcagtccacatctaggggatactctcaaaccgtgagaactcgcgagcagaaagtctgccttaccgctgaatgctgtgcaaaaactagcactgcacacgcattcgtcccctctttactacaggagaaaaagccgattggaaatgcactgactgtaggaagtccatttgtggtacgaactgctttagatgcatttctttttgctgcaatcatccggtgtcttcaccgctgcgcatgcagacggatccggttcctgagacaggaggacgaggcgcatgtgcacttcgcacaagagacgggacttttttcaaggcaatgaattcgtactctctccttttcgatcgtcgcggttcactttcggtatgtgtgtgactcagtggaatggtctatgaatgtcgctggtgtcaaatggcagccaccatgcctcctcccaagctcttcttggaatgagtggcgggtgaccaggtctgtgagtctctcgctgctaaattgggttgagtaaaactcgttatgtccgagcatgtgagttggacggacggttttcttcttctctgtgaggctccggaaaccgacgcgggtgcgtcttcggcatttccctccgcagtctcccgtggcacgagcctgttttctcctgcaggatgccatgtttctctctcgtttgagcactctgtttgactctccactttaagttaaggagtctgtttcctacagtctgaagcgctccatgcaggtgcctactgctgcattgcgttgcaacattcgttcgatgggaacaagtccagtcgaacagagacacaatcggatctaacagattccttctgcttttcctccatcttcggcatcccttcaaccttcttcgtgcgaga

SEQ ID NO: 1012 - DNA, 2364 bp, Toxoplasma gondii
cgccaaagatagcgtcagttccactgacacagttgttgaaacacgataaattggcagggtctagttggtggattagtctaggaattttcggtagggaaccccaacgtgaagttgctccaaggacagaaagtgacaggcgcacagagggcagctttgtcgttgtgcattcttgattctcgacagaattcacagaactccgacagggtgagatggttgccatgctgctgaacctgtttgctgttgatgcaaatgctggtaacagtattcagttacatattggaatgggactgtgtgtcagacgaacagcaggtggagccagcacctctccgtagggtgcatcgttcacggtaggtgcggatggtccccccccttgtctgtaaagaaattacccatggccgcgatagctgctgaggcaagagtgcctgaatgggttcctgtcatcaatcaccagtactcgttggtttggtagaactctcgagtgctgtcaaaacgactgtactcgtggtttcattgcttgcgactgcctcatgccgcggacagcactggtgcaaaagcagcaggcgttcgctaatctggacctcacacagtgggcacagccgtgtattctttccgttctgcaaacagctcagtatcccgcagcatgtatctctgacgcaatcagcatcattcttggatccttcacatactttccgcgtactcactcccacgaagccgcagcaagtacaggccgtggaagactgtctcgaaaggtaataacacattttcaccagggctcactcacttgcattgccagcaggtgaccatacgcgcacgaagacccgtctccaatgaacactagagctagctgaaagcaacagcggcggatggacgacggactgtgccgtttctgcgcgtttttcgtctgacgatgcagaaagacacaacttctcaccgagaaggccaacactaaagaggggcagcttttgtcaaaaatgactcgtaacagaggtacaacagggagcgacgcaaggacgattgtttatcttgagttgcatttatcaactctgtcttcttcagttgctggtaacaacaatggtggcttgcttctgaatcggcgcatatcgtgtggggcctttctggtggaactatataacggggctgagatattactctagcttttgctgttacatgcaagagataaacgagatcaaacacaatatagaacaagacccgctagatgctacttgcggagtcggttggtagaaaaaacgttggtgttaagagtgttttttcggctgcaccctcaccttctcgttctcgtgcaagtgtgcctgggccctgcgcacctttctctcctacatttcacgatgaattcgcaaaaaagaacttcggggcacgaggtgcccattgatcactcagccgtgccgaaactaccgggatttgaaccgttcacgttcaaggacgtaaggcgtagaggattggcgacagagccagcccgatacgatgcaagtgccaatagctcacgtctcgtctccagtcagttgacaagtggtaaaagggttcgaatttttttcgttcttgggaacaaaacggaagggcttaagaaaagctcatgggcatgactacggccagtagccgcctcgcccttttccaatgctgtttcaccgacagaaagcccatcttacgtgtgttcctggctgtgacaacgcagaactatcgcaagtcccagagatggggattatcaaacaaacagtgtgtagaaaacctggaagacaagcgtcaaaagctcgtaacagtgccacggtacgtctgtgtatgtttcagtgcagagatgtacttaatgcggtatattgacttgaaggccgataccagctacaggcggacgccttcttgcttttgccccaatttacacaatttttctctttgtttcaaaaaagtgccttctgcatagggtatgccaaataatggcactcaccttccccaagcctcttacagtgcactgaaatgctctcgcgtatctgacttctgaaacgagaatggagagttcaatttgaatcgtttaccctagatatccacctatggcgtactgcatgtaagaggcatttttcggcaagcatccgtaggaagggaaccccagtcgtccagcagccttcgacccctgtccctcacgtctcttcccacacggagtttacagaaactactgtccagtttttgtccactgtggatagttcatttcaaagggacttcaatgttaaatatgggaatccttgccagtctacacattcaaagacatcgttgtgctcttcactttgactggtatcaaagcacttcagtcggacactcgctcgtcagaaggagagcttaattgtaggaaaaaagaacgga

SEQ ID NO: 1013 - DNA, 2392 bp, Toxoplasma gondii
caacgtcttattgcctcttctccgctttaatcataccaaagtcacaagggcgtcccgcagacatcgagacgccagcgagtctcgctcgtgtccaggaggcatcccgattctggcagatcgattgagggtcctcgggagagagaatcaccgaggggacacaaacgaaatacaaactgaggctgtccagggggtcgaccgagcaagagaaaagcggagaatgattgcgagcaaaaaggcgcaatacggcaccagtagtaaggtaatgcgtgtatggactgggcacatttttttgactgtcctcttttttggctgtgtcactctgcctgttcctgagttgtctgttttatgtggttcgccttcaaagtaataacactttcagagcaccaaagtgaaaacccttggtgcgacgaacaggaggaccaacttcgcggccacttaaactgcctcccgtctttctcgcgacctgggtacctgttcggtgctccgaaacctagctgatttctctgagcggtctctgtgattgatccgaccagcgcaaactttgtgcatgtcgctcacccttgctccgccctaccctccagtgtcaagaacgcacacgcttgcagtgttcctttgagatcaagcatatttcaataaagaacgtgcgtcaaagaaggggagtgcttagtccaggcggaagttggtttacaaaacttccattggcgagacgagttccgcaagcatcctctgacgcttcctctgcctcggagagtaatatcaatgtatttccgattatgttctccatttgaagatcccctagtgcaacgatttgcgttgtggatggtccaatttcactctggccgtgttcaaccacgcgtgagagagcaggggttctgtcgttggtcccaggcgaagaccggcgctcgccgacatgtgcttgttcctgcgggaattttcaaagcagtacatttaaatcagagctggcacgtttggtttcgttttcaggactgcttcaagacacagtgacacactcctctgcgatagtcttaggtttttctggggttcaaaactcgacgtagaagcgaagctctggagaacgaatcgtcacgcagtttagtcaaaattcgatgccaacagttcgcttaacgttgctttgcaaatgcactgcttcatcaggaagcgtcatgttgtacagggtatagggagcttgtcctcatggcgaatctgatttatctttcatgttgtctatatcggccaatctagtcttgaagtattgcacgccgtaaaggaaccgccgtccttgtgtcaggatgatgaggatctttgaaactgatctgcgtgcatcgtacagaaacattcgagctgcatgcataggaaagtttcttatgctctgaggtagtacgttttactatgtcttgctgtcgaaatgcagttccatggccagcagcgtttttctgatgtaatcaagtccctcgctatatctgtgggtcgaaagacagtggtttccttccctgttgtggcagctctttactcaaactgaaaagaacatcttttctcggttctgcaaaccaaacggcattatgagcttccctttcatcaatattcacgcggccacaatcgaggagccaccagtactcaatacggcgcacgtctgtagcacagggcggcgttgtaatcgttaaaaccgcttgtcgtgtcttcagtgatgaagaggtttccaaggcctgcagcgtacagtttctcttccctcatggtttcattttaagagacttttccgtggcgaatgtggcagtgaaggcgccgctggcgacccctttccagatgtgcacgcgcatgcgcctggagaagctgtaggctgaggtaaggcagggtcgcgtcggtctcgacgcacgaagcacaagtacgcgtttcacaggtcgagaaaaaaatttcgaagagcgtgagctcgtctggaatcagaggtaacaagactgcgaaaaggattcggcagcctcttgtcttcttgccatccctgaggtctttctcttagggcacagttcgccacgctttcctactctctcccaatgcaggcgcgatgaagcggcgctaggaaagagtttacactggacgcagactcaacacaccgactctttttccgcattttcgtgttttttcaagcagcatcatcatcacaccttcccttttctggtcaggtctgctctgtttgcaactctgaggcagtttttcttgacatcccgggggcgtatgccatcggggcacccgcgtaccttgcatctaaataagaacggctgtgacctgaagtctgtcgtggtgtaacgagagtgtttcgcttgaagagagtgtcttcctcgagacctgcacaccggttttcgtaccggtttctctttcctttaactcatcgtcgcgacagcga

SEQ ID NO: 1014 - DNA, 2202 bp, Toxoplasma gondii
tcagtttctgcatatacagaggtgttgagacagtgaggctttaggtctacaggggtgtacaatcctgtacaagtctacaaatgatatgacgcgcacgtaaatatatatatacatatatataaataagtatatatatatgtataaatgtgtataaaaatgcatataaatatgtataaaaatatatgtaaatatgtataaaaatgtatataaatgcttttaaaatatgcataaaaatatatataaaaatatatgtaaatatatgtacgtagggtggcattcatagatgtcgatctgtgtgtgcggcttctgctgaggaagcgcatgtgcctgttctaggtgacagtgtctacgcatgtttgtgtgtctgtagaagtggaaacgattccgtacaaaaggagaatattagaaaagctggatttcctgggaaaggatcagaatgcctcaacacttgagactgaaactcttttctgtttttctgctcgcacgctggggggtcgaccgactcttgattggccgagttgcagggctcagacaaggcagattcgaacaggaaaacgcagaatgcgccgcttagtcagagaaagtttaaataaaagactgccgcctacggtagagacaagacgcagactgaggacagcgagagtctgttgaaactcgacgccaggtaaaccgagtggcgcctgaagctcgagtcatagcggtaagaaggaaacagattcttaagtattttccaccagttcaggtatccagcgcttccagtgcgtatgtgtgttttattttctatcctttcgagaagcaacgtacaacatcatcgaagcgaatggggtctggagagcgctgaaaatgctccacgcttcgacagaggctctcctcctctctggcgcttcggacttccccgtctcgtcagtagggcgtgtgaacaacctacgctttcactctactttatttggggcagagaacgcgtttgcggaaagaagcgagtgcggcggagaaagaaagaaccgcggcggcctcgcaggcagacgtctcgacgtctcgagatcgggagccaggaggcgcttcgggtgtcactgcgcctcggcaaatgcgaggaagagccattttgctcgctttcttctatagtggctcaggtccttcgggcacagcgtccagtcttcggcgaaacctctggggaaacgcgccgaagagcctctgctccctgcatttttcgcagccgagaccggcgcggtgttccccaagaaaaaagagcgatgcaacttggcagagagaaggagggagggggttgaagacaacagcgctcgctgtgtcgtttgtcttctttccggcctcttcgcctccttttcccctcctggagctcacgaaaaggcacaaagatacgcgcttcttcattctggaaaacactggaagagagaagcgtctccttcctccacattttccggttctttttggcgcggccatacaagttccctcccgcgtgtctcctctctctaagccaacaaaccgcccgcctcagtgcctcgacgcacaccgcctttcaagttcgtttgcgtcttcggttttcggctttttctttaaactcgagttccctgctcttccggccttgtctcctttcctttcgccgttcttttttcctctcgcttttcgttttcgtcctttttttcctcggcgacatcgcgcgtgcaggccactctcgcagcttttgcccccccccccctcatgcgaggttgcggacctggtcgtcggtttcctcaactcttgtgcgagaggaattcttttttagccgcccagattctctgtccttgccagtttctctccgccgaaacagttttggcgtttcttcttgccaccctgaaaagtcgcctgtcttcaacgatccgccgcgcccgcccagcccccggagcgcatgtagcgctgtatgtacaccgcaaaactgcgttttcactcggcgacgaggaaacgccgtttcggtttctcgacgtttgtctattctctcgtttcgttctaagtctcctttgtcactgccgccctcctctgaggcgagctggatgagaggaagaggatggcaaggaagcagaggcgaacgacaagcacaaagggcaacccagaggctccgagtagaggcgagcatcccaagaaggtcggtttccatggaggagaggacgccgaactgaaaaaacgtaccttttttcgagagagcgacca

SEQ ID NO: 1015 - DNA, 2297 bp, Toxoplasma gondii
ccgaacctgcctctgtgttactactcaaggtacttgattccttgtttccgcttgctccacgcgaccttttcagctgcatttccagagacaaaagggtggttttgcggcaaaagtacagagaatctcgtacacgaacctttcctttacaacctgtggagtcaacatggtggtggtaccggttggtagcgctgatggcaacaaatgccttttccctgtggcggtctatttttgcagtttgtctagaaaagactctccgctcttcgccgtcgtgtagcaaagctttcacaatgacgaggcagcactggttacctacggcgatttttctgtacagcattctaacagatttctctgctgcctgccgcacgccagcccttttgtgaacacgcaggaactaccgtcatgcgcgtctgcctccaacaggtggactttttcgagtgcaacgtagctctttccgcgatttctacattaaacgtcaacctttccccccaatcttgaagtaaagtgcgctttcccagtttgcctctcctcgctaatatggataacttcaccgaaaccagcgtaaagagcacaggatgcactccaaggctctcacgaacagcagggtgaaaagtaccttcgcttccactttcacgtttggcttcgctcgcggtttgtttcgctcgtgcagatctccggggcccatatgggcacgctgcactgttctgtcagtgacatgcacatcttcttcgtcttctggattcagaagcttacacaaagcgatcacgctatcggcccctagaggatcaaacggcccgcgaaagtgcgcggactgcgccatctctgtttcgggtctcttttcgggatttttgtcaggctttgttcaggcaggagtggtgtaatgcgtgcaacctagatcgactcataaagtcgccagtggcagagcgttcgtgctgaggacagagacagttaggttgcaccctgtgcctctcaagacttcacaaacgctttctgacagacctcgcgcgcgttttcgtgtgtagtcttcaccacgcaactcactaaaaacagtttttttcgggtgaggcaccgtgcgagtaaacgacgaggtcagcggcagtctttcaagcaggatcagatacagaacgatgcgtttaacagcttttcacgagcgagagaagcgagcgttctgctcaacacaaacatgcgaccacacagaagccggccggcattcagggtcactgactgcttcgtcgaaaggcacatcagatgccagtaagctttttcacccgccgtgcgcttttagttcctgacgagttaaagaaatcacacaaacgcttcgtcaaagaagcaacgaattccacttccgaagaatgcactttccaggcgcactgcggccgcagcatctaggagcaggaggaaacagcacacatgcaccggcggcagagagttctttttttcccgcatgtggcagcgcaacttttttcatagtttatgcatttcgatgattgacctgcagggcaggcctgtgttctgtcttggcttttttcttccttccttgcggactctgtactcttcgctgatttctgcctcacgacttggagagacttcatccttcccttcacggacgttcggccccgttaaaacagtgtgtcgctgcacaggtcataaatttcgtgacgactgcatgctccgcgtgcttgcgttcccttcttctccacacacgcttctctttcccctgttgaagaaaacgatatgaatttcttcagggagcccggcaaaaccatcccgtaacttcggcggtctgtctgtcccccggtggagaagcctcgaaaccggttccagtgcttcgagggttcttttcttggtctcttgttcccgcgcgacgagaattgcctgtcttttcccctctactgctgcatgctcgaactcgccgttctagaagggaactttcctccaacgatgtccctctccttctccaccgcagttctctcgcgacgcaggcacctccagagagccgtgaagcactgcaacctccacagccgcttgccgctgcttgcccgcccatctcccgcgtcctgcacaacctgcagacgttcctttcttccttttacgacgcgtttaacattttctgtctgggcagctcttttggaaaactttctccctcgcgcattcctcttctacttcaacgcgtcgcgtctgggcagttgctctgtggccgtcctccttcttttctcggtccgtctcggccggcttctgcgtctctgtgtctcgaccgttcccttgctcgaagaagaactccctagatccaactcgcgcca

SEQ ID NO: 1016 - DNA, 942 bp, Toxoplasma gondii
ctacactcttttgtccggcacttctcatctcgaatatcctggtagaagtcgaaagaaagaatgattttgtcgaatggctcgacactcggagtgcggcctgctccttcgacaacacggaggcgctgcaagtaatttgcattatgcagcaccttccccgatttgctgtgggcataccgcgtttggcgatcaaaaggttgtggcctgtggtgaaaagtcttttttaaagatctttcagagcccggtgccggacacccaagttcgccgtctgtcgcagcagccgttgtgttgccgtcgacactgcttacagccgaaattgtttcgatacccatctttgacaaaatcaggtgtacgtacagctgagacgagactctcgaactaggcaagtaggcggctgaaaagtctcggcgctacatgatatgagacacctccgctacaaggcgccctttcatgcacgtaagatagtatctgactagtctccacatactaaagctgccagaataagcgggtgactggcgacatctttcttgacagttcagccaaggtgtcacgtcaattaatttcgcgtcacaggccttgtaacggacaggggagagtagacgaccaaagaagcaaacgaacaaggtaagtacgacggcagaaataaaggcagtcactgcggggttgttatgtcttttggcggaagacccctaactggaggagcacagttgacagagggtatctggaacggcgactagagacgcaaagtcgattgacaagcaaagcaagtggggtctacgatagactccctccaggaaacgccgctcgagagtatgctaagcactgttgcgtttctttctattcaaaccaatatctcagtcgaagtcgagttgcagaacatgtgacgaagcagcgccagatgaggaaaccggggtcacggtctgctgcgtcgtttctctcacgaaa

SEQ ID NO: 1017 - DNA, 1897 bp, Toxoplasma gondii
ttgttcctatacagttatgggctcagaacaacttgggtgcagatgatatacttgtgtgtcaagacagttgcgctaatggtcctgtggatgacttgatatagtggcttgaagagaaagttcttttgtcgctgttctacggtaaccgagatcctgatagatcaaaactgtcgtgtgatgactataaggtgcgaggcatttagtccgagattaaacaaccagggcggatgcgctgtatccttttacacaggtgaaagctctctgggaagaaatagtgtaacttcagttccgcacgtgtattcactgaggatgttcccttgtatccggtaggtagactggcttgtaaaccggtgtaaagacggcatactccacttcacgaactcccttgtgagtttagtactttagtacacgttccgtatttagttaggcaagagcaacatcattggaatctaggatgttgcaagctgcaacagcctctttcttaaagctgtcctcaacacgggatcccccgtaccttgcacttcctcttgcagaaagcggcgtggtgtgcagctgctcggcgccttgtcaagcagcagcaaccgcttgcgacatgattctatcgtggtagccaatgtgcctgatgaatggtacaggtgcaaatgacaaagaacgtgagactaccgctgttcaggaactgtcagccctgccactgtggtgccatgagcagagagacgtccatgattcccaattcgcggacagtttttgagtcccgtgcgtataatgctgtttgtcagggtgggggcgacactatcggagcgcggatcgtccgctgcttcggcgttattgctgataagcaagaatccccgcctcagacgtcaggcaagattttcccacaccttcacgtggtcattgcagctacagtagaaacgaaatgacgagaatctcactagtcgttgaacagctcgccatccattctgcgtcgagacacacggtagttgccaaatgctgtgactatatgatactggaattcatcggtgcaagtttgccggaacgaagagagggcggccaataacagagcccggatagttgttcagacacaacagcagaaaacggatcaaccacgaactacccaagagaatcaaagccagagtttttatagaatgcttgcgttgcagcgcccaagtgagatatgggtactagcaagcagctcgcagttattctttggagttcataaagcaagttcctgtctgtttcatcacgtcgttaccattccaaagtttgctcctcccttttgtaccccggggcgacaggagaggcggcacacgtgtgacatcttcgaaaattgcggggcgacggagtgcccgcagcaaacatataattactcagcaatacttgtgcacctactgtgcacgtttctttaagtcacgaatgaacacgcggctaactggtaaaatctctttttttgtttcccgggcacaaaacaccttctgaatgtgagcatgcgattgctattaaaagaacgaaacaacgtttccagcggcgctctccctcagcgacggggcaccccaacttctaacgttggccgcggggtcgaacaactagccgccttattacgtctcactacctaaacggcttttgatgataactgttttctttgttgccgacttttgaaacacctttgtcgtgcgaaactgcagaatagttgccacctttttgtgtcagttcattgcactgaaaagtttagcttgtgcttgttcaggatcgctcaacggagacgcgtcacgagctgttcgaactacattgaaaagctgctgcccgtggattggttcggaggcatttttaggtcccatttgtctctttcagcttgaagaagtggatgtgtgaacccattataaaggctgttgtaagaaagcgaaaa

SEQ ID NO: 1018 - DNA, 2366 bp, Toxoplasma gondii
gtgtagagacagacggagcgcgaggaaacggtaacgaaggcgaagacgggaggaaaacagaggaggaaacggaagatacgagggaagagctgcacagaggcactgcccgagcagaggttgcagaggctggtcgcatccgcgacaaccgccgcactgcgtacgccatatttgtttgtcagagaaaggcaaaacgccgagaagagtgactcgaggggaagccgctcgggggtatgtacacctggcgcaagcggaaaggattcttctttgtggagcgtcgacggaggagagtgagtggaacggattctcgcggccgccggaactctatgggtgagatcaagagaatcaaacgacacgacacagagaaagacgaaagggaaaatccggatcccctgacaagagcctcgcgctgaaatgtagaaactctgctttgtggcgtcctcgaagaccggtgcgttctacatggagctgttaccaccgttttctccagtgcaaggtccataagcgtgcgttcctggaaaagtcacgcattcgtgatggcgcagttcttcagacgacgcacaggaatccttgcggggaggaagagagcacttgtgaggccgcgccgcgaacagaggcagagcgtacgttctgcaaacttttcggtagagagcggggaggaaaagcataatttcttcgcgatgccctcaggacggatccaggcatttgaagtctgatgaaaaccacaggaaagaagacgttgtttgacccgcctctctgggccttgtgtcgccggagccgtccgttgaaagactccttccaggaggccgttccgtccggcggcgctggggtcttcagaagacgcgagaggagagagaggagcctgtggagcgaagcgacgaagagagatgtgaggagagagagctgcggcgagtggggaccgagagactgagaggctgtgaaaacagcgcgaggcaagacttcgcgttcgcaggagacctgcgacggagaggcgagaggctcgcagcgggaaacttcgcagtggagacacccgacccttcgagtgagcagagagagagaaaaaaaacagttcgccggacaaaagaagagaaaggagctggttccctctgcgtttctttctcgcagtcgacactgcaacttctcttttcgctgcatgcacgtcgtgcttctctctgctacctttctcgctgcggaaacgtggagcaagtgagagagccagacgagacgtcaaagaacggagtggagcgcggcagcgagaagagtggagggaacggtcgccgttgcagaggtctttatttttcggcggaaatcgacagttcccgatcgtctcgccgttgggtgggggcgtcgtctcgcctgcacgcaacgaccccaaaaaggattcgcgccacagggggctcccagaggagagaacggactgcttctttctctctcgctgctctcttctgcttcgccttccgcgcggcaacgtctctcgcttcttccgcagttgctgacaggaaagtccctgcatgtttcctgcccctgctcggacgaccggcacaggactttgtctcctctctctcacgcgagacaagactcacaccctttcaagcacaagaggggatctcgtcttttgctcgctgttggtctcacgaattcacatgcttcgccaactcacgttcctcttcgtggtctcttcctcctcttctcgttctcccttctctcgttccttctttctcttgtcctctcgttctcttgtcctccctgtctctccctgtctctccctgtctctccctgtctctctgaggaacctgtggtttgtgctgcatgcagtggaagtcgacgggaagggcagcactgatccgagagcaggtccctgggcaccctgctcgtgagtcctcgccttctgtttcttccctcgcgcttcgactttcttcttgcgtacctctcttgctgtctccgaaccgcgttcttccttcctctcttccgtggatgcctcgttcgtctccgtcagtttcagtctcgttcttcgacttccgactggaaaaagagaaacgctttgtagccgacgttctgcatctcaaactccgtctggctgggaaaggattccgaacacccgagtctccgtctttcgcttcttctcttctctgcatccgggggctccgctttagcgcgtcctctgtctcgtcttcttcttctcctcctctgcgtactctcttgtctgctcccctcaacagtgtgtccttctctacatcgtcgtgaaccagctgccctcgaaccttcgtcctggttctctcttcttctccacattctccttctatctctttccactctgttcacccccacccccagagcgcgccgcctatcgactctcgttctggagacaa

SEQ ID NO: 1019 - DNA, 2881 bp, Toxoplasma gondii
ctttagagatggtgtgagtgctgtcaccatagcgacacaaaaaggaagtatggtggcctatcagtacatttgcagcaccccgcttttcccccggaggtgtaccgaaatttcgtcgaaacgtggttcagtacattaccagattgtttggtagaagcatctatgtgcacactgtttcgaaaggctcagctcaacgccttccactagcttatattaagggacacacggagtagagtaacctatccaatcgtagtgagcatgcggaacgatgctaccactcgaagacgatctctttcactccttgatgactgagcattgattgctattatcattacccagcattttggcctaggggataattgctgtcaatatccagtcacaatggcatcaagggtgaaaattgctcatgcaacaacggtgccctcaaccaaggaggtttagtaagacagtgatatagagggaggtggtacctttctgtctggaggggctgctttgaattagggagcactagtctaccatcacgacgttggatatagggtgcgggtgttttgatttcctgatagtggaaggaagagtgtgcatgcacataatttcggttgaaccactctcagcaaaccggttcccaacctgcagagctcgcacagtgtactggacgatgcctctgcagagaaaatgacactgtgagccttcggtcagggattcgcaagcgcacgctttttcccgcgtaattaaatttatggtagttgattgagagattcatatactaccacctctccacgataaaacagtaaggagaaacgcgagtggtgtcgtgggtgcgctagcgagaattgctgcacacatattctcccagacactcgaccacagcggaacttacagcagggcaagaacctcggtggaccgttcgttattgctccccgtttcctgttgatgcttccttccgccttgagtcacttcatatgttccactgatcgtacgttccgagaacggaacttctgtagttcggctgaagactcggattttcgaccacccgacaaacgcctctagtcccagcggcgcaccaagactttgaaacggcgattgtactgtaggaggtggtagtcgaatttgttcacgtgcaattgcatatccatgaaaaatgtacacttgtactactacaggtggccggttccattggtacaccgtggcatgttactccggccagtcgaatgaatccgacaaacaatgggagacactttgaacgggagaaagggcacctgagtctgttaacatcttgtagtacaacattaccagaagggaactgaacagaaagatattgcacgtggactagcgggcacaatatttggctccaggcctggttagcggcttgtagctgccaggatcaaccaacagctccgcatttttcgttctgatgtgatgtccagacgcgttgtttcattacgagggagtcttgacgaacccctgctcttccttcttcagaagtttgcgaggcattattgtcgtggttcgttttgcgactaacgtgactgccgtaaagctcgagccggtgagtcgacccgtgctgcagcagtgatggggtaaatgctgcaaacacagacttctagtgagtgcctagacgaagtcgtgtaactggagaaactgcgaggactcaattgcgagcatgccaacgaagagcaactggggtgtgagcggggtgtttggaactaggatgagaaatacggaaagtggactcaagcaccgttaaaggcgtcacatgcactcaagtcgctgcacacgcaccagcaaaaaggacgaaaaattaagtgtgaactatagtttttcagccaactgacgtgagttgggggagaccaggaacaactttagcggatttttccgtcaacgcatgcaacaagcgttcgctaccaggcgtttttttacagcagctgaaagcgactgtggtcgccacccgttaaatgttaggaaacccccacctgcgttttcttaaaaccctactgccaacaccagtcggcaaaaagcattcccaaccttgactgtggaaagaaggcaccactcaggcaggatttttttccacgatttccactcagaagccgtttcgtggcggtgtcttcccggtctgttgacggcgtagaacatcggatagttggttgcaggggattcactacttccacacggttttgccaccgaattcagaactcgatggcttttcttcgtgattctttccgctcctaagacggaataatgcgattttcaaacataaagaaagcacttcttctatccttttgtgcaacgactcaaatgagcatttccgcccgcgttgttgcggatgccgctcgtaaagcgctgaccggaaaatagtcttttttttcgccgttgtaccctggttcccatagctcatttacctttcagatctgtctgaactccagcgcgggtttctttgttgtctgtgattctgcgtcgtggacgacgtgttactgtggagcttttgagccctcttgaactgtttgcattgggtgtagtccgctcgacattgaggcaactacgctattttttagtcggtggatcgcctgggaccaattgcgacatgtcatgtgaactcagaagagagatatgccccgtgtgtttagacctttcccccccaaaagctgtttaaggtgactgaggattgcaggagccagaaacgactgcgtttcgtgtgaattcgacacaggagcaacacaccgacctgcacgcagggggatcgcttttggaatattatcaccgttttctgtaggacgtcgtcgtatgccaactgcggctgcgatccggtgcagctgatcatcttcccgagaggccactgatcgagtcacttcaagaagacttccggttactgtcacattttccacaa

SEQ ID NO: 1020 - DNA, 3329 bp, Toxoplasma gondii
cagagaaggcgtaccacgagcagttgtctgtcgctgagatcaccaactcggctttcgagcccgcgagcatgatggccaagtgtgatcctcgtcacggaaagtacatggcctgctgcttgatgtaccgtggtgatgtcgtccccaaggatgtgaacgcagccgttgcgaccatcaagaccaagagaaccatccagttcgtcgactggtgtcccaccgggttcaagtgcggtatcaactaccagccacccactgtggttcctggtggtgacttggccaaggtcatgcgcgccgtctgcatgatcagcaacagcactgccatcgcagaagttttcagtcgcatggaccacaaattcgatctcatgtacgccaagagggccttcgtccactggtatgtcggtgagggtatggaagaaggtgaattctctgaggcgcgtgaggatttggctgctctcgagaaggactacgaagaggttggcatcgagaccgccgaaggtgaaggtgaagaggagggctatggtgacgagtactaaaccgcaagcccgagtacagaaattctggcgatagcgggaaaggcatagcgaacgagaccgaataattccagccaggattttttggtgtcttttacttgaaaaggtgaaggtataaacgaccaagcgtggcagatatggaaaatccgttttcagctggtctatgtacaccagggagtatgaacgttgttttagcagtttcgttgccttcgcggttttttgatatgttctaaacggggagtgtgagcaccgaaaaacttttttctaggctcttggctgctgaaatgtcccgcgaagaatcgcttcttccttgaatttcagtcgacgcccaaccaaaccaccggcactgaacgaacttaggttaagttggccttagcgttctcatttagtgaaggcaccgcaccctaccccgctctcgagagccatcggcgcattctgtcacccctcgggagttcgacacaatcccgattgacgggtttcagatttgcaaaagtcccacaggcgcccatcgctccgtcagtcttggtttgtagggtatctttccacgagaaagggtggttaactagtgtcacactgccgctgcgctccgtcttaagggaaaccgtcgcacgttgttctggcagtctgctgtgcgtggaaccgtttggcggtcacacatgtgctttcgtgacgcacggggagcgtgaagacgtctgaaacgttcggtgttttttgtcgaggagtgaccaggaacgaggttcactgctgcactgtacatgcttgacgattttacatgatattgactgcaaagcagtcccccagactggcctcgtgattcgacacatgaggaatgacttgaagttttccgaggtcatgccactgtcattgtccgccgcgttgtggaacggaccccaacgagtgctgatttggcaaccatcaatcgacttcctttaccgtagacggcaggtattaatccttttgctgtccgaatgaaaagccgtcaaaggacagaacgtctatcaagtctgtgcgtgatcgagagctttcactacaaatatttgtgacagccggaagaggcacggggggtagagtattttggttcttgcctttcttacattattagaggcggaatagacccctatcaagaaatctccacacgcactctgccggcgaacttcaaggatgtcacctgttctgccatgtcactgctcccggaccaagagcaacggaactgctgtacacctgaaggttgtgcatgtgtctagcgagttcgtagtaatacgcacgtcaaagcatatccattgcacgtacaacacacgggtgtacagtgtaattcttgctcgtggtgcagtggacaaacgccacaaaaatatccattcgatgcaaggatttagcgactagcatggaacagcttgattgcgagcctgcagctcggccgcccacaactggtcacgattcgacttatgtaaataggggtatcatacctgcttgtgacaggtgcgcatcgccaccactgaaccatcgagaagtgtctcttggactggagtgtctgttgtaatggaggtatcgttgtggtgtgtcttctctaaggcatacgtggagctcggcaaaacaagcgttgcagattcggatgatatttccattcttccatgttcaggcatgtatgcagggcggggttgctgtcttccctgttacaagattcgctttatggtagaaagcaacaggcgccaaatgctctgactggggaattctaaagaaaagcttacgacggcgcttcttgcgttgcaattagagtttcgatggtcacgactgtgggggatttctgcttagtgtctagcatcggagacggtcgcgtgtgtgttcttccgcgaaaccaccaacagactcaatgctctagactatgatttgacatgtttctttgcacaaccgggcgccccacaacgactctttgtccttttagatgtgccaatagaaagtgtcgattgctcgatgcagaggcacgacagagcacgctgtggttctcgatgtcgccgacaaccctacactcaagaaaacgtcagcatggcctgaggcatccctcgaaatatgccgtttacgtgattttgaagggccgtcaaatgttgtcttctgtttggcctgccggtgttgaaacctgaaaactggaacaccgtcttcacagagtcgacttgtgatccactgaaaatgactcttagattgttctaagtgtattagttcttttcgtgcggcgcgaaagtgtggctgacctacagactacattaatccttgtgtgggatgagaagagggaacgcttgcagtcgatgacctcattttttgatcacagtcaactgcaaaggcaagagaccgcgaatgctcagtgatgtccatggacatggtaagatcccgttatattccggcccgagagaaaagagggaggaatagatctctgtaatatccaccgcggtgacgaggtcacgccgccccccgaacctgcactgtgggaaacctgcacaaacgtttgtcgcacgagattcagcggacgcacatgtttttcttggcagggcattttgtttgaagactcacacgagatactacaatggaaaaaccaacacacgctctgactgaaggcttacatctgcgctgttgggaaacgttttttcagcacaacacggtcttctttaaggtattgtttcggttgccctagcaaaatatatcaaacaccctttccccatgtatgcaaatggcgtccaagtttggtgaaacagccatctgtactcgttgcttgttatttctgtgctttcagttcggttggcgctgtaacggaaa

SEQ ID NO: 1021 - DNA, 2058 bp, Toxoplasma gondii
cacaaatgcaagccactctttggaagcctatccacaaagacatccatgtacttattcctgtacatacaacatgtatatatatatatatatatatatacagacaagcatctgtaagacgtacagacatatgcacacatacatatgcatatatggacaaatatatgtacaagcattcatagggatagatagatagataagtacagagagagacagataaatagatagatgaacagagagagatagagagacggagatagagattcagagatagagagattcagagatagagagattgattgagataatgtcgtggagtatgcggtcgacacagacgcttcaggcgaaccgaatggtcacagcagaggttgagatcttgcgaacagagacgcgagaggaagggagtgagtagaaagaaaagaacgggagaaaaacgagcgtggcgagtctttttcgagtttgaggatgtgaagaagagcacacctccgaagggcaggctgcgaaaacgtctcctgcctgaggaagaaatgggtccgagaagaatcagattcatggaacaaagcatttttagacgaagagaaatatttgcgttactgtgtggagtcgctctggaggtccgtagggcgtggtttttgcagactctgccgcccttgacacttgtctgaaggggccttgcacaacgggagaaaagcgcatcttttcgcctgccaaagaaacaagtctgagggagaatcaagagctgcgagacgcatggggaaaaatgaacacaaatgcgtccttcgaacctccaaacgtcgtgaggacacaacagcaaggctcagctcgaagagcctctgccggatcctcggagaaggcctcgccgggcggctcagtccgagaaaagagggtgaagaaaacgctggacgcacaaagacgcgtgaaagaaactggaagaaggaggtcctgaaaagacggagagaggaatccgcgagaaactccagagttcagcgagccggtgaatgcgccttctctgcgtgcaggcgcggaagacaacgatggagacacggacggccaaaaaagcatcgcgggcgaaaaaatttggacgccacgatcttcacagaaaaaacgaatcagagtggaggggaagatgaacggtaaaacgagcgtcggagaaaatgcaacgagggaaaaagtctcgagatctgacgcaaatgaaacctgcgaaaagaaggcggcactcccatcgacagctagtcctcgctctgtctcctcgtgaccacggccttggagatatcttgaaaacgggattgtcctcgctatttctcataaagagtatggtgccagtgtggaaggaggtgggagacaagaaaatatggcgaaatagagttcaggaacgtatgtgttgagccatgtgcaggcgaaactctcctgtgaaaagccgcgcgactctgaacgaaaaaatctcgtgacacctttgtgagatgatggggacttttacatggggagtttgagtaacatgaagggacacagacgcttactctttccgctcttcgtcactcttctctgaagcctgaagaagtcgcctgctgtttttctgaacggcaaacgacagaaccctcggacggcagctgggtgggtgtctgactttcggagctcccgagacggtggaacggtgtggttccaaaatgtccatatacggagcgaatcttgcggggaacgctgtgttttgacaacttccctgataaacgcctctcttcttattcgcgtaacacacatcacgtctcgtcggtactgacagttggaggaaccagagtggcatggctgttctgtgctccaagtccgtttgacaccgaaatgtttcgcattctgaaggtggaacggatcgcagaaaaacgcgtgcaagctgttgttcctcaaactgttgatttcgtgtgaatccggtagcaagaacagcaaggaagctccgacccagcaagtcgaagtcctggtctctgtcgaatcgttggacagaaaagagctgtctgtgttaacgacaatggaattcacggtctcttgatcctcggattgatctatttctaacaa

SEQ ID NO: 1022 - DNA, 3346 bp, Toxoplasma gondii
gtaggtggatatgatgacgttcacgttctcgatcgttcgggagaaggtctggtagatttcttcaccgtccatctgcaactcgaggagagcgcggtcgaccttgttcacgtggagaacagggcgaatacgctcagccagagcttgacgcaacacagtctcggtctggacgcacacaccttcgatggtgtcgacgaccacgagcgcaccgtcagtgacacggagggcagctgtgacctcagaggagaagtcgacatgtcccggagagtcgataaggttgataaggtacggctgcgcacccttgccgtcttccatgtcgtgctcgaagtacatggaaataccagtcgacttgatggtaatgcagcgttcctgctcgtccgcacgggtgtctgtgaaacgtgcgtcaccggccgccttagcggaaataataccggccttcgagaccaaggagtctgtcagcgtcgactttccgtggtcgacgtgggcaatgacggacatgttccgaatgttcttcggattgcccataatctcacgcatctgctccactgaaaagttcacctgaaaaaacacaaaacgcgagcacactcaatacatgatgccgaaatccaacctcgcaccgaactgtgtgcacacgcacacgacaatcgagacacgcacgaggaaacccgcggcagaaaaatggtgcggatcacactgcaaataaagtgactcgtctgtgaaaagttccatcctcttcactggaacggaacgaccgacaagatttcttccctggagcaaactgctgccactcgaaacgtcgttcacgcatactccgctcacgtatcagccacatcaacatgggagacaaccgacatttaaaagcaattgaacgcacagacaactcactcacatacaaggtagtctacgcgtttagcgtcggtctcggataccgaatcctctaacgcaccctcgaattctatttcttatcctactcaaagccgcgtcatcgcctcgactgcggacccagtgtggcaccagacacgaaccagaatacaaaccgtgaaaatacattaaccgaatgaaacaaatatgcactggggaaaattcttttgactgtcctcgatacaaggaattaccgccgaacttgtaactaccaacagagaagacatggccaccacaacaaatctaaaccagttgtgtgcctgtgaattcgccgtgctcttcggcagcgtcccgcaaagcaactagcgttctggtagtctaatggaacagatgctcgagacaactatcctgagtatgctgggtgactttccttctggaaaaactaggacgtaaatcaacaccactacggggtggacgggagagctgtgggaagaacccgcgcatcacgtggccattgcagtcctatgaatgatgaaaaatcattaatatttcgtggaaacaaagaacatttcgctcttcctgaacagaatcttcccatcttctggaaaactgctgagaagtcacgggagacaagaggattcgctgcgttccttcgccggactgtgggcccgaaaaactagtgaagacgtaccattttgacgacggggcgggggtgaagggaaccggtaaacggacgaaggggagacaaagaaacaaaatacagattccaaagaaggaaaacaacctttgtgagagagagctccggacgctgctccaggaaaagaacccacgaaaacggcacaagcagacgaggacactgggacgcccgaccagcaattggtgccgtttcccccctcacggcggcaacggcaacaggaaaaaccagactcctctgcgagacggcccattccctcgttcgcaacgcgaagtcgcgatttatcagcccccaactctttgtgaggtcgggaccgtgtctctggggggtgggaacgaattgcccacccgaggggtgcatcgcaggccgtagatatcttatataagccgaaagccgcaacttccactggggtatacggcgatatcgctctggtcgactctttttgacggagaacgttttatgcaagttttcatttcctgaccctcgccgattttggttttgcaaccgcggtggatcgagccactgtcatatgctaacgagtcatatacgcagatgaagttcctagactcagacaagcagcaagaggaggcgggcttgccaagtaaaggagtttttttaggtcctcgtggagttttcgcctttataagccgagggtgtcgaaaagagataacactcggttgggctgcttaaagaaaatgcacaccaaggatgtacacatctaatcctgccctttacgaaccgtttgaagtgcgcaccaacgtgtttcgctggaaggatggacggcacagtgcttgcggattggcttaaatagcaggcggtcagggtttcgtggcgtaagactagagcatcttccgcagagacagagtgagctggtggacactctttatggcttagcatgaagtttttctcaatccttttacgttagggcggggtaattcagcacagtactgcgctcagccagctgggtcgcccacactgttcacgcgtgtgcgaagaaaatgaagcgcaacgcccgacactacgaatcctcttgaaccgaccccgcgacttgcaaagaatgcaccagtaatagagccgtatttgttgtgtttttccatgctctgaagtgtggaacttcttgtctgctttccgccttctagaaggtgtgcagccctccagcctcactgggactgaatcgacgtgggcagctcgctgccacagggaggcccggccgagcgtacaactgttctccaagtgccagtggcgtactttctcttcactatagtcattcattttcggatttttccgcaagagttcgagtcattctcgcactctcgatgtcggtgaaggtccctgaaaggaagttgcagggagaccctccaggctttttgcaggctgcatgcgatacctgtagtcaactggctgatgcgtcgtcggcgggttgcatgacccgcgtacatctagcgtttttccgtccgtcacagagtcttctcgcctgcagaataagttggccatctctcgagttcccatctcctggatttcgtcagacctgaagagtacagaaaggttgcagttgagtgggagattggtccggtgcggcgtcgatgcagcggcgttcggccggctttgtgctggacaactccgtgtcaacagcgccgtgaaactgaaaatttttagacccgtggaagcttctatgaggtaaccttgcccactttggcttgggaaacagccatcttcacggtcgacttgaaagagtcttcaagccgcattcggatgaaacgcagttgttgaaagacagagattcctgcaccgaaa

SEQ ID NO: 1023 - DNA, 1339 bp, Toxoplasma gondii
tctttactaccagtgaattttctgccttttccagttgttcatctcgagcgtctaaaccttgaaacgaagacgctcttggaaagatgtgctgaactccacacatcaaaaaacacgctggtcacgaagaacccagcagcgcaactccttttgtgagcgaaaagtccatcgggagcgtacgtccaccaggtgtccatacactcgagagaaaacttcggcgggtcggcactcgctttctctttagcgatcgcgatcgcgttatcaatcccgtgggtgttcaatatgcagaacaactgttgagaagccgcgtttcacgctgcgttcttctccacttgctgtcgtctccgttctaagaaggcgagggccttctgcggatcgctctcgatgaagatgtccccctgctgtacgtacaccgcgcgtccaggcttcagcgtcttcacctcgtgtgctgcgactcccagttcactgtttagtccccgcgccgcctctccgtgtttttcccgtctctcgcctccgccacacccgccgcacgccggggtcttctccatgagagaagaaaaagaaaaaaaggcccgttttctctaacaaaaactacgaggggaaaacgccgaaggggcgaatcaaacggggaaagagcggtgagaacactgccgggacgggagcgggacaggcgacatcggcaagggcaagcgacgacaaaagacgcacgtacagtcagaaacacagagacggggaagagaggaaaagtagcaggcggccgagagagagaaggcgaaggcaaagaagagagcaaacaaaggcggagacaactgcttaaaaaagcgtatgatgaaggctttctgttccctggaaaaagagagggtccattcaggatccacgcgtaggcttcgagcagaaaaaatctggccgaaaaaatcgaaaaagtgtgcgttcctccaagcaactgaaaagcgaacgcgcggagaaaagagaaatggagagcgataagggaaaagcgagtcctgtctcgcttccttgccgccgcgagatgcagaagtgacctctctttctttttcttgagcgctgaacgcatgcatgccgtctctcttgcgcgcagggcgcatgcacttccggaaaaatcgaacctcgcgataagacgaggcccgcgcggcgtactgcgggtggccatcccacacctgtgttttctctccccccctggatggtcagcaactgagtcgagcaaactgggagttttctgaccacgaggccgttggggatcgccaagcaagtcgcagattgtgtttcttcttgttttccgttttctgcttcttcggtgggtagacactgtaaaaattctccacca

SEQ ID NO: 1024 - DNA, 1917 bp, Toxoplasma gondii
gactgctcttcagaatttcctcgaggctcctctgcagacttctttccagagtccccttcgcgcctactcacagcctttctgtcgacgacggcggccgacaggcggcgcaggaaacgcatgaaagcctggtagctgggaccagccgtccatacacttaaatcgtggagggagtgaatctgcttcttgcatgcacgcaaatcttcctcgcggcccgtcgccggctccaccgccgcaaaggcggcgggtgcgccgggtgtacgtacacccgagagcggggcggtggccaagggcgaggcccagggagcgacgcagcagacacccggcgagagcgcgggagagaacgaagctggaggtcgaaagagcggggaagaagacaccctcggcgccgcacaagcaacgccggcagaggagctcatacaaggctgaaatgcagaagaagaagggagaggaggagaagaaaaaggaggagaagacgaagaggagggagggggagagagttccggatctctgggcattgttggagatgaagaagaagagaagggggcgaggcagggaaggaaagatccagggaggcagtcgaaagatttgactggaaaagactgccaagagcgaaaaactctgaaaggaaagaggttcgttcgtttcctcggagaggcaggtgtacttacacacgagctcgacgaaagaacgcgagggacggagaaggagaatccaagagagcgagcgaagcagagaaggtgaggaggctggaaaagaaaaaagaactctgaagcgtcaacggacagtgaaaggcggagaggcgagaagatctcggaggacgatcgagtgcagcagtgtgctccagtgtcaggctcacgtctcgagcatgccttttgccggcaacaacagcggccgagagaaggaagaaaagaaggagaaagacgcgaaagaaagaggaaatgaagtacacaggagaaagaagagtaggcaggagaaagggagaaagtccagtgcgcgagcattcagttttgaggaccggcctgtgaggagacgaaaacatgagaaaacgagaagaaaaagaagaaaagaaaaagagagaaacggaccaagagaccttctcgtgacgcggcgtcaagcgccctgttcactgtcagacgcgttgcgcgtagctagtaaggcgagtctcggcggagaagaagagccccgcggtcgttctgtcttttttcgacacaagaaactgtcagatgcgcctgagacaaggtgcgagaagagtggagaggaaaagtcttcgatccgcctgtgcggagcggcagagaaaccgacagaaaactgcatgcagcttctcttttgttgtgcatgccgcggtcactcacgactctctgcacatccgccggtcctgcctccaaaagaagacaagacagacaagggaatagacggcgaaacttcagaaaatgagagagtgacctcatcccgaatccgtcttgctgcaccttcccagacctcttcctgcgtcttcgatctctcgacctctcctcttcttctacacctgtctctctccttgtcttctcggtctttctctctctctcgctctttctctcgctctttctccctttctctctctcttttcttctttctctttctctctctctctttgtctcctcgttcgttttctccttcttctccgcttcttctcccgcttctcctccttctttctcttcctccccccttctctctcctccgtcttcgctctgctctctgctgtctgtcttctcctttttctccaccgtcgcgtatgctgtatcgccccgtgcctgtgtgtggcagacgcgcccaagtccctgcttctctgtctgctgtctctcggtctgttttcgtctctcgctgtgctcctcgtcgccgactcggacgtcgaccgcgtcttcttctcggtctccacga

SEQ ID NO: 1025 - DNA, 2016 bp, Toxoplasma gondii
aatagtcagggcatctgtggacgggtacatcattcgaggctggagagcaggagcagcctgcgaagtgaacgtggctgcaggcagacaaaaagggaaccaacacaacataacaacttgttgcacgcgaaggtctgagcgcgacagcataagaacaaaacactacaatcacacgatctgcttcaatgttttttctgctactgtctcttttttctctctctatccacgtcgtacaagtgacacgaatatcttcgcttttaagtcgcatctgcggtgaagtctctctgtgccccgcctgccgatgatgagcacgaacgtaaagaatgcggcacttgccacaaaaaagcaacctacaaccgacgccactactagcgtccccagtgcccacttcagcgtgctccttccgtatacacacagaaaaatccactccaatcgtgcctcgcgtagttttctatggtcactgcacacgtttcctgtctgtgaagccatgaaaacgaacgtactcgtctgcggaattggggatcccggaggcgggcactcgacgctgtggccgccatcgctgtgaatctcgttgtcggtgtaaacacggccttccatggggctggattctgtggcgaacaaaagagagacgcaacaaggaatcgacagaatctgtgtgaacgcgcaaatattaccaaagtccaagtgcagaccacctcgacacgtatgcttttatgtcgttagcaaacgtgtgcacattccctgtcaacatgaagagcacaaatgtcctctcggacggtgtgcatacatgtgataagcttctcgttgaggcgtttctcagatatttttcttttgacactgactatggcgtacaaacggctgaagacactggctggatatatatatatatatatggggagagacggacatatccatatactccatggtccacaacacagcccgacggccctactggataggttacatattggcacatcgcattaaccgtcgacagcagcacacgtagaacaaaagcataggggaaaactcagcatgggaccctagtgtgtcagctgattatctgataaattttcgcattgttctcataacttctttctctccagcacttcacacaggcggggccgcgtagcccagcccgcgtctcccggttcccgtctcggcagactttttccacagcggtgatccacgaaatggctctccgcaattagaaccatgcatctcaggaaacagaatttgccttcagaacggccgtcctcaggctataaaggtcatggcttaccaacttccaactgacgctccgaagcgccacagttgagtggtgtgccgggggagacggtaggggaagttggttgcgacattgctgctgacaatccctactgggtacaaagatttctgaaattccctcaccgcttagtggaaacaatttcaacaaagacaagtgcagagagagaggacgcgcgccgatacatgcctttcgttgggaacggataaggaattcacagccctgagggacgcggaagaagggagcaaaaatgcgccggagcaaagttgctgccgcgtcggctgaaagaagctttccatttgtcagcggggttcctcagtggtgggggataggaaggccgcacacgctgtagcgtacgtaatgcacagtccccaaacgcaccggcttttcccccccccccccccccaccagggggtatctgtaaggtctcgcaactttggaggacgaaacgacctgtcgttgtgtcttacttctctgttcacgaacaggagacatcatcaagtgctgtgcatactctgagaaaaccttgtcgcaggccagcccaaacatgaaaaaccgcatagttcttctttttgcagaagggagacatcgaggggccatagcgatggactgtcacctgaatgtagcctcataccaggaagccgcgccctctggagtcacaaatagactgaatgacagtcttcacccataaagaatgccgaagagaactatttaatttagaacagactggctgtcaa

SEQ ID NO: 1026 - DNA, 1308 bp, Toxoplasma gondii
ccccataaggagaagtttgctgttggtcccagagtcgctcctctccatcttgctcgcgtacgtcaaacgctgaagcccacgaaggaaattcaagaagacaagacagttgcagaccacatgacaggcgtgtctccagcctcagcggcacgcggaagtatcccataaagtgaatgcacggagacaacaatgtgcacagatggttctccgagtacttgcgtgcatgcacagatgcttcgaatactgagggtgactgtaagtgcaagtccacaagcattgagccttgtgccaagagaaatcgttcttgcagttatatttagcgggaagcgtcgtcttgtcttccaccatgaggttcgtctgcgcgtacgatttccacaagtgtgacccttcaactagagcacgcgaggcaaccggctagttctcctccttcatccctctgagtagtgcacgtgaactgtagaaaatgggaggaaggcagaaagcgacgaatggggaacgccagaacacaacgaatactcggtacggagtatgacaggaatgtaccaccgaacaccggatctgggacagccacggatgccaaacaagagatccacttgtccacgtatcgaatgggtattgtttgcaagagcgagagtctcctgagtgttgctgtaccagttaaacgtctgcaataacggaattacagtcacaggcgggaaacaggaaaagtctcttactagcgggcgtggctggacatggcaaagctaggcgacggctaacgtcgggtaaaccggggcgcctgacactaaaactgaattcgtcttctccgtaattttttagtagttttgcatgtcgcggtctcagagatcaacaaagataactgttgcgtgaccgcctctcaagaaacgccgcatgatctaagtctccacagctgcatgcatgcatgcatgcacacgggtcgccagccaagctgttcgagtcttgcgaaatatgtcagcttcagcgtgtgaatggacgagggaacagtggaaacaaaggatgcttttgagttcgaatccttgcactgcaggaattttcactgagaaacgcatagagtcgaggaaccgaatgagaaatccgcaagcatctgagcttccccgtcggggtgcgcttcgtctgagccgacaacgcaggcggtcgcgcgaagtgtcggtcaacgtgtaagtcacttcagctccggtagtgttaccagttgagggatagcaacaaagttcctctttttatggatttgtacgacgttcgcaagccgttgactgcaaccgcggtgtgttttctgctttgcccgatccacca

SEQ ID NO: 1027 - DNA, 4364 bp, Toxoplasma gondii
cctgaaaagacagatggtcgtcgctctctccctcctccacatcttcccagtcttcttcttcgtcttcttcttcgccttcttcttctctctcctcgcctgcgccgttctctccgtctcgttcctccggactacctgctgccggtctctcgctcccaacgcgagacgtcgagcgtcgttcgttcgttgccggcgcatgcgcaggagtgggcaggcgccgagcctcagtgtcttctccctccgccgcgttctccgtctccgcttctctcatttctctcgcgtctcttcgctcgacgcagctgtcgcggctctcaggatctcctgctgtgttcacagccatgcctccgaccagccagttcctctctctggcgaaagaagagagcaagaaacaggagaggaagcgacggggaaacggcgggggaaaagaagaaggagacgaaagatgaggaggagaggaagcgacggggaaacggcgggggaaaagaagaaggagacgaaagatgaggaggagaggaagcgacggggaaacggcgggggaagagaagaacgacgtagaacaggtcgcgaagatcgaaggaggctgggagatgagggcaagacggtcagatttacatggagagaaaaagaggaagaagcaaacagcgaagaggaataaaaagaggcgaagtaaagcagagaagacagaaggccggggaaacacagagaagcgtggagacgggagtgtgtagcagtgagggagtagagcaagccaccggaacaaagagggggtcggaaaggcgacggtgagagagcgctcgtaaatggaagctacaaaaaggtctcgctggcgagagaaaagagatgaaacgcggggagagaaggaaactgaagaattccctgaagaccccaaagatagaaaaagatgctgtgcctctccagtcaaacaaaaaattagacgcatatgtccatctatgtcaccatcaagaaacacacatggctgcatgcagacatatatacacgcacatacatgaatgcaaatatatgcatatatatttatatgtagacagacagatacggaaatatttgttttttctgtgtcgacgactctctgtgcatgtaccccagtgtgcaggaaacgacatgaaagtctcagaagggcaacaggcaaaggaaacgcgtcaagcagtctacatgcgagttcgtcttctcttgggactggactgaagagacctttttcttcgctgagttttaggtcctcaacgcttctggcggctggaaggagagagcggcgctgcccaggcagcaggaccagacaaggcggacgttgcaactccgcagtggctctggggattttccgaggagcaaacggcgaggcctttgagaagcgaaggccgggagagagccggcggaacttcccaaaagtttgtcagagcagaaagaggtgactttcgcgggggcgttctgtcggatgcacgcaaacgcgttccgacaggctcgacatgggattccgcggaaagtccttttctgagaaacgagcgaaaaaaatcaaaaacgcagaaatgtcgattaggacgcggaaaaaaacagccgaaaaacgtttgcgacacatgcacactttcccgacatacaacgcgaagaaaaggcacttttgcggcgacagcagtcagcagtcttcatggctttgcttttttttcttcctcgctagagcgagggacgcggccggactctgtggagtcggggggtcattgctggacttccgataacgctcttgtggatatttctcggaactgaactggagctcctcgtctccggcgtcgtccgcgcgactcaaagtcacagtctcctcggaggcactcacgacggagaaccgaccgcaggactgtcgggaagtcaggtttttggctttttcctcggcgaagcaaaacacaaggaatttgtggctgcacagaggacgacagctctccggcaaacaagcctggtggatgtgggtgagcgcaggccaggagcgagaaggagcaaaaggtagccaggctgggtggatttctcttttttttgagaggaaacctgtgagaagttgccagttgaagaaaccttggcgacgatatgtggaaggtccttctttgtgaaggcctttgtcagcaagaagattcgcgatcttgtgcagcgacgccgctagggaatgtcggcgttgtctgctgtgaacgaccggggaaaaaagtgactctccaaaagtgaacagaagacatcacttccacgcatgattggagagactgcgcgaatctctgattccttccttgggcagcgaactggtttcgctgcgagagttacgaagtccaaagaaagctctgtactcgagcaaaaggtacgagagcttcctgaaagcctggtaccgacaaacgattgatttccggagtgacacagacagtgaacggtggaaggagacaaagagaaggcggaagaggtgataaaaaacgagagatggagaagcagagaacgagaaaacgatgaaggaaaaacagagtacctgtgaaatgcgagtgtccgcgaaacccaagctcgctgattgtcggctccttgctcctccctcctgttctctctccctgtcttccacctgttctttcttgttttctctccatctgttctctctccctgtcttcccgctgttctttcttgttttctctccctctgttctctctccctgtgtaccgcgtgtgtgcttcgcttgtcctcttcctcatcaagggggagcccagcaaacggatggcggaatttctgacaatcagcagtccgagagattcacacctcgctcccaaagctcttgtggagacccaattgagaaaagaccgcaatcggctgcatcaagagaaaacatttggaggcaccgctcagcctgcaatgtcgccacacttcgcttcctccatttcgctttctccatttcgctgctccacaaatgcggatttcgagtttgacgcacagccccgaggacatgcatatatacacatatatgcatgtgtatacatatatatatatatatatacacatatttatattcatatatggagagagagagttatctgtgtattcgcaagtaagtgtacctgtgcgtaactgcaggagagtgtgcaagtaataggaggcatgatgtccgcaaggacgcgtatccaggaaatggtgacttctggcctgggcaagccgacaactttggcatttctcaccccagcgcaaaatgcaactggcgaggtccagaaatgccaagaagcatgcacgcatatgtattcatagaaatatatatatatatatatatttggatgaggattttaatttgcgaatatacgaatcgatacccagcgtataaacccagtctagagagagaagcagagataggcatcattgatgcttgtacgttgtccggtatgtacctactggactctgcaattaacgaggaagttttgtccagcttctgcggagccgctgtgttcgctctttgtttttgggggtaggccattctgtttgaaatgtgtggtattttgagcgcaagaaaaaaacttcagtgcgcttcaacaaaaagtgaggtatacgacgcggttcctcgaagtaagcgtctggcttcggagagagccgttttcttcccccatcccgtcgatccctccccccgcccagcaagaagcgagaatgagcagagaggtaaactgcaggacttcgtcatgtcctctgcgtgtgcaataatgcctcttttaactctcgtcacccattggatctaggatccggtacgccagaacctcttaaattcacagtgaggttctttcgcagctgcatgcgatcgaacatcgcgagtcgccggtgtctctccgacgcggtgagtcccatgtgggatgcatgcgttttcagcgagttgaaattgtttctctttcggaagaagcaggtgcctcttccgttcctcccaggtctgattgccagtcatcctcgttttttgtcgatcgtttttgagtcgtaagcaagcggcgcagcggctcttgtcaagttccgcctttctctgccgggaaaaaggaaagcttttccgagtctgtgtgttcctgagactctgtgtgactctgaaatcttccgcttgacgccaatttcgtcgttttctgcgtcgcatgcaaaagcgcgtgccctttgaggtgtttttgtcaaagtagtttcttccgcgcatgcagagactcgcgagtttgaagattcgtcaagccgaattttttcgctggcaagttgcatgcagccccgctaggtggtgccactgggctgtttcgtgtgagtctctcccctcattcttgcgacagggacaattttgtctacgaggaacgacaggttttgcggcagaggttgtcaacgcagagatttttcaggcaaaa

SEQ ID NO: 1028 - DNA, 2177 bp, Toxoplasma gondii
tgtggtgcccgagaattttggacctgttcctcagaaatgggagaagatccgatcttaaacaagggatgcgtgttcaatcgcctgtgtgcatgtttacgcgtgaaatacccacagtatctgtgcgtgttttttggtgtagaagaggtcgcaaattcgtggatttttacaacactgcgtgagtgaacgcgtttgggggcgacgggacacgtggagagtcagagggattcgctggcctctccgtctctcagcccctccttttgtcttcggagaaaggtaaagcaggttttgggcttggaacattctgtgaaaaaagtgcatgcgcgacacttgcgtcccgcccacacgtgttgacccctacgtgggttgttggtgaggctcgcggagacagacacgaacagaagtactttcggagagtgaagactcgctcttctttggcatcattcagtgagggttctaccgcttcttaatgctgtccgagaggtgcccggacgtcgcaagaaacagccagagaacttctcttttgcgaagatggaaatgacagacgatcatcagtcgaaatgggtttgaaggtttcccagaaaagcagctgcgggaccgttgtggacttccacatgcccaaaaacaacgatgtgtgcagaaaactccctctgtctgtccgctcgaatgtgcacagatcacagctaagcaaggaatagaaaaagtaccccattgtaagtggattgccaacacacgtcatggtctacacagtgctctcattacttgtaaacggctcactttgggagagacgcccacagggtctggggtagcaagcaggttatctgagctgttgaaacatgctttttgtttcgttgcaaatacgcgtccatctaacttctcttccctgatgcttgcgaggctcgtgaggcgtgggtgagagactgcgggagcaaagtgggatattcttctgtctcggaaacaagacagttctgacttttctgggggtgtctgttctttccctcgacagtctgtatcttgcataataggagcgacacacgagtagccaaggaaatgccacggagggcatgtcaaaccagaaattctcctggatccaagagaagggacctctaaacctatttagagtcgtccgttctgtgcagattcaaagatggaggatctctacgaagtccgtttacttcccagaaactctgcttttccgcgagggtgcatccttgcacttttccccccttggtgtggaaactggggacttctctgcggcaaatctttgcatacaggcgctgtagaaaaatgtatagacgggatacatatatatgtatgtatatatatatatatgcatatatgtataggtgtatatatgtgtgcatctctataatgtgtatctgtggagcagtgcagcttcatccgttttgcactccccagtgcactttccacccagcttggtttcccttgttcagcgacgtgcctgtcgcggacggggcagcagctgagacacgcctcttggaagtgttgcttttttctagcgcagagaaggaacagatttcacgagaacttcaagaaggcggagagggaaaagtctgaggcagtcaaaaagaccaggtcttgcggctttttcgcctgcgaaaatgtgcacaccccacacagctcgaggcgcgcgagggtgcccttcggcctatagacggcgaacgcgtggtctccagttcccccccttgggtcccgcgtcgaagtttcttgggtttttcccttttctctggaacattcgggtgtctcatcgctggaaaggcgacacggcctctaaactttgacgacgttttctgctttcttcgctttttttcctctgagttggcagtggaactaccggggtcgattttggcagaagtacccaggagagtcgggagacagagtctctgtggacctgtgcgcttttctcgtcctcgatcgttttctcgtcttccctgctgcgtcgtcagtctctctctcttctctcatctttacctccgtctcttcctccctccggcaatttcctccttccgttcgctgcgcctcgtccatttgttccgttcccgaggatccagtttgagcagttgagttttttcctctgtctttgctcgtttcttctcctctgcttcctgcaagctccttctcttttccgcagcttcgttccgaccattttcccctgaaaa

SEQ ID NO: 1029 - DNA, 3024 bp, Toxoplasma gondii
aagcagctgcacacagcacagcagacactgacagccatgttgaatcggcgagagaaaggaaagagagaaacgcgagagaagagaaggagaagagggagaaaggagggagagaagacagcaagaagagaaatggaagagaaaggagagaaaagagagagaaaaaaacgcgccataaagagatgcacatctagggagggacagagaaggaaaggcagtgcgagggagagagatggaaggagagttgaagattcgtctgcccctgcactccatccctctctttgcatttctcgtgaagccaggattttccaactgtcgcgatgtcttctcgggtttccttccccgactttttttccaccttctcccgccttccaagtcgcgagttgtctggccacccgcgagcgcgagctccgaggcgaagggaactctcgctcctctttcttctcttttttttggcgacgtcttcacgaagaccagtccgacctgctggctttgccggcgtcgcgctgccactggaggaccgggtcgaggatccagaggagaatgcggctgattagaatgagagaggaagcaaggaaaagcagaaggagaagaagaaggagaagaagaagaaggcagtcacgcggatagccaccgacatgcccggtcgagagacacaagcccaagaggcggtcggcaaagtccaggaagaacagagtagccgaggcctccattgcgaagaaaagacagcgcgagggggaaggcgtagcagaacggggagagccgcgggaacagccgaagtggagaagcgaggataccgccttcttgagactcgaaggcacacaaagcagaacgcagcagcaagcgaaccgaaggcgccctccccccgtcttcaaggtttctctttcgcttggcaggaaaaggctgtgcagcgaccacggtaaagaggcgcaaacaggaaagctgagactgcgaagccgagaaagtggagcggagaggagagccaatggagaagctccgcgagggcagagggaaacgagaacggagagagagtgccccggagcatacacacagagagaggactcgagacacaaggtgaggaaaaaagaggagccccagagaaaaaaggaaagaagaaacggaaaggcgaacgactccgtgacaagttctgtcggcgccctcgcatgcgcgtagctcaccacgctgtcagttcaccaaacctcacaagaaacatgtcggagggggcaagatctgtctcggtctgtctcctgcaaattcttgtccttcttcttctgtcaatcgatccgtttcctgctcggctttttcttctcgagtgcgttcgtctctctttgcctcggatggcgcgtctggagccgctgctgtccgccggggaaaagaagccgccagagctcccgctactactgtctctcggtctctttcttgttcccccgggtgttgcctctctgtccctctctttctcttttctcgctctttctctttcctcgcttcttctctgttctcgctcttttgttcgctctctctgtcttttctcgcttcctttctcttgttctctgtcttgctctctccctcgcactcgcgctgagttcgctgtcttgctctcgttctcgttctcgggtctccgtcgcttcagcatccggtgttcctcgaacatctgagcactcgactcgtctgtcgcgccatcaacgcgacaggcagactggcctcttctctcctctctctttctcttcgccgtccatggcagcaggtgactgtcacgacggaaaggaagaggggaagagacggcgttttctctcggcagcgccgcctctcaggaggcagagagtctctccaagaaggtaggacgcggtcacaacgctccgtccagatccagcttcggttctccagcgttgcgtcgggggtctcttcgccgctccagcgtcctcttcttcggattcgcagagctccctctttctttctttccttctttccttctttctggcgtcgatttccagccgtctggttgcaaagaaagagcgagaatcggtgaaacctacctagtcgcgtcgaagtgaacatctggccgaccgtccgttctcgccgatgtagctcagtcggtagagcgcgaggctcttaacctcgtggtcgcgggttcgagccccgtcgtcggcttttcttttttctatcgtcgaggaacttcgcgtttttcgttccttctcctcccctcctctcggaaaatccttcccctgccttcgttttctgggccgcgtaacctctcacgagaaattggtgcctcttcgcgccagcctcgcgaggtcgcagtgaaaattctgccttccacgcgtctgtgcacgcattctgccgcagcaacacggagcgcagttttcttttcgttgcatgcgcatgcatctgtgaaaactgtcgggaaaacagatccccgaggagagccttgggacccgcaaaaatactcacttcgtttcgctattcgagacgcaggaaacgaggcgaaagaacggctaccgatcctgcctcgcgcggccgttgggaaaacgaggagctcgaagcctgcagctgcgaggccgactcagcgaaaggtctcttcggggggcttcaaacgcagtggtttctgcttaggttgtcctgtcttctttgtcgtcatatccttcttcggaacgacagaggggactcgcgcagcacggtgcatctctctcaggagagaggggtgcggcagaagaagagaggaaatcggccgaggagaactagaaggaaagagtggagagacatctgaagggcaaaacggagcgatacgcgactgcggagcctttttttttcttcgatttctcgcctcccaatcccaaccgttgtctcgcctcgcgtctggctcttttgcgtctgcttgcccgttccgtagccttccgtgatacgcatgttcttcgtcttctccagctgtctcctcgtcttgtcagtcgtccccttctctccgttcttcttctccctctcgttgttccttctcgtcttcctctccccgtcgtctcagtttcttccgcgcga

SEQ ID NO: 1030 - DNA, 2793 bp, Toxoplasma gondii
tttctccgccagttcgccgttccgagggattctcgacgaagtcgaagggggagagatgcagaggcgttcggcatgtctctgccgcagaaccatgggcgagtggagtgtgccggcgcccccacaggtttggcgcctgagaagacccgcgcagatgatggacggaagcctccgcgggggtggtgccaacagctgctgtggagaggagcgaagacttgcggtgatggcatcgctgcgcctccggagacactcgcgaaagcgggagagacgactcgttcgtcgtccctgagagccgcctgtcgctgcctgcgggggtcgaaaacaggcttgttcctcgtctaggaaaaagagcagaagaagcctgaacgctggccctcgacaacctcccagagcctgcctccacttgccacaggcgcggatccattggcgctgcctgtgacggttccctgcccagggaggcggcgccgccaaggaaacgcatgcagcccggtctggaagggagaaaagactccgggggacaagacagcatcgacgcaagtgcgacggctcaacaaatcgaagtgcagtcagcagttccgtcgcgccttggctgtagactgtggtcttctcgcgaggaaggacgaagagggagagagagaggacagggaggacgatggagaagcgagagagggggcgcgtcagtctagcgggggggaggggggggagcggcggcggcagggtcagacaggagcgtcgaaaacaaataagaaatcatctgcgaacgcgtcttggttggtccatgaagcgaggagctcgggaacgagggcaagacgagatgccatcaggactccctctgtccctagctcctcgtccaccgctctaaggacagagacgcccgatgtagagctctgtcttccgagagagtccccccgcccctacaggagcatcttcatatatgcgcatgcacatcgacatttatatttatacacagagggaggtgtagggagagtcagagaggtcggatgcagcagacggagagcaagtatcgcgtagttgtggttcccgttggcagcagtgcgcagcgagaaagcgaaggtaatcttgcaaaggacggtcacctggagttcgagaagcaagacggaagagcattgcggtctcgagcgagagcggaaaacaccgacagcaaaacggatgtcttccggttcgttgggccgttccgagcagacacaccagagggacttccgtaccagacaggttcgcgcgtggatttcccgatcgcaagttctgcacgcaactcatgtagaaagaagtagcagcgtaggccgatcgatgctgaagtcgaagaagcgcggaatttctcagagcccatgaagactcccgaaaagggtctctctgcgtagcagaccatgaacttgggtcgatctcggagttgaaagggagtccggcttccaaggagtgcacttcaaaaaacgagacgagacttccagaacagagtccagcgtttcaactcccgacggttttcacgggaaagcggccactctttgggcttgcagacatcgcgaacagatcgcatctaccgatcggacagaggcaggaattccgatgtgtgttgtcgtggcgaatgcctcgaagcggctccccagttgcttcgctaaaaaagagaacgacctgtttcctctcagacccaaggtggactgttcgataaagctctcgcccgataaaagtgggtctggccgtgcaccgaggcagagggggaaaccgagagaggcagagaggaccgcggaaactccgcagagaggaaaaacacagaggaacgctaagcgttgcgagaagcagaaatcagctgcgatgcatgtacatttacgccggggaacattcttctggcagactcccagctgcggacagactcagaagacacacacttgcgtgtgcttttcttgttcgcgccctccttttctcagcaccattttcctgtccgtcgcctttgcaccttgactcgctcccgccgttgcctttccatagacggcgtctgtcgacgacgagaggagagaaaacgcgaaggcgaggggacaaaggtagcgaaaggagaaatttcacagactggagtgaatctgtggtaaggttgtcttggcagaaaccagcgtccggcaaacgcgtgccacacagctaatctggaacggcgcagttgacagcctacccagttcgagtggagcaggcccagagaagcgagtgaccaaacaaccgatggaaaggcagtctgaatctcaatgacgctcaagcaatttccgctcttcacagtgaaatcgatacgtcgacttctcgttctctctcgcctcggccgtccgttcggggcgggcaacagaggaatttcctcactccagcctctttagctcagtcggtagagcgccagccttttaagctggtggtcaggggttcgagccccctaggaggctctatgccttttttctgctcaacttgtctcgtttgtgtctgcagtttggtgggattgtgttttccctgtttcctccggtctgtagctcttgccagctgaagacagtgatcagcctgagtggaatttactttcctttgaccttcgatacggggtccgccggagaccctcttcttcctttttagactggcgacgagctactgagtgcgtagggaaatgacaatccaaaccctcaactgtccgccgggccataaagtagaatgtggagtagaatagaattccttttttgcgtaaaaatgcgtggaaacctgactttcgattcgggctacagatagtatggtagcgaaaaaaagatcgctttcgatcag

SEQ ID NO: 1031 - DNA, 4538 bp, Toxoplasma gondii
gttgctcgcatggccgtcgaaaacggcgtaaagcgacatgtcttgcgcgaaagccggcagcgcctctttgctttctcgagacccggactgtgcaagttcctcgagagtcttggcggccgcaggcgaagcagtccgaagagacggcgtcgcgatgtgagcgtcttccatcgtctgtcgccatccctgcatcgaggcggcaccgaagcaggtgatcgtgcgaccctcttctccaccttcttccgagaccttctgggtcttaggtttcgccagatacgctcccatcttcgcgcagcctttgaaagcgcggagacgtccgaggaactctcgctcggcggtgatcacgcagatgcagggtgtacacagacaccgtctgaggcgcggagcgggaggagagcgcggagaggagactgcgacggaagatgtcaggcgggagacagagaccgttccgaaaagagaacggcggcggacgaactgaagaacacccaggcgggagaactgacttcagagaaacgacgagtttgctgacggggaagagacgggggaacaaaaggttcggtggaagctgatgcgagtggcgctcaacgcttgggttccgcgagacaggcgaaacggcatgaagcctgcagggcgttgagccgccaaaaggacagcaaaaaaccggagagaactcagaggctctgaagtcgcaagtctttttctccaggaaggaacgcgcagagacgcggtggaagcggaaaggccaggtcctaggcgactggggactgtttaccggaaacaagaaaagagtttgaccttccccgcggagtcagttcgggagaggccgcgaaacagagacaacgcgcgccaccgaaaaacagatcgcgttctgacaaaaacgtggaacggcgagtttctctctcagatcgtcggcgctcggagaagtctccgtgctcagatagtcacggttccgcacacgagtcggcagccgacgcaaaccacgcgttcctcctctcaagggcagatgatcccgggctgcaaaggcgggcgtttccctctacaaattcacggggaacgcgaggggcgggaccgtccgcagaacgaacggagcggaggcagaaaaatgcagagaaactaggacggacgggagcgccctgggctgtgtagatggggcgggcgcacggtgggagttctggagagagcgactggctgcgaaaaggcgattcccgagagaaacccccgaaaaagtctgggaactggaacgcgcgacggacagggggaggagtttgtcgcctgcagagaacgcaagaaaagggccgacgaagggagaccggaatgaggaacggggagacaagagaacggggaaacaggagaaaaggcgaagacaagccagcgcggtccctacgctctcgcggagggtcgaacgaaaacgggaaaaagatgttcgccaggtttcgtagaagcgcgagaaccaggcgcggggaaaagagttctgggaagggcagcacgaaagtgcgattgtggaaagaacgcggtgccgcagaaaacacggatcaaccgggaaaacgctctgtcgcacgtggtgattttacacgacctttttgccccggcgctccgggaagttcagggctttccgggacggccaggaacccccgaacacgccgccgagaggggaagacaagaagacggtacagcataaggctttttcgcgatgcaaccgcatctccccctcttgaacaaggccgcacgctggacgttaccccccgttttaattggaaaacgattgtcgtcgcgttgcccctatccctatgttagccgaagtcgcagtcctcgcgtcgtttcgctctccttccgcacaaactcagacccctgaaaggcgcccgaaaaatcgagacaccgggaaaaaaacctcttccgcgacatttccctgaatatcagacagaccaagccggtttgtgcaggaattcatgcggtacaattatcccaccacccttctacccgctgtaggagggtcgccacacggacttgtgcgtcgctcctaacaaaggggcggaaacagcctttctgccgggcttcgacggagaaaggttacgttttcgacgtcttccgggcaacttttccactttcgagtgtctctgtagttgggagactgtgggggaaggtacgtttttgggggggagacggtaaatccaggtagtttgacgcagcagccgtgtaggcctgaggggagggtgtgccacacagaggaacctgaagcagagaagggagcagaaactcgaagggacgcggaagactaaatctggagcacatgatcgtgaattgccgtacagctgatacagctgtgtcagaggggacgatccagcaatgcccgctccggcacactcgggaaatcgacacaagctaaacaggaaaggcggaaatctggacggattacgtcttagtccgcagattgtacttcgaagatgcactccatctatctgaaaagcgtaggttgcgaaattctgcccgcctctagattgcgtctgggaatttgcagtccacttcgttaccccctgtgcaaacaccgtcccactcacactgaacaacgcagaaacgtcacgggcagcgcattcgtcggtcgtattctgctaggctgttaaacggttgaacaggaggtccatcggatttgtcctgtcagtaaacgcggaaagacttgttactgacgacagagcccccgtaattcgcaggcgaaccgtctaaggcaaggatcgaacatgcttcgctaagcagagaagaaccgaatcgatattcaccgtagtagccgtacacatgcactatgcacgttgaacgacaaagtttctcaatcacattttgtgctctgggcgatccactgtatcgtggaagctccggcagaacgttacttcgatagtcacgacaaccaccgaagatatcactccaacgaggactgacgtctctaaccatgttgaagaatggacgtgggtggctaccactttgcctgtacgtctttcctcccatccgacctctaccgcgcttaggatagcgtctgcagtatgttacagaagctgctgcaactttggattgatgacagaacaccgtgcaggtgtgtacgctcgaagagcgaaaagtctggactttccaccatcattgtcatctactcttagaactgctgatgtccgaatacgatggagttgatgaaggagtccgcgtacagaaacaccgtgcagcgcacaagaggggagcggacaatgtgagaagtagtcatcaatacgcgttcttcctcgattcaggcagtctccctagcacctcgtgcacacttctcaaaacgcaatctacgtttaccgggaggaaataaaaggaaagaggcaggaagctgtcgcctgtccagcgtagcaatcactggaaacaaccgagagcgctggatactactgccgaaaagtgtgtcttgctctagctgagtactcgggaatcggacagtcaaaacttccccaaaaatggatccttttcttttcgagtctacgtcacgattgtgacacacgccactctgcaggcgtgatttctgatctgcagtgccctgtgaacaactcattcgcgctctgtcctaaccacctcttccctacccagcaaactcgttgagtagcgttctgctctctgatcgcgccatggatccctggtccctacgttccacccattcaccagagttctttgaatcttcaaaatgaagtcaacaaacgacgcaaagcacagtgtaacagtgaatcggacggtccgccctcggaagcaactctttcagaatgtagcgaggggcctccgatccgactcgagatgtgtcagcatacagagtcaccccgtttgttgaaatgccgtaggtacagattaacagaatacatacgcaatgtatagtatgccgtggatctctaaatctctacccgagggcctgctgtgcgaatgtgtcgcgtcgtttaaaactgaacgtggaaaccgttttcgtgcgatcccagttactcggcggcgtctgaagtgtgtccctcttctccacttcaagactgggacgggaacgagagttggacgaccactggaagcgggcgctcgaattttctaaagttggcctcgggtgttcgtccggtatctcgcagcagatgacgcagcactccccgctgtttaaggaactggaatcttgaactgtgcccctctaacatcgcaccgtctctgcgcaccgtcgctgttccgcgactcccgtcagagcgatatcgcgttgcgtcacgtcatcgttattcggtttttgttcgggaaaatggcagcagcgggacgaacacactgggtagtgtccacgccgcttccgtcccacctgcgaaggtgcgtccaccacaactcacgcgactaggtgctgcggctgcgaattcgcgttcccacactcgaccagatttttttgattttcgatttccaaacgcgatttattccaatccgccttgtagcagactaaccggtgcacttttgcacgtgtacgcaagacagcttcgcagacaacatctggcagcctcccgctcatttttagtcagcaaaaa

SEQ ID NO: 1032 - DNA, 4062 bp, Toxoplasma gondii
caacttacgtgctgtctctaagtcgcttggtgcggagtacttccagccggtagtctttccaccgcagaggatcatcgtatcgtgcatcttgcagtgaagccacagaagggcttgttgacattccggaggaagggacttgggatcagtgtgccagcctgccaggcagaaacgacagaagtacacaacgccagaggaaaattgggatccagtccgatgttgtttttattactttatacaactatcactgtctctcattattacgcgagcggttaatttgcaagtttgatccgtggacgtagccgtggttgctgaagctgatgatcgtcgggggcacaaaaatatgtcacggttaatttgtgatagctcctcagcaatagggaaggaaatccgtctgactctgaagagaatgtaaactatattctggataaataaatggcttaaactgcatgacgtttgatacagggactcaggtggctcaatcgcctgtcagaatatctgagtggcacagcagattctggcggtatatgcacagctatgcagtctgttcggaccgcttgtcaccggagtaaactcgctttccacgttttccacgaaaaatacgaccgagtatccaagtttggtgtctagaggcttgttacgttccgtcactatccccgcgttgaacggggtcttccttcccagtcattaaagagggctttgttttgtgctggggatgctcaccctgtttaagggacacgtccttgagaactgcaagctgttgtcggtatgggggagggagcgacgtgtctacgagaccctcgaaaggcgcgtacagtagatatactgtgtgccacacgctgtacacaacaaaccgaacatagggagaataacacagatggctgaagcgtctgaacaaccatcactgtactacatttgttgcgcgacacacgctgcagtattttgaacggttccctctgaaccgaaactgaattccgccgtgacggttcctcgcttttggtgggaaacaccggtcctgattccgttgattttgtcccggttcgcatgccaacaagtacagtggttccgattgagtgtgtcagtgccgaaattgaagatgtgtagtctctctcttggtgcgatcaatctgtctgtggaacgtctgatatctcaacgcgggttcttcaggaacttatcagactgactgcttttcaccaatgtggtgtctggtttaagcattactcgactgtggcagcagggcaaccgaaaggaggtagactcgtcttgaactggctcgtctccacctctagcatcttcgagcaagccccaatgggggctgttgtctccgcatcttgaactccaccttgaagcgcagcgcctcctcgtagcacaggcccaccgacagtgactgatttctcgtaattcaccttcaccactgggctctctgaggaagaggacatggttgcggtctcctgccgccgaatccagttcaaagatgggcctccttcagacaggaaggaacttcgagaaccggcgtgctcagtcaccagtctgtcgcgggaaataaatgacggtgcgcgggatctacttccggagcgtgccacttgatgctggagagcggctttctcggctgatcgggaggaacgtggaaacagaacggggtcaccgggtaacagtgagtcgaagcagtttgagggtaagacaaaaatggaaacaaggaagcacattgccgcaagtagagctgacgtttctcgcagcgatacgagagaaagacgccgatgtttcccgacagacttcatggcggttatcctagtatcggcaaatgctgttgtcccgtgagaggagcagtgctgttgatgatcaacagcctcttctcaaacaaccgttacagtagaaccacactcttgagaacatcgaccggagaggaaagtgtgcgagacacaaccgcctccggcgattagatactttctccaatggattctcgcctcggacaggacataacctgattaagtgtcgcgaagtcaatagtcgcaaatccacaactgaaaagtgcctgttatgcaaaatgcttatctgttgtctacttgagaagtaggacggcacagccgagtccctcacggtgtgaaccgctctgagttccagtcgggcataactggcgacggcgtgttgtcgccggacgaatcggagaagacagcattattgacgtcgccggtgaggatcaagggctcaggaagaaacccttcagcttagcatttgggtgcatataacagaaaggtgaccgttttggtggaaaaggggtgtttttggtggaaaagcggtgattcagccgaatctcgagtgcaagccgccggcgggcaagacactatgtctctgcaaacggctagccaagtaagggggcacttgacatgccagaaggctcaccagtcctaaatcagtgaaaatacactctgggtcacttctccaaggagcttgcctggtgagacacactgcagaatgtgtaaataacaacctgtactaagtagacatcggtggaaagaggatctttgcatgggacggcagccacgccactcacgtgaccaccggtcacagacgcttgttccacagaagctgaactgcgagaaaaagggatttcgcttttgggtggaggttgccggacgcatgagttttcacgagtttcatcgttattgatatttcattggcatgttgatgacgtaaatgcaagcaaaccaccggttttggatggaattacttttcattttcaccacttgtattctgccttgctcccacttaggaattatatacgaacagtacgctgtgggtacaatgatattttgactgtcgaagcggcttagtgtgtcagtcaaagacactcccaccggctttactcgtgttgccgtggtttctcagggggagccttgctccaaagcattatgcctttccaaaacagtcctaaagcgagttgaatacaccttgtttttgtgtttgacttgatgtaccctgggatccagaggactgcgggactaccgagtaaggatcttagcgcctgtagtaacagccatcttcattgtcgtagcacagccgcgaaggttggtcatgtatccagtggcaccgagtttacacaaagccagcgtacggaatgttgtcgccggcagtgatgctgtcagcaagattccccatcaacgcccaggatttgcgtcaaagaagtttattttcacggtactataactggctactaccggccgagcagtgtggagagacgagagcaaagtcgtcagtataaactccaaaccgatcttaatcgtgcaagcaacacttgaagcaccaacaggacaaggcgccacctgaggaaagtgtgatgctcggcagagtgtggcgcctctcgcagccccaacagttttggttgctttgtatggaaacgcttcttgctgctccgacagcacgctgagtgtggcaccttttgtgtttgccccacacgctattgctggggatgcataacttacaaatatcttcaacaagcatatgcacgaaaggcacgaaattggtgacaccggaaggttgctcgtgtacttgcaagaaacggctttgcagatgcatcacaaccttccgtcccgtgatgtatgctgcgcaagtcatacttgttcgttaaaagcgtgtcgttgaccacgcaaacgtgagacagaggtctaagataagttttacctcagaattcccctccatctgtgccgtaaccctcctcaaaaaggcggccacgttttttgcagatgcacgacaccaccgtcttcggtcgaatcgttttccacgttttctcggtcagaagccattttcggcttaaatgccgtccgcccagccgtgttcgaggattctgtagcatctggatcctggaaaataatggaacgaatatgaaaacgattatttttgtttggaacaatgtggtgtctcgtcgaaccctcatctacagtcagcctttcttttcgactggaagtttgacgggttcacgatgatctgcagcaaatgagctgacgctgacacgcgcaccggtggcgttccttcttcttccagtccctccgcctgcaacccctttggcca

SEQ ID NO: 1033 - DNA, 2703 bp, Toxoplasma gondii
gaggagaaacgtatcctacagaaagtggcgtgcgacggcgaactcacccgctcctctgctaaccttttcgccttttcctcctcctctgcttctcgccgtagacgatcttcatactgttttcgatgcatcgacctgtagtcgtccaacgcagcatccacggatttgcggatttcttctcccgtctctccggcaagactctcctcctctcgccttcccgaggctccttcagcctcgggtctgctggcagcgtcagcagagttcatttcgtttacaattaacttgcgggcaacagcggttttttagtctcgaaatcgcatggttcccaaacgacccccaggtcgctgacagatttgccttggtcaaaccggcgaggtgccttttgtccagctgtcaccacctcttcacttcaaagtccacctagtgaaagcgcagcgcggtatccccaccgggagcaattcactggaaacttctacggaaactaagcgagcaacctcagttgccagaaaacacggctggttcgcagacggagtcgagaacaaacacacgccggggtgcccctaggaaacgtagaatacacacaacccgcaccgggctgaagcgggcattgatttgtatcatgaatgtagcggggagaaaaatctgagccttgcagttaggcgtccgcagggcgtctacgttcggtggagtaaagacgctcgaatgcacaaaaaaattgcgacacgcagaagacacaacgctgtaaattatcctcacgcgagacaagaccgatctgtcgaaagtaaaagctgaaacaggaccggcacggatgcggaaaccaacctcgatacgtgccttgtgtgagactgcgctgcagaacgctgttgcccaaagtggacaggatgacacgtcactcgtcaaggaacccgttttgtaggatatgcgttgacgatccgacggtatccattgacgctccgaaggtctttttctggatatcaaacggggactactgagcagcaagccgcactccggattaggccgggaagactacggtagcattcccctgtcttcatgagggggaacagtccaaggtacggcagcatatcgccgcaggccgaagttcacatcgcaaatagtgctgcggaaaacccagctcgaagacggttagatgttctagacgttcagaggcgccgcaatttcgggccgactacagtaaaagagacaatggacgctgcgttgacgtaggggtggctctctgcagctcctacagcatctgactacaccgttcagcctgctccgtcttttcttcaaacgaaaaaacggattcgaggttaagacacggcgtcggggaccccgtttccgcgccgtgcatatatcctgcaaagtcggtgttcctatgcgagacgggtgttagtcggtgcttcgcggcggaccgggaagacaactcttgaggaggcaagcgaaagaacgcgcgttgccttacaatacagatcgtcctgacagaacaagcaaaagtagtttctgcctacaaggaattccagccttgttgccggacacgcgtgcttttttctcagcgttccgagcacagtgcacacgcagcctctgtaggcggccacgcatgtgccgcggagagtcactgttccggttttgtcgacagctgctcgtagttttgagaaaacgtgaggaagaagggcttgcgtgactccagtcttctttctaaaggtcctgtgcggtatcgtatgtcgtgtgtatgcttcataaacgtagatctgtaactgtggtgcgcttctgtcttcccagcggcggctcgttgcgctgtgactttcgctggattttttccaacttaccgcttcgacctctccccaaggggggcgcttccgacccaagtttcactcgtctccacgcgggagtttttttttcgtggactcgagtgcttttggtcacagtccttttttgttaaacggggaaaactgaagtcggagttggacgaagcctgtcgcagctgcagaccagctgatttcgctgcgcttgcgagacaccaagcaagtttttacgaatgcgtctggagtacatctaactgttgtttgtacgctctttgtggatactgcggacgaacttttcacctgtgaacatccaacgagaggtatcatgtcgatttttaagggaccttcccggtcaaaagcggcatcgacactccatcgaaagatcgaggcgccagcagcgaactcgctgccccagcctcgagtgtgttttacaaggaaggattttcttttctcgtgaaggagcgaagacccaaaatgcgccaaacctcactctgtcagaaacgctgttttcaaacgcctgcgcgtttgccgtttcgcggtcgctttcgtggtctgttggtcgtcaattccgtagaagttgtatggatttccgcatttgttattcgtatatcgggaataaactgcctccagacactcttacctcggctcacgtatcaaaaaccaggaagctacgaaaggagctgagagcggggcagaacggggaaccggggtaagttcttgattgcaagatattttagggattctttcgtccaccgcacacgacatttttcgcgagccgcgaactctcccagcttctctccttcctgctttcccgtgtttgcgccctcgctcatttcctatataacaccggagccgcgaagaaacgcagcctgtaaagtgcgagtctgcggacgttctgggcaga

SEQ ID NO: 1034 - DNA, 4519 bp, Toxoplasma gondii
actgcttctgcttgggaaacgtcggcgtcttctccctttctacttgcgcccgtgtctcctgtggtccgccccggcgtggtgtctcctccaggctcaagcggcgaggcctgtggctccgcattctctctggggaagccagcagaaaccgccgaggtattctgaggactggccgaaagccgttcctcgctgccaaggagtgagtcttctcttgcacttccccccgaatccttttctgcgttcggcagcggaagctccctcgaggacgaaacagtctggggagcggcggtgggcctcagctgaaaaggagagaccttcgcggacttcgttttcaagtgagaaagcgggaggttcgtcggacgagaggcccccgcgaggcctctcgagtgtgtgcaccccatccacccgctgacgaggggagacgaggacgcgagctttcttatctgtcgactttggcatacatagtagcttccaggagatgcgtctaccccaaacaaagcatgcggagaaacagtgttttctaacgtggacgggaacgccccagctccagctcttcagtctggtgggtgctgcgtcctcagactccgttgcacagggttgacgaccctcacacagagaaaccgacagggaagcagaagaaggaaaactttcctccacaaaagtgtcgtttttcaggcgttgacagtgcgctgagaggcagaaagcgccaccgcggaagcggaagagacgaggacaaagagaaagagggagaagacgacgaggagatggagagaaaggaagaccaggagggctttcgacagacgcttgtggtcaacgaaaaaactagtttctgtgaaacaaaggtccacctcccgaagagacaaaggtgaagaagcaggaaacgggagattcagagtctcgatcagaagtcagggcactgcacgcgcgcaggcgagaacggagaagacgatccggatagcctttagagaaagggaggaagccagagggaatgaagacagtttctataagaggctatattggagagctcctgaagagtaaggcgaatgtgttccggcgaggacgaggcgggagacggagttcagagatcgaaaggagcgaaaacacgatggagagaagttgggaagcatgcaagtgaaactgcctcccctcgaaagaggcaggagacacgggaagaagcttgtggagacaggaggaacctccagattgagtgcggagacagaaacgggacgctccacacagcgggagttgcggccaagaggttgcagttgagagggaagtgtataggtttcgttgccatgaaaggcgcagaattcaacggaaacaaatgcgcaaaagtcgggtgggcacaaaggtgagaaaagcaggaaatcgaactggagaaaaagccacgcgcacttttctcgctctgttgccggtgtctagtcgcgcacgcgtagagcccatctatcgtctggggctcgaggcgagagagtcgaaaatcacacttttgaaatcgaaaacagaggaactgtcgccgtcaactcgagaacggagagaagttggcgactgggtttttagcggcacaaaaaccggaagcgtcagagtttacgtcccgtgcatcttctccgtgtctcctagaccgcccgcgtaggaaagaagactgacgtctcaggggcatggatactcagcagggatgacacctgcggcactcgacctcggcatgcagtttttgccgagccgccttttggaagcctgcgatgcggagtccacggggggtccgggtccgggagtcgttttctggaaaaaatgcgaaaatgcagaactcggaaagtagctggtggctgtcggtgtccctggtggagcgctgcggcgggcggtaaaagcaaagacaggactgtttgtcgacacttttcataccccgcctaggcccagcgccgatgttcacttccctgctcgcttgagacctcctctcagcatccgtcacagaaggcgtgaggggtggatgttgcactgatctttgcatgtctatcaggcgaaagaggcctgaagcggaggaaaaaaaggtaaaaacccagtcttcgccagcaggttttctaaccgcagctcgacaggctgctgatcttgagaggagggggtgaggtgggcgaattcggcagcggggggtacaccatgtagaacttgagtcgactggggacgcgcgtctctccttcgttttctcttctgttctgaagcagtcgcgcatgtgatcctgcatccatgtggatacgcgcctctctgcgtagccccatctggagatcgacacgctgaggtacactttcgtgtgtcggatgcggggtactgggttattatgtcggcaggcgagtgtcctcagacgttgcgcgtgagcaagagatttgcacacaagatcctgcactatagacacggcgatacacctgggcgtgtaccgaaagccacatctcgtgtagccatcagttttcgttatctcaggtgttcagcttgtaaacaggtagataggtttccacacaaatctgcagacaggaagcgtgcacgcatgtgctgacagacaaacagaagagtcggtgacaaatggtgagtctgagaaaatcccagcagccgataacaactacgggcacatgttcacgaagtacggcattccaaaggacccctcaggaaagaagtttctgacttcgtgagcctggtttgcgatcgaaagcactatttcattcgtactccacgctcaatctgacgacacatattcctttatgatcccagacgttggccagtgaagaacgacgcaccagcgatgagagaatcgtcagctctcaatcttttgtcgatatgcgctttctcgtgccggcagtgtacctgagtacccataactcaccctaatcgtctcactgatcctctggcaccttaccgctcctgctttcttcagagtcccggttttgtctgtatcacggtgtccatccttgcaccgtattgcttgttttctttgcttcggtatcttcctgttcctgcgcctgtgttgcatcattccaagcaagcttggtctcctggcagttcgtcaaataaatgtcgcacttctgttgtcgcagattgttccttccatctgggtacctccggcacacgattctgtccgattgaaatgcacaccgcttcagagctcgatcgctcccgtgatgtgtcacactgctgcctagttgaaaaatgcacatgcagaagtcaggggaaggccaacttgcaagcaaacgacagttgtttcgtgcgggtggaattgtggagaggcaatttcttctctcgaaggaaactggataaccaggctgcccgccgggagggaacccaggtaatgccatttttgcggaccgacagagcgggggctggaagttaagggaggaacgaactgctgatagaaaggcgtatgatactagccttcttctccaggtcgtctactgagcttctagactccagcaccacagctaacaaccggctttggtcctcgagaggtgagtttccgcagtacgagagcggtagccttcacctccttaacaaaaccgtggtgctgaaatacgaaaggtctgtgaagtcgtccaacaatagagtgtaggcaggtgcaccaatcttgctcggcaaaccggctctttctgttaacggggcaccgcttctgaacagcctgctcctgccttagcggagacaagaatatcctattttcgttgtcttccctgttttaggcggttggcatagccgcctgaaccgactcagctctaaagaccggcggcagtctctcaacacaaatttttcctaaggtttgtcaccaaactctgtacgctgaaatgctgttctgaaggacggtagtctggccgttgtgttttcctcaaatgtgtttctccccctaacgttttgtgttttaatgttgaaccgaatgtcagcagggatcaaagggttctgggatagacagatgccagaaaagaagacgcgacgctcagctcaaagacaaccgtggctgttcgcagggtgctccatgtctcatgtagcactctgtcaattctttgtacctcaacttctctggtctcacacaaactgtgtgatagtaggttacagacattctacttaaaattaactggctctgcaaaccctgaagctgtatataccgcgctgaaaagctgtttgtatttgtccggagacgcgttgcgctcccccatttccgacgctgtttgtcgtgttgtcgatgccagtgtctcagcggcagcgtcaaccccacatgcgggggtttcttgcgggcagtgtctgcgtctgtctgtctcggcaacctgcatgagtctgtttttttgagcctggggacgcagcgttttgttcagtgtatatcttgtttcttttctcgtaattgactcccgcttgcactgattccttcccggttttctccgacgtcgtctctagcctcgttcgtccccacgcccttctcgtcgccccaaagtgctcgcgccgcgtcgtggatagctctgggacagttgcaaagaagtacgcttttgtgttggcgacgaaaaga

SEQ ID NO: 1035 - DNA, 2416 bp, Toxoplasma gondii
gaagaaggacaagaaacctgaggaaaacgggagcggagtgggtcaagacagacgagagaaattggcaaaaaagggagagacgaaagcgtacacagaggagagaagaaagaggagaacaagcaaccgagcagaaggaagagcagtgaagaccagagaaacagaagagaagagcaatgaaaatgctgaagagaaaacgccatggctcgtagaagaaggaacagttactccaagagagaaggaggagttcagtccgacgaactgtcaaactcaccctctgatagacaagacttccgtgtttgttgttgatgaagagagaatacatctttctcaagcgaggcgtacttcggcctgcgagaggcacggagaagaagagttgaacttggcgagaagaaaacagcagagggaaaaggctgtcagaatatccacggggaactccgaggggacggaggcgaagaggggagacttcctgctccgagagaaacttccttcagagagccgacgaatctcgaagaaagtcacgacgcgaagaagacatcggaaaaaaagtgaacgccagcgaaagacgcagaagcatgcgagagcgcctcccactgcgaaaacgacggaggaaaagagaagttgcgcggcctctcctgccctttcctccgcataaaacttctttcttctttcttttcgaatcttttttcaccgtcctctctcgtaagagaagaaaggaaggccctcagacgcctatgggagaagggagagagagaacaagagagagagagcagggggagaacaagagagaaagagcagggggagaacaaaagagagaaagagcaaggggagaacaagagagagaaagagcaaggggagaacaagagggaagacaagagaaagaagaaaaggtgacgaggcagaagtctttgtcttgcagatttggcgacggagtgacagttggtgtctgggggctttgaagaaaatgtcgagacgaagtgcgtctaggccaaagtcgcgaggcgagcttcgcctgccctgcgaagcttttttctcgaggcagatatcgagaaaaaacggaggaaaaatcagttgggaactgcatgcgaaaatcgcttctcgtttgaggcaagccccgccaggcgagcgagtccagaggagtgcagcgaccgtggacctggagctcagagagggaaaagcgggaggctttgtttcctcggtttttgtgaagcgtctcggcgcgagactggaagagaacctcgaaagcctccttttgcttttcccaagctcgcatcgggcttcgcgatgcgacacacacacgcacaagatttcttttttcccccgtacaaagagaaaactccttctttttgtcgtctgaaacgcggcattccgcgcttctctcctcgcctccggtcttcttccggttgcgctcccgctgtttcacccgctgtccacgctgttcataggtaacaccttgacgaaagtttgcctcgcattgacttttgaattcccccttcctcaagttcctcccatcattccttcgtcttcgtcgtctctccagcctttcggcgacctcgcgctgcctttttctcgcttcttctctcctcagactcaaacgcagccgtcgcagcgcgctcgagcgagagatagaggtctcgcgccgctgggtccccggccgctgatacggaagccgataaggacggcgagggccggaggagagaagcagaaaggtcgactgtgcctcgccagaagaggagaagaagaggagagaaaaaccgagacagagacagaagaacagctcgtgtctctgattcgcggagtgccactggggaaagcgagacaggtcaacaagcgaaagcgaacaggcgtctctcgcgggattgacacacaaaaacagagtggaaaaatcgagctcgaagacagagacttccctccttctcattctcgcggttcttgagaaaaacgaaacaacgacttcactcgaaacgcaaaaaaaaagacaccggaaacctatgtgtgagtggctactctcagacgaggacgagacccccgaggagaagaagccacagggccgtttctctcccgtttccttgctctcgttcgtttcctcctttcttcttctccacgctcaactcttttcagttctcttccttgcgctgcgtttcgcagtttctacatccacgggggcattttcatgtgccaggctctgctcgcatctgcaacgtcaacgcactcgccaggatctagccttgagagagaattccttcctctcacgtttttgactctccctgcttcttctctcactcctctcgatcggacctctgctcgtcttccatcttctccttctgtctttgcagtttctctcttcttctcccgcaatctccagctgtctcccctcccaccgtacctccctcgcttctcttcttccggctccccacga

SEQ ID NO: 1036 - DNA, 3685 bp, Toxoplasma gondii
ttcttcataaggacctgaaagttctccacggccttcacgacatcttggagaagtctgtccaccaggcgcgtattgacggggtcgaacttctcggtgtactgcagagacagcaactgcaagcgtactcgctgaaaagccacaaattcgtcggctgcctgcgagtgcggaccctctcctgagcaagaagatgaagacgaggaagcagacgacgaagacgaagaagaacaagcagaagaagaacaagcagaagaagagcaagcagaagaagagggaaggacggcggaggactggatgagttgcggtggaaaaggcgagaagccagcgtcgtttttcggagagtagcggcagaggaagtcagcgccagtcccagcgtgagggccaggtgtacatacactcgagtagctgtctgcacgggatgcgggcaagtcgtgtcgcgagcgaaggagacacggtcccaaagggaacttcagtttgccgttctcgtcgtcttcgtttctcggatgtccggcggtttctcttgaagacttgttgaaagaagaaacgcgcgttgtatcccttctccccttttctccttctccttcttctccttcttcttctccttcctcgccttctctgtcttcctccgtctctgcctctgtctggtgcacccgtttccttgcatcttctgcggttgcacacgggggcgagcctgcggcgtcttcctcccagagcgcgcgcgctcggagacgcaggcaggacctgtttccggcctctctgctcagagccttcacttctgtgtgtcgatgagaagtgcggcaggagacgggggcgggaccgggcctgtagaagagcgtgccgctgttgccgaggggctcaggcggctgtggaacgaaggagagaggaggagtcgagtacgcgcctccgcgtgagggcattttgaagtcgcagcatgcagagagagaaagagaggcaggagaagcaggagaggcaggcagagctgcgcgacgaagacgagggacggaaggcgagaggaacctgagcagttgcggcgggcgcgcgccgcgcagactcgcgctgacgtcctccttgcagagtcgtcaggacggctcggcgtccggtgtacgtacacccgaggccgcagacgcgggaggagacatcgacgcagcggaagtgtggaggagagtggagacggggagcgcagcttcctcggcaaatgaagaagttccaaggagaaaagcgacgagcgcgcgcggcgacgcaacgctgttcttcttcactcttcttcaccgcagtgtctcccttcttttagtggcgcaagtcttctctggcgggcacacccggcgagtgtggcgatttcccgagagaaaagtctcgttcgagaaagaaatgcggagaaagcagcgcgttctcactaaaggcgtccgcagcgttcccagaaaaagaaagctgcgtgcgtctgcagaggggcggacctactgtgcgcggcgtctgctctttttctctgcttctacgagctcgagaaaacggcggggacgcgagaaacaggcggagagaggaagaagaaaattcgtcggtctctacaggcagcgaaagggaaggaggaagtgcgttctgctcgcgcgggacagagaaattcacgcaagcgagcaagcgaagaaaggggggtgcgaatcgtgtgtcttgtcaagtgcgtgtcgaacgcggcttctgcgtttctcactttttctcctactctttttctgccgccgtgtttcaggggggcatctctgcatgtagggaagacggcaacggcagcgtgagaactgccgctgtcttcttcgacggcagtctgcaactctttctgcttctggaggggaggccctctccctttccggggcgtctcccgttctcgcttttctcccctggctcctcggacgtccggtatctctccgtttctccctctttgcttctccctctgtgcttctctcctctctcttccctggctttctttctgggtggctctcctgctgctgttcgggtcgtcgcgtcgtcggtgccgcctgccggtgcctcgctgcacgacggtgagtcttcgtctcctcgcagaggggatgagatgctgagactgaaagagacagaggctgtgctgctggcagtcaagtgctgcggctttgactctgagtgcgtcgagaggcgaactgtgggcagctgcctgtcggggtctctctccaacgcatccactgagtttaattccaaaagaactgtgctcccgctaatgagcatcctgtcgtcagtcaccacagcgacgctttctctacctgtcagagacaactgaagctagacgccttgtcacacatagtcgtgtggacttgcctgttttccgcgttccagctaagggtcttctctgggccagcttatcgccgcccgttcggctctcaactgaacgacacgcggcaggaaagcctcttttcttcctctctctgactgtcagagtatgcagcgaagtccgatgggtgccgtctttgtcgctgctccttcgtgctactaaaaaaaagtagagagcttctctcaagacttccatgcggtgtacatacaccccaactgacacccctggttcggggatttaggtatctttgctttcaagtttcctgccagctttttgcctgcttctttgtgcagtgtgtgacacagcatccagcaagacagcatgtgtttagagtagaacctctttcaacacagagtggcagtttcgtgtagagactggtgtctcgcgctctcaacaagaagaggcagagcgaccttccctgtgagaacttgtcgccgagcctttcaataatttgtcgggaggctttacaacgaagctctcccgtctaatctacgggttttttcggtggctcggataaaaccatttctctgctgttcgtgctgggggaattctttctcctaagaagatccaccagcaaagccgtggagaaccgagcccggcaaccgtgtgcggtgtcccccagagaaaacgcagtcgttcagtgaagggcagcaatctctgtcttccgcaaaagcgatcgccgacgaagatgcaaacattttctctcaaaaaacgcgtccggaaaaagccgacgacggggctcgaacccgcgaccacgaggttaagagcctcgcgctctaccgactgagctacatcggcgagagtcccatcgtgcctcctctggattttcgtagctgtcctggtgttatgttttctccgagctgacgtgctctttttgtgagcgttgctttgctaacgagcacttagaggacagaaacgtcacctggaactggactctttagtatctcgaacgcctttgctggctgtcagggaggtgtacagtccccgcatccctcagacgtcaggtacgcagttcaccgacacaaagaccatgattgtggcggctgcatctctctagatgtgatgccagtgctgtgagtgtcgagttctattcggagtcgctattcggcgctttcaggtagtaggggtttgacaagtcccgcatgacgtgaagtccagtggagttccacatgctttgctcatgaatcagcatgttctttcatttgtgtccccacgcagctcgcatgtcctctgtgactgagaaaagacccgatatcctgtgtttctgcgattctttctttggcagttagaaagtctgtttggaacctttctccgagttctcgcgtgtgtggtgggtatctg

SEQ ID NO: 1037 - DNA, 1714 bp, Toxoplasma gondii
gaattctcagcctggtaccgccgctttcgaaactatcctcaaaacccgctgtaccttcagaactcatgcatctccctctgtacagacacacgtgtgagaatgtacattcctattcacatattcgcagacataggtctacatctcggcatgtctgtatctctatatatctacatctatatgtctatatgtatgtttatgtatatatgtatgtgcatgtgtatgcttgatgtgccaagcagtaccttttatttaggattcgagtacacattgggtgggagggagtgttggctgagggaagtgagcgtggaagcgacttcgagactcttgtgaagagcttttgtcctgatttttcaaggcagtgcggaacgcatgcgaacgaggagaacgtcgcctgcggaaaaagatacgtgtcagttctcgtcgatgttgaaggcagacggtcgcatgtttttcaggagagagagtggaagccgtgtgtatcgaacagcgtgctagcaaaaaaaagaatggaagaaaaaactgaacctggagagcagagctcgcaagcagaagacacaaaggagcgacagagaagcgcagagaggcacctggtgtggcaggagtgtcactgagggagagtcggccgaccccctcggctttcttgagcaatgcctctcgacgaagaaagacaggaaaggcttgcaaaggagacaaatccgaacggcctctgaaaaactttagtccgttctttggtggatcgagcgacgcggtcggcacagcggaaaacgcggcagggtccccgcagataaaagaagaacgagaggacagccgcgagcagagaatggagaaggaaaaaggagcaccaacgatggaaagacacatagagagaagcagagaggaaaagtcagagaacaggggacgagcgagaggaggaaaagaaagagacacggaaacaaagagagaaagagagagaaacgtccatctgctagggagggtcgtgtgtatcttcgctctacgagccccgagactcactgcagtcgagttgtgcggaggaggacagcgatcgatgtcgaccgccttcctgagctcccgagaagctgcagaacccccatgatccaataagcagaagacctcctgacggctcgaagcttgagtaaagagctacttttagctcgagacagagtgtgtgtcagtatgatctgtctgagaagagatcccgtgtaaaaacgaaacgagaaatccaccgcatgtgcatgcgcttactgcatgccgtgtgaaaagcttagaaaggattttctttcttcctcaaatgtgcgcaagaaaaagtgagactgtgctgtggcaaacagccagtcgtgaagaggcttcttctctttccgctaggggcgaagcagctctccttgtcttgccccccttcccaaatctgctcgccgtctctgcagctcttccactttcaacgttgacgcgcggaagaaaattgtccgcttttttcctcgccgtgttcacatttttcgaggtcttcacccgcctcaaacaagtgaaacagacccgagccttttcgtcatggcgctgcagggaaggaacgcgatcttttcctcgtctcgtcctgtatccgtctccagctaaactctccgctttttgtctctattctgcgtctgcttctcttcaccacacctctgtgtctctcgtcacttctcaattgctctctcgtccaaaactccctctactgccgcca

SEQ ID NO: 1038 - DNA, 1639 bp, Toxoplasma gondii
gagtcgaacaagcttcgaaaactctcagacacactgatagagagttgtcgttgacggacaaggagagccagcgtacttcatctttggagtactgacagtcgaggtctgcagctgtgtcttcgtgatcttctgcctgcggagaggagccttctcctgcccatttctccacgaatctaacttcttgctcctgtttgaaacagacgcgcttcgccactgcgccgcccggcggctgttctctctccggctgttccatgtttcgacttcttgccgaagacatacgagcgggagagcgccgacgttcaagctcgagagaagcgcgaagggagagcacagacgacgcggacagagggtggacagaaagcagacaggagctgagtacggtcggcagtgcgaggacgaccagttcttcgcctcgagcgagaaaagcagggatggaagacaacagcagacggacgaaggcgagccggaagaacgcaggccgtgagcgcggaggatgagcaggaagcgagacggagaaggacaggaaagaaggaggaaggtttccacatccacagcgaagagtggaagcagacagcttctctctcgctgtcgggcagagacagagtcgtcaggcggtactctcaaggtcgtacaaaaaatacgaaactcctctcgcgacccaggcagggagaggaagagagttcgaagacgcaaaaagggatgctttcgcaggaagcgcctccgacgactgcgaacggcgagtggaaagcaaggcgaatccgcggtagttctacacttcagctgtgaacgactttgttctgacaatcagcaggactacgcttgacgcgtcctccgccatcgacgtcgggcagggcacacagggaaaggagagaagagatggagagcggagacgagagctccgttgacggtgaaaaacgaaacagagagaaaatggacgagagaaactgcgagagcaacaacattcctcgtcgggagaaggtcctttctcagagaccaacgcttttccctgacatgtttctcaagctcgaacctcagggaaacgcatgctgtggcgaaagtcctcaacgcgtttttttcgtctccgttttagacaggagagtctccgcgactctttttcttttcagagaggggggagcttccagaagttgtgttgcctttcttctcggcaggagaacgcgttgcgaaacctgcatgcgaaatccagtgacttttcggtggcgcaagagacggaggaggaacagacacccagttccagcttcctaggttctctgcgaacagcgagttcagagtggatgtcctgtgcctccatcttttttttgaaggagagctttttgcgaggaaaagaagacgcgcccctccgatgtttcgtccttcgtcttggcacatttttgcaaaagtccctcgctctctggcggagttcccggagtttttcctgtttccatttcttcacccgtcgttctttcttctttcctcgcagagttcttgacaaaacgcgtccgccttcccccgctctctccgttgtgccctcagatgcaggcgcgcgttcgctgggcttccgtggacccccggagaaggcgttgatgagtggctgcgaaaaatagactttttccgacgttttcaccgtgtgaacaggcggcca

SEQ ID NO: 1039 - DNA, 4317 bp, Toxoplasma gondii
aaaactgggtgtctttgcggtcgttcacgccctccaactgcagcaaagagcaggacgggtactggttgaccttggatctgcagagacaccacacagcgggaccacaccacctgagacggctgcaagcatctctgagtctcggatggaaattcacagctcagaacaaagtgagggtgttccctcgacacaacgtcatcggccgccgcatgtcgacagcggcccagaggccagtgctctccagcagacggcttcaagtgatgcaaagtctctagtgcttggatccttaggctgtttcctatttgaccaggaaaggcgtcgctgtcgacgaaaatgagtcacgtgaacgacgggacttgttgccgcctcgcttgagacacatcgaagcgcgtcacacgccatgatgccccaatacacctgcaggtccgccaacttccaaactagagagattcgtcagcgttgaacttttctttgacagtggatcttgaatggggtgaacacagattactgtggaggtcctgacaccccgcgacgcgagtgtataggctaccactactttgtcaggccaggacattattccaccgcgattgcggcaggtagcttgaaaagcatacagggcgggagctgcagtcagccttctgacgggtggatactcaggaaacagagacgaaggtacacgaggagagagggcagtcaggcacagacagatatgctaggttcgtggaccctgaaggtatggcatgtatagattccaggttcgaacggccattgacgtcgcctgctgttttccgagggaacatggacagaaacctccgtcccccgcattacaagaaaaagtcgaaagacactcgtagttcgtttctgcaggagactgcgctctgggcaagtcagccgctcgcccccacagcctcaagaaaatcaaggaaattcactatccgaccgcgttgccgcaggcccacaaagcaggtccgacagacgagtttgtggcctcccacatgtcagagaagagaaaacgaggaccttcgtccgtgtcaacaagcaaattcgcatgccgcgttcaccgtaaaaacttgtggagcaagaaaaacgtaccttttgtatccgagcacaatcccccgcacatacagccgcacgggctgcttcgttcctgacttcttcatcctcgcgacaagagatggcacacttaaccacaaggaaaaaagaaggaaaaatgtaacaagagcctgaatcgcgggacttcccgtctcctcgcaggccagaccagtctccgcttcagcaaatgccacgtgtcgatcgaaaacgggtctacttcgctccgctgcaacagacgagtcccccccccctgagaggccgccacagtcatcccactggatcgccttatcgacgggcgcatgtcttcgtccgaacagaaagtggcgtaattgaacaaaattggagaaaacgtgcagcccgggtgcgtgcgagtttcgcagaagtcagcctcgcactgcacatccgaaaaacgagaaaaaatgagcatcgcatttgtgtgggacaaagcgagagacgtccaccagctgcttccacatcttacaaagcccctgttcccccactgtttaggccacttgattttgatctttcttccaaagaattgcttgtatggaagtgtagggacggtgaagctgcgaccagggttgctaacgggacattgccgagacattccctgtcggcttaatcatagttcctcgaaccggcccatcagccaattcccggggaatcctccggtaatttcgctatttccgtgggaacggtggtatatttgatcctctcacctagggaaccgcaggaaaatcgagcctgagggaacgttgaaagcagacatgggcgggcgggctctaagcttcagttgccgacactccgggatctataccttcactaactgggagttacccacagatgagcgggaagagtctgcaagagctggagttgcttcatgacgagatttgactctgtaggcattggtagccccctttatctggattccgcgtactggtggcagatctcgtgctcaagggagcgagtcgccggcttaacaggaacgaaaacgcacgcgtcgattcacgcacaccgaaacctctaaacacgaactgagctcagttcgtgaattactctgcgccatcagtcaagaggcttacggcgagcgcgagtctcttcacaattatggcgcagtgcataaagtgcgcgacatcggaacaagccgtggcgacgatgcgtcattcaacattcggtcgcacgtattgttgtgagaggcaacctcagcgtctgcccattggtttgtgtctctagatttgttgccggcgcgaatagcagccagagtgaaagatatgctgctgtgtccgctcgtaacgtcgatagacttgtgctgcctatcggtttgccatacgcgtcagtactcgtacgagtgtggcctgattcgggagcatacccactcagcgccttgcctgtaacattctacggggtatctcggactccgtcgtgaaaccctcgggttattgtgcttaccgactgtccatcctcaaaaatcatgtaacaacttgattttctttggaaggatcggacgcttctcgcagcgaaaaacaaaagggcactgcgcatcggataccactgaatcagccttccgacactcgttccggtaatggctgcaaggtcttgcttctcaagacagatattttacaggttggcaagcactctcgaccccctgtacgacttacgggagtgcccctgtgctggtactatccgccccgtaacctgttcacattatgaagtggcctgctgagtcgggtcgcctaggatgtcgttctccccacttcagaaagttcacagtatgtgccattccagataaagggggctgccgatgtctacaaagtcactctatctgcatggatcaactccagatggttcgtagtcttccctctcatctgtgggtatctcccagtgagtgaaggtacagatcctgtagtgctggcaagtgcgttcccacgacggggatacggacagaagttgcccactcgaccagtttctcgcctcagccaaagcaacagtcgtctcacagagagcgagctgcacctcatttcgtcttgcagttttgtttaccggcaacgggtcgtgtgaccgtccgctctcaatccctcacctccggtcccccgtatgcagagtcaaatagccaacagtctgtcctacaagcatgacaagatcggttatttgtgcacccatttctaaatgccatctaccatacaaaaaaatcatgtgggtgaaacgaaacagtacagtgtgtgtccgtagggtctcttcgtccgacgggcagccagcaccgtcgcatacgagcacgcccactagaaagccgcatatacttgtgagctacaaggtgagcaataaagcgtgtccctgtttctccgtttcatagtcaattatgggtaagtctttgttgatgccgacgaaagaaactgcgccactcgcccggaaaactttgtagatccggcgaggcaagccacaacacagcagccggcctggccggttcaaagtgcaaattctggagcatttggcttggtgagtgggagaaatgtcaattcatggactccatttctgccatctgtgtcggataccaaagatctcggacactggaaaacgtgtttatttgttacggcacctagtccgtcgttgctgcgatggcagacaacttggttttgatcccaacctgtgctattggcggcttgattaatgatggcgtttatttatcgctagaatagaaaggctgttcctgtctaacgcgcacatgagcatgctttgggcttcagggtaaatgaagttaaattgctctcctcagtccccgcgttgaccgggttcttgccatttcccgcgctcgtttattgttgtaacacacaaaccgctagtgcttgccggtggtaagctgcgcgccagagggagggcgcgtcgagaatgtggcgttacatacaggctgctgctgtcagctacgctgctcgcgaaaactgtggtggttttggtgacggctcattcaaaatccgctcttctctgtccaccccggagtgcagcggtatacccactgtgcgtgcgtgcggctcttttctgaaaaattcacatgaactggaaatccctttttctgtgagcgcgcgcggattctgggctcggaaagctttcggattttcacattcggtgtttcttgtccgggggtgttctcctggccccgatagtggtggtggttagcgtacacatacacttctcacatttccgttccagaaaactcctctttttttacaaacaaaa

SEQ ID NO: 1040 - DNA, 1689 bp, Toxoplasma gondii
ctttatcccgttctgagtcgttgttgacgcagagatggcggcatatctgcgcttctgcgcgtaaaaaaacggaagcctctcttgagaagtttgcgcgccgccgcttgcgagcgtgtcgtgtttgggtgccttggactcgcttaccgtctggtgtctggacagcacagttgattgcggcatgcgggcatccggtggtagatcagttggtgaagaaagtcgcagaattcgcccttcatgcacatgcctttccaccagtgtctgcagacaactgtgtgttttccccactggcgtccgctcacgcagtcggccctggagatgccctgctcgttcagcaggcgaccctcctcttgcttttgctgctccagagaaggctcgaaagaaaactggaacctctggtcagtgaccgaggcgggcgccggagacgcagaagacggagagagcgcagagacccgagaagacgcaggccgcgaactcgtggaaccgagaaagtcctgcagtattttccgcttccttcgtcttcggggcgccgacgcggcggaagctgaagaggcgagcggcagaagcgcgtgcgcctgcacagagagggcgaggccaggcgaagcgaaggagctgaatggatagctcggaggaagaactggtggaacaaaggaagcagacgcggccccgctgggaccgacgggggggagagacatcgccaggaaacagcggcgaggaaaaataagcttgtgagtgaacggccggccacaacgcaaaagaagcgccggcgagagagatctgaatcgaccccgtctccgtcaaaaaagcttgtcaagggcctcacatggccgtgaggaaaggggagcgacaagaaggcgaaccacaaggtaaacggcagcggaagacagacgcagaaaaaagacggatccacgcctctgaagagaaaaacagcgaactacaaggaagcacaggcggctgcagaagaggacgcgcagggaacgggagacagaagagaagaacggagtaagcgacgaagaagcgaagtaagaaaaagagacgggaaacccggaaagcgcgcaagagacaaaggaagaagtcgcgcggggatagaaacgggtgaggagcagagaggaacaatgggaagacagcgcagcgaagagacccaacggaagaggtcctatgcgcaggtagtggtcttgggaggagatccaaagagtgattgactgtggtactctgtctggaaaaagtcaaggaacgccattaaagttagacaactcatgaaagaaacacgatggacaacggaaatgggacagcacggaaagctgagagcatgcaacacatgaaattcgcatgttcacgtgaaccggcacttccatccttgtgttccgttcttctcctgcgttctctttccgctctgttgcttctctctgttttcgttgtcctgcgcaacgcttctgtatggtgtcgcccaacgagggagagagaccgccttcttctgtttgctacttcctttccgtgtgccctcagcctcaaccgcgttccctctcgctctcctcgtctccgtcgtcctcgctcatcgtcgcggcgccgtccaaaagcagccgttcgctgtccctgagaagaaaacaagaaacggtctctttcccttccgtttcgtctccgcctgcaacggttgcaggtggtctggcgtcttcgcaggtctcttctctcaca

SEQ ID NO: 1041 - DNA, 3035 bp, Toxoplasma gondii
aagcctgacagttctgctccaacattttcgaggatgcaatgcaaacatctttttgtgtgggtactgaagatctgggcctcacttgccgcgaaggagttcgctaccgactgaccgactatcagggggctagctacaagtgctggatttcgatattcgacgatgtcgaggttattccacatcgtttatgttccaggcggaatacgtggattattatcactcgtatcaacagtggctgccattgcgaggaaacgcgtgaggaacagaccatctattagaggatttgtctcttgttcctggcctgtgccccatgcttgcgaggatgcgagtaacaacgcacacatttgttttgtggcccaggaggaattcttcggtgaccaaaagacacttaagtttcacgtctttgcaccaccgtcgccggcaccttttttaaacagaggagccgtcgtaaccgcagaccgaaacgcggacctaccatttggcacaccttcattcggtccttttctcgagctgacacgggagagactcaattatgccatcgaatgatgttaactagtttctgatgcactgaactcgactcgttgtttctcactaaacaaagggatttttaggttcatgtaaactaccactttctggcctttgacacagaccaaaaaaggcggttcgtcgagccatcccgacaagctgttgctttgacaaatctcgattatcgtttttagcaaatcaaaattgcaagcaacagttgtcaaatagcaatccgacaaactgtttgaggacgtacatcactggcttcgtacgccgtggtgggcagacacgaaccgtaccaaggtatagcccaaagcttgtttgcggttcttctatcgtgcagttcatgatcaaagtgaagatacagtttcgttgttctgtttgggctccccgtgaaaaagcgacacgtgacggcgagcttgccggtcgcaccgttacaagttggcatccactacgattgaaaagcttccttctcacgggttcgtcacattgagttagcggagatagtgacgcccagatgttttgctattttctgatgttgcatcgttcaaagacaacaccaccacacaatatgtccagtccagccgcttccttgactttttctttcacgtgggaggcacggaaggcatcttcaattcagggaccatagactatctccgagatccgcagaaacaggctcatactgcttcacttccatgtcgagtgatcgtgttgacgcaacgtaccaaggattcggtggcactacaacatagggctaagctgtcgttagagacttcttgcatcgttgcagggaccgaaaggaaacttctctgcaagcttttctcagctgctgcccacaggattcttgctccgggattcaaatggccaagactacgcgctacgaatctgcttttcctgtcatggcacaacgcacccagtgtggctacgtcataaattacttccactagcattcttgtcccgtacctccctcgcgggtggcactcatcgaagcaacagccaacaccgaagattcttccgcctcttccattgatctgttactctccccatctcccggcgaagctagcttttacggtcggtgtgcaccttctgtacagcccagctactttcaataatcaaatggtgaccacggggaccttcgccgctgcctgcagatatttgtgacgttgttttgtccacctggaagactagaaaacaaagctggactttcgtcgaatttagttccataagccagtcattccttttactaaacgttcagaatctagactgtaacgtgctaggttttttcacgactgcatcggcgtcaaatgcccctgcatcgacaacttactgccattttccctcttcaagaatgcgaaagacgtgctgacaacacactcaggcgctgtgcctctccctgagaaatgcgcgtgagttctcaagaaccacggacaaagactttagggacctgcatcgcgcgtgaaccgtacgactcctgaagaagaactgcaaacgaaagaaaaggcgttgcaaagcgtatgccgacaagcaaatggactgatcagtgcgagggaggagtcgcgattctctcctacggaagtggtttcaacggatgctcttaaaagcaagtgaactttccgctgaaaggagccacaagaaatgccacagcgactgaagacgagagacacaacccccagttgtgtctgcagggggcacatgctgccgtgtcttcggaggggagggtccagctgactaggaagacgctagacgtcggagatgctgtcgagctgttgcggtgttttcttgattctgagctgttcattttctctgatgttctgtgtggtagatccatcgcaaggcattttgatttaccgttcgttacccggtggcgactttgatcctccttgatttcgagtgcagcacatcgcgcagtgcgtttcaagtcgcgttctctggggggtagtatcggtggacgtcgaggcgagaaccgctttaccgcgagccgaaggctgcgaagacttttttttcactatcttcttcggttcctcgttttttccagcaagctcactttttcgccggcacattttttcttactttccccggtactcgctggaacttctgaaaacgcactggtgggtcgatagatcagttcttgccgcttgcagacctgcagtgaacccgttttctcgtgttcctctccgcttctctgcactctcactcgcattttctgttttattcttctcacgcagtgacaagcctgactttcgtttcccttgtccagcctcgaagacccccaaactctccagtcgctcctcttccccgccgatttatgaaggctcgtacaacgggactgctgcagtcaaagacgaaccagttgatccccgcgagttttccgtcagctctcccgaagttcggtcgttcctaccgtgtgtgaataaacgtcatttttcggcctcttaatttctctggcgagaccgttcgcgtttcaatcatgccacgcgcctaaaggatttcgcggaaccttccatgcagcacca

SEQ ID NO: 1042 - DNA, 3841 bp, Toxoplasma gondii
aagcgaggcagtggtggactttttggagagcggagaaagccgcaaaaggcccgctggccttgtcgctttcgcgctggtcggaggcgactgaaacgagactctggaggcgaggaagcgacagacgagaaagcagaagaagaggatggacgcacggcagcagaggaaatcgtggaagaccgcagaaaagaggaagaggaggaggaagaagtctggaccgaggagaagagcacgagagaaggatgagggaagggagacgaagaaagtgagagaggagatcgaggccagtcgaataggccgaacctccgcgatctcacgattcttcgttttctcgcagaggagatcgttttgcctctcgggagagaaaagctgtccaaagaggagaccccaagggtccgacttgccagcggatggacagcagccatggctgtgtcgcttcgccgccgactggaattctgggcttcactcgaagcttctttttcttgatgacggctttccgcgaggaaggacgatacttctttcagagtccgtaaaagcaggcaacaaaggggagaaaagcgtaaaaaggagtaaaggctttgttgtttctcgccagtgagcttccgtctgagctcaccgcgcgctggaactcgaattcagagttgccagccaggcagctgtgtagtcctcggtttgcggacttggacaacgaggtgaagggatcctgggtcctgcgcctcagacgccgagcgctgtagaaaaaccacagatgttgcccgacaaggagagaggaaaggaagaaacgatccgcgcaagtgggcgaccaacgaggaggcgcgcatctgacgcccgcaagacgaaaaaccggaaagaagcggggaaaggagtcgcacggggaagggggaaaaagtgaacgaatgtgcatgtgcagagaggccctgaaaatttttcttcgcggacaccgccaatggagaggtcgcggaggctctgtttgctctgcttgctgttcgtaactttctccgcggctcgtgactcaaaacagaaattcatttcgcaacctgcgctgtcgaggcggactgcctctccccctcgacagagcgcctggctgagagactccgcgattttcagcggtttcaacagaatagccgtttttcctttgggcgagaggaagactttgtcggaaaactcccgattccgccgagtcgacgcatgcgcgctgttgcatgccttttctgtgaagtagtcatgcgagcgggcgggcaagcggccgcctttccggtgtgtacagggggctctgcaactcgcgttccatccggaaacagcactgtgtggtggaggtttcccagtttttttctcgagattcacttctgcagtggatcacgttcgccttgcttcacgattgccaaggcgaagacaacagcgggtcgtctcgggattccgagtcacgcaggtgaccgtgcgcacaggactccaacgcagtcgacacaagcggggaacgccgagggcaggccgtagggttccacgtcaaagaatcctttatttagacagcactggttcgacgtcctctgagacgagggaaagaaaagtttcgaggtgtggaggaaaacaacttggacgggaaccagctggagcgccaacatctcgcagtagagagggcgcacagcagctggtacggagccgagcaaccacggcggcgcccagaacggtgtttccaacatgaatttgtgagagacatcggcggcagtttcctttcccagccgcaaagaataaccgacacaggtccgctgcgacatgaaagtcgagctcgagtttgaagtctcgatgggtcaccgacgagccttggactgccgcggcgcgtgcacagcgttcccccggcaacgggtccgggtgaaagagtctgtgcgaacgggagatgtcgaacgttccacggcccagcctttccgtcccgggaaatgtactccagactgagtggcacagttcagtggcaatagacgggggttttatgtcttgtgtgtctgtgtttcccggatgcaagggagacttgtgctttccgtgcgcatcgggtgaggcgcagtaagacttgtggtatcccgcgcaagcttgagaagatccagcacttcagtctgagttgtgcaaggctcacgatattcacttggcgagtctctttgctaatcagtccgacagcaacagaaggcagccgatggaggcggcacacaaaggcttagacccagaggggaggcacgataccgcggcgacaaagtgcaggtcacgtgacgcgttccagactgtggtctgacaattgctaagagcacacatcacggagaggaaagcagcgatctgcttaagtgcgtcgagttccatgcgcggcaacgttttctggcaattccggtggtcgtcggtggacacattcgtggtatacggacatctggaattgtcgaagtcgaatatcagcctgagccgtgaaggccatcgctggactgaacgttctatgtacttagtggctctctgaagaaaacgaatcctctgatgtacgtccaaggagttcgaccctttgaaatctgcgaaaggaactgtctcctagcaaacagaagttttctatccggtctcggatgatttggcaagcctgttttccacgagtttgtaacgtccagttcacaggtgcgaacaagcacttcggtttgcccgtgactcttctacaaagttacggccaccatgtcgtgctcaatccgtcgaccagtcgcactcgtcgtcgacactccccagcaacagctgaacaggagaacttcctgtcgccgcgagagcttctttcgcgagcgggtacacccgcgttcgttagaacgtcacgtctctgcacttttggaggctacgtcggagacgcgtttatcagaaacatccgcttctactaggttctgtacggcagttggtcacccttcactcgttctcagcggaaagaaacctgcacgcacctcgctgcggttaagtgcgtggcattcctctgtgcaggaaacgtcatccgtggaaaagaggccttctggggtctgagaattggggtaagctgtttcaggagagtggtacttctttgctgaatcgttcaaaatcgctctcgacgcgggactcttgaaaatggttacgattcgcggcattttgtttcggggaatggctcgctgaaggggtgacggctggctggtctggacctgccagcgcgttttaagtccgtcgagttttgcatccgaaaacgagtttatggcgtgcaagccttgtttgtccttttcatttgagcgcagttttgcgctcgtccgcggaaatagcgcaagtggcgagggaaactcaccgcgcgtgccgcaaaatgtgcaagttccacatgcatcacggccagaacacacagcgcacggcgcggagtggcgggcgagacaggtcacttggacatgttttcgctcgcgagaaaagccatttctcatcaggcgtgtcggtgtgcggttttttgagtttttcgtggcaacttctgctgggctcggttgcgtccagagaagtctctgtctgcagtgcgagtttcgtggcagtgacgtccgcttctccagattcccgtcacggctccgcgcatttccgacgaaaatgtcaccggggccgcgtttgcgtgcttccgtgtcttcccctgtgcttgtcgatttttcaaactgtctgcggacgttcccttgccgcttgcagtgagctgcactcccagacccagttccagctgcgcttctctgccagcgacgcggcgtcgccttcgttttttttcacccgtccaacccactcgcgtcagcggctgtcgcgcaggttcccagtcccgcttcctctgtatgtcggcggtttccgtttgggtcca

SEQ ID NO: 1043 - DNA, 2820 bp, Toxoplasma gondii
cgtttcttcggctggcatttgccgcttcgaagaagatgcttcctttctcccagtttcaggttctctgaaaggctctggatggttcgagacggttatgtctcttcacggttttggggaaagaggtggacattttaagtgtaccttggataccacaactctgctcattgtactgaaagtcggacttgaatcaggtaagccaacgtcttcatctctaagtcaggagtcctcgttgtgcacatcctcgttggttccgacgcctgctgtttctggctacctcaagccttcgaggacagtgcccggcctccgttctcagcttgcggagagtctgaagcagtcgtggctgttcctgtacggtccacatacagcgcgaaagattcgtcgaattccagggtctatggaaagttgcacacacagcaccggcttgatacacacacagggaggaccgttcctccgcttgttggctttaaaatggtggttggcctgaaaacagattcatcgcggtaggaacgtccccggggggcacgcgagtctgattgcgggactgcttttttgcccgaatagattctcccgttgttcgttcaaaaccggcactgagaatcgaaacgatcgtcgctggatcacggatttttcccgtcacaccgtcagtagacatggtcttggtcgatcgctcgacagaccccgtttctcataggacggtaggttcctgccagtgttcttcgctggactcgtttcctcgttgttttctgatgcgggactgcacggcagagagcctctgggtcatcttccagttagtgactgtcgacattcatccttgctcggcagagcacacgatcctttcgtctacaacgtatcttgcctttcatatggtgtgctatcataggtctatctatcttgactctgtcagatcgagaaaagcagaaaacagcagctgcttccttggttcgagaacaggagaaatatacacacagaaagtttcacttctttgtcatattttataccaatccaacacattcgatgaaaagcggagcggacaatttggaacaccgatagatgctgctgcaatctgaacagtgaaaacttgctgaataacactgaaaaagatttctatttcacaacctgttttagtaacactggcagagtgcctttccgatttacctaataggacaatcttacaccgtcgttcccgttggccagtctctgccttggttggcgcattagagaaacggcgtgaaaaaaagtctctgcacgtgcaatagcgacctttcaacacgacacgaacaagttcgagcctgcaactctggtggatctgctgcgccttagcggattctggtgacgcttatcgaaatgctttgcggctttctgtttgagtgtatcacattcgggttttctttgtcgctaaacggctacgttcttgagataatcaacgggaaatcgtcatgaaaatagagtgcgtgcaccgtgtacgcccactttcacaagttctgttgtctgccgtgagagcgaggttgatcatgctttacctgaagcagactacactacaacttgcacagacacactctgatgtgatgcctacatgaatgccatccaaacagtctcactgcacacgtttttggccaagataaaacatcgagaatgcgacgcggggtctgtcaggttcgagcggatactgctcgctagcagacaaaacaagtagacagagaacttaacagccaaagtttgagaacgcctgcatggacgtagatgtgtatttgatatgcgtaaaaactcctatagatctattgcgacagactcttaccattgcctcggcgatttgtgcaaacgtttcgatgaattcggaaacaccaaccgagaaaacggggagtaaacatttatcgatcagctgctgttctggataaagtcgtcctcgcttgaggcacacagttgctcgttgcaggggcttctcgtttcccatctttgcttttcccatcgactaatcgcactgtttttgtttcgtcgaaggcaagcgacatccaattcgtctactagtaattcgttccaaatacgaggttcctgccttttttgcgcattgtttttcgctttttcatccttacggtggtcctcacgtgacggaaccggtctgcgcctccggtgcattgtttttgagaatgtttttgactcgatctttggaagcgccagttccgctacttcgtcctgcctcttgaaggtttttctactttttgttttggtaatgtacacgttggagctcccacccgctggcgtcgtcgcaactcaaatccgataaaaaaccacctttttgactctcgcgtttggaacgaatcggcagagaatgaagctcacttgctgaattgcttgtcttactggaagagagaaaattcttttccttggctttgattctcatgcttttgcaaactcgccactctacatatgtggaagcgacgggggtctcgaatcgacattttctgtcggatatagtgggttttcttgactttttgccacttcgttatcgtatctcttgtcaactttttttcgttgcacttggctgcgaagcatgcggggtcacactgccggaattggctctcccatcgaccagccacatcaagcacgtcgttgacttggggaaaaaatttcacctatttctgctgcaaccaagagggcagatacggagggtgcgcaaatccgagacagccaaacgcggcaatgtctagtaggtaaacgcccagagttgttgaaacggcgcccccgattgcggaccccaaagaatagccttccgtacgtcggttcgatccaggaaaaccttagtggagccacgagaagggaaga

SEQ ID NO: 1044 - DNA, 3794 bp, Toxoplasma gondii
cgtatcgagcagacgaaatgctgcggatgaaaggcctgaaagatggactcgacatcggcactgacatcgatgacaaagacgtcggagacgtcgaggaggaggacgaagatgatttcggctaaggcttgaactgacaaaggcgctttcttatttttttgcggggcgaggttatgttaaaggacggaaactggcgagaggggtgtttcagctcgaatagaagtggacaaatacatgcacacgaatgcgcgaggtcaacggggtggaattcagagtgaagggaacatgccggaatggagttaattccaaaccggggacgacatgcaagcggttgatttcgcttttcacagacggggctgcgttggtttgatggactcttggtttttgtggctgaatcacgtttttgtgtggtggttctcgtcaattgccgaggccggaaacccccgggttttttccccgctggacttgttgcccgtgtccccccggtgagactgctccaaacgacactataaacactggaaaggtgaagcgcgacagtttggattgcaaagcgaaatatccctgtttaactcgttcactagaagtcggtgttctaagctgtgccagctgatccaaaatcgtgtagtcttttgtcgtgttcgggtgctaagatgtgtacggatccacccggaatgcgagcgaccgatcgggacccatggctaaaaacacagattgatcaccgaagaatgctcgaaatgaatacataagagtagacaacgtttgacagagtacaccgaaacgcgacactgagagtcactccatccagaatccgcgttttgttcttttctgtgccatccgtcactagtctaggattactgtatgaggttcgacctttgaacgcctgagtgttcattcgtcctgggtttcccaccttccagggagtgtggggtcgtcttttccgaacggaaactactcagtgaatgttgcatgttgctttctcagccaaagcgattttcgcgtacacagggctggtgggtttttggcgtagaagaggtgctttaccatgaacaaatctttgaaaagctacattggaattgcatgcagtttctgttaaacagatattatatgcgttgctatacagaacgaacaaagtcccacctgcaatcacacgaacgcgaagctagagacctacgggcaagaaattgcaatcgtccaattcggattcaacactcgacgcacgaccatgtcgatatccactcaatagatgtcaaacaaccggtcagagcttttgccgccgaaacgtgttaaaacaagcgtgcagttatacatacccctatgtttagatttgcatatttatgaatacagcatgccaatttagagacttgcaaaacgcggttgttgcccatatctgatcggcggcaccacaggtcacatgtgtctcactgttgaacccaccgctaaatgcaaatttggaagagacaagcgtttcagtgtcttgtgagtaggaaccattaattcgaaaaacaacaagctttgtctctcatatcgtgactgtagcagacatacaatcacggatactttatggttatgtacagcatatcccacatgtactaaagcctccaagctgttgcaccgaggcctaggttttcccgggggaaattgcctctctaacgttagcaaaatgtccgtgaacgactatcctcattgttctagctctgacgaatcaaacctccgtagatgctattgcttgttttgggcttgccggaaaaaatctggcagtcacgtcaacgcgcccccgcttctagttttctgtgtgtggagtgaaactgacaatcatttgtcgtgtcttgttgctcacgtgggcaagtggctctgccatagccacacttaggatgagggtattacgggacttgtgccattcgatcagaacagatctgatcacttccgtggaaagtgccgttgccatatgcttgtcctcgttattgtgtgttggcttttctcgataaacaataaaagcaaacactcgacgagtcacgctaggaaaaaaacctcttggtcgctgacggtcttgctcaagtttagctaacccggtgcacttcctcttacataatatctggaaactgttgtggtgtttactgttgttttactgtttcggtccgcgtagaaaaaatatcaatccttgaaaccacaagtctctacttttccctttaaactttgttccacgaatgtggggtactacgtggtttgacttctgactggtgtcacggatgatttccaaagttctgtttgattcagcgatacggtcaaacaactgtcggaatgctaacatgtcatttcttgcctgcggtgcagaggcggaaatcctttctggaggcagccggagaaggataactcttcgtgtctcccaactccactgtaggagttctctatatccgtcgaactcctatggaaagtggggtcggtggcgtatacgtgcagtcttctttgtatggggcggccgatggcagcagctctctgtttggtgtgtccgtgaaaaatcgggacgctgtgggaccgaaaaatttgtcaccaatcgtctcagcatgcagacttttcagctgtctcgttattggttgctagacaaagaaacaacaaggcttaatcgctgtgacgcttgttcaaattcatattccgagctgctgcacggggataccctcagggagcagccggtggcttttttcagtcaacgtctctagaacacgtgttcgccctcaaagcatatttccactctcaccttctagtcaaaccagcaataatcatgaacgcatctgcagtaataggattgaatcgttttgatgaaggcactggcaccgcgcatgctgctgtcttccccaatgaagaggttttcgacgtacgaccaggcgagggaagaatcatatgaaaatgccgtcgacgaaataacataatggctttcgttttcccttcgcatgtttctctctttcctgagacgagtctcgagctctggaatacgctgcttgtcgtattctgcttttctctagtctgtgacattcgcagtgtgcattcatgggagaggcaatggccgcaagccagtttgtgcagccgggtgtgaatcgattgttcgccagctgcgggtgtttgagttcagtctcatttcggactcacaaaccctagaagtgctttgtatcctttctgcttcctacgtaacgtttcgctgggtttctgcagaacagccgctctgagccacaacgcaaaaaatcccagaacgtgcgccgtccatgtaaaacagtgacctcaagcccaagtatcaactgacagtttaacagtgggtcatggtacagcatccgcttttcatgaagaagcgcatgtgcttgtagaatgactgcgaacggtatttcttgggcatgctgacataccgcttgcacagattggtgtgagtgaggctccgtcttattgcgtccgttctctattgcgctcggaccccccgatgtcccagattcttcgagacacgtagactttcccggtatgcctctccgtttcatgagatatatgctctttgtttcgacagttcttctttgagatcacgaagtttctgaaacccacaattcgacccgcaacttactcgacctaacatgcaacccattttgacacgtacagtcacatcaccgcactagtgtggatgctggtttcccaggaagcgtggcgtcgtcgatatagagttacatagacggtgcattggcgacaactggctcgtgccatttctagcctgcagtccgcttgtcagttaacactcctgctagtgaacggacagatccggacaa

SEQ ID NO: 1045 - DNA, 2399 bp, Toxoplasma gondii
gggtttcgtagtcgagttttgagcctttgacgtaccaagagtagggcatgagtcggaggacgccttctttcatgcagggcgtttcgatgagtcgttcgtactcctctttggtgagcctccagatctggggaaggagaggcttcgtgaagtggatgagttcttcggctgcgtgataagaggtcaactggctggcttcaacctcttcctccgaggcagcgagccgcgccgcctcccctttccggaagcgcctgcggcgagtctcgcgcgcggcttctgctctgtcgcacaggcatcgttctccgacctctcgtctgtgtcgctctgccctctcttccacgatgccgacgcagagagacgcgaggagcttcagcgcatgcacagagtggcctgcctcgtagaacgcggttgtcaggtctttgcctgcgaagccgtggagcaaatgagcgccgccggggtgagagaaacgcgaaaggtcgtagacgcagttctcgaacatcaccaagcactggccaccggaacctggttcggctgaacatgcggcgacttcgctctcgctgaagaatttcccgtggagaggacagttcccgcggcgaagttcgcacgaacgcagacgctcggcaggtgatgacgtttcctcgtcgggctgttcagatgcaagccaagcaggcttctccgcctcggagctcgtttccttctcacagagagacagtccttcttcgccaggttgctcgatctcggcgtgtgttgtttcgtcgcagagcgaaagagcttctttgccgcaaggcgaagacatgtctcgagaggatccaccacaaaaacgctcggcaacatccacgaaagagctgtcgggacagctgccgggcgtggagaccgagtcggaggcccggtggtcgtccgcgagggaggacatctttgcttcttctaaataggcgaaatccagaacttctctcttctcgacagatggagaagaacaatctctcgactctgacgaagtccaagtcaaagtccgcattcaaaaaccaaggccctctcggaatcgtcgagtctcgcgctaacgtcaaacccgtagctgcgcaggatcttcacacactcacacacagcggtttcggttgtccaggaaatctatttctaataaaagacgatcccgagcttcaaattggatgcggaaggcagggcgtcctgcagcgaacggttaattccggagagagaaagacaagactcgatcgggtgtcggcctatgtcttctgcgtgtgtacaaccgcatctagccggggaaacgacacaaatcacagacggcgtcacgatgctgtgaggccgcaaacggaaaggctcgaaagtgtgaaagcgaaaaggcaaaaaaatggatttctcgcctccgtcctccctcattgcaaaaaacgacggcgcccggctgtacgggcagctcgtgaggggcaatattgtctagactcggcgaaaagggatctaaagcacaggaagctctacagcgtgtcgacttgaaatggagacgcacgctgccgattgtttgcgataaaacaaatgagacaaagtccacacattttcctcaaaaacccgacccgcctcacacgctgtgtctcagcgagttggactcgcgtcaggagaaaagctgcagaaaaaaggtcggcttcctctctttcgcctgcattttcttagagacactcagttctatcgaagcaaaacagctcaataaatctgcaggaagccggcagagaccgcggaactcagcaaaaaagggggcagtaaagaggcactcgcttgtcttgttgaggcgcgtgcaacgacagtccctgtttaaaaagagactcggcacacagcgtccaggcaaagaagctggaaacgagcaagaaaagccggctctcgatgcaagggcgccgcagcgttttcggggacgcaacgtctggggaattcgcgaagttttcggcatcgatgtccagaaaaactgggaaaactctccgaggcgaagtcgaaaagcggcgttttcagagtccacagtgcgctcgcggggattcgcctccgcgagagagcagaaaagcgtctgctcaccgacttcgagagcctgcactcgtggtttcgttaactagaaacgaggcaatgcgttttgacgacctcgcggagaagaaaacgctcgcttctcttgtgaaagagggcgcttcttccactgtgcagcctgtctggaacgcacgcgtgtgcctgtgactcttccaggtccgagtctctgtcgtccggcgctttggaagattctccgtccctcctccgggggaaatttcctaagcgctgtggctctggaagatcgggaagactgacggcatgcggactgagacgggagagaaactcggcaaaaatcgaccttttttttctccaggcctttcgacgaatca

SEQ ID NO: 1046 - DNA, 2058 bp, Toxoplasma gondii
cttgaagttgtcaaactccggcacaggcggaagaaaacagctttctctggagacgaaactgcgagtcctctcccaagcttgtttgcgtggacacctgcacttccatgtacatacacaatatatgtatatatgtagactgatcaataggtagtcacttttgcttgtaccgatgcgcatgaatatgtgagtgattgtagataaatatatatctgtgtgtaggtatgaagtgtcgacggtgctgtatggtctgcagcggtgagacatggagaaaacgcgtttcgtttatccagcacatttacgttatagttgtcacaagggcattgaccgcacatgtcctatctttcactgtggtgcacgttcatcgcgagaagaccgagaagcacaaggcgcatgaaaagttggacgcgagaattgtctggatccactaattttaaagctctggcatcgagccaatgcatgcaaagaggcgaactttcggcctgtttctgtctgctgtgctatcgtctaagaagctttgatcgattccaggtttctacgataaccgtttagggttttggggtcattcttgaaacgggtgttccagtatacacgctgcgcacgctttagacgcagaatttacaaagactggtaggttcttctgttgaaaggattaagaatacatttccagattttctgctggggctacagccgtttccccgaagtatttgagtgggaagtgcacgtacgtgttctcaaacgattctaccagtgggctagaggttaacaagaactgacagctgcaagtgtggcgtcgcatattgattcttattattgggagcttcttcgtgaacccctacgtttttcggacgtcccgtaagagctatgtcgctggccccctcctgtacagtctaactttgtgcgcctttcacttgacgaattctggagtcttagaagtgtgtcgtcgagtcttcccaggtgccatgccgacctcatggcagtccaggatcgacttctggggaaaaagagaaccaatgtaactccatgaaccgtgattttgtgtagcgagataatatgggtaatctggggaccttcatagcgcactatcgtgcagttagatactgcgtaaattctttgtgttgtgacagtcgcagcttgtgaaaaaagctataagagggagaacatgttagagctttacgccttaagtcagtttcctttggtgtgggttgtttgaagagctacggaaactctgatgtgtctttccgtcctcgctgaacaccggggattcgaggaattcgcagacatggaattcccggacgcggatgccggcactcggctctcgtgtgttcagtcacatataccctttcctggcgcaaaacaccgacagaaaaagggatttaagtgagcttctcttgtgaatatggtttgttttgtagcccgtgcatctccctgtgtctagatatatccacctggatcgtcgatttcggttagtccattgacctcatcaacccgtcaacgaagagggttaaagtcccgttttcttccgaacccgttctcgagtttttccacgcagagtggcgtactcttcaacagctgccacccgtccacattgcaggggtttgggcgctggtgtgtgtaggttgtgtctcgttgacgtacaatttccagagacgcagtctctgtcgatgtcaccgtccgcagctgcttggagtgtcccgaaggcataaacaaaatcgtcatttaccactctctaggcttttgttggccacagatgttgagcgacgtctccaaagtgcgcggtcgctttcgctgccaagtggatttgtggagagaaaggtggacctggattgcggctttgcacacctcggcgtggtcgtgtctgtttttactgtgcgtttctcgtccacagtgccgacacggcattccagcactgtctacgcgtgcggccccgtttcacgtccttagaaagagagcaaaccgctcaaaaatcgtaggattcgccattggttgcctagacgctgttttagttctttagttcttgtgtcaccaagcgtgtgtgtacggcacagtctggtgtcaaaa

SEQ ID NO: 1047 - DNA, 4324 bp, Toxoplasma gondii
ggacttcacacatgcagcctcgccaagagagtccctcgacgagcttgcctggttgaggaagcgtccacgttgctggcagccaccctgaggcgcttctgtccgcagaggcagacagagcagtcgagcgcgaaggagagacaatgtcccctaggttgtgttccgagacgcctctcggagaagagaaatggtggaagcagaacggagacaccgcagcagggtggaagagaagtcggcgggccgcgatgcggaggttcacaaacaaggttcggagagaggagtcttccccgaagtcgtcgtcgacatccaaagactttcgacttgtcgaactgtcggaagacgaggaactatgcagtccactggacgcagaccctttcttcaacgtgccgtccttaccatttctttcttgcaagtgtctcttctctgactgcagttctgaggaggatgcgtcgggtgttccgacagaagacgcgggcgaagagggcaccgtcgaaccgagcgagcaagccgcagtccccggcagaatcagcggtcgaaactcgtcgtcgctctccaaaaagacctccattgtgtagtctccgcgcaacacgaatcaagcagagccttgtctttgtctctggacgccagcagagaccttcccgagggtcctcacaaagccatgagggccagctgaggtacacaacgtcgtctttcgggtgcgagggaagaaatccaattcaagattagaaattgcgggttcgtggttaagatacactgaggaattgtcaatacgaatgtaaggaactgtagccgtaaaagcatcgcgtcgagtaatgaggcgtcacgtacattcaggaagcgagaacgggtgaactgagtcgagagaagaatgcacccaacggttccgcaggtaagggttcaagaggtaggggaccagctgcccgcatttcatcgtcggtgatcaattcggtttgagagcgcttcctgaaggtgcaacgtggactggagagaaaactgactggaggcaggaggtcccgagacagctcggaaaacagattttcgagtgaggcgctttttccacagtataagctgaaagaaccgccgcgagagagcgacgcctctgcagccatttgctcctctcaagggtttcaccgtgtaacacgtgaaaaggcatttgcagaaggtggaagacggagcaaaacgacggaaatcatcggagaaaatcgaacacggggctagtatcaccggcagaagtgaagccgcaagttgtctgacgaaactcgactcaaggatcgcccagtttccacggctctctctcccgttctgccgacagaagggagaggcgagtggtcggaaaacggatggagaaactcagtttccagcatcgaccctggcactccgctatgagaagttccgaggggcgaagcgcgatgggcatgtatgtttgcctagaacgttccagggacacctgggtcaaacaaatccgcaaacgaaaggacatgaagtcaattttcgcagccccggctttttgacagagactgtggactaaacagtgcgcatttccatgtctttcaccggcgcgggaaaacctcgcagtcgcctgtctcggaaggagcacatgcaccgccgcgcctttgtcggttctcccccagacaggaggaacgagtcgcggttcaaccccgacgggaggaaaggcgagatttaagtggaattccttctcacactcatcaccattacggacgataagtcacttcgtttgcaagctgctcaaacacggtccgattctgttcgtgtgctgatgtgcagacgacgtgacaggatctcgaacatcgggggagtgtggcagcgccgccattgcaagaagctccacgattctcacgccgctgtgtttgctaacggggataaatatataggaatgactatacatgtgtgtacgtaaactaaaggggagaaagttctgccaaccgggcccacttgcgaggctggacgcgtttcgaatggatggtacagaagatcgaacgaaaactaatcgacttaaatcctacagggttgaactggtttgtttcgacgctcagcacgaaccactggatgggatcctcgacgcaaactcaagcgacattctggacggatgtctcagcagtccactttttgtggaggacagccgcagaggcacagctcccgagttccctgttccaggcgtaccatgtgcattactgatttcacttgcgttaacgcgaaagaaaacgatgcctcagatgacagggtagaaaaacacgacgccagtggcgttgtcatgcgagtaataatcttcgtcgcgatgctttatctcataaacacccaggatggtgttttcccgtctgccatccctatgtcacacattcgaggaaagaagaaaaaccaaagtcgaggcgtttcagtgtgtacagaggcgaccgattccccgggacgccgatcggtatggtaaggagaaaacaagtatcaacaccgtcacgtgtagtgaacggttaaaatttgagaagccgaaggacctcaaagtgtcctacgctgttagggacacacaggatgcacaggatgtccggtgagcgtatcaaacaatgctgtgtcgtcgagaatacagattcactaaacgggatgaaagtggtggctacaactcttatttgccgtagtcactccaagaccgtccttgctccacacaaggacgaggtcagtttgaggaaattgtccaatttcatgtagctgccattgctgttgtagattattcaccaggtaccgcagtatgccttcataccccggttgtcagcaccgtttctccaagttcattggcgtctgtagtatttccaaaacagtccgtgtctaaggatctgtcggcagtcgtcggcttcgcttcttcaacttctaagcgaactttcctcgcggtttagggtggtaggagaatcttttatgttctttgtctgtgctccaggtagatgcatttgggctctggcaggcaaaaccggtgaccgcacagtgcctgtttcgatattttgcagagtcacacgagttaatacttgtcgctgctcaagaaaaaggaggcgataccttttgtctaccatacgcttcgtcgatacagatgtagcataaggatctccacggaaagcaaagcgcgaacgaagtggaagagaggacagcaaagaagagtaatggagattggactgctggttccgttaggtgaccgttccgccgaaaccattcgaagtttcagtctggcagctaaaaccccttgtaggagagtgactgcttccttttatggaaccagtgaggcctgtgtaagcttcagacatttctgtagggatttttggaagaggcaggttctacgcatggcgccatcacggtttctcgacaggcctcacggacgatgcaggtgaagctcgacgggaactgcatggttcgccacgccagaaaaacagaggcaggaaccgcttcggtgaacacctctcatttggtgtgcgcaactgagagctttaccccggaaccccgagttgtgtctgcaggaaaccgagagccacaatcgattctgccaaccgagccgcctgtggcacttcttcgttggccgcgttgggtggcacgagtgaggagctgagatccgtgtgtccgcgtttcgccggatctcagcagaaagtctggttttgaccggcatattcttgcagtgtctgccgcaaagaaatggtttaaccaagctggaagacgctctgcagtcgaagaacgaggacgcgcagagtcgcagctgcggcgggtccccgatacaggtcgaaagcatcgaggacggactaccctgcgcgatgcatcgtcggacagagtaacgcgcggcaacaccaagcgccagcgcggatttcgtcctcgtttttccgagtggtctcagttccttcccaatagtccgcgacggttccgagtttctcctgctgcggtgttgacactgccgaaatctttctagtagccaagtgcgtaggctccaggcaaaccgctttttgacacttcgatgccaccggtcgtgggagttttcgcgtgagaccgactagctcactgctctccagatttccggagactcgtcgcttgcctcggttgcagggttcgtgtgtccgatttgaaccaggaagggatatttccgaaacgcccagagaatagggttcgaaacatcgttttcgtttttttatacaccgtcgacggcaactcccttagtgcgcacgctggctcgctgcaggcgccgttgcactgggcggccgcgtttccagtcgtttccgcaactttcgcgttttatttcgtcgccgttctgttcatttctgctgcctcgaacgcaaacgagcctctgcaa

SEQ ID NO: 1048 - DNA, 2087 bp, Toxoplasma gondii
agactacctccttcaaacaccacgcacaatggagatggtgataggatattaatacccatgaggatccatttggcacccaaatgcggtggacgcattttttcagacccttcatagttcgcatccaacacatcgagacgtaaatcggctcacactgtgggatgctcggagttgcgacgttgttatgcagacaagacagtcagttgcttcttttggactacaaaacaagctatgttttcggcgtttcgccgttgaacacatttttgtgtgacgcggtctaacaaagaacgcgttgacctgtttcgggtgactgtcgatgatcaaccacgaatagcgcgcatattcaatcgcgaatgccatttgtatagaccttagactgcgagcgaacccaaggttcatttgtcgtggtgttctgagaccgcgcattctgcactgaaaatcactcgaacaccagtatttgctgtccaggtccatcccacgaacagcacacgagacattagaggagggtatcgacaacaatgccgacgggcacctatacaatctgtccattgtaagaccgaaactacacgagcatctatctttccgttaattgttgctgtggatcacctgacagtgccttacgagattcagacattatccgatgacctacctagtggccattatgttaatatgtttatccgacctccgattactctatccgtccatatttccttggagtcatctgcacatccgatcaagccgccactgtgcaaacataaaggggtttatgcgcgttcttgtgagttagtttagcacttcccgtggttacgtgtgccggcttcaactgatctcattctagataattcacacaacctgtggtttagttcacgcgggcatttttctttgtgtaatcgcctcacagcagggttcttttcgctcggactactgcatgttagcgacccagcggtatcggcggctctgtcggcactggaacgctgtaacttttttccagtctgaacgcaccaaaactgctctggtagaggaacgggaaaaagcaattaatggtccctccagtgaatgaaatctggtatcgcggttagtgcgagtcatctgcatgcaacaacatgcagttagtcggtttgtgcagtccttgcggtgtttgcatgactatcgcaggcgaaccaccctgcagctggttttcgcctctgtgactgtgacgttcgcgtctccgtttttcagaagagccaaaaagcaacagcgatcaatcaccgcagtgtacgatggaactaaatcatataagtattccctttcgtccgatggtaacactttcggaaggtgttcggaaacaaaacgaaataatggaagctaccggccggcccctgggaccgcatgtcgttttgcactcgcaaagaaaccacagaaattacaatgtgtctttccaaacaactgtcgtgttagcatagacacatccaccagggctgacctgcaaagacttaccacactgaaggtgtaactttacggttcccctttcagcatctgaagcagattacattacgagcgttgagtgggaagaatgtattcagcgtatcctctgcagtatctatttggctacgatgtgtaaccggacgtcgataacaatttctcatcaagtggccgttttcatccgggtcgagattgctatttcatcgtgtcactgaacgattgagtggggcgccttcagacgacaaaacaaatacgcagcatttcatctgctactttgacgtgcctttaactcttagataccttctcccgacatccccccctgcaacccactgcttttccttggtccgatcgcttctcaacaattccatcccaggcaacccatcaccaggacaaagaggctgtttttttatttgcctgcgcgcgcttggttgttctaaaggcagactcttgggaaggaatgcccgtccaggaaaggcccgacgcgaacctgtgtgcaggaattctgcgtctctgctctcgtgtctcgggttttaccagatgccggtgaattatacgcgaaagctaaacgttctactccagacgtttctgcagcaaccatccacggatagaaaacgaacagcatttttcga

SEQ ID NO: 1049 - DNA, 4153 bp, Toxoplasma gondii
ggctttcttgacagcccaggcggaccgaaacaaagctcgagcagaggtttcatcgacctcttttcctcgttcttgtcccgaagtcccctgtctctgctccactcgtgtcgtcgccgcctccctccctcttctgtttatgaagaaaagagtacgtctccattcttccggtgtatcgaccgcctctggacgtgtctcctcgacagacacaatatgcgtcagtcttctgcgtgtcgtccgcggccgttgacagagcgcccgatgcttggagacaaaacgcaaaggaaagcaagacgacgaacggaggaggaaggacgagcaaccctggggccccattctcccttcccgttgaagacaaacgaaaaccacagacgttcttcgctgggattcaggagtgagaggttcggttgtggagagacgcaagaaggcaaatacgcaacacgagactggccaaagcagagcgaagaaggaaaggtgttttgggggggatggaaccgtcttaaaagaggcgagtaaacgtggaattggcgaagattcacacaggagggactggagaaagatggagaaaggaggcaaaaacatgcgggatgaaattatgcgctctagaaaacgcagacagattggcggcgaaggtccaagcgattctgctcgttcgagaagagcctgtgaaaacagcgagttcctcctctttgttcaagggaaaaaaggtcatggcaaaagaacaggagtgacaaagactccctgagagttttatgaaaacccgttcagggcacttggacacgtcataggacgatctttgccaacgatgctacgacggaaaagtgagacaaccggtgacagaagagcgggcttcctgtcaaagccaaaagtgtgcgcatgcaggtgttccgaaaataaactctgattttcaaagttgcagtgtgtttcaagtggttgccaacacaagaggaactcacaatcgacggaaattcgtgaccatgatggtttgaacctcagaactgcatgcaacgtaaagaacacagatgacatgcggcgtgtgtgctccgagaaatcgcgtaaaacgccaaatatggacacagcgtccctcgccttccctcttcgttatgttattcgaaggaaatgcatgaaaccggtttagaaaacccgttttctctgacactttacggtcacacaagtgccggccctgtcgagatgtcgaagcggctatcctgactgcatgcgcgagtcaaagcgtgcaagtccagattggtgagaaaggagtgagagatcagtttccgtctaaaaaatgagcttcacgacgctgtatttagaatcaaaccagtggtggcttgaagcagaacactctacatcagccgggctggcacagaacctgagacaccgtaggaatttgtgcgtgtgtgtgagaggctttccgtctgaatgttgttacaacgaacgaaaatgaatgatgcaagggcacgtttcttcggagttgctcgggtgtacacgggcatttttgagacgctgtgaaacaaagaagcttaaggttgcgtacgagtgaggcgccagtgtgtagacgggatgtttgtcgcgagctacacatgacgagaaaagtcagtgaaaacctgggagtgaggacagggttgtagcatgcgaaacgaagacaagccgaagaactgagagagaggtgggaaaaggagaggcagtacgaggtaagtaacgtctcttgcgagatgggtattccattagcgacaagactgtcgcgcatacaggcgcattcgagacgctcgaaagcaaagagttgccaggatgtacagactttgtctcgcttaagatcgaatgaatgagattcattactagtatcggtcactggaaccacatttcctgggggaattcggagaatattcagaaacaaacacgaacgttcgaattgaacttcagtgcgacctaaattccttcccacaacatagtcccgatcaagaggagcatttcgtggatgaaacgcttcctcgtgctcattttatcacttgcctacacttccacggtaaatctaaccacgctgctgacggaagacttgccacatgtttgctaagcgtttacggttgaagtggctcagcctaccgtgtgcgatagcacagcgtgggggacgtggaagagtcttgagtctgcaactgaatgaaagatctacgtttgtgttttatgacaccgcataaaatttgactcaccaacaatttttgtcaggctgttcgtgcaccattgaccctcacttgcaaagcagaatagcagcctgagattgctctgacggcgctgctgctacaaagggctggtctctcagcgaccagaaagcattaaacacgcgaatgggtgggtgcaatgccccttatacgtcaacacggtaggaacgggaactgcaaggtgtcagacactgctgccaaaaaacttttctttatcctccgttttgtgtcgcaacggtcctaacagatccgtctcaacagtctgcgctgaaaaaaacgtctaggaaaactgctgtcacgcaatgcgtggcgagtttcattcttgtcgtttctcggccctgaatctgcgtcatgacatgcacagctgtttattcggaaaaatctcacacaacatccacatgagagccgatggcacagttatttcgcggaaggagccgaacccgctcgttaactgatttacaggatcaaaacgtgtgccacatttgaaggtaaactgtcgcatccttgtttgttttcaccctggcgagcatttcctggttttcccaagcaactggaatctttatacacactgaaaggcagacgaaattggtatggcgactcatttataacttccaacaagataggacagctaaacagagcgttacccggtacgaagaaatacggaatccccttttcggcaattgattcggcgagaagtgttcaaggacgagaaaaagtttatactacactccgtcaagacgccttctacgagggaaaaggctgcattctttgcctctacaagcaaccaaaggaagagcagaaactgccagagttacttatcgtttgttgtcgccacgaatcatgcacacacatcgtagattaaattatgctctgtgctgcgtgataccttgattagatgtgctgtctttgatgatgccgtgaatgaggcgtgaccttaagtttcgcatcttctccagcgatatacgatactacatcgttaggaaaactcggggaatgctaccaaggctggacacacgaaaaccattcactcattggttttcacgtgcctcagcacaggcaagacgtacatgaatgccagcgttagcttcgctttgttctcgagcccagattgcttctcggcctaaagtctgccaccccttttttacaaggcaccttgctttgcgatgctggccaccggcagttgacccctgccgttgttttcatcgaacaaaggcgccccacgagaacgcgaaactttccaaataacgctgtggtttgagatcggtacaattctgcggtgtatgtacagcttttccaaatgaacgacgcgcgaacccgttaacacacaacttttttgcaggaactaacatgcacagacgtggcgaatgttacgcacagtacctgtgcgcggtgtaagcgctacacgtttgttttcgtctgctgaactgtgggggaatttctgcgaagacactagtatttgcagtgagcgtgtactggttgcaaccgaaagatctggtgtgttgcttggcgccgaatcggaaggtgtctgcacagacgcacagctggctggcgttttttcagctaagctagcattgacgaacggagttgtcgacgtctttcgctttttgtcggcgactctgtaaacgcgagttgtgctcgttttttgttcttgaccagaaccaatgtgcagcgtacttcttaccgtctgcagccgtcgtctaacaggggtaacgcaccccgaagtagatactgttgacggccaggtttcgccgcctgacgcaccgttttcccttccagatcaaggcggttcttttcgcgtggcaccggcgtacacgacagcgggtggtggacagatacggtcggcacgcgctgcgcagaggcgagcagctttttgtggccgcggtttcgcgcgtgccggcctgtaccgtgcgagcaacgcagcttcagagccagctgggaggcga

SEQ ID NO: 1050 - DNA, 3535 bp, Toxoplasma gondii
cagggagcgccttccagagacgctgcttgcctcgtttttgcgttttttgacgctacaacgcttctctttggttagaaacgacgtctgaggcgccgcctcgacgttacttttatctctagttcttttttctgcatgctcgtcgagccttcctccgggaagcgaaaagcaaccagccagccagggagctggcgctgaagtgaccccaggaggggaccaccacgggcaggagttgtttttccggtcaactttggcaggagaggagagcggtgggggactttcatgcaaacacaattttggacgatggatttacctaacagcttttgaatgtgaaggagttgctgtctaacactggagctcttcaagatgcacggaaatctgcatctgtcatggagagatgcttaacactacactctagggaaattggggactcagaggaaatgtaggtagaatcacagcaatttgtgattgtaaatgacatctatggccattcctacagagtatggctcaataaaacgcttctcgacgcttgtaaatatatatacataaatacgtacatatgcgtgtgtaagtctgtacggttgtctaggtgtatatatttttactcacgtgtatgtcctgtgcatgctccgtgtatgtcaaccgaggtatttagacttttgaccaagttatttcttttcaaaaccgcggtgggttggaggctttcgggcatttgacaactgagtgtgttttctgtctaatgcacagtggttggaagagcgaaaacatcctttttttaaattcagcttgtccttcggtatccttgggtcgttgaagttttcccggagtcctaaactccgatctcgacggaattcgtggtccgttcgggctagagggaagctacggttttgcgtccgtgctgaaatcgactcggacacaaaccgttcacttgggttccgcgatttacgctttcatctccccgcagaagttgatttcacaactcgctgatggtgacgcgcatgcacccatgacagaaaagacgccgcctgctcttgcgtcagctctttcgtctccttcgcacttcgctttgagagtcttgactgagttcacgggcctgccggaggactgaaaaaaaggcgaagtgccaactgaggtgtcggagagaggaggcctctcaggactgactcagctcatagctaaacgcttgccctccgagactgaccggaagggagcactatcgaattaaaggaggtaaaaaggctgaaccgatttagctggagatgaatccatgcatcagggcagaaactgcttctcacgttctggcttctcgggtgcttcagttgtgcctcagttaccctaggagcataacagatctggaataacctttctgtatgttgtttatattactccaagagcattccgaatgtgacatacccttgatttcgaatgacattgaaatccagagattcgccaaatgcttagggctgcttaaatccacggattgcttttccaacctttccttgcaaggcgacaaacggttacaccaattgacagctaggaacagaaaagcctgtctcccagatcagcaccggcaaaaggcaacagtgggctcacataggatttgccagtaaatttctgctgcggtcaagccgtaacgaacgtcttttatgtgtctgaaacgatcctctgagacatgaactttttttgggcggcttgcatctctgaaatatccgagaacactccaggtagattcaaagctatctttcagagtgtgacgaggaacaagattcacggaagctacaaaaatccgtgaagtcggagctcttgcgcacaccccaaccgcgccacttcgaaattgcgtaccgacgtcttttcatggatactcaagcagtgcaacagcacatccgttcgacttgaaagacaacagctagaacctgctgactcctaagggacgaaatcattgtttatgcggatgtgcaatgaccatctacaatgtgcatttatcgaggcagggagagacatatgcacatacacctaccgctgcagaaccttctaaaatatataggagtgatccgtaccaaagggcatgtgtctcggcgtcgtggcacctactttattcgcagcaactttcctacctacccacccacacaaacccccgtagagaggaagacaactctacagacgatgtgcagcagttcgtgagaccgtaaactcgtgtaaggagttggagtatgttttcccggccagtagcagtgaaaataaagaacgcaatcgaagacagacatctctccagccttcaactacgtgtcgagagcggcgaaaatgacaggaaagatggaaaaggaagaaacacgcgtttcacagctcttcaggagacgcatagggcgccggcgcccgcaacagcgctcgcgttggctgttaagcagaatcttttgtcggacagcgaagtctgcggaaatcgctttgactgcaggtgtctacggttcacaattttcaagatttagtttccccgcgcccttgaggggtcaacagaaacgcgacgctccctctcttgagcttcgtccggtaacccgggtaaagatgtcgcgcttgaagttaccttctgtcctcaaagatgtcaaccaatactaaatgtctaccgtactttgttcgcttcatctcctcacaagccactttcggttcggactaccacgcccatgtaacaaaaatcactaaactgtaaaacacgcggcgcgaagtgacagagtcgctcaggagcaaggagcaagcgcttgccaaacgcgtactacgcggggagtgtgactcaaggctgctggcacatgcagcgacggttctgttggaacgccgagagctttcgcggtgcccttccacagaaaagcacgttcacaagactttgagagtaaaaagcatcggcaaacagagagaaaacgaataccctggctgcgaaagaaggtacagcggcgacgagaaagtgtgtcgtgggcttcggcacttgacgggcaccgcgttcctcatattggagcgaaacgcgacagtgctgtcgcgaactttttcctgcaccacaactctggtgcgttttttccggaggacgtgagactcaaaagcttcaaactgatcgagattttcgtctgccgtggccggaagtcggcttccttcgcggcaaaaagcgacactcgttgtagggacttgggggatctccactagccgtggctttttcggggcttgtcgacaaattcgaccttgtttttgtcgagcgcatcttctttctttcctcgactcttttctcgtcttttcgacgctttagggacgccgttatcagacgatccctgacgtccttgctcgggtcgggtgttttgctgtttcccgtctttctgccgaccggcagccgcttccaggaaagctgttgcatcgctcgtagcgcagaaggcacgcagtctgtgtgtcttggacgacgcgtatattgaccgcaagtgatgcgttttttccagtgcctttgttgccacaagtatctctttgtccgtggaagggcgtcggtttccttactaccaacttaggaaga

SEQ ID NO: 1051 - DNA, 2311 bp, Toxoplasma gondii
gtttatctttctcttcgcttggcgcgactgatggagtcctcgcaggctcggcaagctgtcgcctggtgacctcgagaaacgtttccgccgcaccttgacaagtttccggagtttcgcagcgcactgaggcgttgtaatgtctcccgtgaacgtttggacgccgcgaatgggggagatcggaaccaggtcgacgccgacgatcgtcgttgcgaccgggcagtgcttcgctgcgacttgaagccagcctcctggggcggcgcagaggtcgacgacgctcgcgcagctcttctcgaagaggcggaaccgctggctgagctgaaggagcttgaaggcgctacgagcgcggtagccttgctccttcgccaggtggtagaacttgtccagacgctgcttccccgtcttcttcttcctatggctgtcgccccccgccatcgtggaagaagagaaaggaagaaaagaaaggaagaaaagaaaggaaagaaaggaaagaaaggaaagaaaggaaagaaaaaagagagaatcgagaaaacagggcagaacgcgagacgggaagcggaggaggagacggaaaggagaaaaggagaagagaagagagaaaagagaagccaacaggaaagacactgaagacggacagcgttggaggtgcgagacagtagcgcgactcgaggaagagaagtggagagcaggtgagagagaagagaatgcggtttcttgaacaaggacggtgacgacaggcaaatctcagatcagaaaaacgaggacctcccctaacagtgccgcgagaatgaagttgtacgcctccatgcagtttgttttcgacagaaaagaggacaagattgaaaattaaaaaaaaatctgcctgctttctgcgaaacttgaccctctcgatgctctgccgtcgtgtggggtattcgaaaggagacaggcaaggagagagacgacctctttgacctccgttgagaaggaaggcctcggcggagaaggaaaagagagaaactgaagcagaagttcgcttctccagccaaatccgaagatttcctcctgcaaggaagaacgcaggattctttgcgcgaaaagctgcatgcgctcttctctcactcctccgtggagagtctcctcagcgcctctcgcgagccgccgagcacgccagagactcgcgtggacacacaggcgaaaaggaaaaggaaaaagagaaggagaaagaagaaagaaaaaggaaaaagaaaaggaaaaagaaaagggaagaagccccgtgtgtgtagagacagacacctctttcttgttttgctgtcttcagcgaaaagggaggactttctactctcaagcggaaaggagaaaaccttttcatcgtgcagaaaaagagcgcgactgcgttgcttgtcggggaagcgcttgagagcgagacgagagaagagttcgtccgtttcgatttgaaagatatcctcttccaccatcctctggcgtgtatggcttcccgtatagacctcgtttgaagtcggggacgcgtctcgttttctcgcggctgcctggacggccaagaacctgcaagtcgccattttttctttccttttgcggcgcgtccttcaaaagcgtcctttcctttctgtcttctttgacgcttcgctgcctcctgccgcgacaaaggacgcggaaccggcttctgtcaggaaaaaaggcagaaaaagaactcggtcttccgcatgtttatagagtagctgcgcttctctgtgtgtctatgtgtgtatcccttgagcagcagcatttgtcgaagagttgagaagtttttttccacctgtgaaagagtctctgaaagactgttctcacggcggtgagcgtctcgctccaggacggtctcggtcaccaaaaagagcagtgcctcagaggctgtggaggatgtctagaaagttccgaaaattcgtttaaatcgaagaagcagacgcgcgacgggggggaagcgtcaggattcgaacggagaggagaggctctttctttcttctctcgtccatgcctcgcgttcctcaagtcttctgccatattcagaagcatctcctttgcccgcaatgtctcctttctcccggcttgctcccttccactctctttcttcttctgctttcactccttctttcttttgttcttctctctcgacttcttcttgttcctttcttcgttctgcgtcggtttctcttgctgcatttcggcgggcagcgtttaccagagaaggcctttcctgagagtggcgaggccctcggctccgttgaccaggacttcctccagttttcgtgaagtcttccaccttcgcgttgtggaaaca

SEQ ID NO: 1052 - DNA, 3781 bp, Toxoplasma gondii
tctttatcaacaaattcctcagcaatcgggataaaaccgaagccggcaaaggagagagggcgtctacagaaggtggcacagaaagagacgaaaacctggcgaaacacggatacattgctgcacatttgagaagaaccgattttctgtatttgaagcgttcagtgccgttgcaaagggcagcggcgtacctcgtgagtagaatgaaggagcacggggttttcaaggtaggcgaagatgaccagttgtgtctcttctcaaacggacccaagaaaaaccggttgttttgcaggaagtacatggactcacgaagcttccacagacgtgtagagggcgactgttttgtttatgactgcctacaccctccttgtgaaagtatacgctcgcgactctccgcctatcgccccactgccaggaacgtcagattaaacaccgactgttacatcgtcactattgagaaaaatttgatcttatccatccgcagagttacacagaacttctttctcaattgtgtgtcacctcctctcagagtattacggttacagcttacggttgccgcgacgaaacacttgacattgcttgtctgcgtttgtgtcctgtcccgtgtcaggcgttcatatgcacggacggaagcgaagacgagaagcgagaattgcgagacgccgtacggcgagtgggcgacgctgcttcgtcgtcaccatacactgtagtttttttcgatttgccaacagttagacgactgatgataaagacgctagaagcaagtagtcacgtctcagacgatggttcattccacgacttgaaggctgtagagacaccaggctacagcggcccaaaccacatttctctacttctacatccaggaataacagcactaattgaagtgtggattgctgcacgtgccgcctatttcattggaaccaaagattcgcgtttttcacaagccattcgctgggagcggcacttgatgggacacccgctcgaatcgagcttggaggttttctgcgtagacagctcacctgatcagactggtgggcaggcgcaaggcaagtgctttgcaacaaaaagtcatgatcctccagaaggacgcagtcgaagtgagctcaggaggaaatactggccttccttggaccccagttcgacactgtaacgtttggtcgcgatccgactccccattttcgtttcgggcatcttggaaacgtcacgctgctgccagagccgcatccgagtacgggaacatcttctcatatctccagagaagacttacgctctcttagagagaagctaaaaactcgcgcatctctagtagtggtgccatcaaccagtgttacctcgtgtcagtttcatacagttggacatgccagctgtgtgtgggagtagatccgttgtccggctaccaggctagcaacgctcgagaattcgtagatccttacctcgtgtaagacactgctactacaactggcatggatgtccctgaagtgtggaggtctgcctcgctgcgattgttcatagtgtggcatcgatgccacaaggtcagattgtttttacgaatgatttttttgaatactctccccgtggggctaaatcttgtgaggagtttgttgagtgtatccgtgccgtgggcagagggtaggggcgaccttcgggaccaggccattttccctgatcgtgcatcgatgttagaacagatgatttgagggagcgctgcagaaaatgcagtagctgcaacagatcgaacgatcacataatttgcgatgtcgaacaccgccaactctttttttcactttcctctcattcctttcgcatttggcgctcatctgcgagctcacaagcttctgggtcctcggagaaccgcatcattccccatgctaaaaaaaatcgcagtgcctcaccgggggtgcgtgtaattactatggtgtccataccaaactcgtcgtaggttttcttaactactgtgttcatgtgatcaatggtaacctgcggttccatacattctatcctctgcatccaatgtcgctgaactgtcgagccgtggaaggttgctaaggttcccttggaaacgaccacaccgatgccagaagttcggcgaggaaacgacgccggcactcgaccacaggctaaccttctttgcaagacctaagaatttgatttgacatacactatagaagctcttgtcgttgcatattatgacttttcctagtcggtgcgtatcgtctgtggcgttggctgacacagtaatgcggttcattgctgcatgctccaggagaaccaaggatctctcctttccttcgatctctgaaaggcaaatccatggtcttgtcagccaaaacacaatcactggagtcaaaagcacagatacatttcggcttgttctttgcgaaagagtggaataaccaaggacaaccgactgatggaagcgcacgagcactagcaaatctgccactcggagcttgacagcggttttactcggactcccgctagtttcttgaaaaaagctgcaaaaaagtgcgtcttttctctctgaactcaaatgtgtttgtcgcattttggtagggggaagagcagccgctcagccgttacggcaaactgtgtttttcattggcgtgcaaaccatcggttagctgctgctgcgtgcggatgccgtccatccaatcgacagaaaccgaataaatagcgaattgcaagagaccaaacatcacagacacttgtcttttgtgtacgcggcgactttaaagcctgcttttccctctattttcatgcttaacagcttccgatagtgcacagaacaacaggacagaaacgcaattatctatctgctgcgcaagcgggcgaactgctctcgcgcttgaagcccttggactgagttcgcttgtcctagcaatcgacatgtccaaccgaggcggagcgcgtttaccacaggaggcgaaggcactaccaacggattgaagctgtttcatcttcgtcgcctaagaaaagcgttatttccacctcaggatgcacatagttttattcgcgcatggccttggctgggtgtcgcacgtgtcttgagtgaacccaatggatacgcggcattgctgccaaccgttctgtcgtggaatctcgccattgtgcactcaaaaatggaggataaatgaactttttgacacacagttagttcgaggatccgttttttatccgtccctgttttctcagtctttttcacatctctgacttcgcacgttttcctgactcaaagggctggaaggaagccccgaatcgcaagaggtgattcttttttttgcttttgccgggacggtgttgctctgcctcgactaacgtgactacaacgaggaccggtcccgcctattcatttttctagcattagtttttccttctttgtggggctcttctccgagcatttcttcgctctgggcccctgtacaggtgacacgaaggacctttacacattcgcggagattcctgtgcttctcagttcgctgtgagccagagggattttcagactgactttttctctcttggcgccaccaaaacttgcaaacgtttcagaaaatttccctcaaaagcacagggtgttttcggcattttgtactgccgccggtatattcctacgctactccgcgggaaccgggccatttctgccccgagactcctggcgagcagctgaaaaagggaagctcaagacaagggaagcaaaggagcagggacgccagagataaaggggacgatcagcagggcgattgagtcgcttcagtctcttcctgcttcacccacccctcaatcatca

SEQ ID NO: 1053 - DNA, 2773 bp, Toxoplasma gondii
agcaaaattgaaacatcgtcacggtagactctcttcaaaatctccacagagtcccactctcagtgtgtcatcatggcagaagtctcacagagtcatccgcggtttgtgcacgtgtcctacgtcgtgtgcatttaacgactttccctgtcacagttcagctgacatatgaataggtgactgcaacagctgtatgtacagccgaaccatgaggccacccggtgcgaatttgcccgtcatgaccactcagtgctgaacatagttgatgctttttttccctgtgttccgtggctctgactgcggcttcgactgttccgtttgtggcgacagactcccgaacgttcgagaactagatctttcccgaaacctgtgcactcgataccgtaggaaacgtacagaaattattgggctgagtaaaagcgtaggaggatttcgagagggaccacacggtggctgtctcagtcgcaaaacaagctcgtgctgcaagcgaggatgacttccaatggccagtttcctcacgacgtgtcaatgaagcaagaaacacccggaagcgactcatgtgcgaaggtggccagctctctaagaccagaacggctagaggcgagactccgtaacgcaattaacgacctggaagcgctcgatgtaaggtctctggcgtgtagtgcattctgactctgtaatgcgaaacaacttccttcaccttgagcacctcgaaatggatatgttcaacgaggtcttgcattggtctttgctccgaaacgagcgacttcttttcgacatcagaacgactcgactgcaggtttgaacttggtcatgatacgaatgacgtgaattccgatacggttccttaggtgcagcaaagatcgacgattgtaggtcatccaccgtgaccagagcctgtttggcacaatgcaggaacaccttccatctcagctgcggcaagagaagtcgtggctcctttgacgggctcacagagggaatgttcacacttgaggagtaagaaaaggcccagagcctgagttgtttgtccggactcttccggcgcgttgtggtagttgaggcgaacattccacgccccttcaaaacttctgtgtctgctgtaagagccgggcgctgcgtttttcgtgaagcaataactatcaaagtagtacttaataggcggcgccctgtccaaatcaagatcgtcactgaatcaagaacacccagttgagattcaaatacgaagtggatatttcctttcgtgacattctacatccttcctctccaggtggactgggaagccttgatgggtattttaaagtaacggtcacaggattacaaccggtgtgcgttcattccgtatgctttcattgaggtgacgtttgcctcctttgctgtacatgtacgtgtgctagcacggaagtgctgaatatctttcctcgacactttaaccacatgcacacgcttccagggaagtacaactgctttctctacagaccaaatgcctgtatgatacggcaagccgtcgctgttaatgtaagcacgtcactccttgcttattgttgattcttcaatctggccactcagctgtctgccgctggtgcgtgtggcagaagtccgcacatcagagacggcatgcacgacggacttggtgctgcggggcagtggcccattagggagcaagagcaagaatgaagcagagttgtccggtggtcttgttcctatcccaggcccgtttttcccattctaagcagatcactcagaaattacgctttttctttcgagtttgaatgtggattgagggaagacgttgcccgtttgcatgctctttcgccagtgtctgcggacggaccggcgggctgctgtgtcttccttgttgtagtgctcaattttgtcacagtttggacgcatgcctgtctgcagcccaaagcatgtctttgtggcgccctttgctcgtcgattgcacttgcagcagtccgtcgtctgtctcattcccttttgactttttattgccgtctattccttgtgcgccagtgcatcgtgtgttggccactcgaccgcgtgccacgcatccatccattcaaggcacctgcgaaccacttgttttatttcgtctgaagcgttgggtgtatttcaacagtttcgacagtttgatgatgtgaggaagcgccttctccgaattcacgttgtgctggggccctctgcctcgtccgcaaaaatgttctctcagccagaagatttcaactccgcccgagcccgataaatcttcatcagctcgttgcgtggagtgttctggtgaggcaggtcactgaattcgtgcttgttcccgactcttttcgtcttctccgtggaaacgacgcgggacaccaggcactacccgcgtgttttcctcaggtcttaccgcggcgaagtcaccgcgtggactcagccttttttccgcggttatcctgttctctgagtaatagggttgggatttttccccaccgtttgttttggacaccgtttaaatttggcagtcctgtctggtgcacacgcggacggacatcccggtgctccacccagcagtatgcttccctgcagtgtgcgtgcgcagtgatttgagcgaaccagatatttgttcggggcgtttgcagcgtttttgagtgcctctaaggtttttcattgtccccttttcggagagtatttgaccagggttcctcttcttaccgtggtttccctccttgaccgagtgtccatcaactctttttttcctttattctctatctctccccatccatccgaggcccagcgtgagaga

SEQ ID NO: 1054 - DNA, 1949 bp, Toxoplasma gondii
tccagttgctttatttagagttcaattgcacaattacgtttccacgtgttatcagctcacgctcaaacaccccaaccacaaacggtggaatactttgtgattcttgacgactggttagtactcgtgtgtcacggaggaaattgtcagtctgttgttgctcggggaacgagtaaatctcttgaaaggatagttgtgccccgctgtggcagatgttcttcagtttttggatagggatctatgtacagaattcaagcttgcatttaacacagtccttagagaacttacatggtcttgcttcccgctagtagcgatctatgtccattagaatcttcttttcccgtagacactacatcgcatctgtaccctttctcgtgaactattaacttcctgaaggcggcacgcgccgtgtcgttttcggcggtagctctcaagtgactcgtgtcatcgataggtttatgttcatgatcattcgcatcatccaccattccaacagaagcccattgatcgaacttcgcgacacagggatcgctcagggctcctggatgtgtaaaaacgcagaaggtccatgtagaagcatttcaaaaagtggcggtgtggctctcgatgttgcgaactgtcgattaactccagcgcgaccagacgcgaaacttcagcagagcaccttgactaggcaacagttacctggatgtggagtcttccgggcgaggaaagtgtcctcagtttcagcaaatatggaaaacgatcgtagttgtcggggcagttgccgaccgtggtatagttacgcgggcgttcccttgcgcaatcagatactatgtcctgcttcgcagctctgtcaccaggtaatttgacgaatctctgggtccctaaagtgtaaccttgtgctggcgtcatatttgggccagggtttttgcatcttccgcattacatttcaaaccgagtgaggatgcgtgcgcctccattccggtgaatagtttcctgtgcctcttctttctctacacggtgtcattcgatgcggtgaagtgataagggtccttttctggaagccactttctaatgttgtcagtagatagcgtggatgtgagaacaccgatgtcttcttcagaagagtcaagcatgatagacaagccgaatcggcggcacggtactcacggacaacaaccatatttcttgttcatggtcccccaggctagcttaactctttcaagcaaggaatttgaagtttccgactctggagcaaaggtatttctttccccgggctggttcgttacgcaacgccggtgttttcactttggtttcgcccttctgaaacaccgttagcccgaaccggattcacgccaacatatagccactcaggatttgaaagcattagacgtagtcacttttttgtcataaagcgtttatattaagattgccgagcccctgcactcgaaaatgttactaactaccaagcttcgccggaacagcggtcacagcagcacatcagtgcgtcaggacggaagcgccgcgagaggcatttgccggaaaccgtatgtgctctaacgtgcttgtataataaagcagctgactcttgcatcccagaaaaacagtcgtggttgtccaagacaagcagctgctaatggaaaatggaagccggtcaggtggctccgccaatgctacctttcgaccttatacccagtgtagtagaaaaggtgggggcacagcatcgggatgctggtgcaactccggtggacaagggacgctggttgatggcgcgccagcaaagatgcgctgctggaagaggccggcggccgcctgttgcatgcaccctgcgatcgagaacggagtcgcttatcgttcttgcccatggcgaaataccacgactgttgagcagtagcatgttccttcagggacacagaaaaatgctgctgcaattcttgtgaattctcttcttccccttacgatagagacga

SEQ ID NO: 1055 - DNA, 3705 bp, Toxoplasma gondii
cttcagggttagaacattcttgaaagggtttgtcaccttcggcgttcaggtgattactgttccactgcgtaaagggcctcgcgatgtttggcaaggacgccaagagggaaatgaacacagttacgacagtgaagggtctcttgaggttctaggacgattttccttccctttcgtgacagagcctgatatgagctgcatgttcacggcagttgctcctgagaaaggggagcgaggttggtcacggggaggtggccaagtggcttcagaatttgctgcttttgtcctcaagggggaggagaaagaaacacttagccgagaaattggtctggcagcgtctggcgcgtctattccgtgcgaagacctcggttttccagttgcagatccgttagcctgtctcggtccgcctccgccattctttgtacttctctctccctaatgaagaagatacatgatcatggggaaccgtattctgtagatattacttttttcatggtgaaatttcgttcacaaaacggcattagttcttgttgactcatctgcgcttgtctatcacgttatcagacgagttaagcgaggcgcatcaagaaaggtaaccgtcttgctacagactgttgtttcgtcacgctttgttttttctgtcgaagtcttgaactttttggtgaggaggtgcttctctgaagtgcagatgagaggatgttttgccggccgacggtgaggtaatttggtagccccgaaaatccatcgtttgctgtattgcacgtaacgactcctagagtgatagtgcggctgtggcttggtaagccgtggtcaaagatcacgttacgcgtcttagtcgttataacagtgcctacatcttctctgcgatacgaggccaatgatcgccgttgctgacgatacaggcatgcctcttagcatgaaagtaatcagaacaaacgaacgtgtaggcttctctgacagtagttctagcgcgcagtggacgctcttcctgtccacgaaggaaaagtcggaggtgaatggagaaatatgtttcggagtcacgttgcacagagtaccgaaaggatttctactactggggatgcaggccattaactgatagaggaaatacgtcgtctttgccgtctagctgcaacaaattggacactcaggatcacaacacaacatccagggtgctgggttataacttatctgagaatggaaacttgaacgttccataggccatgtgtgatactgccacagtatacgtggctaggctctctgtagccgacccactttcgatggagtctcacagactctcttcatgcgaagtactttccgaataaccctcggggaaccaaatgtcgtactggtgaaagaaggtgtgtatatttgagagtattcggaggagctttgctatcgtcttgcacggtgttcagggaatctccttgccaccagctatcgaagtatatcagtggggaaatgacctctgaaccccaatttagtgttaaccatccttccgttcagaaactatacatactgttaatggggtaatgcctggttgtcgtctcaacgtacacagaactgccgtacgccaccatcccatgaaattacgacaactaacagtgaaatattaaacaaaactggtcgagactaaagtcgggcgcgtaagtgtcaaccagtaactagccaccttctgtagctttagttgttatcttatttattttccgtgttcgtttgaaccttttctcccggcaacaaaaaacgtgttgtcacaaagtagaactggcaatactatcagtacctaatatatacgagactgttggctgtttgaccatgtgcaatgcatccagcacctggcgttccttcgtcatgcgaaaagcgtgttgcacaaaactttgaaacggtggttcgggtatcctgtatttgcttccactcgcattccctgttcattttgccatgcatcactggtagtgttaggcacctaccagtggaatcaagcaaatggtggcaacccggaaataatcacccagagtgtaccccgactgcacaagggataatatctccagaagcaaagcacgtttcatctcagagtgtgccggatctgctgttcccgctctacaggcgttttacaggactctcgcctccgcgacacagagccagaaaccgatacaatttattcaagtatgctgcactcatgtgttgcccccatgtggcgcttatattgtcttaattccaaaggcagacggctgcagatcgttccatctctcaaacggcgtctgttgccttctagtgctcgagctagcaagaatcagcgtttgcccctgtggttaatttcatgtgtcaaaacgttgtagaggcgtttcgcccgtctgcagctctacggtggggacgaaggggggttaacacacagtagttggtgctttctgtccgacttataattcggttacctggctaccagcctcactgtcacagagcatgaacaactacgggtttttctcttgtcctcatagaatcggcactaacgaaaaaaggctgcccgtactctcagtgcaacaatagccgtccgggaaatctgcgcattcggaatagcggtggccacgaaggactgctaccgtacactccatgctgcgtgagaggtctagtgagtttctctcgccaagacacggagctcttccgtgctcttgcacaatcgtgtgtctaacagctagaaagctgagccagagatttgtttctcacaggcaaacgtgcatggtcatgcagagcacgctcatcctggcaagacagaccgcatctctttcagcagggtatggtctgctggtggatgggttgactctgctcacggtcgcctccacggtaggcacggggtgtgaacccagcggcgcgggcaaaagattccatctgacatttctgaaggtaaaagtatctacgagctcgcagttgcgaatttaagagaaccatatcccagaaaattagagaaatccagattttaaggagtgagcgtacaggtaaaagacagccgtcgtccagcgaacgaactcgttctaaagctgctgaaaggcttgattctcgaaacgctggaacagcgcacagccccccagaggacgcgaagactccgtcaagcgacttgtgcgcacaacaaggactccgcatgagaacatcgagtaagagaatctgttgttattccggagcgtctgaagatttcaaagacagcaaggcgaattccctttccaagtgattccctccacttcccgaaaaagcgactttaccctgagaattgcatcacgcgcaggtggtccctaccacctagcgtgtcaaagtcagctagcacgccggctcgccgctttacaagtcccatcgaagaagcttttcttaacgacctctctgcttctcttgcctattgggattgaccgtcttccgacattgcttggcgggagaagtcattctaccaaacgttgagtgatatttcgcccctgaactccctcaagctccacccaccgcgcgaccccgtgtctggcttaccctggaagaggcaactgaggccacaatctagctccgattcgtttctaattgtgggaaatccgctctgcacagtcgtattcgcgttcgattccctttctctctttcaagctgctcctatggcccatatttttgccgggaacccgggcgtggactcccctccacggaaggggacctccggaagtagttgcttgtcaatttgcccagaaggaa

SEQ ID NO: 1056 - DNA, 5039 bp, Toxoplasma gondii
acacgagacggaagctgacgaagatgcgaggaagggtgtatgtacacctcagagacggcatcactgccttcttcctgataatcctgcttgtcgtcacaccgcctctgctcgaaaaagctctctgattctgtcatctgttgttcgagtgagagaagttggcgagagcacttctcccaggaaaccgtctttgcgcgtttttttttacctcggtcttcgaacatcctctcacgccgctgtcgatcttctgtctctgctctttcgtccccttgtgtctcctgttggcgccctcgcctgcctgcacaagcaactctccatgctggcatttgagaatagccgcaaaggaaacctccacggaagagaagcgcatagtttttctcgagtacttcttttctcgccttgtcgtttcgcttttactccgaaaaaattctcaaaattcataaaaaatggaaaaatgaggtaacgcaaaacagaaccattgcactgtcagcaacgtattggcactgaaacaggatcttcgctctctctctctctcgacctcgttgtccgtcgttgttcctctcaagaggttgcgaacaagcaggctcaagcagcggcggcactgaggcagagaaagtgaaaaacgcgtttgcaagagacaaagaggagaagagaaagaggacgagaaagacgcttggaggagaaggaggaacagagaacctagaagagaatgaggctcgaacagcgacaggcggattagcagaaccgctcgcggaagagacgagggagaggagaaggcacaccacaggcttctgcgtagtcgagaggaacagggaacagaaaacaaggacgtccactcaacaagcggtcagatagcatttttgacaacagagattcgttcatcgcaaacaagactgcatgcagagtgtgcgagtgtctctgtgcacactgttgtcttcagtcttcagcgggagaagagaattctcttgcaacaggagacagaaaaccgatattcgcgttgctgctgagaaaacctcgcaaagcgctgttctcctctctctgcaaggtttggattagaaaggccgcgaaagatacaagttctgcatgcaggttgtgctgggtggagccaccaacgcggaacctgaatcgagacccgctggcacggacagataactctttcgcatgactcagactttctcttctcgcgtaaagccaagagtcactctgtgggaagcaaaaaagcctattttgtccccgcggagttctggaaaaaaaacaagaaaacgcgagcgaaaggcggtcgctagatacacactgcatgcagacgatttggtctgtacagcgagtgaccctcacaatatctgtatctatatctctatctatagatgtatatataaaagcatgtatgaataaatatacattttatgtgtataggttccttctttgatcctaggcgtcattgaaacgccacactttaggagagtccaaacgaaaattggcgatgtgtgtatcggttggataccgtatagcgcgatgtttttcctttcatcgatttaactcacctctcatctccacatctacgcccgcgagctttgcatagtgtccgctcacgaaggagatgggccagcaaccgcatctgaatttggcagtcgcagcaaagactctccagaaaaagcattgctaaattcctgaggcgataactccaccagtgtgatggcctgcccgttggaaccaccctcgattgtactgcctggtgattttctccaaaacatggccggggaactctgaatactcacttgaatgcgtgcgcttcgccatactctagtttttcgcttgttgttgtactcgccgcgaggatcatgttgatccttttctttctgagcacacaactttccaccgagaaggaatgcctagcaggctcagatcgtgaggacacagtgccctgtaggagtcggttccaaatgtattctgttttttcgtcttcgtcggccctgcgggagtctcgtctacgcgcaggtatgtcgaagcgcgagtcgctggctgcgcaaacggagcgatggaaaactcttcctgagatgctaggaaggccagtgccagcgcgctgcgaaccctcctctccgaaaagtatttacgagctttttctgaagaggattccccacacgctggactcccagtttgagctctgaaagccttggtctaccggatccgaggcctgttctgttaacgagatttcaacgacctttttttctaggaggcgcgcttccggtcaccccagcgatatttgagaacccacatttggatggaagctttgaaaatgctgcattggtttgccagtctcctaatgataatctggaggaaatagacggatcaaagtcttactgccctcgcgcctttcgtctccgcagacgccggtagtcacccacacatctcttttgcttgtttttccttagatagacatggcatgaccgtcgaatacatgacctcgtctctgtcgacgaactttcaactcgacccatacattcatacatatatatatatatatatataaatatatagggacagagagatggatgacaggtaggtggaaaggggatagatagattatagacagatctatgacagatcaatgcagatggaagtattgttgataggtctgtttcagacggataaaagcagtgggtcgatattgaagagaacgatctattgtagagacgccgcttgtcaggaggggggactggggaatacgctcacgatgctccaccggatatacactgcatatgcacacccagaagtgacagttcggcgacgattcgaaacttccagagaaacgagaggagtttggggagatgtggatcgaacctgtcaaagtgttccatgtaaacttcgacgctacactgcaattattctttgagtcgtttctcgtccactcgacgcgcttgagccgttgcggggaccggggcgtttgatttgtctagcggatatggtttcgcatattttgtgcatctgggaggatttcttatcacgacaaacgaaggacgacggtgtagtttgggagtctcggcctgtccagttcgtgtctaggaagctttctttaaccgttgaaaagcaagcagcagacatgtaaaaccgttagaaagcaacttgaaaaaagcaaggcaaaatcgaagccgcctgagaggtgctccgcgaaaaactcagacgcacagttagagacatgagaaactcgtttttccattgaggaaatcatctgaggcagttcagttaccctgccggaagaattcttctgaggagctcctgtcgacgaaagattcgcagaatgccgatgtgtagtcgatacaacaggataacttgccgatacaatgtagaccccgtctccctcgtggataatacagttgaacagtatacatacatatgcatatgcatgtacgtatctatgtaaacgtagtcagatggaacaggtgagtaaagaagactcacgtaggagcaggttcttgcctccatgtttgcgtgacattctgtaactgaaaccggaattgttattggtgtacaatgcccactctctccagagtattctttaactcgaactggggcgcgaagtcgacagaaacttaggaaacgaaaacgtcgcggtgagcagtgaccctttgagttgtctttccactctcccactgcctggtctggcactccagcatgttcttcgggtacacagaagttccgcagaaaccaagtggagaaacattcgatttgcctgtcccttgcctcttcgttttcagactggaggtctctcgacagtttttcttgtgtaaaaagccgcccagtgaaagcgtggtgtgcagcacccaggcaacctcttctttgaatctacctcacaactagagtcctgctcagtaaccaaagtcgcagattgaccctgttgcctcgacttgcccttcttactcgtgagcgttgaagcctgtccaataatagttttctccgttctaagtggtggatcacgacagacgcagtcagacgcttttttctcggtggctggtgaaactttcgaagcggcgggcgggagcctcctcccgccagtgcgctgcgcgcctgcctggagttctctcccttttggcgggcaggtttcttccgttttctttccatttccccacgctgtgtgagctaacgtttctcccgttcctttcgcctcgtgaaaaacggcgtctttctgctctcttttccccgcttcccttcgtcatgggagcggtcgagatccctgaacgacagcgagcgctgtgcgcgccagtccgagacggcgcgcgacggcgacccagtttttggtggagtttctcctccgtgtgtgccttcgagaaaagactggccagttccctttttgtctctccagacgttttttgacgcggagtgttcgctgcgcatcttcaccttcgaactctggcgatcgtcctctaactcgcggtcgacgcgtcgagagaagcgcgcacactgtccagcgcgttcttggtctcacggcagcacagctatgtccgacgtcaaaaactgcggattcctcctttctcaacagctttttctctcagatctcttaatcttttctttgcctttctctgtgtacgacctttcttttctctcttctgtctccacctctctgttccaatttttccgatcacgctcagtccacctcgtccagccccctctctgtctccggtgactcgcgtctctcgctagctcttcgcttttgacgttccgctgcagaagccctcgtgaccgccagtctccttttctctctgtcgcttttctcgctttttgtcttcgctcctccggctttctttctgccttcgttcctcccgcatgtccctgggcgtttccgactgcctctgtcacgctgtctgccctgcctctcgcgcctgagaagaactgccgccagcgtacacccgaaagcagagagaggacgcctcgatgcgcgccagccttctctctcgcgacatacacagacagcgttgcggtccccgcagcgtcctctttcctcccccagcgcctgtgtttcgctgccacagccgacctcgccgccgcca

SEQ ID NO: 1057 - DNA, 2034 bp, Toxoplasma gondii
aaacaggttgcggcgctttcaaaacctgtggacgttcacggagacacttgggggttctctccaaaagcgccgtttttctccgtgaagaacctccgccgatggccggtcgaagccgagcggagaagaaatgtgtaaaaaacgcgcgtttaaagaactgcgtcaaaagaactgcgttagaaagggagacgagcacggtgctgttcgaagatcccgagtttcttttgagcggtgaaccgtgttttttcgagaggcagagaaacagaagaaggtctgtgctgtgcttggttgcaggagcgactggacaagctgcacatcgaggagagccctctcgcgatggagaacgtctttggggactttgttcgggacagcgaagatcgtcgcggcaagaagaaacggaaagtgggagaagcgtagagtaggagaccgatttttgtgtcaaaaattgtgtttcgttttcaccaaacccccctttctctccactctcttgtgaacacacggtggtccactttggtgcactttgtcctgtctggcgcacctccctgccgactgatgctccacttcttcaaacctcgcgcatggtcggaatgcagaacgccgcgactctgtagctgacagcgaagaagctctcttgcggctctccctattttttgacgcgcctctcctcccgccagtagagagtcgcctcaagcgcagaacgcgcctttctttttgtttccacctctttctgccacactccacatccgccttgcagccggcggctctcacaagaagttacgtcctcggcaccaagccggcatgaaacgttcgagagactgcggtgggagcctccgccgaacttaacacgtcatgcgcagatgctgccactggcgctggacaagcggcgtgagacccagtcttagaagagcacaagaaacctgggatccggagaaaacacgatacgttcaccatctcaagctgcagcgcagctttgtgtggtgtcgaagcgccagaaaaagcgtataggacttctcagagatgctttctcccagtacgatggctctgctcgctgtcgagcatctgagtctgttttctctgtctctctctctggttacgagtgtggtagcagggactttgtccatattgaacctagagggcaaccgatagtccgacacgatggttttcaaaaggaaactgaactctctccattttgtgctttatgaaagtcagttcctcgaaacacaaccgccacagggcacccagatagcgtggaaaacggagagaatttccttgaagaaacgtggttggcaacgcacacaaaacagagcgtcagaactgtgttccagaagagcgtggatccgctctctcaagaaaggatgaagtgcagtcgttttgtgtcgagtaagagtccaggccctgttcttgcgctgtgttttctagctggaggaccttcgaaaaaagacaaggtgtgaggacgggaccgttataggaaacacggagacttcaacacacagaggtccgtttgcctcatttttcgggaagtcacgccaaaccccaacattttcgaagacctgtcctcgcgggcctgcgagtgaaacattcgctttcctatctttcgttctggaaagaggcgctgccccaccttgtttcctgaagctcgcgcggtcgatgttcccggttccgctgtttcacctgtgcagcctgtgggtggcgcaacagccgagcagcgcggtttctgcgcaccttcctcctttattgtagccacttctttgtttgaatctcttcgccttcttcttcgctcgtctcttgtgacaagcctgtgactttgtcatttcctcttttctgctcaagctacaacgcgcttgtgcgcacgacccaggctagctagcgctcctcgtcccggcgcgcgctcagtttctgttgttgtctcgagtgttgtctggaatttcacggtgttttttcgtgtgtctcgagggagtttcggtgtttcgctccgcgctgcttccacggccgatcgtgtctttttgccgtgaaaatttctgtcttcttctcgactca

SEQ ID NO: 1058 - DNA, 1773 bp, Toxoplasma gondii
gatgcaagcaaacgtacttcgtagagctcatcttctgtcgtagaaaagttcaagtttccaacgtacacgacgcaggaacgcgaaactttctcctgccagtcctctttgctcctcgccgtccggcgatcgtagtaggtgtcgcggcctttgatgctcgcgtagaggcgcgacatggtcaagacgaacgcagaaaacaggagaggcaacggagaagaaaaggagaagagaaggaagaaaggggagagaaagaagaggtcgtggaggaagaagagtaaggaagataacgaaaggaggagggagaagaaagacaacgaagagaggcgaaaggactccggcgcctaagaaggaaaaagaccggagggtggggcagacgcagagagaaagaagcgaaaggaacgtggagaatgggagacagagacggaggagagaagagagaagaaagaggagacgtcgaacatgcgagagaccctcgcgagagggcgaaaagacggaaacggggaacgaagaataagaagggcacagacaacagagaagaaccggagctctcccaacgactgcagcagagaggcagtcgaaaaaagataagcagctggactttttcttcctctttcttggcagtgaagaagagcagaaacaggcagacgaagaagaggaagcgtacgcctcgaaggagagaagcgaggatgccaaggatgaagatggtgaaaagcagacgcgaacaagagagagaagagagagaacaagaaagagaacaagagagagaacaagagagggaaaacaggagagaaaagaggagagaggacaagacaaagaactagagcgaataagagagaacacgagagggaaaacaagacctaacaagaatgaggacaagagagaactcgagggggaacaagaatccgagatgtcggagagaaaccgcggcaaagacaagaatgaagaaggcgacaagagcaccaagacaaagagattgcctgtacagtgttgcctggtcttcctgcgttttctccagagatgtcgtctgctggagatgatgtgcaaagagcagcagcgcgagagaaaacatgactctttctctctgagcgcatgcaccggtcgccagctccgctttctcaacctgcccgtctctcgtccctgttctgttctcttttccactcttcttcagagccactgattctccgtcaatttccctcttgctcttttcttttctttcttccagactctccttcgcagggcgtcgcgacggtcgcgcgctccgtcagagtggctcttgaggtcgagttctgattcgccggcgccaacgaggcttttcctttttttgtttcctcgttccagttttctgtttcgtttccctcttgttttctttcctttccagggtgccgcgccagagaaagaaaaacagtggaggcactcgaggccaaggaccccatgggtgtggggctacgagtgttgactctttttgtctttcctttttccactttgtgtctcttcaccgggacccagttctgttttctcagaaacgaagagacgcgaagatagtcatctcattccctgtcctgtcgctcccgagtcttctccccgctccaagatcctctgcctgctttgtctctttattgtctctcctttggcattctctgcatttccttcttccatctctttcctttctcttcttttctctctctgccttatccctcttcctcttctctctcttcgctttctctccttcccctttcctcctcctcttctctctcttcgctttctctccttccacca

SEQ ID NO: 1059 - DNA, 3684 bp, Toxoplasma gondii
ttataatgctgtgcatgtgtataaatgcgtacatatttgtctgattgcttccgtctggggggctgcgcgacccccacacctgctgacagcgtttcttccgtcgcttttttcctttttttttgctcgtggtgtccctacttttttttgcccagccttctgctcgcgtcttgcggttcgctctgcagactgtgcacaccgtcgccgtcgaaccgcgatccgttcgtccccatgcaagccgtcgcggtagacatgtttcctcacacccttcactgcgaaggcgtgttgctgctgtgtcgcttgtcggacgtcgcgaagtgccgccgcgaactggcgacgaaggcgcgagagtcgcccgcgcgcgttcaagaggtactccgcgcagtcgaggccgagagcgaccgcaaccgcttcgcggacaacgtgagaggacgaactgcggagccaactgcgaaagactctccgggacagagatgcgccggctcgcggacgaggcgccgtctgcatgcagagacagaagaactcttgaaaggcgttgacgaagccgaggacgcgggaactgcgaaaggccgcagcggccgcagcagcggcgggggagggcctgcgacgcgagctgcatatagcgacgaggatacacttgcgggagactcaggtgacatcgcgtctggaaagagaaggcgagaaccgatcaacgaccgcgaggagagttctgcagccgtcgggatttcggcggccagcaacccacttctggggtgaacgtgcgttttgaaattcgaggttcgccgcagggagcgcagcagagagatccaactccagggtcgacaaatatggcatgtttctgaggtcaagagtccgtcaaacaatgcgaatttcaagtttcctgaggcgctgaaaaattgaggcaaaccgctcttcgggaaacatactacacgcttgcgcgcggcgagggtgaccacagagggatcggaagatgctctcaggctgctaactgcgcttgacatgtcgtacggtacaggcccggcggcagtgctgctttcgggggagagaggcctaagtagaaaatgcagcgggaaatggacgagcgccgctttagtttaacggcggagacgtttgcaacaaagtccgaaactgtttgtcaaaaaaaagacgtggaacgtaggtaggggaaaccgcttgcaaccatgcatacaggcaccttcgtttcgtatctgcgtcgccaccgttttcagtctttgcgagtttttctcaccaaggaacgtggattctcgaaacagctttcctgtcgacgcaaggcaaaacccacagagtctccgcgcttaatctttcatgacggctttccccggtttgccacagaatcaatgggcggaaattctacgcacgtccgatagatagacagcgctgtgtgctgcggatgaccttgatgaggagcacaggcaacaacagaaaatcgcatttcgtttagtagacagtggagtagaaattccattcagatgcggtagaacgggagcgctgtgtgatgctgaggacttgaggatcacaggcaacagaaagtcgcatttcgtttagtagacagtggagtagaaattccattcagatgcggtagaaagggagcgctgtgtgatgctgaggacttgaggatcacaggcaacagaaagtcgcatttcgtttagtagacggtggagtagaaattccattaagatgcggtagaaagggagcgctgtgtgatgctgaggacttgaggatcacaggcaacagaaagtcgcatttcgtttagtagacggtggagtagaaattccattaagatgcggtagaaagggagcgctgtgtgatgctgaggacttgaggatcacaggcaacagaaagtcgcatttcgtttagtagacggtggagtagaaattccattaagatgcggtagaaagggagcgctgtgtgatgctgaggacttgaggatcacaggcaacagaaagtcgcatttcgtttagtagacggtggagtagaaattccattaagatgcggtagaaagggagcgctgtgtgatgctgaggacttgaggatcacaggcaacagaaagtcgcatttcgtttagtagacggtggagtagaaattccattaagatgcggtagaaagggagcgctgtgtgatgctgaggacttgaggatcacaggcaactgaaagtcgcatttcgtttagtagacggtggagtagaaattccattcagggacgatataaatgaacgacacggacttctatgtggtaagcatcaatctaggaacttgtctaaagcgtttcacatatcgtcactttgttctgaggataactgttttatatttctgtgtctatatctcgattaaacaaacgttgttgaataatttttattgacgttcacctgtacgaatcttcctgcgggtcgtcttttttgtttatcttcttcgctgggttattctcccttttctccccttgtttctctgcttggccatgcttcttcccgcgtttttcctcccctcttctccaccacattttttcacttcctccgtcttcactttttggatgtctctgggataaacagcggcgccttcggcttgcatgcaacgtcgtctttttttttctttggggagacgtaaaaaagcctcagacactttaactgtaaagggcgtctgtccgtcctgttgcacaagcgaggcggacccgcgtcttgttcatgactttgtttcctcgtttctgagccttccctcctgaaactccgtgaggacagcagctagatcgccagtttttgcgctgcatcgacagctggcgcgtttaacgcttttcgcttctgttcgacgcttcgctgctcctctctttctgtctgctctgtactatagcatcgtttgccttcccgcatttctctaagttggaaagaaaaagcttttccgcgacggtttctgtttccgcgagtgcattgcatgcgccgcggacaccgggtgtgtgtcggggacggtgcgttgaggtcgaattctacggtgtgttttcgcctttttgtcctccaaacgcgagcatctacgtcttcacatcacgcttctccgggtcgtcatctgtccaccattgctgcttttcccgaaccaacgccgtctttcgaacgcatatgctgacgacgacgcagacgcacaatctgcttcgtacgtccctggtttatccgcggaattccacatttttctcaactcagtctccgaacaaagatcggttctcttcggcctctctgggcaggcggctgtgcgtcgcggcggcgctctttcgtcgcgctttaatagtcacttcgagtggatcgagcagcccggcgccgccgactgttgtctgttccttcacgaagatggccgcacggtatctgaggatttttctcctttcttcttgtcgcggaaaccaagtaatcaagacgccttccctcagcgggtgtcagcgctcccgaattccttgctttttcttctgcggttagtgaccccggacacggccgtctgtcatctgctctcttcctgtcgatctgcttctcaacttctcttccattcttcactctggaactctcccccttttccacttgctacgtcttccttctcttgtcgaaggttccctcggattgctcggagaaaaacaccctcaggcgatctcgaacttctctttcttttcaaatcttttcccctctcgctgcggccacaa

SEQ ID NO: 1060 - DNA, 1273 bp, Toxoplasma gondii
atgccggatttgatcttgccagcctctcctagttggagttatttgtatttaccaagtgggaggggagcccctgttgctagcgatatcattctgtactttactcgaaatctcttctgcaggttgacgagccaaggtggttttccgcttatgtgctgtggttgtagatatcagtggtttctcagagcatctgcttttgtaggcgattactaccatggtcgatgcatccgttgtgggatataactgtagaatttctacatcttccatgatatgcagtaaaccttgtcctgattctggtgactcagttttttacattgggaagaaaaagctagaggctgtactcgcaagccaatttgattagccagtcctgctgtacctccggacttgagccaggcgactccacatggtgggtaaaaagcaacagacaagtttgaagggaagacatccgcggtgggctcattgcttctcagagtcacgtcgtcgcatctgattcgcccagtagtcactccatgaacaagaagccgtcacaacaacgcacattcactctacttgtcgatttgtaacgccgtgtctgtcatggttcgcaccccgggcctcacttggcggcacacgagggacggcgaggttgtcactttctgctgaaaagaagcagttctactcggtcgatccacgtttatcagaacacgttgtcagcggatagtcgggaggcgaaataatcttcggatttctacagggttaccaacgctgttgcggcatgtgtctactgtatccctgtgtaaaggactattattattcagttgagaaggcacgttggtgtctcattacttttgttcctggatcttttgaggctccgcacaacaaagcaacagatctaccgtactaaagcgcgagcccttattgaatacaactgcggtactaggacactttggacaggaacgtcatgagaggctgcgtcaagggcaatgcattcttcgtgtgtgtagtttttggacagttgttacatcgttgcagaaccgcaggggagtttagggaaactgtgcgaatgtacaggcacgccgtgtatgactggataaccagtgttcccgtacgccacagacaaaagcagagacacagtgtagtgacacccgaaatattgagcgcgcaccgctccaataacggaggcaagcaccgggcgcaaggggaaatgcactggtctcgcgccgttgacaagccacaccggtcaacggtggtcgtctgtgttctacgtcatattcatatcggcattactgtagtggca

SEQ ID NO: 1061 - DNA, 1857 bp, Toxoplasma gondii
gttgcagatgtggacgaggcaacaaagaaggaagttcgtgatattctcgttgcgtacgacagatccctgatcgtcgccgatccgcggcgctgcgagccgaagaagtttggcggtcctggtgccagagcacgctaccagaaatcttatcgatgagtgttttggagggttcctgtctcccctgttcggttttctgaaggggaggaagggaggtcttcttgtgtgctcgttgactcttttcacttcacccttgtggatcctctttcttctttggcgcgcagcccatggctaaagctggtacggaagactggaagtgtgagtattctaaactgtgcttcgaaaacatgcagccttctgggcattgtcggctagtgtgtagcctgaactgtgttgacagcgcctgaaaagtttcgagtaatcataaagaagtcgcctgtatttgttccctcgtctggaaagacacattcacccaggtccagtggtcgcgcggctaacagtcacaaacggacggaggcaccttttgtcgacatccatattcgcaaactccccgctcagaagcgcaccactccactacataatggttgtacgaagatactagagtccatagttggttgtcagcagatcaatttgttccgtgcgtcttcgcgcacggaaaaatcccagtttttagtgcgtgactgttggattcagtcagaaccaacatctggcctggatttgcaaacaagacgttttgtctacgtatggagtcgaacaaaagctgttttgtagaagaaaggttctcatcaaacacatttaacccagttcagctgtccaactgattctctcctagaggacgtagaccacgtgcgaaaagttgacaaagagttgtcccacaagcaacgtcgtgcgccactggatgcgattgtctacattcattggagctttctttgaacactctcattcgacaagcacttccactagcagcaatgtcaattatggaacatcaagcgaatgctgcggccactacatccaagacctgcacctggttccttgcgtagcgcttcttagcaattgtctatagacaccggagaactactgggtatgtcaagtttctattagctgtactgggtgaatgttttactcacaattcatagttggtacgatttttaaacgtctcttagaactgccctggtgtatgtgttgacaagatgccggccactcaggaaatggttatggacatggagcctaattccgaaatgcacggagacgcacttgcccaggcgactcttgcagtccaaaaatacgaaacagaaaaagaaatatcacggcatatcaagaccttctttgacgcaaagtactcaccaaactggcactgtattgtcggcaagaacttcgcaaactacgcgtcctacgagtgcaagtgctaccttttcttctacgtcgggcagacagctgtactcctctacaaaatgggatgaccctgcttgcggcgacgtagtagtacgcaaaattgttggagtttcctcgcagcattttttttcagtagatctccttttctatgtctagtcccgttcctacatgctctgtgtttgttgtgcgcactttccatttctcaggcatccactgcatgccagacacaatgtccgctgcttctcactgtgtcgatctttttaatcagtcctgctaacatgagggctcctgtgtttaccgcatttgtctttcatactgttttctgtgttctggtccacggttttactggcctgtgctacagactgactcctcctcttctcccttccgtcatctgtctccgcagcacacctgcgccacaatcgatcacccctacactgcggccaaacagtcgtcgtgtcctgaacttgttta

SEQ ID NO: 1062 - DNA, 1774 bp, Toxoplasma gondii
acgttcttcctcatcagatgatggaagccgagggatggatttcttaactttcgcgatcagggcgaggatcctcttccctgaccgctgaatgccactgtgtgcgttgcgccagtccgaatacaactcatccgcaacagaataatggcgtgcctccccattctcaaaattgtccagctttctgtccaatttgtaagctttttctgcacccggaaagaattctgttgtcaggaagtgggcgatgagtgagggaattgattttgtgtgactcgcgcccgcagcgtgcaatcctaggagggccatccgtcgcgaaaatagatcacccgaacagaggggtgtggcctacctgcagcttgctgtgatccctctcggacatgcagtgacagtgaattataaggtccttgtgacgagttgttgtcctccagtgctcctatttcttggacttggcgttgcatcttcgaagacacgttgtggtacgattttcggcggagtgattttagtatacttcacctgtgagaatatgttttgcatcgcctcaaaatccgtctgcagcatttcagtgtcgccggtcgtcaaacgattcttcgacaagagaaggaaaacctgttggtggtacgtttatcgatgcatggcttttgaggtctaatgcttagctgacattttcgagcagcggcctgatcctgttacttctgatttggaccgagtcgagtagcttcataagggcttcatcgtttagggcttgtctctgcgcacgagaaagggactgagatatcatggctaagtggaatgccacacctgacaacgggccataaagaggggactgcaaaagttttgcgtcaaggacctcctcctgtcccgggagaactcgatacgcacgagttgtgccacaacaaaataaacagaggaaaatgacatttgataatcccattttttcaaatgatgctgtcaaccgtcagaaaaaatggttgtccgcgccacttcgaatactgccgcaacctgtcgggtatttagatatcctgtagagttgtaccggtgtgctgtacagacagtggaggcgaacatgggcgacccgaaggggactgatgatttctccggaattcgttttttcataaccctaaacaccgtctcccgaacagtcacgacaagcaaatttttaggcggctgaatctattcgttctccacgtccttgcagtgggcagcgtgcacacgctgtacgcgtgctacgcgatcatacatggcctgctacacgctgctgacgcgtacacaagcgcctccgacattcgacaaatgtggtcaaagaggtacaaatggtcgtcgcgcacgacaactgattattgaatacaaaatagcaggctagtagtgaataaaacggaatgcagtgcacgttgcgagacgcgatgaagtatactcaaagcaacgcggtgcgaatcgcatgcaattgagtgacgtgctcgtgcttctctgctcgttcaaaatccataactgctttccactatggttttttccttataaaaccaagaacatgtcatagtatgtaggcacagccttattttgtcggtttcgtgttctggcccctacgtttttgctcgtacgccagcgacgtcatccctccggacgatggtgagaagaatctggagacggtcccgcggcgcagttcaccgccgcgccttttgaattaattccaaagtttttgccaccgtagcttgtggtttgcatctagtcagtcatacggagacataggcatcgcattattagcgcccagtcctgtggttgctga

SEQ ID NO: 1063 - DNA, 1695 bp, Toxoplasma gondii
ttccttttccttccttgccttccttcttctcattcgtttctggcggcgtacgtgagggatgcactgagggccggcgccacggcgccgaggcgcgaggctgcgacgtcgaggaaggcgagagtcgccgtcgcaagctctccgtcggcagtcttgcgttcgcgtccgcgcgtctgcgacgaactctccagtctctcggctctcctctccagcagactctccactttctccgcgaaggcctctctcacttctgcaggaaaaagctgctcaggcgcttccgccctcacctcctctgtcacgaatccaggtgaagaagggaaggcggaagatcccgaagaagatgaggcaagaggcgggtgtgtacggattctgtcgctgtccggacaccgagaggtggaagaagaggaacctttgactggtcttgtgtctttgacttcttggacctgtttcttctccccttgattcgcgaagagaacggagagaggcttcgaacatgcgagattcagcgacgcgttcagctgtacagacatctgcggggagacagacgcggagtcttggccccggagggccgcagcgatttgcagcagagaggccatgtctcgctttcttttcgcgcgtcaggttcccctcgtttacctcatatctttctcttcttccgaggctgtcttctcgcgtttctcgccgccaaaagaggactccaagagacggtctttcggaggagaagccccgcgcgagacccccgcgggtgtacatacaccggggcgtttcagaagaacggacgcagtttcttcaagaaatccctgatcacgcaggagctacctcagacgcagcctgcgcttgaaagacacacgcaactgcacattcaagttcacagacattttagttctttgcttaacgttttcatgcatgcacctttctgtccagaactgaatacttcttctgttgaaagtctctgggtctgcaggcgaagacggcgaatcctcctccctgcacgcgcggtgagggaagaagcaagaagaagaaacaggaagcaagcaatcaggagaaaggagagaaatgaagacctttcttttcttcttctcagctgacggcgagaagctgcatgcaccgttctacctttttcgcgccttctctgcatgcgtcagcgccggcggcgaaagccggagatccagcaccctgaagcgcgttgaggggaactctgttcagaggttctttttctccgaggcactttccggctttctcggaaaagccgacagaaacgcccgccgtccaacttcgggtgtagctccactcgtggttccggtcttcggttcgcgaggtcggaaaagtctcgtcgctcgcggctgcgcttcaaatgcgggccgcactccagggccgttttctgtcttttatgccacgtaaaactttcattccttttccctgttcctccccttctaggacgatccctcattcaacttttcctcagtttctacgcctctcctctcggcttccaaacgcgctgtggctcgtctctgcgcctctcggagccccgaagcctcaaggcgacatgcagaacgcctggaacgaacgcgaaaaaaaggaacaaatgacgcagcggagcgaggggagaaaaaagagtcttcagattcctgaactgtccacgtcaccagagatctacaactgccttcttcctctcgccctcctctccaccctccacca

SEQ ID NO: 1064 - DNA, 2947 bp, Toxoplasma gondii
gagtaaggtgcttgtaattgagttgcgtactttagcagaccacatgtgagcgcttaagttggcagcaggcttaagtatactaatattttttttgttccacaatgaccgacaatagcggatggtcagcaattgcagggatcctgttgtccgcacgttctgtatgttgaaggtgcgcacaatccagttctcagaactgcaccgctttaacaactgatcaacacgtcctcacgtttctcattccgcgtgaacgcaacggctttgccggtttacggcaaatggccctagtggggcagagattgggagacagcatgcgacaggggccttctcttgaaaaggaacgtcctggcctgtgcttaaactgcaatggacgttcagagtctcagcatttgctgtttgtggacttagcgcctctcgcttgagttgccaccacatggataagtgaaccattagtaccatgaggtcccctctgtcaacatacattatgacacaagcatatgctctgcaatcaggaaataattcctctgactacggcgcgcgatggtcccgagggacagtaaaccctcttcacgtatacacttaccagttctagaggacgcgcgcactggaggcgaacagcctcccccaaatcccgtcttgctgagatctgcaaggtaatccatatcgtgggataatcacattggcacggttgaaggaaagctgcaaaagctgaagactgattacattgttttggtaatcccggatattgcgttgacgttcgctgctcgaaatactttcgagcgacaagagcacaccctggaactgcagtaccgactaaatacgcacgtgccctcctagcgcgaaatgtgatcacggttatgtctagcaattatcagagaaaagagggcgtgtcatgaaagacaacatgatggactcttcgaactttgcttgagataaaatgcgccagtgcaggacgtcttagcatactcctgcctgtgaaagaggccaggttccctggtactatgtggactgcttaagacagctaaaagcgttggattttaacgtacgacattaagactgttcgacatgggttatgttataggcgtgtgtgataatacacctgcttgccactaattcatggattccttttccctttcgcggattggaataccacacaggccttctgctgaagtgttgttttgagcagaacgcaagagcttacggtaaggagcgagaagactacaatgaaacctcgccattagttacggatagcaggatcctcttgggtggcatatcctcgttagtggatattcgatctggaatcgtttgcacccaactgctcgtcacagaaaaaatcggggcatttatgaactcgaaagttccccaccgttgacctgcgagaccacgacagtcaacggactgaattgctgggtttcgaaggttcacctccaccgacgttataaataatatagaacttccactgcattgaaaaacgatctcaactggatggggctttgccctcgcaggattatgagacatgatgcctgatggttcagagccggtagtacgacactcccagttccacccaaactgccatttatgcgcccgatcacccctagacacctccgtcgcttcaactgcaacagcactgcccctgatgtcagaaacctgagtacatgcccaggtcgccctggtgtcgctcgatcaggaaactttatgcccattttgccaacaaggatctttcctacgccttttcttccgctactgggacttgttgccttccgtccgtgttgagacgttgcctgatgcaaagaaacgatgctatgtcgctttcatgcaaggcaacaatacaaactgctttgaggaagaggcatagtgcatacagcacaccacatcagtgaccccccaaatgcgtttgaatttctacaaggaccccaacatacggggcttccctgtcgtttgctgattgtcttgtcgacaattttttcttgttcgtccaacaaagaaacacgtcgtgtgacatttcaaaatctctcaccaggcgtacgggtcgttttacgtttttttctgggttgcaaactagggcagcttcgtgcgtcagagccgggtatcatcggcactgaggcagttttcacaatgtcgtgcctcctcgccagtctgtgacgggcaagtcagtggtcgtgcgctgaaggcgagaacgcatatgtacaaatcaaagtgcagtatttgcaactgcatctgtggatgaccgcctattgcagtgactaatggtagcatttcagcagagtcctcgacatctgcgatccttctatgcctcgtttgctgccggagcgaaaaaaattttgttacggtgctgacccacctggctgcggcggacgcctgacgggaatgcatgtctgctgtgtcttgcgcacgcggcgggtgatgagttgctggtgggtttttagaagttttactccccgccgaagacttttctggcaactattgtcttcttccagttgagctgcgtttgttaagctgtatgataaaaacagaagtgggtgtcaccggtcaattcagagattcgtgcgcaggatttccagcttcgttgtcttgtctcccaaattcctcgtccttgaagagctcgacacgacgtcctactgccggtcttggtctcggccgattcgagtgtttccctgcattgtttctcaacttctgcaagtcaaaaactttccttgtttgtggcttcgccggcataagcgctcaaacaagcacgcgacagcggtacgcagtggtagctagtcgtgctgcccggccgcggaggtggctccagttgccaaacccaatttcgctgcttgccctcagaattcgcgaccgcacattcctttttttattcacggaacagaagcatctgttgtgaggttcgaaacgtggttttctgtacacgtagattcgacgcacgtgccagctgtttccgagcctattgccagaa

SEQ ID NO: 1065 - DNA, 1974 bp, Toxoplasma gondii
ttcgattcgctcacagacgccagtgcggagaaagcaacacgtttcagcctggggggcttctctcccttcttcccctcttgcttcctctcccccgagtctccggaactcgtccgttgccgctgcgtcttccttcgcttcttctctccgttcaccactcttttccgtttccctcttgtctccactcttcttctcttcgtctccacgctcctcttcttcgagaacgtcgagctcctcgggctctctgacttgtctgtgcaattctctgcactgagggcaccacaggaggtagagggacagatagtctctctctgagtggaggcgcgattggtctgtcttcttcacctcggtggagtgggcggctctgaacggcttcgcttctccggcctgtgaagccttcgcttcgcgtttcctctcgcgttcgcccgtctgacttctctccccgcgttgctcggcctcagcaagttctgtcactcttcttctttcggaactctcgaggtcgcgtctgccgtcgacatctccctgggttctcgtggacgccgggagtttggattctgccgcgtcaatcgaactcagaagcgactctccttgcaggcttcctccaggcgttccactgcatgtacatcgacaccgcgaaaagggaggaggcggcctgtctgcgcggtgtcgcgcgtcaggcactgtgactgctgggggagaatgtggcggctccctttcgccttcagtgtgtagagagggtgaagaaaaaaaaactctagaaactgagagaagcgcagggtcgccggacgcatccccgaccagcagcgcggcttcagagtctctcgccttccccacgagagactcggcctcgccgcgcggaaaaaaggagctcgctcccgcggagaagcctggcgcagacggcgaagaaggggaacaaagcagacaacgacgaatacctttgcagccacaacgaggcgcaacagacgactcagaaggggaagagtgatggggagaacagaaagaggaaacggaagaagaagaagaaaacgagggagaaggagaagaggaagaagaggcagcgtagagacaagggtgcgcgggatcgattcgttgctgtgttggcgggcgctgttgagcgccttgcgagttgtgaagtgccattttctttcaggaggactataggcgtggagtttcgagagaaggaagagacttctgcgtctggggcgaggagcccgaaacgctaagacatcccttccactttctttgagtttattccgacagttttgaggcccacaacgcggtgctgtgcaggcacatgcaaaacggaacgacgccgacgcgcgaagggcgcttggcgaggacctttcgtcgtctttcctcttctctctttcttctctctttcttctctctttcttctctctttcttctcgctcttctttgtcttctctgctgctggtgtctagacactcggcggggccttttccgtctgtttcttcagtctgcatgtgtgcgacgccttcgcgatttggaaaggctcgcggaactctgcgcgggcgcgcatgccctccctccccaactcaacatctctctcgtgtctccctttgcttcttctctccgtctcccgctcttcttcctttctccccgttttcttctcccgccctctcccttctccccggctttctcttctctctgtcatctctgtttgcttctttcttcctgctttgtctctcgcggttgtctttctgttctgctctttttcgggtgtcttcgcgccgctctcgaacggcacgcgacgagtctcttccccagccgaccgcgcggtgccagccaggaccgtctctctcgcggcgggcgcgctagcgcagctgcggcgccgcgcggcattgcgagtccgcaggaatccgacgcagagagacgggattctgcagacaccaggccgttcggggacttatgtgatttctcgcctcaagtttctcggtccaaagagcgactcgtgta

SEQ ID NO: 1066 - DNA, 2284 bp, Toxoplasma gondii
ggggagaaggaaaagaaaaactgtggcgaaggagcgcacctcgaaagtacatgcgaaaagaaaaaaacgaacgacgcgaagaaggatccacgcctccagttctcgtcgcgctgtttcacctccaagttcggaatccaaagccccacatgctcaacaagtagcgtgtctcttacacagacatatacgtttatatatatatatatctacatatacatctttgtatacacatatatatatatatatatatacatctttgtatatatgtatatacatatgcatgcacacttgtgcatgtagattggtcgatagattgactgacacaggtcgaggcaagtccgcatacaaatatatatatatatatatatatatttatatatacatatacatacatatatatatgtatatatatatatatatgaagatatgaaagatgctgtgcatgcatttatagcgcaagtcgatttgggctggcgtgtccctttgcagaggattccgaggggaaattcgatgtgcgtagaaagtttggttcttacgtctctgtttccttggcttttccagcgtctccatttgtcgccggcgaggcggccggagactgagagcctgtctgctcgggtgctgggaccatggtggagaatcgagacagaacaagagaatacgcgacagagaacaggaaagagaatacgagagagaccacggggagaacaagaaaggactctcgggagagaagaacgacagtagaaggttctttaacgcgcagagcggagtcgctagcggaaagggctgcgcgcgcggggacgagagccgcgagtttccgttgttctgacagctcaggagactaaggcgccacacgagaaggcgaggacggaggaaagcgaaggaacctcgagaaaaaagagcgaaaagcaggaaaaaaggccggtctgcgtcgacagcacacacacactgtttcgcgcgtgtgaagacaggcgcccggacgagcctggaaacgaggagcgttcggggacgctcagagtcgcagaacggcgcttgcgaagaaggtgcagagaagtcaagagagaacgcgcagccgagttccctcctacgtttgcgcacaagcggaaaagaggcctgtgcgctctcgtataactcgcggcgcaacaccgggtgtacgtacacccgaaaaacttcgagtttggcggacaagcggctggcgcgcctctcggctgcaagaagctgaacgtggaccgagacgaatcgcttcttcctggagaaagtcgacgagcgtggacaaagaaaagagaaggaatctgcggcgaggacgcctccgcagacacggaggaagaagagagaggaggccgcgagcctcgaaactctaggcgcggaaaaaactgcatgcccgcgatttttcgagttcagcgctgaatcgccggcagtctcttttccaggcggggagaggggggggcggcgggcgaggaatccgagtttttctcagtgcgttgagagacacaaagccaaacgaagactggaaaacagaagagcgaatgaaacggtctgcggtgtagacggacgtctgcgcggaggagtcctcacgcgtttcctctctcgaatttcatggaacggaacggcctctagaggaagaacgcgcgagcatcttgagctttctgtccgttttcgggacttcgtctctaacttgcgttctcttctctgtctgacaatcctcttcgagttgacactcacgtcggaaaagctccactctggaaactccagagttcactctctgtcgcagcacacgaagaagtcgccctctaccgtcgttcttcttgtactcgttcagaccttcccctcttccctctctgttctgccgtctctctcacctcttgtcgccttgtcctcttgtcgtttatctccttgtttcaccgccgtcgactcatctctgttctgtcgtccttcacctcaactctccgcctttcttttgtctgttgcttgtcctctttgtctctgaaatcactatcgattggccagtgacgaggacctcgaagattcgcttcctcctttgtctccactctctcgcctgctgctcccgcttcttcgtggcgctctcttctcaggtgtatgtacaccccagcggggccccgtcttgtgtccgctttcggggcttggctgacctttgcagcctcttggaggcggggaggaagaggcgagagctcgcgttgcctcgcgtcctcactagcgggctaacaggaagaggctgtccctggttttcgtctttcttttctctttcttttctcctccttttctgtcgaaa

SEQ ID NO: 1067 - DNA, 1956 bp, Toxoplasma gondii
atcaagtgcgaaagacgcagacgaaaaggccaaggacacagcatcggctgcagaagaaggaaacgacgagagagaaggagatgaaggagacgacgagccatgacgacggctccgcgaggaaggaagagaatggagagacagaagacgagaagaccgccaagtcgaggaaggcgaagtcgaggagctcgccgaaaggagagtgaacgaagaacttggagaagactggtcgactgggtggaatggagaggaagaggagaaactgaaagcagtgtttccgaagatctttcgccaggacgccacccgggcgcaagagacaaaggcaggcgagccggagggagagagaagaagatcggaggcgaagaaaagcaagaaattcagagaggcgaaaagaaggagaaagcgatggcaggcgccggggggccgcatggtgcagatcagacggaagagaaagcgcggcagagagagccttttccgacgtcagccggaagggcatctgcgataaacgaagcagtgtgaagaagggagaagaggaaagacgagggactggggacaaagccgctacgcttggagtttgaaggggaacctagacacgaaagagacgagacgaaaagaagaagaagaagcacgggagaggaaggaaagaaaaagaagaagagaagccaggcaacaggcagccaggggaagaaggggaaagaagaggatgaaggggagacaaagagaaacagacaagaagaggagagatagagagacagatcgtctacgacgcatttctcgagtgcctgtcttgatttacaagcgagcatcggagcttctcgcgtctttctgccggtcctgcgaacagcgatgtgtacagacgcgtctggacgacagctgcgtcggggaaggagatggaaaatccacaaaacaagcagacaggctcgacttctctgaatgcaaaaggaaggctctgctaggaaaccactgcgtaaactcaaagcgcctcccttctcgagtccgcgcgcatgcaaagttgacatgaaagaattcctggcctgtcttgcaggggtcactcgcggaaaaagcggttacgcctcctgcttgcgagaagagttccttttctgcgaagtgagcttgaaaagcaaggccaaaccgatgaagaatcgcaggcaaagaaaggaaagcgagttcgcattgcgtccgactccgaagaaagacaggacaaaggcggcgacgcctatactggatagctccctctgtgaggccattggaggacgcggaggagacatactgatcgtgtctctgtctcggaagaagacagatggagaagaagaaggaagaaccttgaggagtctcagactttttttcaagccgagacgcaaagaaggccgtctaccaagttcgaattacagagttggactttttctcttggaatttcgacctccccaggtgactcccttcgcactgcgcgcgtccgacgatggagtccccccgcgtcagctgcggccgcgatgtcggggctgcatgcgttttttttattttagcggcggaagttcttcagtcgaagattcgcgttttccctgacgcagccaacgctctagcggttttctcttcttcgctgtcggcttccttcgacgtcttcgccgttcctctgctcttcgcgcctctccggtaccgcgcgcatctgtgtcccggtgcatgcagcctttcttcagatttctcgcgtcgtttagcgcgcctctggcttccctggatcgagccttcgtctcttctaccttctgttctcgaaggacgcccctctcggtcgttctcctctcgctacactggcgccggccttcctctcatcgtctcctgcgtcttctctcctcggcgttgcctctccaggcgttgcctttttcctcgcctaaaccgtatacccctgcgctgcgcgcctcttcttcttcagcctttttccaggagattttctttctgccgattcaa

SEQ ID NO: 1068 - DNA, 4026 bp, Toxoplasma gondii
tttccctttctccggattgacacctctgtcgtcttcaagtgtctctctgtgttggcatacattaggggattcagacttgttcattttgagtaagcgcttgaagaaacagacgaaagctctccatgcggctttgagtttttccagcatagtgcagggttcttttcctcctgcatcgttcattggtttcctgccggcgcccttcgcaccatcctttccaggagaagctttgcgctcagcagcacctagggctttgcctgcagtcgccgctgcatcattcgctcctgacactgcagcacggttcgccacgtcgtctgctttcgttacacctttctcaccaacagaagttgctttagcggctgcttgccccgttgcagcaacgccctcctcgtcaaaagagccagggcgcccagcaacttcgactatattgctgccaggagcgttcaatggactcttttcgttctttgttgcttcctttccaaggctgccctcgactgtcaaggctttggaacctgctgagtctccagctaccgctacatcatctgcgctcaccagatcctctcctgctgccggaacgaaacccagtcctccataaggttcattaacaggtaaagtcgcagttctgaaccaagacaggagcgcacagcacatgatgttcacagcgaatcatggcgtatccagagtttagcgctcctcactgtgttgtctgcccgagtggattcagtttagtcacgttatttcgttccccgaggaatatcggatataccacgtgtctcaaacttacggcacacatacgaatgcgtcctgctgtgcagtcggtctggcaaacgtggctacggttcaatgccttgaaagggtggccattaaacgcaacttgtttcagcttacgcgccgctgaaaagaggccccatactctggaaaatggtcactgttgtatacgaaaaagaacgagcgctgagtttgcatctcatctcggctggcttcttggctttacccgggcgatggtccagctgtgggttgcgctggagcccacgcgagtaccgtcacgagaccttggagaacaaggctggaggccaggaggcgctgaagatttgtcgttttcactgtcgtcatcttagcaagcgcacacacgtatcctggcaagcgttgcggttgcctaacagcgggagacatgatttacaccgcctcgctgacaggtgccctcacttgttgcttacagtgtcctcggacgaggccgttaccccagtcggtcatccgtgtgtggagacggcacagttcaggacgtgtcgaacgacagcagtggtaaatggaaaacagcgaaactggctgtgtggaaagtactggaaaagtgcgaatgcgccagaataactcgacaaagtactggcgttgaaacacctctgtagcgaaatcacactgcgaaaccaccctttcggtcggcgtggtctcgcctcgcacccgcccgcggtggcggtgtctcccgaaccagggagtcacgggccccgttttcggtgccgatcatttaattccaatgggactccactaccgtctccgtttgtccccaccctgttcaccgactgtcacccgaacaaaggcccacgctcttccctctcaatctttcgacacgtgcttcatcacgtgaaattacagaacagaggaaacatgttgctagaaagacgtatcttcgtgcacacccagaaacaactgaatcgtgtacctttctgcccgatccttcccccaggataatgcagaaaagctggaacgccctcgtgatttctccaaggtgccaccacgtgtatctctatccccgtgctacctctaatggggtggacagcaaatatccttcaaagggtgcattcagtcaatttctcactgctatcccgttgcagttcctcaatatctgccgtcccatcttccttgtcgccactttcaacacaaccatctgaacccattaacgcggaagccgctgtgcggtaaaaacatagcgtagcataatgcagcgttcgtctacatttcctgtctcctgcagcatgaatgcattccagagaagtagaatctccagaagcacttcctgtacaactttgctgcttgaaactttgtttcgttgctttaagtgtccctttccattactgtgtaagaatagccggtcagtcgagactttctgctgccagatgctgcgaccagtggtccctcgagtccgatttcctcctgtgttacgttgcgttctctgcaacggtcgactggaacatcggtgtttgtttctttctgcgtccttgtatcatgtcaataattcgtctgccactgtcataagctggcgaaatcaacgcacaccaaaaacttgcatcccagacacactcacaaggcatatgacatctgggagcgtcacatacaaccaactgacgtccggcattgggctattgcgtacataccagttttgcaatcgtcttttggtcctctctacggagaaaacaggttcttaacattgaagcagtgtccttccgcgcacaactgatacacgcactgcattcgaacacgatgcttaacaccattgcattcctgcaacaagaccacctccccacacatttttcactgatcggctttgtagacttctcccttcagcggctttccagcctgcgcatcactttcgtcgtagtcaacattactgcgaaaagtctgggacgggcacgtgtgcggcccgctgttggggctccactggagcctgggtttctgccaggccattagggctgtcgggggcctgcgttgtcgtagtgcttctgtcactctccacattcgcgagtttcttgccaacggtcaccatgccccttccagctgcttctttggccaccttgaaacccctaaccgtgtgcgtttttgccgcggtgaagcctttttctgccaccacctttgcttttttgaaggccttctcactgtgctgtccgacgttttcagcgaacttcaagaacttgcgaaacagttgttctgccactctggatgcacgttgggaaaccggttcttctggctcttgttgcctctcgtctgggagtggtggtgtatgttcaccttttcctctgcagacacaaaattctacatggcaccgagtctcaagacactacagtgcgtgggaaattggactaggacaatacatatcacacagaaagcgcacctccctagctcccatgggtgcgatgaacagtcagacggcatcactctccgaaaaaaaaccgtggcagctacatcatgttgtgttatacaaatctgcagccgcctatcgttcaacccctgcctctatcattacttttgccaacttacccaactgctctctcatcaagaggtttaccgctgaaaggcacgtcgactggtccctggttaacaactccggaaaactcggcagccctcaccgagacgttgaccagggcgccaacggcaacaaccagcaaacaatgttttacggcgaacattgtgaggcgatatgtggagaagaagcaatatctaatcaaaacaactattcgtgggacgagaaacaacgtgcgataacgacgcgaattgcaaaagaaatcgtttaatgaccctttctgtcatcagttcgcaggacagacagcgacgcaggttccgctgttcattttgcgtctctggcgtcgtctctgtgtagagatgttgctcgcacttagcctaagggacgacagggagtaggctgccccgggtcaatttggtttggacgccggcgagagacgtacgtgcaagtcaccagtcagtatcaccgtgcgacgggcacgttgcctccactggacggcccaagtatttgtatattgaccgtaaggactgacgtgatacgcgttttccttcgtggtgcgtaggtaattaaccttttgcgacgaacttgtttttcgcaagcctggctgcactgcggaacctatcgcatagctacttgatgaagcaaacgggaggcgttcgtccacggcaagtcacccgaggatttttcgcctacgagacggttggaaaggtcgagagcagacgactgtcacaaagtcctaa

SEQ ID NO: 1069 - DNA, 2776 bp, Toxoplasma gondii
ttcgtttcgagtcgtgtttcgttcgggtaaaacctggaacgcgtcctgagagtcacctgcagagactcaccctttccgcctccaccttgctggttccggccccctcccgccgcctgggtgttgacccgcgcaggcgggggaccgcctcccccaacagcagcggccactgcagccatctccgcggtgggaaagttgaactactcgtccaaatcctcaactctctgtttgccggagcgatgttctagcgtgtactcgtagaaccaacatgtttacacgtgcaggggcgcgcaacaccaatcagacagcaacttgcgctagactccctcttacacattacaaaacgcgatgagggagacagtggagagagagacagttgaagaatcagaaaataacacggaaaagtacacgcacaagaaagaccacatgcgggtggctaacggaaacacggggctaggaaggagacgaagacaaagaagaacgggtcagtgaatggggcagaagaacgacagagcataatgtcgagaagaaccgtgcaacggggaaacgaaaaagaattggaaggcgatgcgatggtgaaaccgcaagaaacataggcatccagggtccccgggtacaagagtaggcgttttgtgggaatctttgaaaacatggacagcaatggaaccgatgacacagacaacaaaaacgggaagcgcagaatgacaacgcaacaaaggccagagtcttctgaacggcgggagacgccagcaaaagagcgaaaaatcaggtttaccgtgggagccacccccgccattccgttctgctacaacaaccggacgctgtagtgaccgtcgagctttggtctccttgtcacaatcgaggaagtgtgccttgttttccccgtcgtcgttgctctttaattctcgtctcccatgcgggtaggaaacgagccggaagagcacacataactcgggtcaacccaaaagcaccgaatcaagcgaggatggagttgcctctctaactcccatacaaaaaatgggcaaagcagcgctctcgtctcagataagaggaagggaacaaagaaaagatgaggaaaaggaagaaatctagccgttccgcgagcacaaaaaagaaggtcgagtcgttggcaccggcgcctaccttctccgggcggcggacacaccagtggaaaagtaacaaaaacgactacttccactatcccggggcatccacagccagtaaaccgcttctggaactttaaaaaaagagaacgactcgttgacatctggaaaaattaaatctttagaacaacgtgtcagtcccgctccatcccgggtagccgtgaacagccgcagacaccttgttccgtgacggacagtcgacaggtgacccaggacaagtcgcgtttgcacaggaaagggggttttatctgcgtcccatcagagaggcgctcggacagatctccaacagtgcccactgtgggaacaaatctgtgtgcgaaacgtgttgcgagccatgtcagcgagctgccaaacagcctagcctggaaggtcgcatgcatgctgcgagaggctgctaccagagagtcaaacacgcgagagcggaagagtcgcccggcgtgaccagatcagcaagctggctgtttgcttctattcgacagatacagcccctcagacccatgctattcacatttccccgggacaagagacaccaccctagatgccacgcgtgtacgcgacccggttcgccgatgccaccaacgcgcgtctcgttccggcctttctgcggatccgagacttgcagcgcggcgcggttgaaaaactggtgtcttttgcgttcccggccgtatgcagcatggagacgcacgagtaacaatgaagggaaataagtaccatcgacttcgttccctcatagcgacggaagacatcacgtaacgctcgtgtcgacgtccaccttcactcacggttaggcagagtccttgtcggtgacaggccttgcgatttttttttacgttggagctttcgcgtgttcatatgcgtacaaacggtcttctgggcgagtgtctcgccttcttgcgatttgccaaacttccgtggacgcgggtacttagtcacaaatattgatcgcattatcaaacgcggcatgtcttgacggtttgagtcagccgctggcaccggcgccgcgggccccccgcttgtcactctagatttgtcctttcgtgaggcaaccggatccttctgcttttccagtatcccgtgtttgctgccttttttgcatcaacaacgaacgtcgccacagcacgcggagcttagttcctcgccatataaagacttggccagtctttggcacagctacgcggaggcaggcgccacatttttttttcgttcaaagggtaggatgtgtgtagacaacttcggactacagtagttgtgtcccatcgacttatgcttccttaagacgggtttcccctgaattctgcagactgataatgtcagaagtgcctttcaggtgtggcaaagtggcatttttgtcggcggtggcttctgtggcacctatcatgctatgaaggtaccagagcagttcgaaactaatgctcgtgtcacccgaagttggcgtgtggactccaagggcttctccgtggcaatgagtctcagcgtcagcagctcagctattctatgccggcagcagggaagaggctgagggtatcgatgtccccagcgaagagtgaggagactgcggaaacgaaagaggacccgcgaatacgaagggtttattccccatcttcttttcgaagaaa

SEQ ID NO: 1070 - DNA, 4905 bp, Toxoplasma gondii
cgctacagcattttagcctcccgaaaaagacctgaagaaacaagcaacggcagatgttgggggcggtgcagatgtgcgaggcgctgccacgaagtgggctcgtggcgagtgtgtacatacaccgggaagacacacggaacctggttgttgagttgcgttggcaccccgttcgtttaccgattccgtggatcctccagacctaaaagtgaaaccgtgatacgcacgcgaagaagcggaagcggttgacaggacagatctgcagaaaggcgccgttgccggccacgaaaggagaaacgccttccacttcaacaccgctctttgggttcgcccaaggcacgaggtgagctttcgagatacaagaaagtggactggtctcaggatatgtatatagacaggatgacggagttcaggttggttcgaacacaaagtcgagcctaaccctagtgaattgtccgaaaaagtgtccaaagcctccacacaaactcggcacaaaacggtaagacccttttcccctccacactgagacgtcagaagaaatggccgccggaagctttggaaacaaaaagacggcagacactggagtgcgacagagtggtccgcagatttactcccgagaattccaatcctccgtcgacgaagtcaagaaagggcacacgagaaatcggaagaagcagatacatgagaggagtgcctataatgcggatgtgcagtccctgcagacgcggttgagctgtgaaagctcgcgtattatccaagagggctttcgccaccttccgtgggcatttcctcaaagtgactgacttccccgggaactacgtgactggagaggtcgacatcgcagagtttcaccaccgaatgcacctttctgcatttccttgaaggtccacaatttactgatagaagttttctcccgtacggcagaggagttgtgtgttcaaaaagcgaaaccgctggcgagtaccacagttcccgaccgtgcaaggacgctctcttcaggaaatcgtcaaaaatggagggtacggaaaggcagaaaccagcactcgcaggcacttccccgcaattgtgtttcagccatcaagacaaggatcgtggatcgcagcaagggtgtacggaagtcgaagagaagtgttagcgacttggaacgcacacacaagtgcgttttccgtcacggaagaaaatgttttttgcgcgccaccggagagaaaaaagagacgtacctgcagggttgtagacgtggaggcggaggctttcgcggaaaagacgcatttatttagaaacagacttggcaggaaggagagataaactcgcgaaacgaacacggcacgggagacaggtcttggggggaggagttgtcaaaagcggaaacgaaggggcagttgctgcgagggggactgtccgaagcgacggggtagcttctccagactcctccagaaaagattcgtgtctgcggagccggttgtatcgcagtttgccgagaaaaaaaactcggaaagaaagcagaagtgggggtgcaatcggcgcaaggaatatacggtgcagagacaccggcgccagaccaggcacagcgctgagcttccacctctcgtgtttgcttagaggggggaaaacttttccgcctttcgacgccctctcgcaagcgcgttgctgcgctcgcagcgacccgcgacctggtccgaaacgtaaccggagatcgtctaatacaagaaaagtggaagatagaggaagaagacggacagtagccgtggcagaatgtgacacctttcatatgctctgtcattgttttacacctacaatttacgtggttatagcaaccccgcaggtcgagatgtggcgcgactgaatcgcgcatttagcgctttgcaagacttgcagtggggaacgaggccgggcacaaagtgcggtcactcccagagtttctcgttccccttttttaccccctgcaccgtcggggtattgaatccccgtggagctgacctcggcaaaagcatccacttctctccaaaatacccatagacacaaaaaacgcagggaaaaatggaacaaaacttcgcaacagccaaggggtaaaaaagactgctcttatagaaaagttcaacagtttcgctgccttactacacccccctcctaatgtttagcgaaacaaccaagctgtccagagaaggaaagcgacacgagactacggactctctaagtacaccacagcagaaaaactagggggtggaacaacagggggacattctccagatacatcgatagaatcgactctctgacgtgtgcagcttttccgccagtgccttctctgctgaatctcatctgtcgttgtgtatgtgtacaagcgcacaaatccctttctcagtgatgaaggaaccacggccaaaagtgaggcaccaaggaacaccaggcatgctggatgtgttcctgttctcctgagagtggcaaggaacaacagcgccgttgttacttttgcctctacagccacaacataacaacggatgccctgcaagacagcacacagaatattaggtactgcttttttattctctgaatatcaggaaatctcttctcgttcctcgcttccgtgtggagaaaggataaccggagtggccgtcggacagaagataggtgtcaccgtccgctgacaacagaggcagacttcgataggtcactgcagggcttcgcgtcagaaaatcctgtaggcgacaggtgatcaaaagtgtccttcaagctgaagtcgcacgtgcaagagatgtcttggcacactaaactggcgttgatatgtcccgtttcttaagtgccgcagccggtgacgacacagatagtgttggttggtcgtctggcaaaagagtgtctcgcagaaccggcattttccgtgatgtgtaccgtgaccgagtgtgcagctgttcgtggcacacaaagagaacaagtagacatttaatgaccgtgaggagaacgtatcagactaagtctggacggggccgctggcaaaagagcaactcgaatttgaaaagacccgcctgaatcacaaaaatgtgctcttcctctgctccttctttcatgtcactgtggctgactgcgatgtcgggtgaatagcgaatgacgttgaaggtaggaatcgaaatcttaaggaagtaagcgtcccgtgacgagtagttggagattgcctgatggagatagactacgcgaagattacgagcccgctccaggatccaagtggttctgcacaaggcgcagatgtcaacaaaagttcacgaacagtagaagattccactaggtgtgaagctgaggaattgtccacggaagatgtagaggctgaggtgggaaacagtcctctaaccaaagtgaaccggcagagctagacggatctctttttgtctcccagcgcaaacagttttactcggacacggtacatccgacgttcgcgttgccggtgccgaagaacagctgtcgccctccacatttacgccgtaaaaggatggactgtgtccatttgtgcacgccaagaaggcttcagactatccaggttctattgcactccaattcgcagttggcgcatgtgtgatgtttccgaaaacaggctaggctacccaaagcctcgttccttcccatcgttgcgctgtgctgatcaaagcaacgcaataaagcattgttgatttgaaaatgccacgcgatgctacaacacgttccttcgtgttttgtttggggaaccccttgccgtgatttgcgtcctctggccggctgtgttctgtcaaccgcgctaagccaccagtctcgtaaactgacactggatattcgtacagctcgctacaattcggttttcccttcgttccccgatatagtcgttggtggtgtgataaaacacccgaaagaatcctgtattttgagtgactcagctcggaggctggcacgctgccggcgatgaaaaggaagacaagcggtggtagacaccgaacccgactcgggtttttctagcgatgcgtcagaggcggtgtggtctacggcatcttggttcagttgaagcaggtggtgtacaacgatgcaatttcgcgagcctgacgagacgagatcgtggcgtttgttgcaagcagatttgtaaatctgagtagctttgcgctgtgagcggttcgctgcacacagacgcctgcacaagcggttccctcgcggcgattttgcccagcatgcgagaaaggcgttctctgtcgccactttttggcacagggtaaccaaggagctgtccgagcgactgttctccaacaaatctgtgcctgtacagatggctgtgagcgcctttaactgactttactaatctgttttagtctttctgaacttcaggcgctttggagcagtgtccgtcttccgcaagtggacggtatccaaccgtttcccctggaaccttggttttgaatgatgtctcaatgagccggcgaacgcggcatggaatgaggattttctcaagtctgtgtggtgagacctaatcgggcatctctcctagctttgtcgagaagcgattgcgctgtgtgcagcgcccgaacccttcgttgcactcgagccgcccagcgacgcgctcgtcaagtattcctgcacattggtttcctgccacttcctttggcagactgctttctttgtatcaacagtctgaacagacctctgattaactgcacgcgtttgtctttgccgttccaccccccgaattcgcctcttttttctccgccggtcgcgctcggttcctttccgcgtctgatgtgcgcgtgtgtgtccacgcgtgcgtttctgactcttcacaactcagaagcgcacgacatggtggcagaaacctgagggttcttctcgttcccataactgtcaacccggtcgtctgtggacttcccactccttgccgtggattcaaaaattcagagtcccacggca

SEQ ID NO: 1071 - DNA, 2504 bp, Toxoplasma gondii
aattagcaccagcccgaaagcgagcatttgttacatgcagtgcatcactgagttcgctttccagcgttcccgtgtcagagcgtcgagcaaaagtccggtctgctcatgacaatgaggctgttttccgagaccaaacgctccctttatacaaacgacgcacaaacgctgtccccaccgctgcgagttattcaaatttataagaccgcggcaatccgccggctagcttgagcctcgttggcactgaaagaccatcgggccctgttcgagttctcttcatatgcgtacgcatgaattgctcatgaaataacgggaaatgataatcaattcactacactggaggccgaataaagaaagggggggcgagcagctccggtgaaagcgagttctagtgcccccacacgagcacaacgacagatcctgcttcagataacgaaggcccgaaaccttcgaaggaaggcggccggttgttctgtccttgtttgatttcttcatgcatgattccttttgacgacatcgatcttttccttgtttcatcagaaaaagagaaaagccttgaggaacatgctcttccttcctggaaaactaggtacacctcaacgacggaattgtggaagagcctctggtcgctgtgccgagagtctacatgtgatttggcgacgaaaaacacccggctctgcgacccacgaaggaaaacaagcaagccttctatccttggtgcgtgcgtcactttacaagcggttggcttgatattatctgtctgatcctctgatgtgacgccagatcgggctggatagccacgctaccgttcaaagacttgcgtgcaggaaaacttgcacgcagagacggggaagcatcgatgatctcattgagctcttgacttctgccactggagaacgagtaaagcgaagaaaactgaaacaaacgtctgtttctttccacgggtaacccagagggaaaacagacgcgcagttaccaacaacgagaatgtgctgttgcactgcgaagcccaccacgaaaggaacaaatcattacatgactatccccactcctcgtgcctccgagtttccgattgaaggacccccgttcacaaagaagcattcacattcggctggccacaaaaatgcagatactttttccgcatacgcgatggcctcacgccctgagcgccaacgctgggaaggcagcgaagggagggtactcggtgactaagtctttccgcggaaaaagcgtgctcagtatgaagataaactgctggggcgaagaagcctctgtctaagcatttaacgcggggaaataaactgaaaatggtgataattttccaacatcttccttcttgtaaagtcgagatgtcacaagacgctcctctggtggtcagctgctcgtgtgtcttttcgtatggtttcccagcggtcaccactgcacttctcggcctcctacgtgacaccctcacaagagaccttcaaaaaggaatgacttttcctcttgcaacaagatgtcttcagaattgtatagtgaacacagtgatttctcattccgactcttccaggcaaacagtgtcagggagttcgccggagcgtcttgttaatcttttgagtatcactgatctcctatctcctcgtcttgcgcgtgtataactgcagccaaggtgaatgctttgacggggtcgagtgtgaggccctggcgtggggcatgcgatagacatgatttcctacatcatgcgacgtttctaatgtgggtatgtgagaaaaaagggaatatgttaacgtttcgtatcgatgcgcccgaaagaacaggtttatatacggtgcgttgtgtgagtttaagccctttgtccgtccttcggagacataggctatgtgcaaccgaagactggacggacggggctgtcggatgtctaaggcttttgcagcagcgcttatgacaagtattggaacatatcgtgagcagacactctttcaatcgttctctgaattctccactcaagagaacatgcgtggatgaacttggtctctgtgtacaagcagacttgcctgtggtgtgccacccgggtgtgccgctggagacaagcggttagcagcggcggtgcatgcctctgggcaacggttaggtttactgagattgtatgagctttcgatcctctttgcacatgccagagcaagaaataattgtcagatctccgcagacggcctcgccacagccgtgtacatactctgatagggttgactgttgtatgtgacacaatctcgggatttcgctgagcggtgggattgtgcgtgtctgttgagtaaaagcgtgttacagagcattgattctaagacagtcgtttcttggtgggaaattgagttgtgcgttgaacggtatttccgtttacggatatgaggagcgctacgtagacacaaactgtggagaagattcttctgcttccgcggttatttgggttgccactggcgctgttgttgtcgtctctgcggtgtcgccgcgactctctgtcttcgccacgtaaa

SEQ ID NO: 1072 - DNA, 2061 bp, Toxoplasma gondii
ctcatcgttccagaccgcctttggaagcgaaggagaaagagcttttgcagagctggtgtcggcttctagcgaggtctttccgaggtcgaacggcgacaggggcaagaggacaggtgaaaaatcttaaaactgaaggaaagcgaggctccttctgcttgatttgaagacgagaaacaaggaaaacgaatcgaacccgggagagcgggagtgaccagacactgtgcggctgccactgctgctgttcactctctctcttttatgaggaagaaagcgagaaatgcaagcgcatctcaacgaaagtcactccagttgttcgtcgcgttgataacgatggctcttgttctcggcgttcgctgctgctcttcgctccagcagagaaaaaagcaaagatctctccccagacccagactccaggagccgtcgcctctgacaactggtgacgactcactcactgaggaagagaggccgagcgaccgccgaacgaatcgcgtacacagtggagacgccgagcagcgtagtcgtcaacatgcaacgacactgccagaaagacacagaagtggagaggcagaggattgcgaaggaagacagaagggagccgtggtttatgacttctgcggatgcgctgtgtcttcgtttttttccagtcgcttcgcgcctgcttctgacgaagaggacgaggagcgaagcacagggacggcaactgccgtccgcttctgtcggcaagcggaggcgcgaaaggcgagagggtggagggaacgatcaagctgagggagacgaaaagaggaagaaaagagctgggagaaaggaaagggaagaaggaaaaggaaactgagacgagtgaggacgccgggaagagagcgaaagaagaatcggcgaaggagacggcagaggagggcgggaggagacgcgaaggaacgagaaaaggaactgaaacgcaggaccaagagagaaaaggaagaaggaagaagaatcgcctgtgctattttgttttcgtttgtctctcgcgatatcctgaggctgcatgcatcgacttttccccaatgaaaatcacacggcggactcgcgctccgacaggcgttgtagcagcggaaggccaggactggcgggaggactggacgctggtttctcagattcgttttcgcgaccagacaaggtctgttctctcgacgaggtgccaagcaagcgcgagagaaagcctgtgcgtcgagagacgaccagcatgaaagacaagaagaattctgcgcgacagcgcggaagcactaagcgcgaaaagaagaacgaactagctgagacatctgccgagatcggctttcagcgtggttttcgcgcgagatctgtgaattctctcctctcctgtccactttgtctcctgtcgaagaaagaagcgacaagcaagacgcacaacagaacacagggtcgacggggaccggaaaatggaggagtttcgagcatccgctgcagtcacctcgctgttcttctgtgtcgcgcatttctaagatcttcaccaggaccttccccggattttttccttggctgtcgcctctctcctctgctctttctcctttttttcttcaacatttcttctctgctgtcctccgtttcctccaagttcctcctctctttctcctcctctccggcgggcattcttggcgcagcgagctgtcgtctctcgaggcgcgccagggcatgtgcctctcactcgagcgtcttagcttctttcttgtccttcttcgctctgtcttcttcctttcttcgtttctcctggagaactgtctccgtctcctccctcctctcctcccctgtcccactgcgttcttcgtcgtctccgcgcgctcctgacttctccgtccgtctctttcttctctcctgttcctgccttcggtggctctccttcgtcgccactgcttcatgcacatttcctgggtggatccgcgtccgcctcatgctcgagggtgaggcgccgtcttgctcctcctcctctgcgtcctcctctcttgaaacatgagtcgctctgactgtcgctctctcctctcacttctctctccccgcctctcttctcaa

SEQ ID NO: 1073 - DNA, 2320 bp, Toxoplasma gondii
agaaagcagaaatcgcgtcgctctccttctcaagtgtgcgagacagtcgttgtcagggaactctggaatccgccgctgcgacggcctaaagcctgtccgcagacatcgttctagaaagacatcttctggaggaccgccggggacctctagctgggctcttcagcaatgaaaagccgcctccaaaaacctttcagaaaaggacggcgggggacgcgagacccaagctgtgttgcgagaatcgaactggaagcgctctgcgccgactctttaagagttcaaaggtgcgagagacaggacccagactcgaaggtacggcaagaacaagtcttttttcatgtcaaatgctcatggtctctcggcgagaggagaagctcttctcgtctacaggagaagctcttctcgtctacaggagaagctcttctcgtctaaaggagaagcccttctcgtctacaggagaagctcttctcgtctaaaggagaagctcttctcgtctaaaggagaagctcttctcgtctaaaggagaagctcttctcgtctaaaggagaagctcttctcgtctaaaggagaagctcaatgagtctacgcgagaggaactcctctacagaacaggacggggcgtagtgacaaccagcggcagtgcgttctagtatgctcgacgagtcttcatgggaagtagctgaccttggcactcagcgaggaaagtggaggaaggcccagattggtgcagcagcgtcgaaaaagcaacagaaaaaagaggcgggtgtccatgtccgcggcgcctgcagcgtcgctagtcctcgcgtcgagttctgtctcgcgcagagagactgcatctgcgcaccgggagagcagacgcaacgccgaacggctcgagatccagatgtcggcaagcgacaaagaaacgcgtctgtggttgtcgagtcacgaggacgacaggcgcggggtcaagctgcctggcactcgcgcgtggaagtctgcgcgcccaccgcaagaagagtggacaagaaggaggtcgggtggagggcgcgcgcgacgcccttcgcgcgaagaagcacgaaatacttggaaacgaaaaagaaaggcaggaaaagcgaccaggaagatctcggcgccgatcggaagcctttcgaaagtcggtgcccgctctccgtgcccggagcgttcccccatggggagtctccagaaaagaaagtcaagttccgcgacgtttctccccttttcacacggaggttttctcgccgtcttctgcgtttcaacggcaagttctagaagaagggggaatctcggaaacgagcaagacttttggacttgccgccggaagcctccgcgccggctagctgtcggtctcgatcgaggaaccccactccactctcttgttggctgcgcgctcgcggaagtcgaaggaagtcggagagcaccgtgtggggaagaagagccgcggactttcgagaaaagtcccttttgagacgccgcctctgcccgaaatccgcagacaggcgactcaaaccgacgccggaaagtcgagaatcgcgcgcacgcgcagtgtacgtacaccgcgggtgtcgcccggaagacgcgcgcgtcggattcagagagcggccggcgaggagagacgagagacgaggcgagttctgcgcgagcagagttttttgagcaggcactgcgcgcaagagaacttgttcgtcttcaactttgcgcgcgctgcgaaaagatccgcgagaagatctgtcgctgtcggaaaccccaagcggtcggggactcgggggggtgtcgtgcatgcgtttgtccggcgaaccgaggcctcgcgtatatcctcgcgctttttcaccgcacacccgggagaaaagcggggagaaggcaaattctctctgaaggaatgccctcactcgcacgcttctctggcaacggcagacaaacggagacagtgcagaatcgcttcgtggcgggcggactgattttctggcttcctttctgcttcgaaagctcgcgcaaaagagcgacgcctgctgtgtggggggcgcctggtgtgacgtctgggaccttctcgtctgtttctgcctaagaagagaagcattttcttctccatatatccgtcagacattttcctcttccttctccgttctccgcggcctccttccactgcgtcttcatccctcttaccgcgcgcctctccctgtctcgccgaccctcaagtttccttcgctgcttcgtccctctctggaaaaggcaaaaagctgtttgcggccgtcttctacgcaggtgccttcttcgtcgtccacggaagctgaattccctcgcttctcttcaattgtcttcaaaa

SEQ ID NO: 1074 - DNA, 2687 bp, Toxoplasma gondii
ctgacaacataaccgtcctggcgacgaaatttcgaaagtttcgtcgtcaaacctcagccaagctccgaattttcgggggactggcaaagagtttcagtgagtgacggctgtgtacttcaggcggaacaagctctgggctacgtagtgattagcgttgtcgtgtctgtaacacctgcacagcgtttccagcgtgatttagggtacaggggatcgacctgtacgttttatttgatccattatgcttatctgtgcgtccccaggtcgagaaaggctgttgcgggaggagaactggtcgttcaagctgcaaggtagaaacggcttctccttacccatgttctaggcagcctgaacgtgtcagctgttgcggcgaacgccctttcctaactgaaaacataagctcaactcagccttcagatattttgcacattctgtacattgcactcgatgctgtttccgtgtttcgcaagtcaggcaaagcagctgcggttgccgcagtagcaggtgctcgcaggtccacacccgtctgctaatggtgtgttgcttctccattcaatccgaagagagagatgctgataacaaaaccagcaaataaatgcattcctctctcgtgagtaggtaatgcatgagatgtgtgcaagccatcagtggagtgggtaactgttacatcacttgtgaaagacacttgtggtgttgtcggaaagagtaaagggcgtttctttaaaatacgttttgtggtttgaaagttgcatttgaatcaaatttcgcttcattttctgggatgttagtccacgtaagggatttttgggtgagatgccgtattcactgaagttgaacgaaccttgcaacatgaactcgcctcctcatagcgtagcgctctcgaccacatcaccggattaaggaggctgtatctcgtttgtctcacggcgccaaaccactcgtttccctttctcgcggtagtctgtgttagccgaggatacctgaataataatatctggggcaatctgtccccaggacgagctgtagagataagcaggatggaaaatcgttatctctgaactggctccagctgttagtcgttctaacaatttcatcactctacccccctttggcgatgtccctgtccaacctctcctatctcaaccgcaggtatccgcacacgcatacttacgcaaacgtatgcgcatggaatggtgttaatgtggtcacacatctttgtattctcgagagcgggatgtggggaagatataagtacatagctgtgacgctaaggagcataggaaatgctcaagccccgtgtgcagcctttgctccataggtcgctcctgcattcgcaggctaccacagtcacttggtttctcagtgtggggtcgctccccttcaccagtcctctgtagccagtggtctctcggtaatcccacgtgtttcggccttttgactctggtagttccccactgcgcgatagtgaaggaagcacagagtgaacggtttttactttcagaacatccttccgcttctaccgtccagtgagcgacgattttgtaaactgtcgacctctggaggctggcgcgcagttcgcccccaaaacacgagactgatcgagggcgacactccctttcgatgtctcggcgataattgagatcggtctccgtttttacctttctgtcagcgactgggatggtccgcacttgagtcatttctgcaagaagaaacgccgcgtcctgcggatgccatacgactcagtggcagcaattttcgaaattagctggtggatcgtacacggccttcactttgtggcagtcactccagaaatcagcaagcgaaaaaggaaacagaaagtctcagttactttttcaacgctacacaattgatataccgacacatttctgtacgtagaaggagcatacctcgtgtcattgtttgccgccacgaaatcaacatcactccaatgatatcgaaaactcaaccccgaatgcaacttgaaaagaacggcgaaaacggctccgcacagtccgtttcgcagataacccgtgtcgccactcaacagcctgcagacaattgatggctttattcgttcttcgacgaaaccggcttggccgtttgcggtcacagaacacagtgttcttggacatttgtctgcaataaaaaacatgggtagtttttagcagagcaagatcatgtgctggctgctcatttcgtcgttttcgcctctgcgggcgccacgtgcagctgcgtcacaagcgggagacgagctggtttgtcttggcatttataattgctagcgataaatccatgtatcatgagttattcgttaccacggggtgacgacgaagtaatcaacgacgcgagactcccgcggacaactgcccgtctttctctatgaaagcatctggcattgtgggtgcgggagctagccacggaacaccgcttcatcaaaccatgatgttagagggaggggtttgtatcacttaagccagtggaggagggcggtcagttgttcagacattatgtgctgttcttcatctccatgcctacaaagaaacagtagaacagattggtttacaaacatgcacaaaaacggcctaccaagttggtttcccaatcgtgtctggaagcgcagtagttcagcatctcctgttccgtggctgccatcgatctggactcctgcctgagaaattgtctttcaacaa

SEQ ID NO: 1075 - DNA, 2399 bp, Toxoplasma gondii
ggagcaaccaaagtgagcgcttttccaactgtgagagttttgtagtgtctcacgttcaccaaagtttagacattgtgggtgagcatgacagtgacgttactggttttggtaatcccgtgccatagttttgcagaacgtactagagaaagcggaagaccaagaaggccgttatttacccctcgataaacggttcttcgtacacaggagctgtggcgacgtaggaactgcttttcttgaaagatcgtagcttaccggtgaaagcagacaccgtctgaagttcctagcatcgtttcgtgtccgccccccgtaaactgcggagtacttctgtcagcaagctcgtagagacgtagatcagttggcagaaacctattcgaggaatcttctggtttcttcaaacgacttgctgcaacaaagcctaatctcgacacgtgaaaacctgcaatcatggacgtaagtcttcctgcaattctcccgctaaacccgaattcttcatctgtcagtttttaggcatgaagacgtcaacgtgtacatcaaatattcatgcattcgtatgctcaaagatatggctcagtggctctgtccatttctgaaacaagctctgcgtgggggaagtcccggttcaggaaaatcgcatgacacaacgggttcgcgaggcctgctgttgccgtggaattctacaatatttaaatcagaataaatgacgtgtggacaagtcttcttctcagtccgctgtccaatggtgcaacgtttaaggtagaaggtttaggcgggccatcaggcaatttgctgacggtctgttgagtgatacgctgggtacagcaggtaacccacatctgcctcccaacgttgctgcatcggcagtgggcggcggaagcagaagcaaaaagaaaagactcccagaaacagcacaagattcctttccacaatatgcgtgaccgcttctcacagcgctttctgaagtgttatgcgaagacaatgtggggcggggcggaatagcaagacaaaccaactggagtttaatcggttcccgtgtttgccttctttttggcaatgaacaagagacccttgttcctcccaggtccctgcaattaaacgtaggtccggtcttcgtgttgtaaaaagtcgctaataaaacgatacagcttgtgggtcttcacctcctctgacctacaacgagacgcttctggacacaatctggcccccaaatcgtcacttcgtaaagtcgtgtttggctcatcgtgatatggttgcatcgaagcaaagcagcagtctcttgcttgaggcaaacaccaatttttggacacgcgagaccggtataaattgttggggcccgatccataaggacgggcgtagcgtctttctttagtgaccgttacattttgtttgtttcggggggaaatgtgcaagtagaggcgacagggcttgacaaaaatgctctgctcatgggaggtctctttcattcgcagaggttttcagcaaaagcagaccaggttcagcttcactatagtgttttccttcgattcgcacacctgaaaaaaaacatgttgattccttgaaatagtaatgtaatttattgaactgacaattttaaatacaaatgcaatcctataaataattctggatctactatcttgttgaaggtgaaacactggaataaattgggcacactcacaacatatgtgtttttacggtgtactattgttgaaactaaatataccgaaaatctgcctctgggtgaccctgagatcatctagaaaagcgttcaaatttgatcgccatattcgtttcgcagaggggcgaaacagtggatgtcgagggggaaacaccgttcagaaatcgatgtgaaaacggggcacctgtgtgcaaactcctttgccgaagatacaggcattgggatgcgctccagtcttaatggccgtgtgcgtctttttggatccaaccacaggttgtgaatcaaactgctggatctgtgaaaatcctctgattttaaggctgcatggattcctaaacttcgaacatcttccacaaggtcctaggtgttgcatagtgtcagcctggcagcccatgaagagccactcgcatcacgtacttgattatggaaagtgcaggtcagagctaggactctagcaaccatgtttccattaggatggattctccaacaaaactttcttttcccgggtcctcacaataatcaagcgaatgaactacacgcaggctttaaacgagacagtgacttccattctccttttcagccatcttccgaggcaggaatacgcgccgaagaactgattggagtgtgtggttctctgtgatagaaactcgtggtgcagccgcatcgcacacgtagaaaaaggcaaaaagggagctcaggggatgcgagagacggtgaaactgcaaga

SEQ ID NO: 1076 - DNA, 2485 bp, Toxoplasma gondii
gacaacagacgacttaaagtgacactctcatatatggaggtgtatgcacgtcccgcgggtctcccgcaagtcggcaagaaacgacaatgtccctaaacaaagcactatcactccagataggatacaggcacccaacgaagagtcatgtccatctaaaaaaaagattgcgctccatgaatgtgtcttgagagatgtagaaatccacgtggagaagccgaattagagcatggggcttgcagaagctcgtgtttctcagatgactgtgaacgtgaagaggcgagctgcgaatcgagtgcacgagttcctcctgagagtgaagcctgcgtggtaccatttgcgataccggctcagagtcttctctggatgcgcgtcgtctggagctgcgtttgaaattcagtttgtctccacagttcgcgcgtcctgggcgaagctctcgactccccggcgaatgctgcgaaggaacgccgagagacacgaggagggaggcgccgtcgaagtcactctcggacagcgaagcaagggagtcgacgccgacgacactgccctgtcgacttctgacgagtgacgagacgctgcagccatttccttgcccgaagaaggaaggtccccgatctcctggcggaaccgtcgatccttcgaatgacgtggtgagctggaccagcggatggcattcgttcgcgccctccgtcgctctgccttcttctcccctccgacttgaaggcgagtctctgaactctctctcgccttcgccatctgccctgcgctttgaagagactccagcgaggcgaatcgcctcatctcgactcttagcatcaggcggcgcggccgccgcgagggtcagaggagactctcttgaacggacgacgaactctggctgacgagacgaggaagaagaagaggaagaagaggaagaagaggacgaagaggaagaagaggaagaagcggaagaagaggaagatggctttgcgaagtagtctgaggacattcgttgtgtctgttgatttacatcaggaggtgcgtacatgctggcgagtcctccttccgtggaagccgatacgagagagacatcccgtcggtcgtggttgtcgcgcaggactggggggcctcctgtttcgtctgtccacgcgaatttggaggcttccttcgcccagagaggaggaagggcaagacaggctgcatctggggatcctggctcttccgccgcagagcgagaagaacgtggaaaccggacatctaagagagttgcggcaacgacgacccccccttgcttccgacgcaggtgaagagccgcgaggcccgcgcatgcagcgttaaacagccagacgacagcgagaggaaacagcagagcaaagggtgcacaggagcagaagagagcgacgcagagaggaagcagcgaagaaggaggcgaggagacagagacggcgtctgcggaggtgagttgccccgcgtcgtcagcctggtcgagaagaaagagaggaaagacagaaggctggagggaggcgccgagaaggaagatgtagcacccggtggacacacagcagagcgcagcttgacggaaggaggccgctgcaggtgtggacgagtgagaaggcgagccgcgcagagagggagagaagaaggccgaggggagagacagcgccggctgcgacgcaaaggaagagacgcgccgcagaacagaggcgaaggagttcgtagggagaccgaaaacgcggtcgcaggagtcgacaggaaacggaccggaggaagactcttcctggacgggagacaggccgttcaaggggagaacagagcggtcgacagcgggggtcgacggcagtgccatagtgacagagggaagcaagaaacaccgggcgggagggggaggacgcagccgtattgacgcaaaagacgcggaatgaggacaacggcgtagcaaatcagcaacggactacaggggagagaggagaaattgccgagaaacgactccgaagtgacgaggtccaggagaaaggagggagagcaggaggaacgagaagtccgacgattccgccagaacgaatgggagggacatcagatctggactgtcgcgttcgttgagcaggaactctctttctggctggtgaacgtacatctcggttccagcgtcacgcgctcgccagaccttcgggaagcgtcggtcgcgttttccatctttttcctccccgcttttgcgtgataaaatgtagcgaatgtgaagacggcttctaacaaattgcgaaaaaaagtttcgaacggcaccgcgttgccacagcatcgcattgcacctgcagaagcagtcgtgtgtctccccccttctttggggatctctcgcgctttctcgcgtgtatccgatcgaaactgtcctaccattcaatctctaaagtgaagaaacaggaagacaataccgcgacaaatgtctaaacaataccgtccactcttcagcaaacagtccgtcgaaaaagaacgacgccgcctagcgacgccacaa

SEQ ID NO: 1077 - DNA, 2432 bp, Toxoplasma gondii
tctatctcttcttcgccctcatgtccctcttgtctgcttccttctgcatgcctctaatctcctctcagtgggcctctgcgctgttctgttctgcgtttttctctccagagagatgtctcttccttctcgtctcctcttccgcacctcaaaacccagacgccggccagaggggcgctgcggtcctctctcaatctctctcttcagtcctctcgcagacgagacagctccgagcgaagtggattcttcctttggctcgactttgtcagaagcagcgaaaacttgtctccgaatccgaggcgtcggacccaacggccctccggccggactcgggcgaggccctcgactcttcgtcaacattgtcaacgcattcagtcgaatctgtacaaacctacgaatgcatctgtatgctgtattcgtcttagtcaatgcactcagaggcggagaaacacgctcatatgccgacgacacgttcacacatacacatgcatacacatgtatgtatttttatatgcatgctgatgtctgcaacggcagatgattgtctgtaggcagctcaagagaagaggagagctactcgacgcatggaggggaggcgggtcgatagagcgggcacatacgggagcagcagaaagaaaggaaaggatatgagagaagaaactggcgaggaagaagggcaccaagaaaccgttcgagagctggttaatagtgaggtccagatacacctgacgccgcgtgaagagacgggaggaaaagaatataaaaaccacaacgacggacgagtgaaaaacgcgcaaagacggcgtgaggaaagcagtgaagagaagaacgcagcttcgttgaaacgagaaaaacgacgaagacgcaaggcctcgactttcttgggccttgagagatgtgagtcttatcctcttgctatctccgcagtttctgttcgctgtccttccctctttccgcgcggtcgctctgaaaaaattgatgaccaacgagagcatttcaaaaaatccgcgactcgcccccgtccgggtcgtgttgcatcgacaaaggtcctcacgagaagcgcacaccgaaactggtgacgcaaaagccgttgagacagagtggaaagcggggaaaagatttggagaaaaaacactggagaaagagacgagaaaagcgagaagcacgcgagagtccagacacccgccacgcgacgaggtcgtttgtcgctgtcgaaaagaagactgcggagagcggcagaagcgctgaacgtgtgcgggtgagttctcttcgcctctcttgggaatcctaggctagaaccaggaatccaattctagcgcgaatcgagtgtttccgactttcaatcttttggagggcgaccgagacagcctgctcttacttgcgatgtgctgcaacagaaagcaattccttgggacgccacagacgcggtcctctctcagctgtgcccatattatacgctgcagagccctatacacggcagagcgcgacgacacagaaagacgaagaagagaaagagggatacgaggaagaaaagaggcagagagggaagaagagagagagaagaggctcttgtctttcgaggtctccgagaggagggacgagtccgaaaacgattctggcgtcttttcgccgcgactggtatacgcgtgaacgtgcacgctgagcggtgtcgagacacccgaagagacacggagacagcaagaagaaacgacgcgcagacagatcgtcctgttgtttcaaggaaagacgaacggggggacaggaggcagaaagaagcgtaatcggcgccccaaaagagacgcacttagcatgacaggaaagctggggaagaggggaggaagcatatgcggaagaagtccacggtttctgtgtcctgcttcgaggaaagtcgagagacaggaaaggagacctctctgttgagaaagcaggcttggagttgaaggtcccgcatcctctgaacgaaggagcagttgttttcggcatttcttcggactccagagcaaccaccgcagctgtctgcgttcttccacttcatgcttctcaaacacccgcgtttagggccttgcgcaatcgacggctcgacgccggtgtagaggcacccaacaaccgagatgaaaaagagagaaaacagttctcgtcttccagacggaaattgaattctttgaggcgagtggcaacagacaggaaacgcggttccgccctcggacactccttcgtctcggtacccttcggtgccggcgagagaagcgcgatttttgaggtgaagtacgcctggacctccaagtgggaagttcgttcctgtgcgttcctatcgtcggcctcgtcacgtctctccagcctccggattctccgtttctcggctttgagagagtcgctacgcctctgcaacttcgtcctctttcgtctgttcctttgacttctcttcgcgtgaagaa

SEQ ID NO: 1078 - DNA, 1960 bp, Toxoplasma gondii
tcaaactggctgtcgttctttctgttgtggcatagagcacttcgttaggtgaaatgtgaaaaaacacggcggcaagggcctctcgaggaaatctcaagctgtggcaatcaacgttcctatcagccagctctaatagaggcgaccaagcatttcggtcttcttgcggtcgaggtgaaggaatgtcttgctggaactgcccagtctatagaaacccgcgcagcgaccaggagcgacttgtggtacaattgcaggcaggagtggaagtaggatgcctttcgcggggcatgtctgcttggtcgcacgctctgtccaccagcgtctttgtactccgaaaaacaaatgcgcgaaaataccaaaaaaaggatctcttcgtgcggctcgagaggctgtaccatacccgcttttctccgttggctggctagactgcttgcgaagctttcgtcgtcagggtggggtgagatcgcgcgataaacagcgcggttagcggactctggaccgagaaggatttcaggctttcctgaggaagtcgacgagtctcgctgtttccctccggaaacgtgaactgaatagtagccatcccgagacgaggaatgaggggtggaatacaagttcatgggttccggacgaatctggtctgttgtccgcaagatgtgatggtcatctgttcgcggagaataattttcaggcgccacaccatcgtgaaggtgtggcgctgaagagcagggaagaaggccgccatcctcagtagacgggaacggagagacgcgacgaggcgcagaaagtaaagttgcagcactttcccattgatttgaaaccgctccggaagttgataagcaaggtaaagtagagtttccgccttctccgaagccatttccttgcattttgactcacgatatgtgaggcaagacgagacagactggtcgaacgcgattgtcgcgcttcaagaggcgactacgcgttcacgggcttcacacagccatggaggagagggaagtgcctggtgaagcagaaacagaagagatctcacaggttcaaaagatgtgagaaatatttgacgaaactaaaactagctgggagaggtggcaactctggactggagggaggaggggaggaaacgacttggaggccggggtggtccgacaagacagtgtgtgccaagtaacggcagtttctgaaaagaacaacagtttgctccgccactgccacgagagtccaccctacgagatttgccgtggcaacacaacaccagcacgggctatcaccaccaactgttctgtgtggagcttcagcttccaccgacaaagtgaggaaacagatccggtagccgcattgtcacccgtgattcgcatgcaaagacaagatgccactaacaggggttcaacaaggcggttgctggttcggctgtcctctgttacgcattttttggagaacgaagtggctcgaaaacaaagtttcacagagcatttcaactctgatatgaaagcaaattattcgaatttgccgggggatattggacgcgttctaacccacgactgcactatctagtagcccggatcgcgcgcccaacgctgtcaccacttctactttacggtaaccattagcatgtgttttttcttccggtccctgaacgagaaagcaactcgaaggaaagttactgagcctaagaaccttctgggatacgaacttagcagcaggagagacaagtttttgctttgcctcggaagttcctttacaaaaaggacgaacatcttttggctcagatgaggcactgccttcagcggaaccgcgataaaaatagttgttgctacacgttgagcgcactttccttccaaacatttcaactcaggaatccagtcgtgtttcctggaggcacactagacctgtagtagctttttgtctcgcgcttaatgggaaattcttccccagtggcgaattcctgtgccagtgtcagatttctgga

SEQ ID NO: 1079 - DNA, 1768 bp, Toxoplasma gondii
gctgtaaagctctacttggttttcctgacatacggctgcttccaagatccgctgaggcttttattatgtgcagaaatgcgccgaggggtgtcgaggcttggatgcgtgtcttccaacatctttatgaggttgagtgatattatattctctagtttccaccttttcgtagttccactgacattgttgtacttcgtttctctccagctgcgcaaacaacagagtgtttgttcataatgttattgcggttttggcgtgcttgtctcttttttaggtgagggaggaacttccgcataagagattcttgccctttgtctatactgaagtaaaaaccgtgcaatgacagcgaccgcgggccatatattgcttagtacgaatactggccttttttttccaagtatacgctggtcaccactaaacccagtgcactcaacatggtggttattttaagcacaatagatcttggatccaatcaatacattcttcacgatctacgccagcagattgaggccccttctgtctgaaacacacttcccttctcgccagtgacatgatctcaagtgcccgaagccatgtggcctacctattataaaaaacggggcgttacaccagaaacctgctagtgacaaatattgttagattatattacgttagcagccctcggattgccataaggccccgattatcgattgctcccaatcgagcgtacggtaccttccagaatcaactacagtgatagcaagaaactgttcagaacggttctcgcgacaagagtgtacggtgcgttgttctttcttgccttgttttttactggcaatccttggcaccctaatgtagctcgcgtgaccaccaccacccgatatcccgctaaatagtttatccaatttttgtttcagaatccgtactgccgttgcaacatggcagctcgatactatgtctgcaccagtggttcgcggtccagaactggacaactcagatcgaatcagcagagacattagagtacccaagggactgaatacgactgcagttgtgaggtgcaggcaccagcggctagagctttgtaccctgaacgcgagttgtgacagctcgcaaaacgaaggaatcgtaaggaaacctgcaaaacgcagacaacctgtttttttctgctccttggtttgagcaaagcgtggtcagggtaaccaaactaagcaactcttgaaccgcagcttatacactgctgagctatgtagagccttctaggagcagcgtggagcaagtgaaccaaggaagctgcgtgctggcgtaggacactcaactgtcctgaaacgcaacgcatgccctgcgcagccagcctaccgggctgaggcagattcaaagggtggcgccaaactcgcctgaaggaagccatctttgcctttgaatccgaacaccttattcaccgtttccctctcaaacgacgcagactgaaattttccaacgcgtgcggtgttttgctcagtcttggtgcagaaatatctgggaaaggtctctcagctgtcgagactggatttcttgcatgcacttcgccttccctcgcgctgtgggggtgaatcgcgaggggcggcgggcgagagaggcccgtcgacactggcggctctgggtaattgtgccttctccgtcggcgggattgcgtttcacacgctccgactgcctccttaacttttttcactgtgcctactgtgtctctctgcttctttggcgaggtcgatcctcccccagctggaacagcacaggaatccgaaccttgggaaaa

SEQ ID NO: 1080 - DNA, 4053 bp, Toxoplasma gondii
aatgatgttacagataccttacgtcttctgcgcgctgaaagggtcgtttgcacgaccagaagggagcccacagatagggattccatgatatcgacggcggcacaaggtacgcgttcaggacaaggatccgcaaattgggaccgtaattcccatcgcttgagtcagccgatgcggagcgcgaaactccgagagacgagtggagattgcgggaactttcagaaccggatatatttgctgagtatgcagcgactgtcgcctcactgctgcttgcgttgccgttttctcttctggcggcttccgattgtgtcttccaggcagttgggtattgaagtccctcgggatcctccccgacgaacaagttttcgtgggtgctcattccagcggggaatgaaatggcggaatagtgaacaacagagggagcctgactgacgggcgagacggttcagtgttggaaccgtcaaagcagcagatgggaaactgtttcagggggtccttactgcctgcaagaaatttgtggacagacagctgcgtacagagtcgtacaggagggtcacgatgacgaatctctcggcgtcagtgttgcagcatcacatggtgaaagacggaagcagaacttattggagcacgcagcgcatcggagaggctgatccgatggagcctctcgtaaaactcaatttctgcgcgtgtttctaccggcgagaacgaggtggaattcagacttcgaagactgccaggtgaagataatgtatcaacaacctttctaggagatcgaactccactggaacggggcatggacatctgccaactgaacgaaacctccgtgaggagacgggcaaacagcgaacgctcctaagtgtctcaaacaccagcaccgtggtatccattctttttgtccttggagggaacgtaccgctccaggccatgtctcacagctttcaatttccaaatccactgatcatgctgcccacaagactacacttgctaccgaacaaaataagcaaacagtacggttttgtgtcatcgtgaccactgtcagacttctacgatccgaacgaattgatccatacctccaatgagaagactgcgctatccggccttggttagctacacagaacgaaagacgggcacctacttgtcggcagccatcctccattttccgcaacgttctttaagatctgcaaaggaagatgcaaggaaaatgagttaaatgaactgacgacaatcactgcaggctgtgcatgcaaattccgaagggtttgctagcgcttgacgaggcgtcttaaaaagagtcaggcgtgaaatgaacgaaacccgcctgaatgctgcttgtactcaaccatgagctattacgatgccctggatctctaaaaaatccaacattcacgttttcgtctgtacccgtccattttcaccgtcttaatttatccgccagcctcaacgatcccgtgttgatcctggctcggcgcacagtagtgtgcgatccacgcagagttcatctagctgagcctaacagaaggccgacgctgcggaccccttgcttgtaattagacaggaaatgtattgctttcctctagtacccttccgtgtagtgcgtgtaggagaaggtgctgttcatgctgtctcggcacgcatttggcaagtcagttaaaaaagcgttatcttctacaagatcggggccgctgttgagccattccttcttttgaaaagccaagagcacgacaatttcgaggcgggggacaattttatgtagaagggcaggtcctcgagtccacagtgcgaaggccaatcaatgaacggcgcctaaggcccccctacgttggggtgccaatcacagtatggaaagaagtgatgtggcacgccccgggaactggaaggtggtggtatgaatgagggccattaaatagaatgattatgaaggagcttcactgctcttctggatttgttcctgcatatgaaggcacaaacgaagcacatgttttcctcttcggaacacatggtgctagccccagctgatgcagatggtgactgacatatgaaagaacagtgagtatgctattttatgtcggatctgttttcattctcacgcaaatacagacacaaggctctggctctctgaccacaactctaggaaaaatcagatgaaaccgagcacgaaactggttgctcggatggcatttcttttctgcgtgtgtcacttatgagcaacatacatcacgataataacttatgtaacatgcagagtttcggccttggtattttcaaagctcttcaatatcaagtcttttgagtgagttcggtgcaccgcctccaaggatgagaatgacgcaacatttgagagaagcgataggaaactatgccggactcccttgatggtctctctatgctcttttgttcagaaacaatctgtcacaacctgggaagttctttacgagacgtcgaattaaaaatcatcttcttccgtaataacatgaaacgaagagcacgaaaagaaaaagaccacatatagttgagcttcccagttatgtgctgtcttttccctcacttggtgggctcaacttgcatgtggacaatatcgcatacctcgtggtcctgtttacgcacccttagaaaaataatgtaaaaaaatgactcgcaatagtgacacgtatcacatcatttgccccataccaaactggctgtcctgcttattttcaactgcggtacgatagcatttgccaccctagaatggacacggccggacggtatgttctatcgccgacaagttacgctctgacaggctttcctaaaagctccatccctctgcagcatctttgttctttaacacaggactgctggcacactccacctgaggcacatagtgacaggaaccacttgtcgttcttctgtgctttagtcaattgctgttgagcaaagggcgaacccatttcgcctgtttcttttattgtctcgcgaagggagcgcaaacacggttggtccttcgagcgtctctgacgatgttacgacctcactacacaagttcttttcctaaaaacggaagccccatttggttgtggcagtcactgaatgcagccgtggtcgccgtgtcaccgtgtgcatctgagctgaacatggaagatccctccgtaccaaatagacgatgcagatgagacaccccgggggcgcgaggaagcatgacgaagggccattggctaacgtgaaaggaaaagaaagccaatttctccggcgtaacgagctaaccttgtcgaataccgaaaggttggtgagaaagatcagaaaccgcttgatgtgatgccacgtgtctccagcgcgaagtcgcgcttgtcgtctgtctcatcgaatactcgttggcccccccgaatgctgattttgttgaagaaggaataagtcaatttcttcctttagttctctagaaatcgggtatttttgcattgtttcctttctctttcggcaacggtcctttacctctcaggaggtcacgggcccgtccccgattatgcccatctggtctatgtcttcatgtggaaaccgttgcgccgctgaccgtttgcgtcggaactgcccccccctcctcactgctgttcttatttccgcaactacaaaaattgcatgagcttacccaagaaccgtctttcctcgtccccgctttgcagcgagcaatggagcagccggaccgcttctgtccatttcgtgtgccaccgtctgccggcgaagaggactccagtggctcgtatttaaaatgaaattgagcgtttatgcttttttacgggtacaagtcgaattcgcttatacaccggctacactgagctggtaatctgacgacccagcaagcagtaatctacttgatcgcacttcccgtagatgcacgggcctttgtcaaagttgtgctacgagtccgtattgtttcagggacctggaagtgcgtatgcgtgttcacgcagtgtacgatccaaaggaactgccagcatacgtcactgcctcgtgatgtttttatatgacacagcagatgacatactttttctgaaacacaacaagttcaatggtgaaagcaccaaa

SEQ ID NO: 1081 - DNA, 2388 bp, Toxoplasma gondii
cgattcaggaaatgactgagatgatcttcaagtttctgcgggcagcggggccgccgcagggagcgctggagaggccaacgggagctgggcgaggaggagagacgtcgggactgcagaactttcggcgacaacaacaccttggcaaggcactcgtctgcgtagaagctctgagggagggatgccgaagagaactggagggcgagaaattcaatgagtttcttgcggaagtgaaggcggaacagtgtcgggcggatgctgcggccgacgacagcttccggaccttttggaacttgctaaaatccagaaaaatcggcctcatcacgcacgccgaggacccacgcgtcgacctcgagccggcccagtctctgagaatctacgaagacgaatcagtgcaagagctttcgacccaaactgcgatgacggccgcgagacccttagatccgcatgacgttgatgacttactcgatctcgtcgagtagaaaacgaacgattgcttcagagaaaaatgccgtcaggcggtctttgacaaaacgggagtggttgctcttggctaacatctgcgggcagttttcgattttccgtctccatgtacgtatatttgcatataaatatgcagatgtacatgagtcgatatatctcgctagctataaatatatctccatgtatttatacatgtatgtgtatgaaacatacatctatgttatctatatctatgtacataagtgtatgaggtgttgcgcagatgcgagagggctggtcggaaagtcctaaatcttttcaaggcgtgcggaactcgttttgtttgcgttttctgtttcaacaatgttgagcagtcaaatattcttacgaggacaggccggtatggtgattgcaccgcgtgaaatagcggtgaactaaaaaaatggggagatttgctgcccccacgaagccacgcacagaaaatgaagggaagggcaaaggcttacatgagcacgcgtacacatctgcctacttcacttctcactttgacgttgattagatctcatcacacatgccttctagggagttcgcgataaatgcacgcaacggttttcacgatgttatatcgggtagtgtagtgtgtcacacctaatactaggttgaattcggagttacattcaatgactacggcccagcacgcagaagcacggatacgcggcattgctgcatggatattgtgtttgttcactgattgtacgatcggcagatacaggcacttggggagggggccatagatgtatacgcacggcaaatgcctacacaacatattgtacacatgagtggtggcaaaatttcaagggaaccttgccactggccgaatatgaatcttcttgtcgcggatttagcggatttgagctgtaccactgggaacataatatcgattgtttaactctaagctgacctgcgttttcgtttgaccacgggcggttcctagcagtagctacgtgttgcatgggactgctctgctcagttgatgatagccaggctgtggagtggtgcagacgctttctaatctgcggcaactgcagagttaaataccttgtgaagctgcatgaacaactgagggggggaaattgcttttatctgacgggtgatacgccactgttaacgttgagctctcccccaagaaccagttagtgtagcactgcgcagttcacgcggaccggcctttcattgcttgtgtgcaccatctttccgaaacgagggtaagaaacaaatgtggcaactgccttttgcctgccttcggtacgaactcgagagtatccatgtttacattcacagcacactttactaccggggtggtaccacccgtctgcagaccctcctctgtccaccgacccactggagggaaaaccagagcagcggcaacgcgcctccctcttctagccgacatgcagtctcccatcacggtgagacacgggatattttcagcgactcaactgctactgcttgtgacaaaacgtcagtgcgcagcggggattcgtccttgttgtcgtgtctgcttcgcaacgatttttgcagaagcggaagagagcactctgttgcccgaataccgatgcaaagctggctcatcggcgtacgtgcttttcctgtgagggcatagagtctgctgggagtgaatgcaaacgtgtttactgggagccggcagcaccgttttcatgagtgtcttgtaaacatttctgtctggttcggtttcctgagacatgcacacctctcagtcccgagcgttgacggttttcctctgtggacggtgccgctccgacgtgcatgcgttcatgtgcctgtgagtcgggtgtacacacaccagtcgatttggtcaatcgccacccaggcgacacaccatttcttttttccttcgctgagacatca

SEQ ID NO: 1082 - DNA, 2232 bp, Toxoplasma gondii
ctgcgctccggagtgtcagtgtgcaaagcaaaggtcctcaacttgaactgaggaggcaggcactgccaggcgttcggctacagctccttgaatgtatcctatctgttggggcaacgaagaactgtcgcacatttttcagcagtggagttgatgtgccggacagaagactgctctcagcgttcgtaactccgtcaggtccgtgatgctcactggcgtccagcgtcgcgaagttttcaggggaatatccctttcactggaaacgcaactcccttcttcggagaatacataggcctcactcagagtttgcatgaattcttgttgaaaaaagacttgcccggatccctagtatgcagcacccgcagccttggacttggtgccgatatccagaaagcgcggtggttgatgtgaacatgcggctgagaagcaagttcggcaaagtctccctttagctgttggagcaccttcgcgaaccgagttcccagtttctagaatccgttacccaaaaagtggagcctcatatgtttccgcgaaaaacaaatcaacggatcatacgttccacgttagaacgaaatccgagatcaggaaatacggcgcctgcaagggacgaacggggaaaacagcgctttgccaggtggcgtgagatgcactcttatttcgcgcaaactttcgaagcttcagttacagtctgtgtgtggccaaagcggtcgaggttcagtatgtttccccttgtgagaaacacgggaagaagcactgaacatccctcggaacgccgatccagtgaacgcgaatcgctggatgcgaaggaaaccgtgttcgtcccctgaaacagctccgttttcggcttgtgtttttcctaaaacatccctctgaagaaacaactaagctcccgcattgtggcgccgcgaaagcgacagcttgccggcagaagttactgcgagagttctgcggtgggcagaaaaggtgacaataggagcttgttcaagaaacacagtctttgtggccgctaaaacgtatgcatgagaagaaataaacctgtttgacaagactttcgagactctttgtgagcgcgaatgcagatgttgaagacttatcgcgcgatgtgcttcaagctgcagagcacagctcaaccttgaggctgttctgactcgtgcggcgccgaccaccggcaagcgctgagaacacagccaatctgtaggcagatagatcgattttctgttttgattccccgtggtaacacagtcaaggcacagcggcaggagtcacctcaatccgtttctttcaggcaagcggtacaaaaggcgtgaaactaaattctttttttttggggggggggtgcctgactagtccgacggcagcgccgacggtgagaggcgacatcgatgctactttgtctctttcagaagatttcttgagcgcagcgcaagggaagacaactggttcaaaaggactagcacagtttctgattcccgacggggaaacgggtggactgcggcttctgaacgcgaaagacaaaatcgacgaagaagcgaaacggtctgctcttccgacgatggggacagcggtgtgctgtgtgaagtgatgcacacagactccaggagtgctatcgtttccctgaaagtgaaaggttctttctcgttcagaagggtggaaaccacagcagacaggaagcgtatagttcggccgaaatgctgacacatggatgcggctcgagttaaaggcgaacagtcgagcaagcccgaaaaatgacacataaacgcgtttacttacctatctagacctactcatatctgtaatgatgtggtgtttgcagattcaaagagaaggtttcatctcaaaaagatggattctaccgttcttttcatgcgtgtagggcatgaaggtcgtggtttctcgtcgctttgcctgttcaggaaagagcgtccgtctccttatgtggaactacttttcgcacctgtaaacgctgtttttccaacgaaaaccggcttctagcattctaaaacaccactacgacaattttcctttctggtcgctgcccttttttgagtctcgtcgtcggctgttgaggtgttctcttcttttcctggccgcgttcagcgggtgtcttcttgagttttgcgaagagtgctttctcagcagagtgacctgaattggattttttttctcggcacttcagttgtctagccaactgtttctcgttgtaacaaacgcgacggacgggctgttttcgcttga

SEQ ID NO: 1083 - DNA, 2956 bp, Toxoplasma gondii
gctctatgtctcgctgtttttacaatatgattttcttcagaaaactacgtgagcgccccccctggccggcgatcttgacagacggcccaagttcttcacgtcaggagatggtcgcaaatttgaggagtgcgagagacgtccaaagagctctgaaagaacgaagagagaagaatcgtcagcctcactcgctggtgatgaatctaggataaactgccctttcgcgcccctctctcacttgcatgctcgttcctcgtggtttttctcgctttctctgctcttccccgtctccctctactcgtttctccgctgtcgactcttttttctgtttcgttttttcaaactcttcgcggagatcgttcgtctcaagctggacgatttccgcgcttgcgtggaaagcgcgcgagcaccgccggacgcacactcgtatcattcgcgtctatggctgttccgcgggctctggcgacctcatccaggagtctgccttgtcgcttgcctcagaaaacgttctcaaaaggaatttcaagcaacagaagctccaccttttttatttcacattccaccaaattcgagagacactttacgcacgaaacacgactcattttttcaaaaaaggagttgcccactcctgctaaaagaaaaacaactgtgcaactcccatcttcgtaatatgcgtcgtcgaggctttttcctctccctcccccctctcttttctttgcctccgtagcgatacctactaactctatgctggctaaatctcgacccccaaatccccacatacccatataatatatatatatatatatgtatagtgtatatttatatatttatatatatcgtatgtgtttacaaatacgtatagaacatcaatgtaaatacatatacaggacgaagatccgtcttggatttaagagcacaggatgaatgaatccagagtccccaattggtggtgctctgcaagcattttctccgtttcgtcgtgttctctcgaaacgactgtcgcaccctaggcacccttttcttgtctttttttccaaagttgaaatcctttttcgatccgtcttcgaaccctctgacgttgcctccggccagagggtgggagctgtccgcgaagcaaacgccatgtacgcactgattttctattcatgaggcggaactctccggcccccagagcctcgctctttttcatttctagagtgtttagagagcctcgctctttttcatttctagagtatttagaggactgggtcgaacacggagttgtctccttgtgccactgcacagagaaccactctccaccgggtccgatttcaaatgctgagaggcgcggaaacaaccacaaacacacacacacacaactacttccaaaaatcataaagtcattgacagatctgtgcgtaggcacgtacatacgcatgcaaatatattcatgtattcacctctatagatcttcctatctcgttatacagtcagagatgtacacagcacaaattcatcatcgtgcgtgatgctacaagttatatatatatatatatatatgcacataggcaatacgtggtttcatattgctatgtaagttgaacctacatcacagacagggcctgtgttggaaaggaaatccaggaaagtatctctctccaaacaagtgtatggatttacgaggaacatgcaactggatctgaatgcggagagcctctacttgatttgtctatgggttgggctttttaaaacctttgtgtgcacagatgcatcagcatattcgccataaatccgctcaattgtttgagagagatactttcctggatttcctttccaacacaggccctgtctgtgatgtgggttcaacttacatagcaatatgaaaccacgtattactcatgtatgtatgtatgtatatatatatatatataacacttgtagcatcacgcacgatgatgaatttgttctttgtacatcttggactttttatacttatataagtatagaggtaaagaaatatgcatatgcggatgtataaaaatgacattgtgtactttctaatcgattgcatttgggaagactgaggcttgtgtcgttcgttgcgtcggacagagcagggtgtttttcagtcccccccctggggggtcttgtcgcgcccgcgcatgcgcacagctgaaaagatgcctgccgtctccctgcgagttccttctcctttgtgacgaccgttttcgagagaagaaatcatttgaagcgagacaaagtttcggcgaagtttttttcctgcgactttcccgtcagcgtgcttgtccgaatccgggtgtacctacaccgcacacctgcctccttttctctgtggcggaaaatcgaggggggcgagagatgctcttttctccgttgttttctcgagttttcgctgaacccgctttctgttctgtttgtcttcaatttcccttcaaaactcacgtatttccaccaacggtttcgtcgttctctcgcgttttcccccgaagacccgcctgcacacggtccgcggtgtcctgcagagactcaccatgtctgcgcggcggtaaacgccacactggtatttctctctgcagcactggcgtctgcggtagagagtttttttgagaggaagaccgcgttctgttctccttttcgtctttggagacatccccggagacactcgagcctgctaggcactccgcagccttccctgacaacggcgtccgcgcttttcgcgcggtggccgaggcttttaaatgcgttgacatttcgaagagccccctccccactctgttgacggagaaaaacatcattttgagtcttcgctctgggttcctcgcctccttcccgttctctgaaggtcgttttctctgtcgggaggagagacgctttagccggccgagaggaaacactcggttttctttcgtttctctccttctgcttctgtcgaaaccaacaaagacagcgaagcgagaca

SEQ ID NO: 1084 - DNA, 3680 bp, Toxoplasma gondii
gtgagtgcctacgtttgttcacctgtgtatatccgtagtcaaactgcctggagtacaacgccgctgggcgctgggggtatgtcatttaaacccgtgtgtttttctggcctactctagaagttctgtcttgcctccgggtcattttttgtcaatttcgggagttcggagactttcagtttccttcctcccttgtcaccgcagtgaagacgcctgcttacaaaggcacatcgttgttataacgtccgtttcggccttcactctgttgacggggaagtagtttgtcaaaaatattccgccttcctcatcgcgtttgcatgtttgttcatcgtatcatggcgtgttctcccttcctcggtaccatcgttgtcaggacttcgtcgagtttcaaacagccccagggcgcacacatagatcctcaccgcgttgcttaagccaccgatttctatcacagcacgacaacagagatccgacctgacttcacatgtatcctaggatcataacgaacacagctggcttttcttgcctccttactaactggggactgcaactcaatgagactgacacgcgatttagagatgatttattggcggcgacggcaacgcagcaacacaacggtttttcacgcagagatgtaccttcttggaaacagaaattccctttggcatccgcaaactagctaaaaatcagctgcgactgtgcgcctgttccttccgcacgacttttctctgcatgtgcatagaagacctcgacaaacgagcgcgaaccactcgcgtttagcacaaagactccgaagacacgaaacggccttcccggacttcttgcgtgccaccgatggtcacccgaaaaaggaaggaagcactatggatcgacgccgttcgctagtttcatttcacacttcacaccggtcggaagatcttcgcgtgttttgtgtcacctgcacgaaaagttccagtcgatcagaaaggaaagtggtggcctattctggacgacaggcgaaaagataccgatttatcctcagtcgggactcgtagatccatctcgcgtgaatgattcggtcaggatcgcacacgccgtggtctttcctagttaccttatgctatgacatccgctgagcgagagcgcagcgctcggaaacagagggaatgcctatttgacgtaaataagactccgccagagcgacaacagagcgcgacactataggcgtgcgatggcgggagaataaaggccaaaaggtgaaaaggactcagagaagaggatgacacggaggagaggtgctcactcacgctcagacaagcactaagtggtgagtgcgaaaccttactccactgccttttctcaaatggttgggcggaagcggaaccgggacccttcagcgaggaggcagcgtccaggtattagttgtgtcaacctatgcagctactgtgggactcggagtcccagtttcagttacggagctttttgagtacaccgtgcaccgttgcattcaggaccacgacttttaatcggttggtacagaatatcccgattaactgggctagaagataccgggtaaaccgcgacccagaattctatggttgaaatcataagtgaacaggtgaatggcgctaacaaatgttagaattccatctgacggttagataagaacgtccccaactgctcgcgaagtaggactgtgccctgtgacaggtgtatacggtgggggacggaagtttgatgattaggaaaggaagcaggactgcatccagtggtattctgtctcttccaatcgatttaaattcgcgagtacggcagcccctaccactgaggtgggcaacttgagtgaacgattccatcttttacccacggaattcgaatcataagacacaacttccacatcaactctaaaagccaccacctggtcacgagaaaggacacagagttccacgtttccagttttcgtttgcttacgccttgccggctttccctcttttgtctgttgctttgtcgaaccgacaacagggtcggaagccaatcgtcccgcgcttgtacgcgtcgatttcttttttttccgtgttccactctcttttttgtgtcctggtgttgccaagcagccaactgccatttttttagaggctgtttactcggtttgaattgtggacgcatttgttgagtccctgttcgcgttttgtgaacctttgcattgaagccttacaggcttgagttcagatctcagggaagtttgagtaaacataccgcctttggcaagatcataagggagaacattcgccggtttatttcggcggatttgccttgttctcgccatatctaacatatccgcgagcggcgtcggttggagtcacagcgcgcccgctggctgaaccgtgacttgtttctgtcttgtctttccgtgcttcccaagtttcttcgcatgccggaacactggcacacacctttcttcaggtctgagttaaacgctccattttttacgagagatgtgcattctctcgccgttgctgcggcctagttggtgactttcccatccgagacaaggatcgcaagctgcgcgcagaagcgacgatcacggagcacacatcgaaaccttgcacattttataaaactgacgaaactgcggttgacgtgacggcagcgcgacgcttttcggacgccagttccatctcatttgctgtcttcccttctggaccggatttgcagcgcgaaggaaaccttttgagtgtgcaacttctcgaacccgctgcttcaactcacgcgttccttgtgccaatgcagtgagcatctcgaaaaggagcgaaaaacagtgaacggttttcacgggaagtcgctggctgtgttgaacgcgcggggctgccgtgccttggatgtcatcgcgtcctttcgtttcttcagatttttttcatttgtgcctgtgttttcgggcgcgcggcatgcctgcaacctgcgaactccgcggtctcaaaatatccgcaacttcttccgcacgtccttcgccgttttctgaccctgtcgatttctgtgagtttgtgtgactctcgctctcggatccagtcgaatcctgctgtggtttatctggcgtcgttctttttctccccagtctcgattctcgtcccgactgctcctttctcctgctccgaacgccgtttcttttctcctcctccccctctctcgtctcctctcaggctctcttctcttcctcatatatttcccctttcctaactccctgttgtttctttgtgtcaacaagctccaggagacgactgtcactccggtccgctgccctgtctacctgcgcccaagctaacgcctcgctctagatgtctcactctgccgtcgttttgtctcgctcttgccgtccgtgcacctctgcccacaaggaaaagctccacatctcaattggtaatgcaatgatgcaactttagattcgtgcgagcgctcatctcgttctcgagaagtcctacacgaaccggggaccgcaggttcgggtcgagtcgcaaaagaaacctgctgcactctgggcctctcgcgacacccgctcgcagtttattcacggcgtcaacggggtaatttctactccgcatcctttcgccctctaccttttctgtgcctctcttcttcgctggcttccaccggcctgcgaggtctctctccactgcggctgtcgcgttttgagagtttttttgcctcaa

SEQ ID NO: 1085 - DNA, 3149 bp, Toxoplasma gondii
gtgctgccatccacagtggagaaaatggcggtgaacatgcttaaccattagtaagcgaaacgtgccacgcgaggctttcatgcgtccagcagctcgcctgtttctcgtcacgttttctgagcccgataaagtggaggaaagatcggctagagttgcagagtatccttctgagcgagaggggaatgagggaaactcgccaggttggttgagaacagcgcgttgtaatgaaaccccggagacccactggatgctaggttttccctggtacgagcgtcgctgaagtgcttgcatttttgtggatgacgagaggttccctggggaagtaagggtgcgacgagaaacgaaacccgcaagaagggcttcgtagaaaggcctacaaagcattgatttgtgtttgatgtcggtcgcattgtagggcgttttatgcctctgacttctggaaagaggggaatagtgccagtgggtcgataccattctccgtgtttacgtggaatctggcaaactggcttgggtggtgcatcgttgttttctgtccattcggtatgtgcccttcagtggaatagaatgggatggcccatctgccacaggctacgccgcacgacgcctggagaagtactgcgaagaaataccccgtggagaatcgaatttgaagtgtggatggtagaccgtggtctggtgactggtgtacactgccactttttccggagcagaaaaggttcctaaccccggtggaggatgaatggggctctgagccgagtacaagaagaggcttggacgtggctacctgctcttttcaagaaacaaaacctatcgtgtttgatggtacgcattcgttggtatcctcgaatcactcttggcaattcgggtggaaaaattacctcgtcgtcgcacatttcggtcacactcgggagcggaaaaaacagacagtggcgcttctccgaagttcccctggagaacagtgaagacgccctcaatgagaagggtatatttctttcttctgtgactacttccgtactcgggtttcattggaattggattaaacacagacaatgtcaatatttctgtttttcacgtacgctgctgatgaaacaacagctaatggagtctgaatcggtgtatttgtgggccgcatctcccacctacgagagcagacctcagtatctcacgctttcgagaacttacttttctcgcattaaagcaacaggagtgtcaacgttagtcactactgctgttgaactcatagtgctgcgatgatgcagctcgtgacaaactacagcggccacggtgttcacagatggcccatccattacacgccgttaaagaaactgcaatccttgctgttttctacgaaagagcagcctgacgaacgcgctcacgaacatgagaaagaatagcactgtagaaagagcatggtctggccgctggcgctacatcatgtctctcggctccttaagtgtcccaggtcatacatccgagtgataaacaactttatgacttatgtctggtggcatccaccacaacattcggtaacactacataccagcagattcctggcctgctcacaggtggtaccaaacccgtggcagtggggacgcccgcaacgcctgtggccgccgcaccatacacgtcgatgaaatccgtaaaagcagtctgatcccctcgaactgcagtgacttgactctgacaaaaccggtgaattactcggacgaggcgtagaggcgctctttcctcccgtactttcggcctcccgtaccattccgagggtggcttcgacgtcagagtttggcaaacgtacatgaacggtggttcgttgttttctatggaaagcctttaaagcagcagaggcccgtataattctcggacagaatgcagatagaatggtcgcatgttcttgtgcataccaccgcagcagggccagcgccgactgcatcctgtcaacgccagcatgcaggtttgcggatgtacctttgagtaaacacgaatgaatgcaaagcagagaactggggtaaaccgtcagcgacgagaagcaccacggtgtctctacttgtccctagcgtcgctgatctaaattaaaccttctgcagccgcttttgtattggttggagattgaggagaagcggaagcctgttgccaatgtctttaataaatgacaagccacttgagcagcacgcggcatggcagagagtcgtgagaatcttcagacaagaggacttcgtggtgttccatatctgagcgccggttttcataagcaacaacacttccagtgtgataccccgtccacacagtcacgaaaaatccccgctgccaacaccgctggcgggctggcaaacatgttttgtattgagggaagacggctctcagcgttggccactgttgagaggtatctcggccaagcgaactgcagttgtatggcgcttacggagtaaagcactttttcggagacaatgtcgatgctaaggcacgcggcacttgcgagtgacatcttggagttaaggttccgcaccatgtatcctctcgagggtcagttgtgtgcagcgggcaacccccggtttgcgacgagttcccctcatcacgcagggaggccggcgcttgcgcttcagaacggccactggacgcgggacaggcagatatgtgggccatgcaatttctgtttcctgggcggaattcatgttggtcgttgtttggaacattttttttcagctgccgtggaggcccttggcgcaaaaactcttccgcatttttttcggctggggcgaggttgtggagatttcttggcaccaactgtttcttctctccgtttctgctttcccacggcagttcgagagatttgtcgcaggcctctcctgtacatataatcctgcggcattaagaaacacgcgtcggtgacgtgtacatagttgtgacagagtgtctgtttcccgtttcgtacaagtagcattgtggtttccgcgcgtcctctgcgtctctctgtcaaccgcaaacgagcgctttcctttttgtctatcccaggccaggtatttgcaggcaatcgtcaccacctcgcaaccctgtttaacgattttgcttcctgctgtgaggacagggagcctgactccagcctgtttaacggttccgcactcgattcgaagtccctcagttcagcgccaaaa

SEQ ID NO: 1086 - DNA, 1797 bp, Toxoplasma gondii
ttgtgcagatcgatcgcctcctcttgcccagaggcttcgacttctcgtgcggccttccgccgcctcgtcgcgccctgtcggcttgcggctacgtcgctgccgcttcggccgtcggcacaggtcgcaggcatgttctccggtcgacgcggcgagagcgctctgcaggagtcgcacagagcaagtgactccggggacgaacggagttgcgcagttcctgcaggcgctccacttgagctcagagtgcaatcggagagaatgtttgcgactgatcgccgtcgcgctacgcatcaacgcgcgagacaaggcgagcgagagaaagacattcgaaacgcttccctgcaccaggaagttcacctggtggtgcaccgcgttaggacgcggaaccggtgaactaggtccaaccgagagaggagcaccagaagagagagaagacgacgatgaagaggaggagagagaagacgacgacgaagaggagagggaagacgacgatgaagaggagagagaagacgacgatgaagaggaagaagaagacgacgatgaagaggaagaagaagacgacgacgaagaggagagagaagacgacgatgaagaagaggagagagaagacgacgatgaagaagaggagagagaagaagaagagaaaggagaagacgaagaagaaaaatgtgtgtgatattggagagttcctgcgtcgtgtagatgtgcgcctggacgcccgacagcgacgcgggagaaaggagcggagaacagaaacgccatcgttggcaaaggcgaggacggagaaaaaagagtctgtttctcccttcctgggtgtctttgaggaaagggagtgtagatcagaccgagaaaaggtcgtccgcctctgtgagatggagtggagaaaccgcatccgaaaaacaaagcctttcaaaggggacggaaacccgacaaggcatctgcgggcacccgttcgaaaagctgcgaccgagacagctcgttgaggagtacatacacctgagaagcaccgccagagggggaaagccttcgtctccactcaacgcgctgcattttcttctgtttctgcctttcggcgccgtggtctggagcgacgacgaagttctcttctatgtctccgttgacgctgaggcagaacctcccgaagccgttggaaggaggagatgaacgcgagcatgaacgaggaagagaaaagtctgcgagaaagagattttctccactttcaaataggagagtcggaatttgaaaaggtagagaaaccgctcgcgtgcagcgtctctcacttcctgggtcgtcgggaaaccgacactgcatgcgcgcgtttgcgctggaatcaagaacctccgcgagacaccggcgaggcatttttctttccgtcttttgcagctgaagcgttcgcttccggtgccatctttctcggtgtttgtgtctccgtggctgggagttgagagaaaactcaacagaaggagccagcaggcgcggagtctcccggaggagacagcagggcgatgtgacgagagaagaagccgagagaacgggagagacgaagtatgacggagaggaccagaaagaaaggagagaagaaaaaagtcatggagaagcagagagtgactctcatcgagctcgaatttctcttgagtccagaggcctgtcgaaggaaagtggatcttctctctgctgcctcggtcgcgtcgagttcgacagacgcgcttgttgagagatctctctgaaagagtctccgttgtgaggaagccaacagcgcgtctcagccttcgcggcgaaacctgttccctctggaagaga

SEQ ID NO: 1087 - DNA, 1487 bp, Toxoplasma gondii
gtctactgtggaacgcgcagaggaaagcctttgagaaaacctatccacaccaagcgtgcaaggaagtcgaacaaactcactgaatgtttagtcgtatcactgtagttttcgttcgcacgtcacggcgcacgtgagtgtgtattggtatctatagctcataaaatcaatgaggaactcaagccgatattgttctgcgccgattaacacaattggcccttgctgctgtccatgtgactcctcggaaatagtataggtcgtaatgagtcgtatatctttaccacacgccagctcttctggtgatggacaatctagtgcattccacggagagaggcagacggtcacgggtgagtggctaccaaacggttcgaactaaagtgattgctgtggtacacgggagttggggtggtcctgtggcctacttgctgcggcgtcgtgtgagttcgaaagaaccgctgggagtttggtttggttcgatgcattctcttcggccaagcaacaccatcgtgtgggctgccagctaagtaaggcacttgaggagcccaggcaggaacacgtttaacaatgataattccattactgaggctgcctatgtcctacaccctctggtatctgttgacgaggacggtcaccggcgttcaggtgaaggtgataccatttattccgagcctgaacaactgcttcgctgaaacaagcgttgagtccgacggtagctaagttctcacccaacctggatgtcgaaataacccataactaataatccttgtccagatatttggccctcacagttcacgtaaccccccgtgtaagaacagcctcgcttgatcataggtaacggagaggatcagcagtcgcgaattgaaagcttgcgtgcgacgtgaatgttatagttccaatcgggggaatcgttatctgctccagcacccctcagtgagctctccattgtcgctctgtcatccaagctaaaagtatactgggcctcacccccacccttctcttcgcggtgatgattggtgcagtcaggtgcccgatagcgaaaggtacacgtcctagctttttttggttgccttcggtgagtctaaattgatcacgttaacagtaggcaaagatggcagcaaaagattccgttgccgtgtcctgatcttccttaatgggcttgaaccaacggcgccgtctcaataatgacgtgattaacgtaaaggatgaagccgctgtccgtttgtctgtgcaaacggctgccattatctttacagtctggaagtgctgcaaatcgacacgttttatgtccacaggtgtccaccggtttcggtgcaaaggttcagggtatattttgttccatttttcccgaatattgtgtgttcttgagcaaaggttctcatactgtttcgctctctggaaaagcgttgcgtcgcctccatccacagaacacttcatgcaaaaagagcagtgtcgtgcaaccacttggtcataacaaacgacgacaacgaaga

SEQ ID NO: 1088 - DNA, 1835 bp, Toxoplasma gondii
gcacatgcgccatataaagcctgttgggctagaacgagatacacaaagagactcctcagcgcgcacactgttgcttccgtagcgtgcaatactctgtcgtagagcgctcgcggtcctcttaaggtctccctcctcttcgacttttccgtccatttcggttgctgcagacacttcctcgcgtgcgtttctctcgttttctttcacagccacgccggcgtctgcggtcgagagttcgggcattttcgctgcgcgtgagaaaaggggaaacgcaaatgagaacggaagacaaccctggtcagcagcagatggctttgaggactgagacttcgtcgcgaagcagagatctgagagtgcgaggccgacaaaaacaagaacttccgggaaggaattaacgtctggtctgcaagcacaacaagtacacaagagaggaaaccagggaacgaggcgtcgatgagtgtaagacacaacattgaaacgaaaaagcagaccacgatgaaaggagacgggtattccataaacttcgatgcagcatatgtagaaaaagggaacgtgtcgaacgagaagttgactttgtgacgaacaggtgatgatgttgcgtgttcaacagggcgttcgttccactctggaaatcgcaccttgaaatgtccaccgtactcgtgggggtagctgggagaagcagcaaatgaggagtaacgggtggcactaaggaatatgggaatgtgcagaaacgcagtcgcaaaatcttctcgtatacgtgccaaaagagctgtttttgtactcttgagactgggggctaaaggcacacagttcttgtcgagatccgaatgcacggatgtcgttagagaagaaccgcgagagagacgatttggtgtggcaggaaacgtcttactttcaggagccgaagagcaactgtggaatgcgtttctctcaagagtggtggaccgcttgtccgtactcgtgtttttcttagggatcgacggagtatctaggctcagacggaaagagtatactttaaccgcggtttctacacaagtcactcaggcggttttcccgctctctccagtgtgtcgtgttctcggggtttccgcgtttaaaaaaatgcgtgttgctgatttcgttgccgtccttgttgctccttttcttgtgttacgcttgacatgcacgcgcgtatttacatcagcgttggccgggttttcgcgaccggtgagtctcgccccaccgcattccttgcgaaaaatattcgttctgttccatttccttttccgcgcctggaactctctctccaatgtgacgttgaacgcgaaccgcctcttggagagacagcgcagcaaacccgcaaaaaggacgtgcgtgtgtgttcgtgtgtcaaggttggagaaagcttttcctgcactgcaattgcgtaggattctgtccgtctccgcaactttgcccaacgcgtcccgcccggaaatgccagcatcacccagggtggtgacccaccaaaaaatccggagaatatgcgtgtccgcacagactcagttgcgacattcacgcaccctgttagcttatggggcggaagtcagagatgacatcgggtgttgcgaaaagcagtgcgcatcggggccgcttgtttaatggttggtgaaggtattcttcttctgggttttccattttttcctttccattgtctcgtgtttgaacgcaccggtttcacggtcgcctctcctcggtcaagtgaacctccaagcaactctgttgccttcgtgaagaatcgagacacgtgcgtggcgcgtctcgcagctcccacagactcgccgctttccgggtttctctgtacgctaaaaagcacaaaa

SEQ ID NO: 1089 - DNA, 1778 bp, Toxoplasma gondii
gactttctttcacgttatgttcatgtcataggtttgaggctcgataccaacgcgacccgaatttcgtcatgaagagcgagtgacggcgctccttgggcgttgtgccttcatttcgagaagtcttcacaggtgtggattcgcgttaattgagtgtaacgtcgctacggggacagctgctacgacgacagtcgcacgccttcctggacaggttgcgcattttgaaggtgcacactccacagcgacttggaccagaaaattggtaaagggaacccatgaaccggtggaagcgttgaggcggagcccggtcttctgcgtggcagtttttgccgccaggacgtttctcttttctctaggggaaattatctataccctcccctggaagcgcgactgccactcgctgatcgcagactctcgctaatgcccggtttttgcgcaccaggaacagtgtcatccatttccagtgtcggccgtgcgagacatattcgccgttgctccgtccctccgttacgggtgcttttttttgtgaagagaatcttttccagtgccagcccagattttcggtgccgcacgacctgctttgtggcagtaggaatccgaagtcggcatgttccgtcgtgtgtgggcagattctgcgcgccaccgcattcttcgtttgtcgtctgtcttctattcttgcatgttggactattcctcctgggggaagtcgtacgttctgcttagcccctctgtcacccctgcagtctccactgatttcggcgcaccacgccacatctccgagttaaactcttctcagagttgtttcacacgactgtgctctcgagcgttgcattgaggtgcataagcgaacagatgcagaaggtatgaacgctggtcttcgtgaaagcagccttccccaatcgtgcatcctaaacggagctgcaaatactgttcgcggggccgtcttctacctcttcaaaagtaacacggcgactcctagctttttagaagaaagactgcggtgttgttgagcgcaacacacgaagccgtgtccagcgtgtcttccagcaggtatgatgatgcatctttttttgggtcaggaactttcagatgtgcaacagcactgggcgtacgaagagtgccccggactgtccacagagggaccgcagcctcttgttttgcagcttttgtacagcatcccttacgtgcgtgaggagtacgtgagccagtgtaactcccgcgaggccacaccgtgtgcgtgcttccgcttaacgcggagttccaaacatataccatctcttcatccacttttgccgcgtgcctcagtagagccacgtccacaacggacaacccgatggccgtgagcgacaccgtttctgctcagccccgaaagtccgcacacaaccttcatacgaatttagcaagatcttctcggcttttgtcctttaggtgtcgagtattgaatcacgtagtctgacccccagagtgatctgcacgaagttacacacgcggaggaaatcgcacagagataagctttttcatgcaacggctgtctcctttaacaggtggacggggggcctgcagagagggagcagcagacacaattacactacgtcgtgtactgggactgggtggcaggggcaggacagtgtgacagggaaaaccgcgcacacagacgtcgcaaacgagaacttttttgaaggcaacgccacgccaggtaccaccccgtgtttcagtaacacagtggggatcacatccgtcacatcagagcgtgggatcgcttgcgcatgccactgggacga

SEQ ID NO: 1090 - DNA, 2274 bp, Toxoplasma gondii
aaatatctgtttctgtgggatcgttcatcactgcgtgctgatgcagtcgtgcagactacactttttaggacagcgtatgaaaagaaaacacttggagggaacgtgagacaagggcgagtgcgtcgggtagtggaagagagttcacttgcgcagattcctgagcaaaaagaggaagcaggtgaagagaaaaacatcgatattttcacagtctctgtaccatcattctaggtggcttgcaaaaactgcacgtgcggggggtaacgcggtgacgtaaattttcaccacatgtatttctcatgccgtcgaccctaaaagttcaacggaacaaaatggtcgggtgtgcaacttgaaagagagaccagaagatcattggtgtctcacatctcctcctttttgatgtggaaaatctgtggatggctttatggttgtgaatagaagcggcggatgcaagtgattttctgggggtgctcgcgagccaacgtagtgcctcagaattagtcttgagcgcttgggagttcccgttcggcgaggcgtgactgcgtggcttctttcgattcttttgaaaatctgaaatgctcatttggcacgaggtacctgcgctcccaacggttcggcgcaggttgtcgcccattccccaccttgcggagtcataatgaagttcttcagaaaataaaggatgcatatcatgtgttgttgtgctatcatttttaaagaaacagcactgtagatatactaacgcttgcggccaagagaacgtatgactctcgcaaaaggttttcttttttaaagaaagcagaccgacgttggaagaggttcggatccggcaatgtcttgcaaacctgccggatttcaacgatttctttggaaaagagaagtgaaacaagaacagaaagcggattgccgactaggattccgatcttgacgctgctgattccaaacacagccgggtaccgaaccaactcacgctgaggaaccacattcacgccgctactgtttccggcaagtttccttctacggtgtgaaaagttgttcatgcagcataaacgaatcggccagcttccatccgtcaccttcacgagttgctggcttgctgggtgaggaagtgctccagtcacgaaacacgaaccgccgaagaactaccagtattttcatgtttacttggaagccgtaggcactaacaatgccgctcatagtgcgctgaatcacgtcttaactttacgctggagtttttttaatgtttactgactagagagcatggaaacaaaaataatctattgtttagctcctttcattgaaatcaagagagctaaaagaaaggggaataccagaggtaccatccaacggaatgaaagcgcagacctggcaaaatcaatgtgttcgcacgctgtcacgaagatctgcatgtatttttgtccattaaacaacccgcttcgataggagtgtatgcataacatgcatgagctcgtctgtcccgtctgttacgatactttggggggctctagcttaagtgctgaagcttatcgctaggaacgtgttttcaccgctggcaacactgtaggaagtgaggttggcgtttcaggagtttcaagagattcttgtctttcttttcaacatgtaacagagttccactgattctccattgtaattcttggtctggttcaggcacccggttgatgtaggctgcagcgattatcgctttttgacgttctgttgtgctcgaaccgtcagtcttccagcaggcagttacttcataccaatgtgactgtccaggaagctaggcttccgggactccattaagctctcaaatcctatcgctgagatgtgaccatagctccaatacgccgttttggcgctactcagccagctggttaccaggtagcccctcaactcgcgtcggcagcggagaacctttccacttaatatgtttccagccttcctcaacgcggcccagttgtcatgaagcttctcggtcagattcatcaacatgccacacgcgcatttgtctgaccactagtttctgcgagtcacttcgggagtgactttttgcaaacaagggaaagcgaagccaacgggaacacatacgagctgtgacacttccatatcttcctccctgggtcaaccgctcccgtgcctgaagattcaactcacttatccaagggttttagcgaggagagagacgcccagaagagtgcactgtgaaaattagtgccatggaagatgggaaccgacaaatgaaacaataagggagagatggtgaaacgaaagaacaaacgt

SEQ ID NO: 1091 - DNA, 4715 bp, Toxoplasma gondii
cgacgtatttttcgcctttgttgtctcacccatgaggtacgcgagtttggcgacgcacgcttcgagggttaagtccttcccgttgatgaccccgaggttggaaagccagacgccgctttcgtaggcgaggaggttggccgagccgcgtcggcactgggtcgtggcgacgatgttgattccgttttcgatcgcggccttaatggtgtcgaggagttccttggtgctgggcgcggtgccggagccgtagagctggaggacgacggcgagggggcgtttcggatcttcgaacacgcgcttcagtcggtcgaccgggaggaacggcgtgatggggacgacggcgacgttcaggcagaactgggtgaagatgcggaatccgcggacgggtggtttgaggaggagttcgtcgtggaggacgacgtcgacgccgacgcatccaagggcagggaagttcggcgactcgaaggcgtcgatccgggagcagtcgactttgctaacgcgggtgccgcgcagcacgcgggagccaaagatcaccaccagttcggtgagttgcgagtagccggccatcatcatagagaccgcgaggtttcgcttcgcgtccgtggagatatgcatcatcggcagcatcgcacccgtcatcaccactggctttcccaggttttcgagcatgaacgagagtgcggcggctgtatatgccatggtgtctgtcccgtggagaaccacgaagccgtcatagtcgccgtaaaaattgtggatctgctgcgccaggagccgccactgcggtaggccgatttcgctgctgtcgaccagtgtatcccactcgagcacgtcgaagtacggcaagttcggatcccgcatttcaggcaagtcctgcagacgctgcgcgagccgtgtcggccgcatcgaagacaactcgccgccgtagtccatgcagatcgtcccgcccgtgataatgatcagaatcagcggcttctgcgggagcaacgtcgtcgtcacacccgaagtccccggagacgacgaagacaaaagcgtcgcggcggtcgcgacactcggatcggtcgccggcgcaaagacgccagtgcccgcggacaaggcgaccgggtcgccaagcaggtgagcgcggcttcccggcgcatgcatcgagttatcggcttctgcgtgcaccttgccagtgtcgctgccggggacgggctttataaccgcgccgtcaaaacgcgagaccggtccagtcgtcccacctgacggactcgctgcagccgaacccgctggcttttcagaagcgttcgccggaaacgaggcaactgctgcatcggtcgcttccgacagatggtgcagctgcttgtcgccggatgtatcggcacctggagccacaacaggagctgcggccggcgagatgtgcaacgcggcaccctcgaagtcgagcgaattctgcgtattggtgcgtttcgacttaatttcttgcatgtccagcccgcagtcggtcacagcagcgctcaggtgcagcggggtgatgtctgcagaaaggcacacgactgtgtggtcgttcacagtcatccgctgcgagaccgagccaaaattggcgggcagcctctcgtgtcgaccgttcaccagctgaagactaccaggaaggcgactctcggtgagatgcggcgcagatgagcacgcacgcaaaacgggggtgctcaaggaggcggcgccagctccggaagccagcacagagtcagacggctgggcgccgccgctctctgcagaaggctcgatagaatgagcaggattcatcgtggaacctgcaaaaaagcaagggggcagtcgaatgaagcaaaagagagaggaacggagtgtcacagggggtggaggcggcaagaaacgcaagggaaacaagaccgaacgatgctgagaagagcgaggaggatggacaaaacgggagcgatgaacggtcactaaacgccagatgcagggagcgagaggacttagaacgaaaaacgggtctgctcttgtagatttcacggaaacggggctacaaagaatcagggtctcttcaaggcggggacaccgtgcacccaagccggcaaaatgcctctggaacgcctacgaaagggagtggcgcgagtctttgaaaaaaccagcacattcccgttttgcgcctcgcctgtccagcaggaaaactttgggaagtggtgacaaaaaaatcgtcgcttcgccacgagacgacagaagctgtttgttgtctcgagcaagcaccagctgtccgggatcccaatcccggcgccagcaggacagcagtcaaggcggccgggaggaaatgaccgagaaaaaacccagttttctgcgtttcgggaggtcacagatgggctcgccaccctcgcgatggcaaatagacactgctgcagttaccctcccgggaaagaaccaaaatctataatgctgcgcgcatgtacgcacttgcgcttgcttgcgcacaacactggttgtctcgcctcgtttcctctgtctcagcgtcgcttgtctggatgaatggaatgtttcgaagagaaagacctagaggaatgggaaaatgaattacagtaagcggatggtaacttgtctgtcggtgttgttttctgtttcttaaggcaggtgacgacaacgcgccgctgcagcggggcccggagtcgtcgggcagattaacggggatggaggtacgcagacatgttgtatatgccagtgccgaaggagcgatgaacggcccttccacctcaacagagttcttctctcctgccttttctgtgccatccgagagtcgtatttctctttaactgaaaaaatcctcgttctacactctgtgctcacgagacagacaccgacgatgcttctgaacagaagcatggctggcggtgatcttctgggacatggcgccaggaacgagcaccattggactcaagcagcacacacaccttcgcgctaggcttctcactcactgaccctcgcgcgtaattcgacaaacaaaacgattcgagacatatcgtcgcttgcaccgtagatcctgtatctccacagatgcagatttgctagcggctacatgcaccagtgtgtattccgcagctttcacaaacgagtatcgcgcgagcgaatccccgttgtagcttgtcagtgacggacatttgtgttttctgcattggtagtattctctcgtcagcatccaattataaaggattttagaggatctgtgcatgactcgcgttctgtgccagcatctgccggcgtagcgacatggcgggtccaagcgattatcggcagccgtttcacaggtagttttcgtttcccgaaaagggcttccatttttctcctcttgcaccgtcgcgaacagattctctgtctagctctttctctcccttccccgtgtggtactgactgcggcgaccccacgcccccccccttcgggacttgcgaacactgccatcacgcgaggacagacacaggctcctgcgttcttattttgcctgcctaacgaagtcatatcacttcccagagagtgtcgagtgaagaaagggaaaacattcggcagttcctactgatacacactagacatcgagatcgcaccacaaatgtatagttgcagtacagtgcacgatcatccataatggctgcctagccgcatgcacatatccagttcaaatagagtaacaatcagtcgtctgcgtatggaaatcccgataaacgtgttcttcagactgactaagaaccacaatgtctgtgtcccgatgctcgttcagacacgagacggcttatattcggagtgctgctatcagatgtggaaatcctgcggacatgcgagtaaacggcccttgatttcgtgtatcatacggtgaagaggcataattgagagcaagtcacgggtaatcttccacattatcttgtttgtgttagtggacgcagggaaagattcattcgcatcacgatgacactgaaagtgtgagccagactggaaacgcgcttcggcgtatataagaagctcgtggcgaggatgaagggcggcgcgagtggtagggttttttctcattacggacatgtgtccagcgtgagagcttccttggagagaaaagcgagggaaggcgcgttttcctctactgcccttgttcctgtttctttgactttccttgtcgcgtccctgtaattttcaccctttggacgaaactcagttgcgaaggcgcgcagccgctgccgactatcggtggagctcttaggttcgccacaccccaaacttgcgtcaagcaaaaacacacaaagttcggccagggacgggaaactcggcttccagtcaacgtccacttttcggcgccgtttcctcgcttttgcctctccccgtctgccgccaccctggagatcggtcgcgtgcctctcccctttttcggcagccccttctcggccacttcccgaaacagaaacctcctttttgtgagaaggcggagctgaccgtttcacgtcttccttcaactcttgtggtctgcgttggctgtgtttctgccactacttttttcgctgcgcaatttggagagactgcgtggacctgtggtacatgcatatcgtgcatgtgttgtggagagccgcacaaaaaacggtgccggcttcctctcgcgttttgtttccggtttttcacctgcgtgtttagccgcgtcaccgctgcgcttcggttctagcgcatctattcctccaggaaccgctttcgaagtcgaccaaga

SEQ ID NO: 1092 - DNA, 2820 bp, Toxoplasma gondii
acgaagaatttgagtgtctagtgcaaaagattcagggtggcactccgaccaattccagtgtatctgtgtgttgttttcgttttacctttccagggtttgattgtggtactttactttttttgtatcgccttccttcaactgttgccggttctcggagtttcactggccgtcacttcgttgattggataccgtgcattgtgccagagccgggcacagcaactgaacgagagcggctttcctgaaaagaagacgttctgaaagcctggcctcgtagataaaatcgatgagacgttttacttgtaggcagagatgtagcggtcgcgtcgccgtcgtggaagctccttcggcgatgtctacatacgcatttgttcgtggagaagctgaatctgtttcgtagacccatgaacaaagcgaactccgccttagctcttcaaaactactaatgcgtccatttatacatatatatatatatatatatatatacaacatgtacatatatgtgtggtatgttatatactgggactgtttgcctcgaattgactatctctaggttttgtgtggtaggttgccttctgcgttttacaacaacgcctttcttgcgcagagaggattcttctctttgcacgaaacattgtcactgccgataatttgccgaggagacggtgggtaatcggccgagtgttccgtccactttggccaaaacgtatccctctcttcctcgcgttcgtgtacttgtgtttttttctccgcggaaatgcctatcctgcatactccagcctagggcgggagtgcgtgctgtctagttttgtcgccaagtaaaccacaagtgggaaaggacacaggcgcagtaatgcctttcccgacacgcttcgaacgagaggagcgtcagcttcccgtaaaatggcctgtttgggagcgccgctggtggttggtcttctgaagacttcaaatttcgctcgcttattttatcaccaacttcttactctctgcggatgccaactgtttatccgcaccagtgttgggtgggcgaccccctttccacttgccagttgtggcgtccgcaccgccgtcaggcaccccagcgagaaatttgacaaaggcgaagtgaccccggcgttgcattttttctgctgcaatctaaactcatttttcgaattgcaggggaaaagaacccgctgtccgccgcatccgaaatcagaaaacaaatccgagatcccgctggagccactgtagtaagacaccccaggtgcgagggtccgtcatggcacacctctctttggcggggttccgtctcccctctctttggcttgctttcgcgcttcgggcgccgaaacggtgcagaacgcttcagagagcaaagccatgagtggccgcagggcatcgcttttttttcagggcttgccagagaacaactcgacaaaacacgagagcggacaccgaacgaacaggggcggcgcttctccaggaaactacttttgttcgcgggttgggggtagcgagagttgccgactgccgtttcccgggtgaatattcataactcgacacggaaaagcatagacaggttgcatcttacatctgacggcgaaccgctattcctaactgaatcttggttagtaactgacacggaagtaatgcgccgacaaggatgaagcaagactcgaccacccgatacggaagtgcgcactgtccatatgcagatggatttggtgatggtctatttacacttcttgccagtaggtatccgatcaaaaaactccaaaagtacttctctagaactgttgctctgttccggtgtgacttctctcgagcttgttggtactaggggcggattgatcacgggaaaaccagtccatgtggttccgcatcccgacgtctttttcagccaacgtcgtgcgcagtctctgtagaccaattctaaacacctaaggattccctgatcggattgttgttggcctggcgcgtgtacagtgcagacaagaccagcgatcggcaacatacgactctttgttctgtcactttttctggaagagaatccttcatgtctgcaaccgacgagcgagctatgtgtctctccctgagtgaagcaccaggggtttcagcagaagaacgcaaaagctgtcaggtagcgtttgtcttcgctgtcgacggggggcggatgccacgcgccggcgaatggcaacggacgagaacagaagccttctccgaccaagtgcgggggcggaaacaggcacgcgccggttttcagggtttaccggatggaacacccaaccggtaccttcccatcccacaggtgaaagtttggggacggtgtctgcgcccgcaccggagtctcgggtcgcccacccacggttcgttgatcgcacagaacttcgatttctgtgtttctgagttcgtgtacaggagcgtagtgtcggcgtctcgaattctacgcacttctcacttggtagacacgtgttccgtgcagtctgtcctcgggttggaaagagtgattctgcgagttccgccactgccgtgtccagctgcatagagttatgcaaatatctccgaacccaatcatgtggaagcccaccggcgtttcagcacagtgtctggggaccggaacaaaggagttgcagctgcagccgaggcaggcctcataaaggcattaagggtacgaggccgaccggtcgctgaacggcagaaattcagttcgttccgtcctcacgtgacaatcacctctgcgtggctctgccaatctgaacgggtacacttcgctgccggaaacacgacactgacttctccgtggagaacgcggcggcgctacgagttccgaactctcta

SEQ ID NO: 1093 - DNA, 1974 bp, Toxoplasma gondii
aaagagttgcagctggctttagttattgaggatatgggtggaggaggggagactacccgcctgcggccagacacactcgttggcagacttcgtggacgaacgccgctggtcacttcacagtctgaacctgtagttattcggctttgtatccatcatgcattttctgatagaatgtactacgttgaggggaatcggcaaacgtacgcaccttttcagatgtatcgggtttaggggaattttagtacgcttcagaacccaaattcaaacaaacatgcacagttttcagacgacaagttttatagtcttcttcagatggtactgctcctggagtttgctggcgtgaatccacggcacacacgtcttcagtacagtctcacgatgccccctcacccgctggacaatgctttcttgtacgctaagtatggttgcccggtactctttttgggcttgggctcgtgttctgcctcttgttcgctccactgcccgaacgatcttcctctcaccagtggcagctgtagctattgccctacagtgagtcagaaggcggttccattgatggcatgatttgttttctcgacggcaaaatatggataaggacgtgatcttttgggttgggtttgctagtctcatccaatactaaactgtctgtttcaaaccgccagtttgtgtgtgtatgtgtgtgcgtgggcaggagaggggggggaggggcggaattcgagcttgatgcattcgacgacacgatcggtttagcactctgcatctggataccaacatttccttctcttggcacggtttctactttgctacgggttccaaggatgcacagtactaccttcgatagcggatcccggtagaactgagatattgatatacatctgcatgttcgcgttgctgaatgcgtggagcagcggagaaatgtgcacaaactggaggagtaaacaacatccagtcgctgtcgagcatcttccccttggaacagttgatgactagaaatgaccttgaggatagtggtggccattgaagtttgcagcgagctgctgaagatgaaaacgcataggcatgttttgttcgggacggatcaagacggatctgatgtgatattcttctgtagcgaccaaaactttcagccctctgaatagataaaaacctcggcatcctggtgtctggttgttgtagggctgtgactgtttcggcaatcgactgcatgcgtgcactcggtgcgccgtgcactggcgtatgcggctggagccgaaaggtgagatctgcctcgttaggatcgcaccgtttttctgcttccaagtttttctgcccggcaagcttgttgattcgatactgaagcaccttcgtgagtgtcgtggcgtaccgtagcgcctctcgctgattttccgctgcagcacgttggcacatctcgacaagatctcatgcagacagaacgccttctgtggaccgacgagcccgcaaaaacatgcgctgcatgtgtagcagtgacttgtgaatttcctagactcaactgcaagaattcagcggtgctgcgactgttctgcttcggcgtaacgatacgggaacctgactgtattttggcccagctatttcacgcgtcggggattaaataccgtgtagatccccctccccctctttgacacagtatgcataattttggaaacaagttgagactttcttttggaccaaacgaattggaatcggttttccccgacaaggtccctgagcggactccatgactttcgtagaggctcacctgcttgcgtcttgcacggcatcgactactccaaaataatatccttaaattgccaggacgataattcatgaccggccagattgacactgtcgaccggctcccgtgtcggaattcaccctcctaaggtggcccacagttccgaccaacttttctgagaaggcaattctgtagctaacatgtagtacctcatccgctggcccttttccaggatctcaaaa

SEQ ID NO: 1094 - DNA, 2370 bp, Toxoplasma gondii
acgcttggacaggtgcttaagtatttatgtcggagttttcaagttgactcgcggtttcccttcaccgcggattccaccctgacctcgacgtgtttcccttacaattgcagcggtttcatcgagcttggtgacgagcatgtcgacgtcccgctcttcgttttgaggccactcctggatgtagggacctgctttgtagatgccctcgcggagcaaggcctgcatctgccccaaaggtccacttgggtcgacttccaagcgccgccccgccatggtcgtttccgccgtcagaggtgcggggtagataggatcggctggcgcaggcagaggcgccgcagaatcgccgtttgagaagggggaaaagccggtggccgggttcgagggaaacgaaggaaactgagggctgtcaggggaacccgccgacgtgccaggggtggcgagtccatcggacgcaactagccgtccatcggactcagagacggatccaagcttggacgaagagagcggggtcacagaaagcatcgggcggccgcctacgttgaagagaggaagccgctgagaaagggaggcgccactgagagaagtcctggagggtaaccctgtgtggacgaaagacgacagacctgcgcgtggcgcttgcagagagcaacgagacagagaacgcgaagcagtggacagactgggcgcgagaaaacactggaactggtcagacagagcggcaggcgacggtacgatcggaattctgacaccgttttcgacgcacgccggcggacaagtgtgcgcgggagagcggctgctgctcgaaatcgacagagcgctggaagcgtccggtgtatgcacacccgagggaaagaagcaacgcaggcaccccaggggctgtccaggcttggtggacccctgcacacgaggataaatttgcagaatgccgccggtactgtgcgaggcagggcgcgacctcaagagcgaaggagaggaatgcgtcacgtgggaaacagcaagcacgagcactcccatggaaacccagaaagtcggcaggagaagcccggcctgaaccgttcgcgggttccagacctccgcgatccggagtgccatggcaggaacgagggaaccgcggaccggagaagtggcgtggatcttggggaaaggcggcaatcaaagccacgaaaaagcggaggaaattgaagttggcgaggatacttctcgaccccgtgaatcctccggcgttgccatggactcaaaaacgctgtggacgccgggcacaggttgctgagacggagctttcagctatccagagaagactctattttgttcctgaggttgccattaacaccgccgagtcttcctcacgaaaactcgcctccgtacctgtgaaatcatacgccaaactacgtgtttcgggcgcaggactgttcaggagacatcgagacgggaattcagcgcgtaggggctttgcgtcgcgtgggagacagcacagaaacccgactcgcgaaacgggagaagaaccgcaccacataaacgaccgctgtccagacgcgaatgctccgggaagtgcaatttctcactgtaatgaagcaaaaaggtgtacatactcgacatgtgtttcccgcgttctacatcgacttgcgcatgttcagaagacatgccgctcgatcacgcgccctggagagcctccgttgttgccacaggcatgccttgtacacgtcgtcatgaaacacaacttttgcacggtttttcctcgggttgtcccttgtcaccctttcctctttctcctttttttcccaacttcccttatccgatcctctgcatcgcgtctgtttcgcacgtccgcatttccagcgcctttttcttgcacatccgagtttcattgttccgttttcagaccgtgaaaccaagtcagcttatcatctccttgtcttgcttctgactctcaaatcggcttttcacatccaacgttgcacctagggcataaacctgttttccgttcaattcttcacaaactacagacgaggaccttcctgcaaaatgaatcaccgcgcgacgcctgcgtcaccatctgccttgcacctctgataaccggtcttgaaactgctttcttttcttgagaaaagtgctttgcaactcaccgctttagccgccgcactcagctgctgactcgaatctcagaacaagctggggtcaagtggtggccgagtgacctgggcagatgaacgacgccggtgtctgtcgaaggagttactcaaattctttgcttttctcagcatccgggaccctttcgaaggcccaccttgtctacgacgtttttttcactcgaaagggtcaagagagagagttcttttctttgtcagtttctcccgtttccacttttccgcaaaa

SEQ ID NO: 1095 - DNA, 3911 bp, Toxoplasma gondii
tgtcttcgtcgtctgaatcgggtgcctcggtttccaaatcaggaacctgctctgtcttcgtctggggactggcggcagcagagagctgcgccgacgggtcttcgccacgatcatcgcacgctgggtgagagacagctcgagagagcgatgaggcgggagacgagacagcgggcttgctgaaacgagtggccggacttgatgtttcgcgatcgtttgccgcgtcgtctttctgctgccgatcttcttgggtcgttgaacccggcgcaggcgaaggcagagaggaccgtgaagggccttcttcccgctcggtggaggcaaacttcggtgtttcgcagtgggagttttccgctcgggtctcttcgcaaagcgacaaggggggttgagcgggagagcatgcgtggaacggagacaaaatcagctgatactcctcatcgtcaatcatcacttcctcttcttcactgccgcttgcgtagggctcggaaatctgggcgcttgccgcagaagccacactgcccaccgccgccatgtcttggcggagtctctcagctcgcgcacccgctccaaaagaatggagaggacgcgaattccctacaaactcctccggaacgtaatccattgtgccttttgtggaagagtgagaaaagtgataactgggtagtcgaccgcgcaggcggcggtcgattccctgacggaaaatcgtgaagcgagagccgactgctacgcccgatgtcggcaacacggatacgtttaaaatgagacatctaaaaatccggaaacaacgaacctgaaaagaccggcctgtctggtacaggagttaaagagaagcaaggtgtaccagggtaggcataattgaaaggagagggagaggctgacaccctcataagctcgctaaaacgacacgatacaaccttattctttttcaagtgtaacgctctccggtgctgaaggccttcatttacaaaagtacaagagtagctcattcagaaggtttggtagcgaaaagtgtcgagttcgaggctgagtgctaaagaattgcgtcactctcggagaaggaagacgaaaacgctatggcttcaaactgatttattacacatatccataagcgaagaggctgtctgaaagcaattggaaatatttggacgcggagatccggttgtgcgcagcgcgctcgagacgcacaagaagacaaacgacaagtagaaaagctgtcggggaaacgaagagcttcgaagtctcttgctggtaaattcgaaaatacatagacacataagatacgataagtttaatgtgtttttctccctgcgaggaggtcccgaaagtggtaaccctccaggctacgagcggggttgatgaagttcacaggtttggccacagtgaatcctagcggaattgggcacaagtgcatcccatcaatttcgagttcaacaaagaatgagtctcagttggttcctcgcctttgaaagttgaggagcctgaacccgaaacctgggcattccctcaagaaagaaagaggtttcctcggggcttggtcccgtgttttcgacagtgaaatggcgtatggagtggggctggagacgctcacatgcgtatgttgaagtgtcaaggacatggacccacagcctctgatgaatgcacgcagaaaaagttgcctgcgatgagaactttcaatgaccgtctactgagagtggaactgtgtcctcagcattgaggtccggttttctccaccctgactccggggtccagatcgctgcgacacgtttgctcgaaaataagtgaaatcccacacgttgcggtcagatatgtcgttgaagaaataacaatcatgcagtgacggcgcacacaaaagcaaaagtagaagattagtcagaggccggcgacctgctgccctccaacggcgatccgaggctagcagaggggaaaatgtgttggcggtggcttttagagcaggcgcccacacgcaaatgagtcacggtaaacggaaagagagtagggaaggcgctagacgaaaaataacacttgtaaacgacgaaagttcagtaacaaaaagcgagacgtgggcatgagcccgcccaaatttttctgtccactgcagttccgccacaagacacgcgaggtcgcaagacggcacccggctgctttcggcagagcaagaggttgtgaaaacgaaaagtagacagtgttgctctacccgaatccaaacacaaacaaacttcttcattgataatattaaactttacgaactcaaaaccatgccattgagaagtctgacacagatctgcgtggaaagacaccagggaagtcaacgatgggaccctgcttttgcagcgtgggaccgtcggcagttaagggtttgagaaatgtcgagccaattcaacagtcaatagatggccagaaagtgcagcttacactcgtgtctgttgatcagttgcattgtaaccgtgggaccagagcaatgcgtctgggttctaagaacaggaaatgtcaaattcgagcaaaggctcgcgacaaccgccacggtttgaaagtctatttcaaaaaacaccaaacgcaagcctggttgagttcgtcgagatgataaggagatgctattcatgttttggtttctgtaaaagtgagcagacccagagagggtcaattgccatgccgaccatggtcacaagcggtgaatctgcctacctgtctgttgaagtgtacgtgtaatacgtagagagctttcatcacgagttgagggtgcaaacaacaggcggtaagatgaagcaaacgactaccgtcatcgggagttttcgtcaagatcagaagatgtcaaccgatgagcccccttcagcacagcagctacgactggaacgagcagtttcctgatatggctacgttgcaaagctccctttgccaacaagcatgttaaactgaacccacccgactgaattgtttgtttctaaaccaagcatgctccgctctactgttgtcaatccgctgcagaatttatagcaggccgcgtcgagtctcttcaacaccgcgtttcgtcgtggcggcggtgtccggaatcgcatcattcgtcaatgagttttttgtggggtttctcgacaccaccgtagttaacctagctttgtctctcactcctcggaccttcgtgtcaagaactccacttctcgtcttgtacaggcgacggcggctggcaccgcgtcagacgaccgataccgatagagtatgctttatcgcagctgatactactttaggaatggactcaaaacctttcttcgaacgaaaatgaaagccactgatccgtgtgtctttggtcgtcattctacatttagtttaaagtctccttgttaatcaagtagagaaacaccggactgtgcttcataaaggccgcaacagagtgaatgagttgcacggaatcaggcgcactacttcagacgaaaattaccgtgctaaaacataaatctcatttaatagttggggttgagcgggtgttatatcaggaaataatagacaagaactgcgaaactatcggacggatcccgacaccggaacctcgtctacgctgacgaccttgctcgaggagtaaaccctgcacgcgacgataagagcctgatctgcctgtgcaatcgatcagtctctcctttggtggaatttccctgcgtttttctacttttgagatatactttctgttaatacctttggttttgttcgacaacggaagccacctaccgagtgtgacgattgtattcgaagacaccgtccagtaattcgaccaccacaaatttgtaaatgaggcttctggagcgcgaccgtctgattttcggtgttttttcgttaccttgtaactgttcatgaactgtggatgtatttttgaatcggacgttttttgtggccaccggtaaaacaatgttttttctcgtttcgtatcgcaa

SEQ ID NO: 1096 - DNA, 2073 bp, Toxoplasma gondii
aagcagctgcacacagcacagcagacactgacagccatgttgaatcggcgagagaaaggaaagagagaaacgcgagagaagagaaggagaagagggagaaaggagggagagaagacagcaagaagagaaatggaagagaaaggagagaaaagagagagaaaaaaacgcgccataaagagatgcacatctagggagggacagagaaggaaaggcagtgcgagggagagagatggaaggagagttgaagattcgtctgcccctgcactccatccctctctttgcatttctcgtgaagccaggattttccaactgtcgcgatgtcttctcgggtttccttccccgactttttttccaccttctcccgccttccaagtcgcgagttgtctggccacccgcgagcgcgagctccgaggcgaagggaactctcgctcctctttcttctcttttttttggcgacgtcttcacgaagaccagtccgacctgctggctttgccggcgtcgcgctgccactggaggaccgggtcgaggatccagaggagaatgcggctgattagaatgagagaggaagcaaggaaaagcagaaggagaagaagaaggagaagaagaagaaggcagtcacgcggatagccaccgacatgcccggtcgagagacacaagcccaagaggcggtcggcaaagtccaggaagaacagagtagccgaggcctccattgcgaagaaaagacagcgcgagggggaaggcgtagcagaacggggagagccgcgggaacagccgaagtggagaagcgaggataccgccttcttgagactcgaaggcacacaaagcagaacgcagcagcaagcgaaccgaaggcgccctccccccgtcttcaaggtttctctttcgcttggcaggaaaaggctgtgcagcgaccacggtaaagaggcgcaaacaggaaagctgagactgcgaagccgagaaagtggagcggagaggagagccaatggagaagctccgcgagggcagagggaaacgagaacggagagagagtgccccggagcatacacacagagagaggactcgagacacaaggtgaggaaaaaagaggagccccagagaaaaaaggaaagaagaaacggaaaggcgaacgactccgtgacaagttctgtcggcgccctcgcatgcgcgtagctcaccacgctgtcagttcaccaaacctcacaagaaacatgtcggagggggcaagatctgtctcggtctgtctcctgcaaattcttgtccttcttcttctgtcaatcgatccgtttcctgctcggctttttcttctcgagtgcgttcgtctctctttgcctcggatggcgcgtctggagccgctgctgtccgccggggaaaagaagccgccagagctcccgctactactgtctctcggtctctttcttgttcccccgggtgttgcctctctgtccctctctttctcttttctcgctctttctctttcctcgcttcttctctgttctcgctcttttgttcgctctctctgtcttttctcgcttcctttctcttgttctctgtcttgctctctccctcgcactcgcgctgagttcgctgtcttgctctcgttctcgttctcgggtctccgtcgcttcagcatccggtgttcctcgaacatctgagcactcgactcgtctgtcgcgccatcaacgcgacaggcagactggcctcttctctcctctctctttctcttcgccgtccatggcagcaggtgactgtcacgacggaaaggaagaggggaagagacggcgttttctctcggcagcgccgcctctcaggaggcagagagtctctccaagaaggtaggacgcggtcacaacgctccgtccagatccagcttcggttctccagcgttgcgtcgggggtctcttcgccgctccagcgtcctcttcttcggattcgcagagctccctctttctttctttccttctttccttctttctggcgtcgatttccagccgtctggttgcaaagaaagagcgagaatcggtgaaacctacctagtcgcgtcgaagtgaacatctggccgaccgtccgttctcg

SEQ ID NO: 1097 - DNA, 2809 bp, Toxoplasma gondii
agagatgtctgttgtcgcattgccgtttgcttccgcacatgtctccgcttgccgttgctggtgcaagacttgtgaagacaggttatttgacttttaaagaagagtttgtcgcctttggagggtcccgaccgactcctcgcttgccagaaacatgccgaccttcacgcccgaggccgctgctctggttgtgttggagaaaaagagttccgtggaaagggtgtccagtttctttatcacgcgtctgcaagacggcgaaagctgactctcaacggcagcagtgttgagctctgtgttgccgcagtctgcccgtagtttcctcacaggtccggcgtgtcttcggagactgcgtcgctctccagcgaaagaagtggaaactggactcgcctactctactaacatttatagcgaaaacacagaacgttcttgattcgcctgactcagagcatttgtttcgaattcagcagcgggaaggacaactggctctagatgctgcacatcctcctatgtcgaacaggaaaaactgaactcgctgaattttgagctaaatttcgacgccgctctctgaggcagctgtccccacaggcgactctgctttctgatgagaccagagacagtgacagaacggggtcttttctgctgtgggaaagggaagtgacttctcttccttccgtctcctgtgtgagagaacagagcttctcccgtgcgggactctctctgcggcttccctgtcaagaaacaggagccttccctctcgcctgggtccctctgctgcccttttctgagaaaaagaagaggcaacacacacaggcgctgctgagggtccgtgcagcaaaatcgacttgtcttttgctgacgagaaacatttgagacggaaggctcgcgacttggggaacgtggacagccgtagccggggccggcgccgcacgaagagtgccgcgagaaacacagaccaaggcaatgcacagagcggacggaagagtcgaggaagcaggagataacgaagttctgactggggatagaacaaaggacggtaaggtgcacgaatgaaacgtcgacgccacagtgtctggcaaaagaaagagaaaagaggaaaggagggcgagttctagaagccgagaagggacaggagcgactctccgcaagaagagaaagacgcaagacgctaagaaatgtctagagtcttcacagatggaaattctgcgggttaaaacgggcatgtaggcagtgagacgcagatcctgcagaacgggctttcgactttcttcacttccgttattcccggaagaagagactctcgaggcgaaagggaacagacgagacagcgagagagacacctgccagcacaaagagacaagagagcaccgccgtcacgaaccgcagagaaacctcacacgtagtgagacgaaaatgtgagagcgcagcagaccgactaaagatgaagagacgggatgtaagcgaggacctgaggaaaaacgagagatgcttttctttctgcgagagagcagatcgaggaaaagcagggcgaaggacgaccggggcctccagggtcccgcgaaacaacgtctaatcttctttcagcaattgtttctccgtcgccgtcgcccttgctgcctcagatccttcttcctgttcagtgtactctgattcctttgtgtttctacaggcaatgcctttctctttcttggcgtcgatctgcgatgctgtctggcttgtctctgtcagtttcacctaggtagcgtacacctacacgggaggaaagaaaggaaggtagaagagaagattttctgcctctctgccgcaaagtacgcatgtgaacgagaaaagacaacagatgagtctctctccctgttttcaaaagacgtaaattagcggaaggactctacggttctgctcgctcgccgatctcctcgagtttgccaagtcttaaggttcgccgtcttcgttctcgccgttgaaacacgctgcttttctttattgctttatcgtgagagtcaaagaagaccgagaactcaccacgtgaaactccttgatagctgttacaactgcccgctggaaaaaaatgcagaagaagaacctgctggcaagacacgcggtgtctccactatggggcggggtgtacagatatgctcgagactgcagcgctcgcgacagtcgcggcttctggtcgagttctttttcgcgcgaagaatttctctttttctctcgaaagaagtggtgacgagttcggttctcgcacccgaagatcgcgaatcctcccgcaagtccgtccagaaaacgttttccatcgttgcttctcgctgtttcgcgacgacaaatcggccacagcccgtgttcggcctcggcaggttgactgctgggaggaaccagtccggagaagaatttgaaataggcaggaaatggaagcgaaggagataaaccatcgagagaacgcggggacccgagagcgaagcgtgagccgaagatgtgcgcggagaaaacgctgaaaagttcctcccgtctccgtctcctcctcaccgcccagcttcccgacagagaccgatagtgtggaacaacaaacgacccgagagcgaggagaaaacggaggaagagaagtgaagagaaaaggatgacagaaggtaatgcagcaggcgcagagcagagacgaacgcggagatcgtgaaagaggtccggaaactcgcagtgaggcggttcttgttgaccacgaggcgtggaacgaaaagagacaaggaagacaatcgggagaggataggaaggaagaaacaagacagcggaagggattcgagggtgacaagaaaggaaacgacagaga

SEQ ID NO: 1098 - DNA, 3614 bp, Toxoplasma gondii
ccatcttcgacttgcttctctcccttatcgctgaggatcgtcattcgttcgcgcttgcccggacggatgcctgaaggaacgggagcacccttcgccagcgaagctctcgtcgggtgtatctcccctggagatgggtgttcttgcagaagagtgcggtttcggctttccgcgattgtgtcgctttcggaactgtcgtcatcgtggatcacctcaacgcctgagatgggttccgaggaacggaaggaggcgtctgcgttgtccatccgaggcgtctgactatcggagtcatcgtccccactcatcgcgtcgcctcccgctgtcccgacagctgaagaggcggcaagagtgccatcggttctcttcgcatcagttctgccacaggttttttgtggcttcgcagccgctttctggttttcctgtgaatagggcgaaacggaagaaggcaagtttcccgaagccggaaagacgcccgacgacacggaggcaggtccactcgggtccttacatagttctgtcttggctgtctcgagcaacttgtccagcagtcggcgcctcaggcgaacgatgtgggggtgagaccgcccaagaaacatgaggaacgaatctgtgtctacatcctttggtgacagtcctgagcatgcggttcgcccgtcctcgtcattgcgctgccgcacatacgcctccagctgtctcttgacagcccctaagtgtcgcgagaacgccattctcccaaagccattgaccagaagaatctcatcagcaaagtctcgctctttattgggacacgcggaaacgcagttgccaccgagaaccgagtaatttgtgatcgctgttcaccaccccactggactgcttaagacagctgaaaatggcgggcatcactatacagtagcagtgaccgtattcgaagtcgattaagttgtaggcgaaatatatacgggtttctggtatcattcgtattaactccgacggcaatacgcaaccatggaacgagacggaaccctgagacagaacgacgaggcacaaaaggggaaacgtgtcacgggcaaaagacaggggaaacacgtcgcggtacgaatgggatcaaagacgtagaaacaaagggaacgaagaagaaagctggagactggctcaacaaattgaccaagacggagacgtcgaccggaagtacaatcgaagcagcggaaatgatgacgcatgaggagaggaaaggatggagatgacaagaaaccctcgcgtaggcgaaatggaaaactacgcctccggtagacgcgtagaaaacgagtctagatgaagaaggcagtatgtttagcggagaaagtaaggaaagaaagacaatacgcatctggaagagactgaaactacgagaaaagtcgcgaagaccaccagcgagtctccgcacggacccttgtgtacattgtgagaagaaactgcgcatggaacgactgacagaatttcattggcttctttcttcccttcttctttttgccttccgtcgcctgcctattctccggtggtggagggcagaatcactccaaattcgctaaacgcgaacggcgctgtgtggggtttccccttcactcggggtaggtatctgggacagagaactctcctgtgcgaaggaaacaccacgagctagcggaccaaaacggaaattttggagccgacgagaactaaattccgtctcacccagacggctttgggagtcatgtttcaaaataaacccacaaacttcgaatctttcccgctacctgtctgcatctttcgcggaactgctttggacagttgaaagtgttagcttcgattttccaaagatgtcaacatccgaagacaccactatcctgagatatcaccattatagtcctaatatcctttgatatctatatgcgcggatttcagtttcttgagacttcagtatcgtccgatagcaatatgctgagaatcagtattctaaggtagaaaaggaaattggctttgttctaggcgtaattgatggtttactgatgcatttcgtaggaatcgtgagataactgtgcagaatgaggtgcaacagagcagagaagtgtaggttcgtaacccgttgcgcccactgaagctagctggagtctcgacatgttgcaagcgaaactacgtaggggtggacgactggattccctccttaacttcgttatgtgtcatttccgcaaagctgtgtctttttctcgctgctctgcccatctgatattccgaagaaagcgatctcaaacgctgtggtgcagaggaacgtccagcgtgtggatatcagcttactcaacaaggaaactgcgtacacagagtcaaccccttgacagccaacggatctcgcagctttgggtcaccgacaaaaactaggaagttgagtcgcggcaccacgaaggctctgcgtgtgtttgtctgtagtgatttcccttaagttggcagttgtggtagaaagccgatctgccgttgtgaagcattacgaaaggccggaaagatcgattttcttgtgcgtgtagtatctgtcgcgttgacaggaaagaacacaccacatcctgccaatgaacacaaatattttttgttgctcttgggaggaacaccaatgcaaccgtgaccatgtgcattgagctcgtacctttatgaggccctccacgccagcatcctattgactgaaaccggtttgtctctttgtgctacactgaccctcgcagaacgcccctgttcatgtcgagatatctaaagaaagaggaaaggcaacaagttctcctcttgtccgaaacgaataatttgtggcgttttccaggcaaacaggcacgtgtcagatactgtgcccctggcgctgttcacccttgcgctagcgtagttgcagttcgtggtgtagcggtgaggggagacggggccaagtaggcatgtttcctgaggtgttcgttccgtgtgtatatcggcacccacgaggaagaaggtaacagcggcagacgttgtctttccccttcaaaccaatctaggcagacactcctgaatcggtcccggccggcctatttgttacgcggcttcctctcacaagaggacacagtcagccgcggcccaggataagacacataccatacaacactgggccatccccaactttcctcgtctctgagaggaaggcactgtctgcgtttcctagtcgatcgtcacacggtagtgtgcaaggtggaatgacgatttctggaaaactgacagtttttcacgcacctttcctggcaggactttccatcgtcaacatgcctggttgcgaggtgaagacttctgtgttgctgtctgttttatcgccagcgatcgacggcctggagcagtggaagtgtttatgacgcagaagacgaataagttccccgagattgatcatcacacgcattccacgaagtgccaaattccatctctagcaatcccttagaagaataccgtacgaattgtgtgtgatgagagccgacccgggacgcgctcacttctgtgtttgagtcaacttgctactgtgcaacacagtctgtcgaacaccatcctacagctgccgtggtaacacacgaagagtgtggaggtaaatcgtgtgctgttcggatacttcacgggtagaaaagcca

SEQ ID NO: 1099 - DNA, 1849 bp, Toxoplasma gondii
gaaaacgacgcagaacaggaagagccgcgagacgcatgaagacgaccagcgtctcggcgacgcgcagagccgcgcggctcgacttccctttttgcctgggttctgtgttccagaagaagagagtccgagaggagagagccgccgagctgcagcagagttgcgggatctgctcgacgaaagagctcgcacgcggcggcgtttcttctccggaggtgtgcctcccgccatgtcatctggttttttctggaaggacgttctcgcgccctccattgccggtgtcagctcctctgctcggagagacaagcggggacgaggttttcttctcgctcttgtcctcttcccactcgacagacggcgacgcatgcgaaggaggccgaaggactcgaactcctcccggcacaggagatgacgtctactgtttccttctgcagacgctacggcgcagcagatgcctccggcagaacgtgtatccttttcaccgcctcgacgaatcttttggagctccgcgaggtgacgggtgcaacaagtggagagaggcgagaagcatgaagacgacagcgaggtgccagcgtcaaagcgcgaagcagaaatcgacgagaaggcgaacgcggagcagagacgatgcttcttcgctgcaacctgcctcgactccaccttacgcccaccacgcttctgtcgcgagggcgcatgcgtcagaaaagccggaatgaactgtgagagagacaggcaagagagaggaggagagccaacgccctccatcgctcggtgtgagcggcctgttgctccttccccacatgaagacgaacgagcagcgaagaaggcgcttgacaaaacggtatgggcgaagatccgagaagtcgaaaagaattcgtggtgcctcgcgtctcgtctcccccgcttccctgggcttccccgtctctctccactcgcggaaccagacagccgcgccttcgccaggtgtacacacactcagcgagtgtagacccgcaggaaagagcgcggaaaagtgtgtctttccgctgcgctccaagtggagatggagaccggcccaggaaaagtgagggaagccgggaactacgcttctcgtggcggtggccgctcggagagactgtgtcgatttcctctcgtcccccgacaggtctcctcgccaagttacacggaagcctcacagttcatgcagaaaaaggagacagagttgaaaccgggcgcgcaaagtccgcgtgtaaaaggtcgacgaactcgattcacgggtgccagctgcgcccggctttgctgctgaacactgcgtgtgcgtacatctgacaggtcttccagagaacctacgaggccgtcgagaaaaagacaagtcgaaacattttcagagcaagttcctcttcgctcgagaaccgaggcggaagactgcatgcacacctgagcagatgcctcgacagaaaagttatctcgtgccgcgctgtacgcgaaaccggggctcactgaaggagatcgattcgcgtcgtccagcaagaaggcgtggaaagaaaactgtgacgaagaactgacgaatcgaggacagcttccccgaagacggaaatgggaggcgcaggggtacacacatgaaatacaacggcgatccccgggaagagtcggggtttgctccctccgtccgcaccggaaaaaagctgatattatctacgaacatactcaggagagacgtttagcgggagaaaggaaacgcagagatgctctatttagaaaacggactgtaaatggcgaggtagaagccgcttttctgtagctcggcgcacggtcggtgggagcagctttgctaggaacccccagcgctgtctcggcgtccgcgtcttcgaaaaga

SEQ ID NO: 1100 - DNA, 1218 bp, Toxoplasma gondii
gaatagaacgatgcgctaatctcttccaggaaagtcaatgacaccgtaagcgtcagcagaaatgcccaggacgatgaagtcatagtctcgttcgcggcagaaaagacgccgggaaagataaggaaagtgacacatccacgtttcggctggagaacgggacagccgaaggttgaacccatgttgaagcagagagaaagcctgttgaaaggcactggcctaaacttggagattgtggaagaaatagataaatgtttcacaagggaagcctgcaacgagtgaccccgccatgtgagaggacaacagggccgacgtacgtcagaagaaagctgtagatgcaaaggcatcgaggtaatcggaacactaaatacgggaatgcggccgactgtgtcaactgatggcgatccaatatgcatgcattcttccttctgttgtactgcagccccgatacatgcaccacggtagacctattgtgaaccacagcgtatctgcataagcttctgttttccttctttacaacgttcgtatgctataacaaatgttccacagaaagtctgcttctctccctcgttatcagagctgacgcatgtgtttcatccacagtgtagtaggtagagggagcgaaatttgctatgatgcgtgtgggatcatgaactgttcgataatatatttatgtgtcggagaagccttgcacggacactgacattccactgcgtgtttcaagctgtcggacacgaattgagcgaacgggccttgaagttgaggcgattccaccccagccattgagtcctaccttgttgtgcgcctacttgcttaaagcatcgaaatatcattccataattcagccttgtcttgtcctggcatgcagaacacgctccgcacgcggtatgctgatttgcatgtgtggcagcgaaagagagcatgcatgcaattttttttctcgtatttcccgcatgctacatgtcgttcaccagcaaacctcacaacgagctacactgtaacaactacacagccgccggacttagtggtgtttgttttgttttgcaccacaaacgtcggttttcccgtcatttttatggtggtgtgaaatcttcctgaaggcactactctgtccgccagtagctgttcgaaaaggggccccacagtgcggcgtgcagaacggcgataaagttaggtaccttgttgatcgtcatacaggtgaaagacagaagaaccacaaaa

SEQ ID NO: 1101 - DNA, 2374 bp, Toxoplasma gondii
gatctcacgttcctgcaacgggaaagccaacgcgatttgtcttgaagaaggcaggacgcctctctcgcgaactacgcacctatattagcaggggcgtttttacatgtgtttttgcgagtcgactctcccgtgacccctcgcctcaacctcgattcagttgttccaggacgtcaaacacgacatcgcggatccagctcaggcttcccctcgttctaggaagaatgctgcgctctcgtactcttggctagactcgcatccacagccagtatctgtcaccgagctcccagagtatgggcacacacaaccacgggagccccccaagacggaaatttcctaagagccactcgtaagaagactgatcgagttcagtacgatagacacttcgcagctgttactaacaaaggatgaaaaggaacttagggcgcggcggcgcagttccttcggcagccatcccagtgctccgccttccctcgggcactaaaaggaacaaagtgtcattgctcgcaccctgtttagccggttaccctcgtcttcagggaacgcctgcaccaagtcgccaaggacgatgatgaaagccggattctgtcgctttatcgcatcaagtccgcagcgtagcctgccgatctcttcagcccactcggcattcttcttcagcatgccgagctacgaaggaaaaggagacgagaacgaacagagttaatgcgcatggcgaagaagtgcacacagaagcggcaggtggatgctgcttttctcggtcgtggtgtctacggtgcttcgaacaagcgcctatccagcacgggcagagactgaaaataggacagttgggccgctctccagtttcaggatatgaaccggagagcatcagttctagatgggtatttaggggggcaagtgatcgccgttatctctttagaatgtctctataacgaaacacgtttaaaattgcctggaagcagatatccatgatgggtcctgaaaactagtacagcctgcaaaaaactcacttgggggtcggcaatgatgccgaatgagacgactctatcagaggtttctgccttttctgtcgcaccgtgatcgtctgcgagagcagagcctccaccacttggcggttgccactgccgtacacacactttaacgattcccatgaagacgaactccggaacacaaggaaaacaaacttggtggtcgacagaaaagtcggattcgatgcgaaacagctcgttccgccctcgaaggcacagtgtgtccgattctgaagaaagtacgcgagtgtcggggggtatatttgagactaaaagagagaccgagaggtgaagagacggaatttcgcctcgcgtctcaaatgggctgcatgctttgggtgccagtgccaaacacgacagtggcgtccgctgaatcgtaggagcgcccaacactccaaaacgaggccatctcagcaaaattgcaatgtattcagcaacacgtagcataccatttcgaggctggaaactgcctcacaattaccgaatttgcatcggctttagatggctactccaaactaccagaggcatgcacctgttctcagagtcgagggcaggaccctcgtctagagccaaacagagcgaacgaaagtgttcccactgtcgaaaatgacggaaaatcgcccagttttttaacacttaccgcagagcagctatgcaagtgaacccgtccctgcattgctcggtttcctctcgattttgcgacgtcaactcagtccctgagtaacggaggatcgcgttggaactcttcagtcgctgatacctggcggtcgtcgcgctttctagttccgttcgtgttaattcatgacctggaggtaaaaggtgttgttaacggattatctgctgtgtaagagcatgaaaggctggaaatatgttgtctcatctgggactctatgtacatcggatatgttgtggcgtggctggtgttcgagtgtggtaagtgtgtccgtgcattgaaattgtactttctgtcaggaagagatggaaactttttccgcagaagtacttctgcattgttaattgctggaaaggtgtacacgagtttgggacgcggtctttttttcttgctgtcggagttcttgctcggatgctggaggatgtcttctgcgcggagacacccagtacggggttcagcgacttttcccgtggcacctgaagtgccagcattggatgccgcttctggcacgttcaactagaagcggagacacgacgtggaagatcgctgccgtgatttgtcctgggtgccgcgtttcgtgtatttttcgtgcgtcgcttagcacggatttcgttcctgcctttgcacggtccgcctctgctcccccgttcgcctcaccagacggaagtttttcaaaaga

SEQ ID NO: 1102 - DNA, 2217 bp, Toxoplasma gondii
gaggtcaggagcggcacttggaaagacagtgagtgtccgcgtttttttggaagcagtcctctaagagtagaagtctctttccgcctgtggtgtggcatttgcaggaacggtcccatgggcatgagcgagtatgcgcctttcgcagctggcacacaggaagtcgctagagccctcgctgaaatcactcgacgcgggggtacgacagttgtcggtggaggtgactctgtggcggcaatagaaaggttgggtctctccaatgaattttcgcatgtctctacgggaggcggtgcatcgcttgaactgcttgagggcaagacactgccaggtgttgcggcgctttcagacgaagaagagacgccttgacagagtgcgcggcgagctgtgcgttagagtagaaaaggacgcatgtagagaggtatagagtgcaacatctgcagcgaaggtatatcagcaaggaccgcgggcaaacggcgtacgtgcgtccgcgtggagcaaacagcagcgcgccctctccgatttcccgttggtcgattttattaagagcccgcgggtcgtcacggttagacgaagccaccgttttaatttttctcgctaaagcgactgaggtccgtttgtgcaagtgatccggactgcagactgggaataaaggggtcctgcctagtcgcaaaccggatggcatgtgatttaggttttcatattaataaaccctacacccgaagcagtcgggtctagatgacggtacaaccgtttgtttcatttgaaaaactgttggtttctgccgccgattgacacggggagaacccagtttttgtgccaaaaactattcgcaagttcctatcccagtcgacgaatggcgaagagcgctccagcagccgttgaaacagcacactgaaggaattcctcaaaaagagagcagaatggaactttctgaaaacacagttgtgccacggtaggggcgtctattccaaccccctagtggagtgcgaccgcaaagtgttcttgaacccctgaaaaaaatcggtatgtaaaattttcttggcgcagggtccgaagttggccttcgccatccgtgcatatcagaaggcggagtgagacgccaatcatcatccatccattgactacctttcgaggcaggactcgttgaccagttaacattcgggtattcaacgccctaaagctctgttgcctttttaggaaagaggtatgttagagactcagaccaccgtaagtgcggctgcagatattcccgaaagccaaacccatgttcattacgcaacctggcattgctaagagactgaggaaggtccaaactaccacgtgactttgtttcgacttctagcgtcccagttctaaacaaaatgagaaacgtgaaagaacacaggattcccatagtcatgaataagtctgcgaccgaaccagcccaatatgtaacaagccaaaacggagatggattaaaggtgcggaaaacagtctacctcgttaatctataaatggcagcaaatgaccgcatgcagtccttagtcgagcgtccatcgcgattgctgtaatttcgcagttcaggggtgttgtgataccgtagagctgcatttcgtccaaactttgaattggatacgtttgaacgataacttattacacaccatggcagcaaagatgagctaacatataacttctttcacggtactcaaaagagctttcacgccatgtacactgcttgtagagtgtcaataagtcgattccgggcataccgtgtattttacgggtgtgtcctatttctaaatgcatctgacaatttgggctgtagatggcgtactcttgacaaatcaaagccactttcccctctacaacatcggtaagcttttcttttgtcttccatccggaaatattccccgtgcactaagtaaaagcttcttacaaatgagctgacgttcatgcaagtgcttttcaaagcgtcttgatagcgtgacttcggcatttggtgtgcgccaaatgcggaaacgcgggaggcaagagaacctcgtctgagcaccgagaaagaataaatcttctactagaagtgagtatcactcttctttttgctacacgacaaacgtagcttgttcagcactgtcatgaccgttttcgagccttcttctggaacagaagagttaacggctttttcagtgtggtcgaacttccctgacgaccgtcaattcacctcttataaatattgcattcgta

SEQ ID NO: 1103 - DNA, 682 bp, Toxoplasma gondii
tcgcttagtcagcttcgcgagagctctgtggatgtcgtcgatttgttgctgttctcctgcgtcagcctgcctcaaggcgcctcgccctgccgcgacggaagaaggcgcctcgctcgcagtctcccgataccggcttcgctgcgctcctcccggagccttagcgcaggcggaggaggaagtcgccggagccaccgaagaaggggaccgagaagaggaagcggcgagggacgcggacaggccttgatcttctccgggcgctgaggacgcagtggaggcttgcgcaaaatgcgcaaaaatcgccgcgagctgcgttgcacctcctggggctccagggtccacagaaggagacagcgaggagacgagctgagcagcacgagcgctcgacgccgcttcgcctcggagttgacgcttcagctgcttcccagtcagctgcttgcctcgagaggccgaggttgccggaaccttctcgttgggcgccattccggaattaccgggcaagtccgttgagaagtggaaaacaacgcggagtgaaggaggtgaaccgaagcatggactggatggagtagggactagagagggaagtcgacggggactctctctgcgagggagacaggtggagagggaagtcgacggggacggggactctctctgcgacgaagacaggtggagaggcgcgagtgca

SEQ ID NO: 1104 - DNA, 3836 bp, Toxoplasma gondii
aatggatcgtcgtcgcggcttcacttcggagtccaaaggcgtctcccgtgataccaaagagccccgcgcagcgacgggtttcggcgatgctgagggcggctgcgggaggaagaatgaggacttctttcacctggaaagatttcgagaaccacttgtcggaaaacgcgccaatcacacaaaaactcgccggagaggacgccgcagctcgagcggccgccgcctcgacttccctgcctgcagccctggcggcggcactcaaaacctcgaggagacgaagggcgacatggcgctgacgtttcttcacggatctccggagagatgacgagctggaacgggaccaagacatcgattgctgactctgggttcttcgcgcctctcgagtgtgctcaaaaacgcttgtcgctagctgaagggggactcccaccgtatagacagcagctgagaggagctgttcccacgcctctttccgaagtctgaggccaccgcaggtcggacacggcggaccgaagaactggtcggttccggagtgagaaagtgacaaacctgggatcgttgacgcctgaggagaaaacggcttttccagagttctctcgctttctatcgcacaacaagggtcttcggtgacacggcttcgacttcccctgaagttgccagagtccccacctctctcggtcgcctcaccctcgccctcggcattccccaagggcacctccgcgacattctcatcgaggctgtgggcggaagatgtcggaatgattttatgtgctttggatcgttcgccactgccggacaccccgtgctccccagttgcggggctctccgaggccacgaaaaaacaactttgactgcgacggtgcttcaaaatccgcccgtggctcgcactgcgctcctcgttggcggaaccggtggcgctgaccgatacaagcgaagctgaggaagcaaggcggctcgcggcgcaactttcagaggtgttgcagacgcagaggtagactggctcttctccctcgccctcaaaaaacggaagaaggtagagatgctctctccccgatcgatcgtagtaggcgggtctcaccctacccccggctgcggctgccacaaaaaggaaacggagagccgtgaggagcgggggggccgacgggtcgcaaagaagctggaagatggggtccgagccggagaggggagacggctgcgaccgcgctaaagggaagagccgtcgagacacgacgagtgcgacgggaagagggatcgaaggcggactcagagttgcgggggaaaacgaaggaaggaagtgaagtagctcctcgactggggacgtaggtgtgccgtcgtctgtctctgcgtactcggcgccgagctccgcttttccgtccaaacgccaccggtgagaccagtgtctccggatacagcacgtggacacaacgctccatgcagaggaaaacatcgtgtgtttttgggaacgcgacagaaagtcagatgaccgtgcccaagaaaagggcaaaaagggggtcaccggcgcataggagagcaaggaggagggaagtcacgaagaaacaaaggggacggtggagagaccgtgtctctgtacaactggtctgcgatcccagactgtagaactcaaatcgagcagacacatactttgccacccggaaaatccaggcggccacaaacccggaaaaagcggaaaacgacgcgctgaggacggatgtgcgtgcactgggggcggacgggagtgcacaaaggaactcaggggatcaaggagggtgccaggagtggtcggtttacgcgaaaactcacggagtgctggagaagggtgtgaagcaacgggtggggtttcggtcagtcgaggatgaacgctgcggcaccattcacttggtggaaaacgcagaggaagactgcgggtgtgacaccggatacaaagcgaaattccgcaaactcctatcatcacgccattggtttattttcgaggttcgacagagtccccacgagaccacgccaccagccagcacccacaacagcgaacacccagagggctggcaaaaaagcacgtggctttctgctttggggctggagatgcaaaagggaaagaaaagcgaaggccattgtagtgcagcggatacatagtatctctggcctatatgacggatggatcttgcgttgtcaaacagaggcgcaaaaggaacgtagcaccggtgtagagaggaaacctgcgaagcgacatctttgctctacgttctttcagagactcggcccctgaaatgcacaccaagttcccactttcgtgcccacgagaatgaggaggaaaacacaaagatgtcaaaaggcacctcctgacactgtcctacagagcgtcgttaacgaagtcgcttctccattttgcagcattttccgctgtcgtcatcgcatataccactctgacgtttccgcgaccgagaaagcgatttgttgtggaaggcacaggcttccgcgggaacgctgtgcttttacttgaggtgtttgcccttgtttgcctccttgtttctttgatcggctcctcaagcgcctcagaaagtagaacgctcccggctgcctcctcacacatgcaaactcagagatatgtcttaacacacgggaatttgctttgctttcctagcaagtgtgagaaggcaagcgatgccgcaccaacttgttggctagtctcgtcaccacgggctggactggctgttgcagcctcgctgcaaaaaaaaacatgcatccagaacgaggtgttgtgcttcccgaagaagaaatatttttaggagaaacgttacgcgcgcctgaggccaaagaaagaaaaggcggcgctgaaatacatgcttaaggaacccaccaagctgcgaagaacgtgcagatttggaacgacggagacaacatgcgcatggtgacatcgactcgcccttaacaggacacagcacgttcttcgaagctgcacgcagacggctgcgtcgtccaccacgagtagaaagagtctcggagtgctttccttcatgctgactagacacactttcaacttcgtaatttgtagacgatgccgtggaaatgcaacttcttgtcacggttcggtcaaaagtttcctgtagtacaaccgtcgtgtcgttagccagagttgctgccttgactttcgtcggccgcgcaaccgggcctttgaaacttgagcccactttgccgtgcccggttattttcttgcgttttgacttcagtttgacttcttttctacactttctcaacgaattagttcctttctgtcccgtcctcagagagagagacctctacatggcgagctaggcaggacacccgttcaatatgtcccgcaaggcacgagccacggaacccaacagtcaaaaccagtatgcgtttcgtgtcgcaacccggctgcatttctcgtctatcgtttcaattttccaaacacccatgttcgttttttccggcttgggggtcgttcaaacataacttgaagtacggcaagtcagtcgccgacccctatgcctagcgcctgagagcgaggggctgaatcatggcgcgaaacttcaagtctggtgttgccgttttccagagatttttccgagacacagtagcacgcgattagatagtttttattcaagctagctctctccagggtgcgacgcgattttcatcgatgcgtcggtcacctgattcgagcctcgtgagctgcctcgagtccgccgttcaacgagccccgtgaaattcgttgctttcttagtcgaccttgtcgctgtggaagcttttgaatgcatttcatgccttcgcatgagtcttttacttgctcatttgcctctcatgttgatttcctgtcggcaaaa

SEQ ID NO: 1105 - DNA, 1832 bp, Toxoplasma gondii
actttgcaatcagcaggtttatgatgaaagaggcgcacgcgggagacgaatagtggcgtttgccattcagaaataaacccttcttcacgtgcatccagaagagcacataacttattcgtggcgcaaacagcaccgggctaaacggatcctgtcattagtgaattaatatggccaccctcagtggggcgccggaacatggccatcgacgtaaaagttccgcgttatctgcggaagacgaatctttgcgttattcagatcgggcgtgacatgaatttgacacccaagtcgtgagctgcagaaacacccagcagcaccatcccagtagctaagaccaattttgagctgtatttccttgacacgagccgaaactcaatcccaacagaaccatcctggtttagctatttgctctgcaaacggggctcgaaatcgcgtagtatagtctatttcacatcttacgttggggtcaggcacgctgccaggtcaagcatgtcttcctcttgctccgacggctctggcagctcatcgtagacctccggttccagaatgacgtggcacgttgagcacgagcaggctccttcacaggcacctgggggcgaacacgtccagacaccatgatgctatgattgtcagctatacttttgtctgtccagaactcctggacccgcgtactgcgattgcttaccttcaagttcaatgttgttcgcgtgagcaacttccaggatggtgtctccaaccttggcctcaacagtcttttctgtattgtcgggaagtacgaaagaaattgtgctgagaagagcagcacagcacgccttatcatatcagcaactgcgcattctgtcagaggacccaaacatttcccgtgagccacgtatctcaaagcagtgtttcttcatttgagtcgctttccgcctgccacgctccactccatagctataaaataaaggcgaaatcaccacttgcacaggattccaaaagctcctagctgctagaaaaaacctacacagtttgcgacgatgacttttcataagctggagacgcagcattcgaggctacatggaaggctcgctgagagaattgccgccaggtacacggttgagaggaggcaaaaggagaaaaacgcgcatgccagatttcagctattctttcccgttgcagttcgctaaagtatcttctgcagctgaaccgcgccgctttgagcgctccgacgcacggacggagtaccattggagctcgaccgcattgaagaattgggggcacaactttgctgacacgcaagctcaaaaaaaatcgacgaaaggcaccatgaatgagtgaaacactgcatatgaaactcgcgaatgacacagttgtgtagcatcgtcaaagaccggcccaaacgctgttcttctgcccggctgaacagcgcacaggccgcatacccgatgccgagagtttaccccaggctcacttcagaaggaagcatggccagatttctgaaaagtggactgcacaactgtaaaggcttgacttaattattgatcaaaggtaaaaaataccgagatcctacttgcgagcgtacagtctaccgtagaatgtgtgaagccaagggagctgaacgtcgtcgagtgcttctgcatgcgacaagtacatgcagcgaaacagtgaaaatgcgcggccgcttactgtgcaagacgcctttttcagccctagtttctgatgcatttggcgtgtgtcgctatccatattttcctcgtggcctttatcgttcgaaggtgactcagtcggaggggcgcgctgcagttgttcacacgccattgcctcttcacatttctgcaacgaaccccgagtctgca

(The sequence listing continues in the following parts.)

What is claimed is:

1. A method of administering a protein-of-interest into a central nervous system of a subject, the method comprising: administering to the subject a *Toxoplasma* transformed with a nucleic acid construct comprising a heterologous polynucleotide comprising a first nucleic acid sequence encoding a *Toxoplasma* secreted protein in frame fused upstream to a second nucleic acid sequence encoding a pharmaceutical polypeptide, wherein said heterologous polynucleotide is operably linked to a promoter for directing transcription of said heterologous polynucleotide in a *Toxoplasma*, wherein said promoter is selected from the group consisting of: a constitutive promoter, an inducible promoter, a latent period-specific promoter, and a *Toxoplasma* endogenous promoter with the proviso that said promoter is not a Toxofilin promoter, wherein said *toxoplasma* secreted protein is secreted to a host cell, and wherein said *toxoplasma* secreted protein is selected from the group consisting of a rhoptry secreted protein, a microneme protein, a dense granule protein and a *Toxoplasma gondii* macrophage migration inhibitory factor (TgMIF), and wherein said dense granule protein is selected from the group consisting of GRA16 and GRA24, thereby administering the protein-of-interest to the central nervous system of the subject.

2. A method of treating a subject in need thereof, comprising administering to the subject a *Toxoplasma* transformed with a nucleic acid construct comprising a heterologous polynucleotide comprising a first nucleic acid sequence encoding a *Toxoplasma* secreted protein in frame fused upstream to a second nucleic acid sequence encoding a pharmaceutical polypeptide, wherein said heterologous polynucleotide is operably linked to a promoter for directing transcription of said heterologous polynucleotide in a *Toxoplasma*, wherein said promoter is selected from the group consisting of: a constitutive promoter, an inducible promoter, a latent period-specific promoter, and a *Toxoplasma* endogenous promoter with the proviso that said promoter is not a Toxofilin promoter, wherein said *toxoplasma* secreted protein is secreted to a host cell, wherein said *toxoplasma* secreted protein is selected from the group consisting of a rhoptry secreted protein, a microneme protein, a dense granule protein and a *Toxoplasma gondii* macrophage migration inhibitory factor (TgMIF), and wherein said dense granule protein is selected from the group consisting of GRA16 and GRA24, wherein the *toxoplasma* being devoid of virulence genes which are not necessary for delivery of the protein-of-interest into a central nervous system (CNS) of a subject, and wherein said subject is diagnosed with a pathology treatable by administration of said pharmaceutical polypeptide in a central nervous system of the subject, thereby treating the subject in need thereof.

3. A method of treating a subject in need thereof, comprising administering to the subject a *Toxoplasma* comprising a nucleic acid construct which comprises a heterologous polynucleotide comprising a first nucleic acid sequence encoding a *Toxoplasma* secreted protein in frame fused upstream to a second nucleic acid sequence encoding a pharmaceutical polypeptide, wherein said heterologous polynucleotide is operably linked to a promoter for directing transcription of said heterologous polynucleotide in a *Toxoplasma*, wherein said *toxoplasma* secreted protein is selected from the group consisting of a rhoptry secreted protein, a microneme protein, a dense granule protein and a *Toxoplasma gondii* macrophage migration inhibitory factor (TgMIF), and wherein said dense granule protein is selected from the group consisting of GRA16 and GRA24, and wherein said subject is diagnosed with a pathology treatable by administration of said pharmaceutical polypeptide in a central nervous system of the subject, thereby treating the subject in need thereof.

4. A method of administering a polypeptide-of-interest to a subject, comprising administering to the subject a *Toxoplasma* comprising a nucleic acid construct which comprises a heterologous polynucleotide comprising a first nucleic acid sequence encoding a *Toxoplasma* secreted protein in frame fused upstream to a second nucleic acid sequence encoding the polypeptide-of-interest, wherein said heterologous polynucleotide is operably linked to a promoter for directing transcription of said heterologous polynucleotide in a *Toxoplasma*, wherein said promoter is selected from the group consisting of: a constitutive promoter, an inducible promoter, a latent period-specific promoter, and a *Toxoplasma* endogenous promoter with the proviso that said promoter is not a toxofilin promoter, and wherein said *toxoplasma* secreted protein is selected from the group consisting of a rhoptry secreted protein, a microneme protein, a dense granule protein and a *Toxoplasma gondii* macrophage migration inhibitory factor (TgMIF), and wherein said dense granule protein is selected from the group consisting of GRA16 and GRA24, thereby administering the polypeptide-of-interest to the subject.

5. The method of claim 1, further comprising administering to the subject an immunosuppression drug prior to administration of said *Toxoplasma* and/or subsequent to administration of said *Toxoplasma* and/or concomitantly with administration of said *Toxoplasma* to the subject.

6. The method of claim 1, wherein said pharmaceutical polypeptide comprises a wild type amino acid sequence corresponding to said endogenous protein capable of treating the pathology.

7. The method of claim 1, wherein said pharmaceutical polypeptide comprises an antibody capable of treating the pathology.

8. The method of claim 1, wherein said pharmaceutical polypeptide comprises a toxin capable of treating the pathology.

9. The method of claim 1, further comprising administering to the subject a drug capable of inducing a self-destruction element.

10. The method of claim 1, wherein said *toxoplasma* persists in said infect host cell.

11. The method of claim 1, wherein said *Toxoplasma* secreted protein is secreted continuously.

12. The method of claim 1, wherein said pharmaceutical polypeptide reaches a nucleus of a host cell.

13. The method of claim 1, wherein said *Toxoplasma* secreted protein is selected from the group consisting of a microneme protein and a dense granule protein.

14. A method of administering a protein-of-interest into a central nervous system of a subject, the method comprising:
    administering to the subject a *Toxoplasma* transformed with a nucleic acid construct comprising a heterologous polynucleotide comprising a first nucleic acid sequence encoding a *Toxoplasma* secreted protein in frame fused upstream to a second nucleic acid sequence encoding a pharmaceutical polypeptide, wherein said heterologous polynucleotide is operably linked to a promoter for directing transcription of said heterologous polynucleotide in a *Toxoplasma*, wherein said promoter is selected from the group consisting of: a constitutive promoter, an inducible promoter, a latent period-specific promoter, and a *Toxoplasma* endogenous promoter with the proviso that said promoter is not a Toxofilin promoter, wherein said *toxoplasma* secreted protein is secreted to a host cell, wherein said *Toxoplasma* secreted protein is secreted from a dense granule of said *Toxoplasma* and is selected from the group consisting of GRA16 and GRA24, thereby administering the protein-of-interest to the central nervous system of the subject.

15. The method of claim 1, with the proviso that said nucleic acid construct does not comprise a Cre-recombinase coding sequence.

16. The method of claim 1, further comprises at least one in frame cleavage site which allows detachment of said pharmaceutical polypeptide from said *Toxoplasma* secreted protein.

17. The method of claim 1, wherein said *Toxoplasma* is comprised in a pharmaceutical composition which further comprises a pharmaceutically acceptable carrier.

18. The method of claim 2, wherein said pathology is characterized by a deficient endogenous protein in a central nervous system of a subject.

* * * * *

UNITED STATES PATENT AND TRADEMARK OFFICE
CERTIFICATE OF CORRECTION

PATENT NO. : 11,260,081 B2
APPLICATION NO. : 16/313060
DATED : March 1, 2022
INVENTOR(S) : Oded Rechavi et al.

It is certified that error appears in the above-identified patent and that said Letters Patent is hereby corrected as shown below:

On the Title Page

Item (73) Assignees:
"The University Court of the University of Glasgow"

Should be changed to:
--The University Court of the University of Glasgow--

Signed and Sealed this
Twenty-second Day of November, 2022

Katherine Kelly Vidal
*Director of the United States Patent and Trademark Office*